(12) United States Patent
Franklin et al.

(10) Patent No.: US 9,518,277 B2
(45) Date of Patent: Dec. 13, 2016

(54) **GENETICALLY ENGINEERED MICROBIAL STRAINS INCLUDING *CHLORELLA PROTOTHECOIDES* LIPID PATHWAY GENES**

(71) Applicant: TerraVia Holdings, Inc., South San Francisco, CA (US)

(72) Inventors: Scott Franklin, La Jolla, CA (US); Shane Brubaker, El Cerrito, CA (US); George N. Rudenko, Mountain View, CA (US); Riyaz Bhat, South San Francisco, CA (US); Matthew Shoa-Azar, San Mateo, CA (US); Aravind Somanchi, Redwood City, CA (US); Aren Ewing, South San Francisco, CA (US)

(73) Assignee: TerraVia Holdings, Inc., South San Francisco, CA (US)

(*) Notice: Subject to any disclaimer, the term of this patent is extended or adjusted under 35 U.S.C. 154(b) by 231 days.

(21) Appl. No.: 14/099,704

(22) Filed: Dec. 6, 2013

(65) Prior Publication Data

US 2014/0178950 A1   Jun. 26, 2014

Related U.S. Application Data

(60) Provisional application No. 61/734,613, filed on Dec. 7, 2012, provisional application No. 61/902,705, filed on Nov. 11, 2013.

(51) Int. Cl.
| | |
|---|---|
| *C12P 7/64* | (2006.01) |
| *C12N 15/52* | (2006.01) |
| *C07H 21/00* | (2006.01) |
| *C12N 1/13* | (2006.01) |
| *C12N 1/15* | (2006.01) |
| *C12N 1/21* | (2006.01) |
| *C12N 9/10* | (2006.01) |

(52) U.S. Cl.
CPC ............. *C12P 7/6463* (2013.01); *C12N 15/52* (2013.01)

(58) Field of Classification Search
CPC ................................ C12N 15/52; C12P 7/6463
See application file for complete search history.

(56) References Cited

U.S. PATENT DOCUMENTS

| | | | |
|---|---|---|---|
| 4,945,050 | A | 7/1990 | Sanford et al. |
| 5,900,370 | A | 5/1999 | Running |
| 6,395,965 | B1 | 5/2002 | Xia |
| 7,135,290 | B2 | 11/2006 | Dillon |
| 8,187,860 | B2 | 5/2012 | Franklin et al. |
| 8,258,109 | B2 | 9/2012 | Bennett et al. |
| 8,791,088 | B2 | 7/2014 | Bennett et al. |
| 8,951,308 | B2 | 2/2015 | Ellis et al. |
| 2004/0236091 | A1 | 11/2004 | Chicz et al. |
| 2009/0203093 | A1 | 8/2009 | Steinbuchel et al. |
| 2009/0211150 | A1 | 8/2009 | Wu et al. |
| 2010/0021912 | A1 | 1/2010 | Farese et al. |
| 2010/0151112 | A1 | 6/2010 | Franklin et al. |
| 2011/0015417 | A1* | 1/2011 | Trimbur ............... C10L 1/026  554/127 |
| 2011/0020889 | A1 | 1/2011 | Feldman et al. |
| 2011/0293785 | A1 | 12/2011 | Franklin et al. |
| 2011/0294174 | A1 | 12/2011 | Franklin et al. |
| 2012/0028319 | A1 | 2/2012 | Trimbur et al. |
| 2013/0197247 | A1 | 8/2013 | Franklin et al. |
| 2013/0280793 | A1 | 10/2013 | Brown et al. |
| 2013/0323780 | A1 | 12/2013 | Schneider et al. |

FOREIGN PATENT DOCUMENTS

| | | |
|---|---|---|
| WO | WO 2008/151149 A2 | 12/2008 |
| WO | WO 2009/105927 A1 | 9/2009 |
| WO | WO 2009/126843 A2 | 10/2009 |
| WO | WO 2010/045368 A2 | 4/2010 |
| WO | WO 2010/063031 A2 | 6/2010 |
| WO | WO 2010/063032 A2 | 6/2010 |
| WO | WO 2010/120939 A2 | 10/2010 |
| WO | WO 2010/147642 A1 | 12/2010 |
| WO | WO 2011/008565 A1 | 1/2011 |
| WO | WO 2011/150410 A2 | 12/2011 |
| WO | WO 2011/150411 A1 | 12/2011 |
| WO | WO 2012/106560 A1 | 8/2012 |
| WO | WO 2013/056212 A2 | 4/2013 |
| WO | WO 2013/082186 A2 | 6/2013 |
| WO | WO 2013/158938 A1 | 10/2013 |
| WO | WO 2014/089514 A1 | 6/2014 |

OTHER PUBLICATIONS

Branden et al., Introduction to Protein Structure, Garland Publishing Inc., New York, p. 247, 1991.*
Seffernick et al., J. Bacteriol. 183(8):2405-2410, 2001.*
Witkowski et al., Biochemistry 38:11643-11650, 1999.*
Sadowski et al., Current Opinion in Structural Biology 19:357-362, 2009.*
Branch, A., TIBS 23:45-50, 1998; A good antisense molecule is hard to find.*
US Office Action, dated Jul. 30, 2015, issued in U.S. Appl. No. 13/688,025.
PCT Invitation to Pay Additional Fees and, Where Applicable, Protest Fee dated Apr. 12, 2013 issued in PCT/US2012/066893.
PCT International Search Report and Written Opinion dated Jul. 19, 2013 issued in PCT/US2012/066893.
PCT International Preliminary Report on Patentability dated Jun. 12, 2014 issued in PCT/US2012/066893.

(Continued)

*Primary Examiner* — Delia Ramirez
(74) *Attorney, Agent, or Firm* — Emily M. Haliday; Weaver Austin Villeneuve & Sampson LLP

(57) ABSTRACT

Genetically engineered microbial, e.g., *Chlorella protothecoides*, cells producing microbial oils are useful as a food additive and a source of renewable fuels and industrial chemicals. Lipid biosynthesis genes for *Auxenochlorella protethecoides* are disclosed that are useful for increasing lipid production and altering fatty acid and triacylglycerol profiles in recombinant microrganisms including cells of the genus *Auxenochlorella* or *Prototheca*.

10 Claims, No Drawings

(56) References Cited

OTHER PUBLICATIONS

Database Geneseq [Online] Aug. 5, 2010 "P. moriforims fatty acyl-ACP thioesterase-1 cDNA, SEQ:134.", retrieved from EBI accession No. GSN :AYC84244 Database accession No. AYC84244 sequence.
Database EMBL [Online] Sep. 17, 2010 "Chlorella variabilis hypothetical protein," retrieved from EBI accession No. EMBL:EFN58098 sequence, One page.
Chinese First Office Action dated Jul. 9, 2015 issued in CN 201280068060.6.
European Office Action dated Jul. 3, 2015 issued in EP 12 799 433.3.
European Office Action dated Sep. 10, 2015 issued in EP 12 799 433.3.
Mexican Office Action dated Jun. 30, 2014 issued in MX/a/2014/006357.
PCT International Search Report and Written Opinion dated Mar. 24, 2014 issued in PCT/US2013/073718.
Mexican Office Action dated Sep. 2, 2014 issued in MX/a/2014/006357.
PCT International Preliminary Report on Patentability and Written Opinion dated Jun. 18, 2015 issued in PCT/US2013/073718.
Abe et al., (2008) "Expression of Exogenous Genes Under the Control of Endogenous *HSP70* and *CAB* Promoters in the *Closterium peracerosum—strigosum—littorale* complex," *Plant Cell Physiology*, 49(4):625-632.
Abe et al., (2011) "Stable Nuclear Transformation of the *Closterium peracerosum—strigosum—littorale* Complex," *Plant & Cell Physiology*, 52(9):1676-1685.
Ando et al., (Sep. 2009) "Establishment of *Agrobacterium tumefaciens*—Mediated Transformation of an Oleaginous Fungus, *Mortierella alpina* 1S-4, and Its Application for Eicosapentaenoic Acid Producer Breeding," *Applied and Environmental Biology*, 75(17):5529-5535.
Apt et al., (1996) "Stable nuclear transformation of the diatom *Phaeodactylum tricornutum*," *Molecular and General Genetics*, 252:572-579.
Armbrust et al., (Oct. 1, 2004) "The Genome of the Diatom *Thalassiosira Pseudonana*: Ecology, Evolution, and Metabolism," *Science*, 306(5693):79-86.
Boyle et al., (May 4, 2012) "Three Acyltransferases and Nitrogen-responsive Regulator Are Implicated in Nitrogen Starvation-induced Triacylglycerol Accumulation in *Chlamydomonas*," *The Journal of Biological Chemistry*, 287(19):15811-15825.
Brown, L.M., (1982) "Production of axenic cultures of algae by an osmotic method," *Phycologia*, 21(3):408-410.
Cerutti et al., (Jan. 1997) "A Eubacterial Gene Conferring Spectinomycin Resistance on *Chlamydomonas reinhardtii*: Integration Into the Nuclear Genome and Gene Expression," *Genetics*,145(1):97-110.
Chen et al., (1988) "Recognition of prokaryotic transcription terminators by spinach chloroplast RNA polymerase," *Nucleic Acids Research*,16(17):8411-8431.
Chen et al., (2001) "Highly efficient expression of rabbit neutrophil peptide-1 gene in *Chlorella ellipsoidea* cells," *Current Genetics*, 39(5):365-370.
Cho et al., (2007) "Optimum temperature and salinity conditions for growth of green algae *Chlorella ellipsoidea* and *Nannochloris oculata*," *Fisheries Science*, 73(5):1050-1056.
Chow et al., (1999) "Electrotransformation of *Chlorella vulgaris*," *Plant Cell Reports*, 18:778-780.
Courchesne, Noémie Manuelle Dorval el al., (2009) "Enhancement of lipid production using biochemical, genetic and transcription factor engineering approaches," *Journal of Biotechnology*, 141(1):31-41.
Davidi, Lital, et al., (Published online Jan. 10, 2012) "Characterization of major lipid droplet proteins front Dunaliella," Department of Biological Chemistry, The Weizmann Institute of Science, Rehovot 76100, Israel, *Springer*, 15pp.
Dawson et al., (1997) "Stable Transformation of *Chlorella*: Rescue of Nitrate Reductase-Deficient Mutants with the Nitrate Reductase Gene," *Current Microbiol.*, 35(6):356-362.
Deng et al., (Feb. 4, 2011) "The effects of nutritional restriction on neutral lipid accumulation in *Chlamydomonas* and *Chlorella*," *African Journal of Microbiology Research*, 5(3):260-270.
El-Sheekh et al., (1999) "Stable transformation of the intact cells of *Chlorella kessleri* with high velocity microprojectiles," *Biologia Plantarium*, 42:(2):209-216.
Ewing et al., (2014) "16S and 23S Plastid RDNA Phylogenies of *Prototheca* Species and Their Auxanographic Phenotypes," *J Phycol.*,50(4):765-769, Epub Jul. 10, 2014.
Ewing et al., (2013) "Whole genome sequencing and phylogeny for members of the microalgae genus *Prototheca*," Abstract and Poster presented on Nov. 12, 2013 at the *Functional and Comparative Genomics & Pharmacogenomics Conference in Chicago*, 2pp.
Fromm et al., (Sep. 1985) "Expression of genes transferred into monocot and dicot plant cells by electroporation," *Proc. Natl. Acad. Sci. USA*, 82:5824 5828.
Gao et al. (Jul. 10, 2014) "Oil accumulation mechanisms of the oleaginous microalga *Chlorella protothecoides* revealed through its genome, transcriptomes, and proteomes," *BMC Genomics*, 15:582, 14pp.
Hallmann et al., (Nov. 1994) "Reporter genes and highly regulated promoters as tools for transformation experiments in *Volvox carteri*," *Proc. Natl. Acad. Sci. USA*, 91:11562-11566.
Hawkins et al., (1999) "Expression of Human Growth Hormone by the Eukaryotic Alga, *Chlorella*," *Current Microbiology*, 38:335-341.
Hickenbottom, S.L., et al., (Jul. 2004) "Structure of a Lipid Droplet Protein: The PAT Family Member TIP47," *Structure*, 12:1199-1207.
Holder et al., (Sep. 2011) "Comparative and Functional Genomics of *Rhodococcus opacus* PD630 for Biofuels Development," *PLOS Genetics*, 7(9):e1002219, 18pp.
Huang et al. (2006) "Expression of mercuric reductase from *Bacillus megaterium* MB1 in eukaryotic microalga *Chlorella* sp. DT: an approach for mercury phytoremediation," *Appl. Microbiol. Biotechnol.* 72:197-205.
Iglesias-Prieto et al., (Nov. 1992) "Photosynthetic response to elevated temperature in the symbiotic dinoflagellate *Symbiodinium microadriaticum* in culture," *Proceedings of the National Academy of Sciences*, 89(21):10302-10305.
Jakobiak et al. (Dec. 2004) "The Bacterial Paromomycin Resistance Gene, *aphH*, as a Dominant Selectable Marker in *Volvox carteri*," *Protist*,155(4):381-393.
Jarvis et al. (1991) "Transient expression of firefly luciferase in protoplasts of the green alga *Chlorella ellipsoidea*," *Current Genetics*, 19:317-321.
Kalscheuer et al., (1999) "Establishment of a gene transfer system for *Rhodococcus opacus* PD630 based on electroporation and its application for recombinant biosynthesis of poly(3-hydroxyalkanoic acids)," *Applied and Environmental Microbiology*, 52:508-515.
Kang et al., (2004) "Genetic diversity in chlorella viruses flanking *kcv*, a gene that encodes a potassium ion channel protein," *Virology*, 326(1):150-159.
Kawasaki et al., (2004) "Immediate early genes expressed in chlorovirus infections," *Virology*, 318(1):214-223.
Kilian et al., (Dec. 27, 2011) "High-efficiency homologous recombination in the oil-producing alga *Nannochloropsis* sp.," *Proceedings of the National Academy of Sciences*, 108(52):21265-21269.
Kim et al., (2002) Stable Integration and Functional Expression of Flounder Growth Hormone Gene in Transformed Microalga, *Chlorella ellipsoidea, Mar. Biotechnol.*, 4(1):63-73.
Kobayashi et al., (Mar. 1993) "Enhanced Carotenoid Biosynthesis by Oxidative Stress in Enhanced Carotenoid Biosynthesis by Oxidative Stress in Acetate-Induced Cyst Cells of a Green Unicellular Alga, *Haematococcus pluvialis*," *Applied and Environmental Microbiology*, 59(3):867-873.
Lerche et al., (2009) "Stable nuclear transformation of Gonium pectorale," *BMC Biotechnology*, 9(64):21pp.

(56) References Cited

OTHER PUBLICATIONS

Levitan et al., (Apr. 26, 2005) "Dual targeting of the protein disulfide isomerase RB60 to the chloroplast and the endoplasmic reticulum," *Proc. Natl. Acad. Sci. USA*,102(17):6225-6230.

Low, K.L., et al., (Jul. 2010) "Lipid Droplet-associated Proteins Are Involved in the Biosynthesis and Hydrolysis of Triacylglycerol in *Mycobacterium bovis* Bacillus Calmette-Guérin," *The Journal of Biological Chemistry*, 285(28):21662-21670.

Lumbreras et al., (1998) "Efficient foreign gene expression in *Chlamydomonas reinhardtii* mediated by an endogenous intron," *Plant Journal*, 14(4):441-447.

Mackenzie et al., (Nov. 2000) "Isolation and Use of a Homologous Histone H4 Promoter and a Ribosomal DNA Region in a Transformation Vector for the Oil-Producing Fungus *Mortierella alpina*," *Applied and Environmental Microbiology*, 66(11):4655-4661.

Merchant et al., (Oct. 12, 2007) "The *Chlamydomonas* Genome Reveals the Evolution of Key Animal and Plant Functions," *Science*, 318(5848):245-250.

Mitra et al., (Oct. 14, 1994) "A Chlorella Virus Gene Promoter Functions as a Strong Promoter Both in Plants and Bacteria," *Biochemical Biophysical Research Communication*, 204(1):187-194.

Mitra et al., (Oct. 1994) "The *Chlorella* virus adenine methyltransferase gene promoter is a strong promoter in plants," *Plant Mol. Biol.*, 26(1):85-93.

Moellering, E.R., et al., (Jan. 1, 2010) "RNA Interference Silencing of a Major Lipid Droplet Protein Affects Lipid Droplet Size in *Chlamydomonas reinhardtii*", *Eukaryotic Cell*, 9(1):97-106.

Peled et al. (2011) "Isolation of a Novel Oil Globule Protein from the Green Alga *Haematococcus pluvialis* (Chlorophyceae)," *Lipids*, 46(9):851-861.

Pignede et al., (Aug. 2000) "Autocloning and Amplification of *LIP2* in *Yarrowia lipolytica*," *Applied and Environmental Biology*, 66(8):3283-3289.

Pore, (Oct. 1973) "Selective Medium for the Isolation of *Prototheca*," *App. Microbiology*, 26(4):648-649.

Poulsen et al., (2005) "A new molecular tool for transgenic diatoms Control of mRNA and protein biosynthesis by an inducible promoter-terminator cassette," *FEBS Journal*, 272:3413-3423.

Prochnik et al., (Jul. 9, 2010) "Genomic Analysis of Organismal Complexity in the Multicellular Green Alga *Volvox carteri*," *Science*, 329:223-226.

Pröschold et al., (Aug. 2005) "Portrait of a species: *Chlamydomonas reinhardtii*," *Genetics*,170:1601-1610.

Radakovits et al., (Apr. 2010) "Genetic Engineering of Algae for Enhanced Biofuel Production," *Eukaryotic Cell*, 9(4):486-501.

Radakovits et al., (Feb. 21, 2012) "Draft genome sequence and genetic transformation of the oleaginous alga *Nannochloropsis gaditana*," *Nature Communications*, 3:686 Article No. 10.1038, 10 pages.

Robenek et al., (2011) "Topography of Lipid Droplet-Associated Proteins: Insights from Freeze-Fracture Replica Immunogold Labeling," *Journal of Lipids*, vol. 2011, Article ID 409371, 10 pages.

Rosenberg, Julian N. et al., (2008) "A green light for engineered algae: redirecting metabolism to fuel a biotechnology revolution," *Current Opinion in Biotechnology*, 19(5):430-436.

Sanford, (Dec. 1988) "The biolistic process," *Trends in Biotech.* 6:299-302.

Schultz et al., (Apr. 2005) "A common core of secondary structure of the internal transcribed spacer 2 (ITS2) throughout the Eukaryota," *RNA*, 11(4):361-364.

Sekimoto et al., (2003) "Expressed Sequence Tags from the *Closterium peracerosum-strigosum-littorale* complex, a Unicellular Charophycean Alga, in the Sexual Reproduction Process," *DNA Research*, 10(4):147-153.

Steinbrenner et al., (Dec. 2006) "Transformation of the Green Alga *Haematococcus pluvialis* with a Phytoene Desaturase for Accelerated Astaxanthin Biosynthesis," *Applied and Environmental Microbiology*, 72(12):7477-7484.

Tan et al., (Aug. 2005) "Establishment of a Micro-Particle Bombardment Transformation System for *Dunaliella salina*," *The Journal of Microbiology*, 43(4):361-365.

Vieler et al., (Apr. 2012) "A Lipid Droplet Protein of *Nannochloropsis* with Functions Partially Analogous to Plant Pleosins," *Plant Physiology*, 158:1562-1569.

Walker et al., (2005) "Characterisation of the *Dunaliella tertiolecta RbcS* genes and their promoter activity in *Chlamydomonas reinhardtii*," *Plant Cell Rep.* 23(10-11):727-735.

Wang et al., (Dec. 2011) "Genome Characterization of the Oleaginous Fungus *Mortierella alpina*," *PLOS One*, 6(12):e28319, 16pp.

Wu et al., (2001) "Identification of *Chlorella* spp. isolates using ribosomal DNA sequences," *Bot. Bull. Acad. Sin*.42:115-121.

Yan et al., (2015) "*Auxenochlorella protothecoides* and *Prototheca wickerhamii* plastid genome sequences give insight into the origins of non-photosynthetic algae," *Scientific Reports*, 5:14465, 8pp.

Yang et al., (2010) "Identification of Perilipin-2 as a lipid droplet protein regulated in oocytes during maturation," *Reproduction, Fertility and Development*, 22:1262-1271.

Yang et al., (2012) "Controlling the size of lipid droplets: lipid and protein factors," *Current Opinion in Cell Biology*, 24:509-516.

Zaslavskaia et aL (Jun. 15, 2001) "Trophic Conversion of an Obligate Photoautotrophic Organism Through Metabolic Engineering," *Science*, 292:2073-2075.

Hypothetical protein CHLNCDRAFT_27559 [Chlorella variabilis] Chorella variabilis protein sequence. Genbank Id: XP_005843858. 1, Oct. 28, 2013.

US Notice of Allowance, dated Jan. 4, 2016, issued in U.S. Appl. No. 13/688,025.

European Extended Search Report dated Mar. 8, 2016 issued in EP 13 85 9876.

Database UniProt [Online] Nov. 28, 2012 Najihah et al.: "Isolation and partial characterization of beta ketoacyl-ACP synthase I (KAS I) cDNA clone from *Chlorella* sp.," retrieved from Database accession No. B2Z3P6 sequence, 213 AA, One page.

Chen et al., (2011) "Structural classification and properties of ketoacyl synthases," *Protein Science*, 20:1659-1667.

Chen et al., (2012) "Prediction of ketoacyl synthase family using reduced amino acid alphabets," *Journal of Industrial Microbiology and Biotechnology*, 39:579-584.

Lennen et al., (Oct. 23, 2012) "Engineering *Escherichia coli* to synthesize free fatty acids," *Trends in Biotechnology*, 30:659-667.

Mackintosh et al., (1989) "A new assay procedure to study the induction of β-ketoacyl-ACP synthase I and II, and the complete purification of β-ketoacyl-ACP synthase I from developing seeds of oilseed rape (*Brassica napus*)," *Biochimica Et Biophysica Acta*, 1002:114-124.

NN: (2010) "Research grants, 2010," Universiti Malaysia Terengganu Research Management Center / Project description (only one page is cited), Retrieved from the Internet on Feb. 8, 2016 at http://rmc.umt.edu.my/?page_id=239, 2pp.

Torella et al., (Jul. 9, 2013) "Tailored fatty acid synthesis via dynamic control of fatty acid elongation," *Proceedings of the National Academy of Sciences, U.S.A.*, 110(28):11290-11295.

\* cited by examiner

GENETICALLY ENGINEERED MICROBIAL STRAINS INCLUDING *CHLORELLA PROTOTHECOIDES* LIPID PATHWAY GENES

CROSS-REFERENCE TO RELATED APPLICATIONS

This application claims the benefit under 35 U.S.C. 119(e) of U.S. Provisional Patent Application No. 61/734,613, filed Dec. 7, 2012 and U.S. Provisional Patent Application No. 61/902,705, filed Nov. 11, 2013. Each of these applications is incorporated herein by reference in its entirety for all purposes.

REFERENCE TO A SEQUENCE LISTING

This application includes a sequence listing which has been submitted electronically in ASCII format and is hereby incorporated by reference in its entirety. Said ASCII copy, created on Dec. 6, 2013, is named SOLAP016US_SL.txt and is 78,185,624 bytes in size.

FIELD OF THE INVENTION

The present disclosure relates to genetically engineered microbes and to biofuels and bioproducts derived from the microbes, and thus find uses in the fields of microbiology, molecular biology, and chemistry, and in food, fuel, and industrial chemicals production. Certain aspects of the disclosure relate to polynucleotides, expression vectors, expression cassettes and host cells comprising coding sequences from the microalgae *Auxenochlorella protothecoides* (also known in the literature as *Chlorella protothecoides*). These terms may be used interchangeably.

DESCRIPTION OF RELATED DISCLOSURES

Microalgae, including genetically engineered microalgae, have been identified as important new sources of oil for use in food and fuels. See PCT Pub. Nos. WO 2008/151149, WO 2009/126843, and WO 2010/045368, each of which is incorporated herein by reference in its entirety for all purposes. *Auxenochlorella protothecoides* finds use in food and fuels (see: Safety evaluation of Whole Algalin Protein (WAP from *Chlorella protothecoides*, Szabo et al, *Food and Chemical Toxicology*, Vol 59, September 2013, pp. 34-45). While *Auxenochlorella* strains have been the focus of much effort in developing microbial oil production methods, more recently strains of the genus *Prototheca* have been identified as also having promise as a new source of microbial oils, including tailored oils for specific applications. See PCT Pub. Nos. WO 2010/063031, WO 2010/063032, WO 2011/150410, WO 2012/106560, and WO2013/158938, each of which is incorporated herein by reference in its entirety for all purposes. WO/2013/056212 discloses genes for optimization of productivity including photosynthesis genes. WO/2009/105927 discloses high-density fermentation methods for *Chlorella protothecoides* using heterotrophic culture. US20090211150 discloses methods for producing biodiesel from *Chlorella protothecoides*.

SUMMARY

In certain embodiments, the invention provides a recombinant (e.g., isolated) nucleic acid comprising a coding sequence that encodes a *Chlorella protothecoides* lipid biosynthesis protein or portion thereof. In some embodiments, provided is a recombinant nucleic acid comprising a coding sequence that encodes a *Chlorella protothecoides* lipid biosynthesis protein, provided that the protein is not stearoyl acyl carrier protein desaturase. In some embodiments the protein is not a stearol acyl carrier protein desaturase of SEQ ID NO: 49107 (coding sequence SEQ ID NO: 49108). In some embodiments, the coding sequence is in operable linkage with a promoter, an untranslated control element, and/or a targeting sequence, such as a plastidial targeting sequence and/or mitochondrial targeting sequence. The recombinant nucleic acid may be, e.g., a DNA molecule. In certain embodiments, the recombinant nucleic acid is an expression vector. The recombinant nucleic acid can, for example, include an expression cassette that encodes an mRNA that encodes a functional *Chlorella protothecoides* lipid biosynthesis enzyme. Alternatively or in addition, the recombinant nucleic acid can include an expression cassette that encodes an inhibitory RNA that suppresses expression of a *Chlorella protothecoides* lipid biosynthesis gene. In some embodiments, the lipid biosynthesis protein is a protein in Table 1. In some embodiments, the protein has at least 50%, 60%, 70%, 80%, 85%, 90% or 95% sequence identity to a protein provided herein or a protein encoded by a gene provided herein. In some embodiments the protein or the gene encoding the protein is listed in Table 1.

In some embodiments, the protein encoded by the coding sequence in the nucleic acid contains one or more point mutations, deletions, substitutions, or combinations thereof. In other embodiments, the protein has at least one point mutation in comparison to a protein in Table 1. In some embodiments, the protein encoded by the coding sequence is a functional protein. In some embodiments, the protein is diacylglycerol diacyltransferase (DGAT) having at least one point mutation. In other embodiments, the recombinant nucleic acid further encodes sucrose invertase.

In certain embodiments, also provided is a genetically engineered microbial cell transformed with a recombinant nucleic acid provided herein. In some embodiments, the cell is a microbial, plant, or yeast cell. In particular embodiments, provided is a cell comprising one or more exogenous gene(s), wherein the exogenous gene is a *Chlorella protothecoides* lipid biosynthesis gene selected from the genes listed in Table 1. The genetically engineered microbial cell can, for example, be a cell of the genus *Prototheca* or *Chlorella*. In particular embodiments, the cell comprises both an endogenous lipid biosynthesis gene and one or more exogenous *Chlorella protothecoides* lipid biosynthesis gene(s) selected from the genes listed in Table 1. In certain embodiments, the exogenous gene can encode a lipid biosynthesis protein, wherein the amino acid sequence of the lipid biosynthesis protein is identical to the endogenous lipid biosynthesis protein. For example, the exogenous gene can include a nucleotide sequence in which the codons of the nucleotide sequence encoding the amino acids of the lipid biosynthesis protein have been altered, as compared to the codons in the native nucleic acid. In various embodiments, the exogenous gene can encode a protein with at least 50%, 60%, 70%, 75%, 80%, 85%, 90%, 95%, 96%, 97%, 98%, or 99% amino acid identity to the native *Chlorella protothecoides* protein. The exogenous gene can, in some embodiments, be in operable linkage with a promoter element that is not the native *Chlorella protothecoides* promoter, an untranslated control element that is not the native *Chlorella protothecoides* untranslated control element, and/or a nucleotide sequence encoding a transit peptide that is not the native *Chlorella protothecoides* transit peptide. The transit peptide can, for example, be a plastidial targeting sequence or a mitochondrial targeting sequence. In certain embodiments, the cell has a 23S rRNA sequence with at least 75%, 80%, 85%, 90%, 95%, 96%, 97%, 98%, or 99% nucleotide identity to SEQ ID NO: 60. In some embodiments, the cell is a *Chlorella* cell. In particular embodiments, the cell is a *Prototheca* cell, wherein the cell has a fatty acid profile that is at least 10% C8-C14.

In certain embodiments, another aspect of the invention is a method for obtaining microbial oil comprising culturing a genetically engineered cell, e.g., a *Chlorella* cell, described above under conditions such that oil is produced. In certain embodiments, the microbial oil thus produced has a fatty acid profile that is at least 10% C8-C14. The invention also includes a microbial oil produced by this method.

In some embodiments provided is a microbial oil obtained from a cell provided herein.

In some cases, the microbial oil is a microalgal oil comprising C29 and C28 sterols, wherein the amount of C28 sterols is greater than C29 sterols.

In some cases, the microbial oil is a microalgal oil comprising one or more of: at least 10% ergosterol; ergosterol and β-sitosterol, wherein the ratio of ergosterol to β-sitosterol is greater than 25:1; ergosterol and brassicasterol; ergosterol, brassicasterol, and poriferasterol, and wherein the oil is optionally free from one or more of β-sitosterol, campesterol, and stigmasterol.

In particular embodiments, the invention provides genetically engineered cell, e.g., of the genus *Chlorella*, wherein the activity of one or more endogenous lipid biosynthesis gene, selected from the genes listed in Table 1, has been attenuated. In various embodiments, the activity of the endogenous gene has been attenuated through chromosomal gene deletion, chromosomal gene insertion, frameshift mutation, point mutation, and/or inhibitory RNA. The genetically engineered cell can, in certain embodiments, further comprise an exogenous *Chlorella protothecoides* lipid biosynthesis pathway gene selected from the genes listed in Table 1. In particular embodiments, one or more allele(s) of an endogenous lipid biosynthesis gene in the genetically engineered cell is attenuated.

In certain embodiments, one allele of the endogenous lipid biosynthesis gene is replaced, in the genetically engineered cell, with a polynucleotide encoding, e.g., an exogenous *Chlorella protothecoides* lipid biosynthesis pathway gene selected from Table 1 and a selectable marker. In a variation of this embodiment, two or more alleles of the endogenous lipid biosynthesis gene are each replaced with a polynucleotide encoding an exogenous *Chlorella protothecoides* lipid biosynthesis pathway gene selected from Table 1 and a selectable marker. In certain embodiments, the genetically engineered cell has a 23S rRNA sequence with at least 75%, 80%, 85%, 90%, 95%, 96%, 97%, 98%, or 99% nucleotide identity to SEQ ID NO: 60 or SEQ ID NO 5. In particular embodiments, the genetically engineered cell is a *Chlorella* or *Prototheca* cell, wherein the cell has a fatty acid profile that is at least 10% C8-C14. In some embodiments, the cell has a fatty acid profile that is at least at least 50%, 60%, or 70% C12:0. In some embodiments, the cell has a fatty acid profile that is at least at least 70%, 75%, 80%, 85%, or 90% C18:1. In certain embodiments, the invention also provides a method for obtaining microbial oil comprising culturing this genetically engineered cell, which may be, e.g., a *Chlorella* or *Prototheca* cell, under conditions such that oil is produced. In certain embodiments, the microbial oil thus produced has a fatty acid profile that is at least 10% C8-C14. The invention also includes a microbial oil produced by this method.

In another aspect, the present invention provides a genetically engineered microbial cell, e.g., *Chlorella* or *Prototheca* cell, in which one or more lipid biosynthesis genes have been modified to increase or decrease expression of such one or more genes such that the fatty acid profile of the genetically engineered strain differs from that of the strain from which it was derived. In one embodiment, at least two genes have been modified. In various embodiments, the genetic modifications include one or more of the following modifications: (i) attenuation of a gene or its enzymatic product; and (ii) increased expression of a gene or its enzymatic product; (iii) altered activity of a gene or its enzymatic product.

In various embodiments, the genetically engineered cell has one or more attenuated genes, wherein the genes attenuated have been attenuated by a means selected from the group consisting of a homologous recombination event and introduction of an exogenous gene that codes for an interfering RNA. In various embodiments, one or more alleles of a gene are attenuated. In some embodiments, genes are attenuated to reduce unwanted side products e.g. starch, cell membranes, or other cellular components.

In various embodiments, the genetically engineered cell has one or more over-expressed genes, wherein the genes over-expressed have been up-regulated by a means selected from the group consisting of introduction of additional copies of said gene into said cell; introduction of new expression control elements for said gene; and alteration of the protein-coding sequence of the gene. In various embodiments, one or more alleles of a gene are over-expressed. In various embodiments, manipulation of gene expression results in improved lipid productivity, oil per cell, and yield per g of sugar. In some embodiments, the cell cycle is manipulated to produce larger cells containing an increased volume of oil. In some embodiments, sugar uptake and other aspects of cellular metabolism are enhanced.

In various embodiments, the modified genes of the genetically engineered cell are selected from the group consisting of *Chlorella protothecoides* lipid biosynthesis genes presented in Table 1. In various embodiments, the genetically engineered cell comprises an exogenous gene selected from the group consisting of *Chlorella protothecoides* lipid biosynthesis genes presented in Table 1. In various embodiments, the genetically engineered cell comprises one or more over-expressed alleles of a gene, the gene selected from the group consisting of *Chlorella protothecoides* lipid biosynthesis genes presented in Table 1. In various embodiments, the genetically engineered cell has an attenuated gene selected from the group consisting of *Chlorella protothecoides* lipid biosynthesis genes presented in Table 1. In various embodiments, the genetically engineered cell has one more attenuated alleles of a gene, the gene selected from the group consisting of *Chlorella protothecoides* lipid biosynthesis genes presented in Table 1.

In various embodiments, the genetically engineered cell has a fatty acid profile selected from the group consisting of: 3% to 60% C8:0, 3% to 60% C10:0, 3% to 70% C12:0, 3% to 95% C14:0, 3% to 95% C16:0, 3% to 95% C18:0, 3% to 95% C18:1, 0% to 60% C18:2, 0% to 60% C18:3 or combinations thereof. In various embodiments, the ratio of C10:0 to C12:0 is at least 3:1. In some cases, the ratio of C10:0 to C14:0 is at least 10:1. In various embodiments, the ratio of C12:0 to C14:0 is at least 3:1. In various embodiments, the genetically engineered cell has a fatty acid profile of at least 40% saturated fatty acids, of at least 60% saturated fatty acids, or at least 85% saturated fatty acids.

In another aspect, the present invention provides methods for obtaining microbial oil comprising culturing a genetically engineered *Chlorella* cell of the invention under conditions such that oil is produced. In various embodiments, the microbial oil has a fatty acid profile selected from the group consisting of: 3% to 40% C8:0, 3% to 60% C10:0, 3% to 70% C12:0, 3% to 95% C14:0, 3% to 95% C16:0, 3% to 95% C18:0, 3% to 95% C18:1, 0% to 60% C18:2, 0% to 60% C18:3 or combinations thereof. In various embodiments, the ratio of C10:0 to C12:0 is at least 3:1. In some cases, the ratio of C10:0 to C14:0 is at least 10:1. In various embodiments, the ratio of C12:0 to C14:0 is at least 3:1. In various embodiments, the genetically engineered cell has a fatty acid profile of at least 40% saturated fatty acids, of at least 60% saturated fatty acids, or at least 85% saturated fatty acids.

In an additional aspect, the present invention provides microbial oils and foods, fuels, and chemicals containing said oil or a chemical derived therefrom.

In another aspect, the present invention provides recombinant nucleic acids useful in methods for making genetically modified *Chlorella* and other cells. The nucleic acids of the invention comprise all or some portion of a *Chlorella protothecoides* lipid biosynthesis gene.

In various embodiments, these nucleic acids include expression cassettes, which consist of a coding sequence and control sequences that regulate expression of the coding sequence, which may code for an mRNA that encodes a lipid biosynthesis protein, enzyme, or for an RNAi that acts to suppress expression of a lipid biosynthesis gene.

In other embodiments, these nucleic acids are expression vectors that include one or more expression cassettes and stably replicate in a *Chlorella* or other host cell, either by integration into chromosomal DNA of the host cell or as freely replicating vectors.

In other embodiments, these nucleic acids comprise only a portion of a *Chlorella protothecoides* lipid biosynthesis gene, which portion may be a portion of a coding sequence, an exon, or a control element. Such nucleic acids are useful in the construction of expression cassettes for *Chlorella* and non-*Chlorella* host cells, for integration of exogenous DNA into *Chlorella* host cells, and for construction of nucleic acids useful for attenuating *Chlorella* lipid biosynthetic genes by homologous recombination.

In some embodiments, provided are sequences, compositions, host cells, and methods for overexpression of a lipid biosynthesis gene. In some aspects, the overexpressed lipid biosynthesis gene is one or more of LEC2, DGAT, ATP:citrate lyase (ACL), malic enzyme, lipase, fatty acyl-CoA reductase, Acyl-CoA Binding Proteins (ACBPs), or Lipoic Acid Synthase (LS1).

These and other aspects and embodiments of the invention are described in the detailed description of the invention below, and are exemplified in the examples below. Any or all of the features discussed above and throughout the application can be combined in various embodiments of the present invention.

DETAILED DESCRIPTION

Section I. Definitions

Unless defined otherwise, all technical and scientific terms used herein have the meaning commonly understood by a person skilled in the art to which this invention belongs. The following references provide one of skill with a general definition of many of the terms used in this invention: Singleton et al., *Dictionary of Microbiology and Molecular Biology* (2nd ed. 1994); *The Cambridge Dictionary of Science and Technology* (Walker ed., 1988); *The Glossary of Genetics,* 5th Ed., R. Rieger et al. (eds.), Springer Verlag (1991); and Hale & Marham, *The Harper Collins Dictionary of Biology* (1991). As used herein, the following terms have the meanings ascribed to them unless specified otherwise.

A nucleic acid "active in microalgae" refers to a nucleic acid that is functional in microalgae. For example, a promoter that has been used to drive an antibiotic resistance gene to impart antibiotic resistance to a transgenic microalgae is active in microalgae.

"Acyl carrier protein" or "ACP" is a protein that binds a growing acyl chain during fatty acid synthesis as a thiol ester at the distal thiol of the 4'-phosphopantetheine moiety and comprises a component of the fatty acid synthase complex.

"Acyl-CoA molecule" or "acyl-CoA" is a molecule comprising an acyl moiety covalently attached to coenzyme A through a thiol ester linkage at the distal thiol of the 4'-phosphopantetheine moiety of coenzyme A.

"Allele" refers to one or two or more forms of a gene or genetic locus. Alleles of a gene may share 100% or less nucleotide sequence identity. Gene products encoded by alleles of a gene may share 100% or less amino acid sequence identity. Overexperession of different alleles of a gene and/or the gene products encoded therein may confer different phenotypes to a genetically engineered organism. Attenuation of different alleles of a gene and/or the gene products encoded therein may confer different phenotypes to a genetically engineered organism.

"Attenuation of a Gene" refers to (i) genetically engineering a gene so that it has, relative to a wild-type gene, different control sequences that result in decreased amounts of a gene product (RNA including mRNA, inhibitory RNA molecules, and other RNAs, polypeptides); (ii) genetically engineering a cell so that it has, relative to a wild-type cell, fewer or no detectable copies of a gene and decreased amounts of the corresponding gene product; and/or (iii) genetically engineering the coding sequence of a gene to either decrease the stability and/or activity of the gene product (i.e., if the increase the stability of an RNA gene product, increase translation of an mRNA gene product, and/or decrease the level of enzymatic activity of a protein encoded by the mRNA gene product, i.e., by making the protein less stable or less active (which may also be referred to as "attenuation of an Enzymatic Product"). An "Attenuated Gene Product" is the gene product of attenuation of a gene by any of the foregoing methods. An "Attenuated Gene" is a gene that has been genetically engineered by one or more of the methods described herein that results in decreased amounts of gene product. Attenuation of a gene thus results in "Decreased Expression of a Gene", "downregulation of the gene", or "inactivation of the gene".

"Axenic" is a culture of an organism substantially free from contamination by other living organisms.

"Biomass" is material produced by growth and/or propagation of cells. Biomass may contain cells and/or intracellular contents as well as extracellular material, includes, but is not limited to, compounds secreted by a cell.

"Catalyst" is an agent, such as a molecule or macromolecular complex, capable of facilitating or promoting a chemical reaction of a reactant to a product without becoming a part of the product. A catalyst increases the rate of a reaction, after which, the catalyst may act on another reactant to form the product. A catalyst generally lowers the overall activation energy required for the reaction such that it proceeds more quickly or at a lower temperature. Thus, a reaction equilibrium may be more quickly attained. Examples of catalysts include enzymes, which are biological catalysts; heat, which is a non-biological catalyst; and metals used in fossil oil refining processes.

"Co-culture", and variants thereof such as "co-cultivate" and "co-ferment", refer to the presence of two or more types of cells in the same bioreactor. The two or more types of cells may both be microorganisms, such as microalgae, or may be a microalgal cell cultured with a different cell type. The culture conditions may be those that foster growth and/or propagation of the two or more cell types or those that facilitate growth and/or proliferation of one, or a subset, of the two or more cells while maintaining cellular growth for the remainder.

"Coding Sequence" refers to that portion of a gene or expression cassette that encodes the RNA transcribed from that gene or expression cassette in a cell, specifically that portion of the mRNA that is translated into the protein encoded by that mRNA. Any non-translated portions of a gene between translated portions are referred to as "introns".

"Cofactor" or "co-factor" is any molecule, other than the substrate, required for an enzyme to carry out its enzymatic activity.

"Complementary DNA" or "cDNA" is a DNA copy of mRNA, usually obtained by reverse transcription of messenger RNA (mRNA) or amplification (e.g., via polymerase chain reaction ("PCR")).

"Control Sequence" refers to nucleic acid sequences in a gene or expression cassette that regulate transcription of a coding sequence and so include promoters, enhancers, transcription termination sequences, and translation initiation sequences.

"Cultivated", and variants thereof such as "cultured" and "fermented", refer to the intentional fostering of growth (increases in cell size, cellular contents, and/or cellular activity) and/or propagation (increases in cell numbers via mitosis) of one or more cells by use of selected and/or controlled conditions. The combination of both growth and propagation may be termed proliferation. Examples of selected and/or controlled conditions include the use of a defined medium (with known characteristics such as pH, ionic strength, and carbon source), specified temperature, oxygen tension, carbon dioxide levels, and growth in a bioreactor. Cultivate does not refer to the growth or propagation of microorganisms in nature or otherwise without human intervention; for example, natural growth of an organism that ultimately becomes fossilized to produce geological crude oil is not cultivation.

"Cytolysis" is the lysis of cells in a hypotonic environment. Cytolysis is caused by excessive osmosis, or movement of water, towards the inside of a cell (hyperhydration). The cell cannot withstand the osmotic pressure of the water inside, and so it explodes.

"Delipidated meal" and "delipidated microbial biomass" is microbial biomass after oil (including lipids) has been extracted or isolated from it, either through the use of mechanical (i.e., exerted by an expeller press) or solvent extraction or both. Delipidated meal has a reduced amount of oil/lipids as compared to before the extraction or isolation of oil/lipids from the microbial biomass but does contain some residual oil/lipid.

"Desaturase" are enzymes in the lipid synthesis pathway responsible for the introduction of double bonds (unsaturation) into the fatty acid chains of fatty acid or triacylglyceride molecules. Examples include but are not limited to stearoyl-Acyl carrier protein desaturase (SAD) and fatty acid desaturase (FAD), also known as fatty acyl desaturase.

"Expression Cassette" refers to a coding sequence and a promoter, optionally in combination with one or more control sequences. Expression cassettes for enzymes include, for example and without limitation, a translation initiation control sequence.

"Expression vector" or "expression construct" or "plasmid" or "recombinant DNA construct" refer to a nucleic acid that has been generated via human intervention, including by recombinant means or direct chemical synthesis, with a series of specified nucleic acid elements that permit transcription and/or translation of a particular nucleic acid in a host cell. The expression vector may be part of a plasmid, virus, or nucleic acid fragment. Typically, the expression vector includes a nucleic acid to be transcribed operably linked to a promoter. Some expression cassettes are expression vectors, but expression vectors often contain more than one expression cassette, for example expression cassettes for selectable markers are sometimes included in expression vectors for introducing exogenous genes into host cells. One of skill in the art understands that a "recombinant nucleic acid" that encodes a particular gene, or portion thereof, is isolated from the specific context in which it naturally occurs.

"Exogenous gene" is a nucleic acid that codes for the expression of an RNA and/or protein that has been introduced ("transformed") into a cell, and is also referred to as a "transgene". A transformed cell may be referred to as a recombinant cell, into which additional exogenous gene(s) may be introduced. The exogenous gene may be from a different species (and so heterologous), or from the same species (and so homologous), relative to the cell being transformed. Thus, an exogenous gene can include a homologous gene that occupies a different location in the genome of the cell or is under different control, relative to the endogenous copy of the gene. An exogenous gene may be present in more than one copy in the cell. An exogenous gene may be maintained in a cell as an insertion into the genome (nuclear or plastid) or as an episomal molecule.

"Exogenously provided" refers to a molecule provided to the culture media of a cell culture.

"Expeller pressing" is a mechanical method for extracting oil from raw materials such as soybeans and rapeseed. An expeller press is a screw type machine, which presses material through a caged barrel-like cavity. Raw materials enter one side of the press and spent cake exits the other side while oil seeps out between the bars in the cage and is collected. The machine uses friction and continuous pressure from the screw drives to move and compress the raw material. The oil seeps through small openings that do not allow solids to pass through. As the raw material is pressed, friction typically causes it to heat up.

"Fatty acids" shall mean free fatty acids, fatty acid salts, or fatty acyl moieties in a glycerolipid.

"Fatty acid modification enzyme" or "fatty acid modifying enzyme" refers to an enzyme that alters the covalent structure of a fatty acid. Examples of fatty acid modification enzymes include lipase, fatty acyl-CoA/aldehyde reductase, fatty acyl-CoA reductase, fatty aldehyde reductase, fatty aldehyde decarbonylase.

"Fatty acid profile" refers to the distribution of fatty acids in a cell or oil derived from a cell in terms of chain length and/or saturation pattern. In this context the saturation pattern can comprise a measure of saturated versus unsaturated acid or a more detailed analysis of the distribution of the positions of double bonds in the various fatty acids of a cell. The fatty acid profile in be readily determined, for example by using gas chromatography. In one method, the fatty acids of the triacylglycerol are converted into a fatty acid methyl ester (FAME) using well known methods. The FAME molecules are then detected by gas chromatography. For example, a separate peak is observed for a fatty acid of 14 carbon atoms with no unsaturation (C14:0) compared to any other fatty acid such as C14:1. The peak area for each class of FAME determined using GC-FID is proportional to the weight percentages of the fatty acids. Unless specified otherwise, the fatty acid profile is expressed as a weight percent of the total fatty acid content. When referring to fatty acid profiles, "at least 4% C8-C14" means that at least 4% by weight of the total fatty acids in a cell or in an extracted glycerolipid composition have a chain length that includes 8, 10, 12 or 14 carbon atoms.

"Fatty acid synthesis enzyme" refers to an enzyme that alters the chain length, saturation, or functional group modification of a fatty acid, or can otherwise lead to an altered fatty acid profile in a cell. Examples of fatty acid synthesis enzymes include fatty acyl-ACP thioesterase, desaturase, including stearoyl acyl carrier protein desaturase (SAD) and fatty acyl destaurase (FAD), fatty acyl hydroxylase, and β-keto-acyl-ACP synthase.

"Fatty acyl-ACP thioesterase" is an enzyme that catalyzes the cleavage of a fatty acid from an acyl carrier protein (ACP) during fatty acid synthesis.

"Fatty acyl-CoA/aldehyde reductase" is an enzyme that catalyzes the reduction of an acyl-CoA molecule to a primary alcohol.

"Fatty acyl-CoA reductase" is an enzyme that catalyzes the reduction of an acyl-CoA molecule to an aldehyde.

"Fatty aldehyde decarbonylase" is an enzyme that catalyzes the conversion of a fatty aldehyde to an alkane.

"Fatty aldehyde reductase" is an enzyme that catalyzes the reduction of an aldehyde to a primary alcohol.

"Fixed carbon source" is a molecule(s) containing carbon, typically an organic molecule, that is present at ambient temperature and pressure in solid or liquid form in a culture media that may be utilized by a microorganism cultured therein.

"Functional protein" refers to a protein whose its activity has been retained even though it may be attenuated.

"Genetically engineered", "genetically engineer", and "genetic engineering" refers to alteration of the DNA and/or RNA of a living cell by human intervention. Typically, the alteration is mediated by the introduction of one or more expression vectors, but in some instances, functionally equivalent alterations may be achieved by mutagenesis alone.

"Glycerolipid" refers to a glycerol molecule esterified at the sn-1, sn-2 or sn-3 position of the glycerol with one or more phosphate, fatty acid, phosphoserine, phosphocholine, phosphoinositol, or phosphoethanolamine, or other moieties covalently attached to the glycerol backbone. Examples of glycerolipids include triacylglycerides (triglycerides), diacylglycerides (diglycerides), monoacylglycerides (monoglycerides), glycerol-3-phosphate, lysophosphatidic acid, phosphatidic acid, phosphatidylcholine, phosphatidylserine, phosphatidylglycerol, and phosphatidylethanolamine.

"Glycerolipid synthesis enzyme" refers to an enzyme involved in the synthesis of glycerolipids. Glycerolipid synthesis enzymes function, for example, to covalently attach acyl groups to a substituted glycerol. Examples of glycerolipid synthesis enzymes include glycerol-3-phosphate acyltransferase, lysophosphatidic acid acyltransferase, diacylglycerol acyltransferase, phospholipid diacylglycerol acyltransferase, and phosphatidic acid phosphatase.

"Glycerophospholipid" is a glycerolipid that at the sn-1, sn-2 or sn-3 positions of the glycerol backbone has at least one or more covalently bound phosphate or a covalently bound phosphate containing moiety, for example, phosphocholine, phosphoserine, phosphoinositol, and phosphoethanolamine. Glycerophospholipids include phosphoglycerol, lysophosphatidic acid, phosphatidic acid, phosphatidylcholine, phosphatidylserine, phosphatidylglycerol, and phosphatidylethanolamine.

"Heterotrophic" as it pertains to culture conditions is culturing in the substantial absence of light while utilizing or metabolizing a fixed carbon source.

"Homogenate" is biomass that has been physically disrupted.

"Hydrogen:carbon ratio" is the ratio of hydrogen atoms to carbon atoms in a molecule on an atom-to-atom basis. The ratio may be used to refer to the number of carbon and hydrogen atoms in a hydrocarbon molecule. For example, the hydrocarbon with the highest ratio is methane $CH_4$ (4:1).

"Hydrophobic fraction" is the portion, or fraction, of a material that is more soluble in a hydrophobic phase in comparison to an aqueous phase. A hydrophobic fraction is substantially insoluble in water and usually non-polar.

"Increase lipid yield" refers to an increase in the productivity of a microbial culture by, for example, increasing dry weight of cells per liter of culture, increasing the percentage of cells that constitute lipid, or increasing the overall amount of lipid per liter of culture volume per unit time.

"Inducible promoter" is a promoter that mediates transcription of an operably linked gene in response to a particular stimulus. Examples of such promoters may be promoter sequences that are induced in conditions of changing pH or nitrogen levels.

"In operable linkage" is a functional linkage between two nucleic acid sequences, such a control sequence (typically a promoter) and the linked sequence (typically a sequence that encodes a protein, also called a coding sequence). A promoter is in operable linkage with an exogenous gene if it can mediate transcription of the gene.

"In situ" means "in place" or "in its original position".

"Limiting concentration of a nutrient" is a concentration of a compound in a culture that limits the propagation of a cultured organism. A "non-limiting concentration of a nutrient" is a concentration that supports maximal propagation during a given culture period. Thus, the number of cells produced during a given culture period is lower in the presence of a limiting concentration of a nutrient than when the nutrient is non-limiting. A nutrient is said to be "in excess" in a culture, when the nutrient is present at a concentration greater than that which supports maximal propagation.

"Lipase" is a water-soluble enzyme that catalyzes the hydrolysis of ester bonds in water-insoluble, lipid substrates. Lipases catalyze the hydrolysis of lipids into glycerols and fatty acids.

"Lipids" are a class of molecules that are soluble in nonpolar solvents (such as ether and chloroform) and are relatively or completely insoluble in water. Lipid molecules have these properties, because they consist largely of long hydrocarbon tails which are hydrophobic in nature. Examples of lipids include fatty acids (saturated and unsaturated); glycerides or glycerolipids (such as monoglycerides, diglycerides, triglycerides or neutral fats, and phosphoglycerides or glycerophospholipids); nonglycerides (sphingolipids, sterol lipids including cholesterol and steroid hormones, prenol lipids including terpenoids, fatty alcohols, waxes, and polyketides); and complex lipid derivatives (sugar-linked lipids, or glycolipids, and protein-linked lipids). As used herein, the term "triacylglycerides" and "triglycerides" are interchangeable. "Fats" and "oils" are a subgroup of lipids called "triacylglycerides." "Oil," as distinguished from "fat" refers to triacylglycerides that are generally liquid at ordinary room temperature and pressure. Fatty acids are conventionally named by the notation that recites number of carbon atoms and the number of double bonds separated by a colon. For example oleic acid can be referred to as C18:1 and capric acid can be referred to as C10:0.

"Lipid biosynthesis pathway" or "lipid biosynthetic pathway" or "lipid metabolic pathway" or "lipid pathway" refers to the synthesis or degradation of lipids. Thus enzymes of the lipid biosynthesis pathway (e.g. lipid pathway enzyme) include fatty acid synthesis enzymes, fatty acid modification enzymes, and glycerolipid synthesis enzymes, as well as proteins (e.g. lipid pathway protein) that affect lipid metabolism, i.e., either lipid modification or degradation, and any proteins that chemically modify lipids, as well as carrier proteins. Lipid biosynthesis proteins also include transcription factors and kinases that are involved in lipid metabolism.

"Lipid biosynthesis gene" is any gene that encodes a protein that is involved in lipid metabolism, either in lipid synthesis, modification, or degradation, and any protein that chemically modifies lipids including carrier proteins.

"Lipid pathway enzyme" is any enzyme that plays a role in lipid metabolism, i.e., either lipid synthesis, modification, or degradation, and any proteins that chemically modify lipids, as well as carrier proteins.

"Lysate" is a solution containing the contents of lysed cells.

"Lysis" is the breakage of the plasma membrane and optionally the cell wall of a biological organism sufficient to release at least some intracellular content, often by mechanical, viral or osmotic mechanisms that compromise its integrity.

"Lysing" is disrupting the cellular membrane and optionally the cell wall of a biological organism or cell sufficient to release at least some intracellular content.

"Microalgae" is a eukaryotic microbial organism that contains a chloroplast or plastid, and optionally that is capable of performing photosynthesis, or a prokaryotic microbial organism capable of performing photosynthesis. Microalgae include obligate photoautotrophs, which cannot metabolize a fixed carbon source as energy, as well as heterotrophs, which can live solely off of a fixed carbon source. Microalgae include unicellular organisms that separate from sister cells shortly after cell division, such as *Chlamydomonas*, as well as microbes such as, for example, *Volvox*, which is a simple multicellular photosynthetic microbe of two distinct cell types. Microalgae include cells such as *Chlorella*, *Dunaliella*, and *Prototheca*. Microalgae also include other microbial photosynthetic organisms that exhibit cell-cell adhesion, such as *Agmenellum*, *Anabaena*, and *Pyrobotrys*. Microalgae also include obligate heterotrophic microorganisms that have lost the ability to perform photosynthesis, such as certain dinoflagellate algae species and species of the genus *Prototheca*.

"Microorganism" and "microbe" are microscopic unicellular organisms.

"Naturally co-expressed" with reference to two proteins or genes means that the proteins or their genes are co-expressed naturally in a tissue or organism from which they are derived, e.g., because the genes encoding the two proteins are under the control of a common regulatory sequence or because they are expressed in response to the same stimulus.

"Overexpression of a Gene" refers to (i) genetically engineering a gene so that it has, relative to a wild-type gene, different control sequences that result in increased amounts of a gene product (RNA and, if the RNA is an mRNA, the protein encoded by the mRNA) in a cell; (ii) genetically engineering a cell so that it has, relative to a wild-type cell, more copies of a gene and increased amounts of the corresponding gene product; and/or (iii) genetically engineering the coding sequence of a gene to either increase the stability and/or activity of the gene product (i.e., if the increase the stability of an RNA gene product, increase translation of an mRNA gene product, and/or increase the level of enzymatic activity of a protein encoded by the mRNA gene product, i.e., by making the protein more stable or more active (which may also be referred to as "Overexpression of an Enzymatic Product"). An "Overexpressed Gene" is the product of overexpression of a gene by any of the foregoing methods. Overexpression of a gene thus results in "Increased Expression of a Gene".

"Promoter" is a nucleic acid control sequence that directs transcription of a nucleic acid. As used herein, a promoter includes necessary nucleic acid sequences near the start site of transcription, such as, in the case of a polymerase II type promoter, a TATA element. A promoter also optionally includes distal enhancer or repressor elements, which may be located as much as several thousand base pairs from the start site of transcription.

"*Prototheca* cell" refers to any cell, strain, and species of microalgae of the genus *Prototheca*. Illustrative *Prototheca* cells and strains include, without limitation, those of any of the following species: *Prototheca wickerhamii*, *Prototheca stagnora*, *Prototheca portoricensis*, *Prototheca moriformis*, and *Prototheca zopfii*. In one important embodiment, a *Prototheca* cell is a cell or strain of *Prototheca moriformis*. More generally, microalgal cells, strains, and species that share greater than 75% sequence identity with the 23s rRNA of *Prototheca moriformis* or that listed in SEQ ID NO: 5.

"Recombinant" is a cell, nucleic acid, protein or vector that has been modified due to the introduction of an exogenous nucleic acid or the alteration of a native nucleic acid. Thus, e.g., recombinant cells express genes that are not found within the native (non-recombinant) form of the cell or express native genes differently than those genes are expressed by a non-recombinant cell. A "recombinant nucleic acid" is a nucleic acid originally formed in vitro, in general, by the manipulation of nucleic acid, e.g., using polymerases and endonucleases, or otherwise is in a form not normally found in nature, including an isolated form, i.e., wherein the nucleic acid is separated from at least one other component with which the native form of the nucleic acid naturally occurs. Recombinant nucleic acids may be produced, for example, to place two or more nucleic acids in operable linkage. Thus, an isolated nucleic acid or an expression vector formed in vitro by ligating DNA molecules that are not normally joined in nature, are both considered recombinant for the purposes of this invention. Once a recombinant nucleic acid is made and introduced into a host cell or organism, it may replicate using the in vivo cellular machinery of the host cell; however, such nucleic acids, once produced recombinantly, although subsequently replicated intracellularly, are still considered recombinant for purposes of this invention. Similarly, a "recombinant protein" is a protein made using recombinant techniques, i.e., through the expression of a recombinant nucleic acid.

The term "replacement" or "replace" or "replaced" when used in reference to modification of a gene sequence by another refers to the ablation or knockout of an endogenous gene by homologous recombination with an exogenous gene sequence containing suitable flanking regions.

"Inhibitory RNA" refers to RNA that inhibits gene expression. Inhibitory RNA includes double-stranded interfering RNA Inhibitory RNA includes long RNA hairpins, which, in some embodiments, are ~200 to 750 nucleotides in length, and comprise a coding sequence of the target gene of 50 to 650 nucleotides and its complementary sequence separated by sequence long enough (typically 25 to 200 nucleotides) to allow the coding sequence and its complementary to form a double-stranded sequence. RNAi also includes microRNAs, which are shorter than long RNA hairpins comprising typically only 19-22 nucleotides of the coding sequence of the target gene and its complement together with flanking sequences to engage the enzymes in the cell that mediate interference with gene expression by RNAi.

"Sonication" is a process of disrupting biological materials, such as a cell, by use of sound wave energy.

"Sucrose utilization gene" is a gene that, when expressed, aids the ability of a cell to utilize sucrose as an energy source. Proteins encoded by a sucrose utilization gene are referred to herein as "sucrose utilization enzymes" and include sucrose transporters, sucrose invertases, and hexokinases such as glucokinases and fructokinases.

"Up-regulation of an exogenous gene" refers to (i) genetically engineering a gene so that it has, relative to a wild-type gene, different control sequences that result in increased amounts of a gene product (RNA and, if the RNA is an mRNA, the protein encoded by the mRNA) in a cell; (ii) genetically engineering a cell so that it has, relative to a wild-type cell, more copies of a gene and increased amounts of the corresponding gene product; and/or (iii) genetically engineering the coding sequence of a gene to either increase the stability and/or activity of the gene product (i.e., if the increase the stability of an RNA gene product, increase translation of an mRNA gene product, and/or increase the level of enzymatic activity of a protein encoded by the mRNA gene product, i.e., by making the protein more stable or more active (which may also be referred to as "Up-regulation of an Enzymatic Product"). An "Up-regulated Gene" is the product of increased expression of a gene by any of the foregoing methods. Up-regulation of a gene thus results in "Increased Expression of a Gene".

Section II. Microalgae Lipid Biosynthesis Pathway

In certain embodiments the present invention provides recombinant *Chlorella protothecoides* cells that have been modified to alter the properties and/or proportions of lipids or fatty acids produced. The lipid biosynthesis pathway can further, or alternatively, be modified to alter the properties and/or proportions of various lipid molecules produced through enzymatic processing of lipids and intermediates in the lipid biosynthesis pathway. In various embodiments, the recombinant *Chlorella protothecoides* cells of the invention have, relative to their untransformed counterparts, optimized lipid yield per unit volume and/or per unit time, carbon chain length (e.g., for renewable diesel production or for industrial chemicals applications requiring lipid feedstock), reduced number of double or triple bonds, optionally to zero, and increasing the hydrogen:carbon ratio of a particular species of lipid or of a population of distinct lipid. In other embodiments, the lipids have increased number of double bonds.

In particular embodiments, one or more key enzymes that control branch points of metabolism of fatty acids and glycerolipids have been up-regulated or down-regulated to improve lipid production. Up-regulation, or over-expression, of genes may be achieved, for example, by transforming cells with expression constructs in which a gene encoding the enzyme of interest is expressed, e.g., using a strong promoter and/or enhancer elements that increase transcription. Such constructs can include a selectable marker such that the transformants may be subjected to selection, which can result in amplification of the construct and an increase in the expression level of the encoded enzyme. Down-regulation, or attenuation, of genes may be achieved, for example, by transforming cells with expression cassettes that ablate, through homologous recombination, all or a portion of the chromosomally-encoded corresponding gene. Expression levels of lipid pathway enzymes can also optionally be reduced through the use of inhibitory RNA constructs. Optionally, endogenous lipid pathway genes may be modified to alter individually or in combination their enzymatic specificity, level of expression, or cellular localization. The expression cassettes used in up- or down-regulation can replicate by integration into chromosomal DNA of the host cell or as a freely replicating vector.

Genes and gene products of the *Chlorella protothecoides* lipid biosynthesis pathway are listed in Table 1 and detailed in the subsections below.

TABLE 1

*Chlorella protothecoides* Lipid Pathway Genes and Proteins

| Sequence description | SEQ ID NO |
| --- | --- |
| Homomeric Acetyl-CoA carboxylase | SEQ ID NO: 63, nucleotide, SEQ ID NO: 64 protein |
| Acetyl-CoA Carboxylase 2 | SEQ ID NO: 65, nucleotide, SEQ ID NO: 66 protein |
| ACC-BC-1; ACCase, subunit, Heteromeric acetyl-CoA carboxylase Biotin Carboxylase (BC) subunit | SEQ ID NO: 67, nucleotide, SEQ ID NO: 68 protein |
| Acetyl-CoA Carboxylase subunit, Heteromeric acetyl-CoA carboxylase BCCP subunit | SEQ ID NO: 61, nucleotide, SEQ ID NO: 62, protein |
| acetyl-CoA carboxylase alpha-CT subunit | SEQ ID NO: 69 nucleotide, SEQ ID NO: 70, protein |
| Plastidial Acyl-Carrier Protein | SEQ ID NO: 73, nucleotide, 74, protein |
| Mitochondrial Acyl-Carrier Protein (ACP) | SEQ ID NO: 71 nucleotide, SEQ ID NO: 72 protein |
| Malonyl-CoA: ACP transacylase (MAT) | SEQ ID NO: 75, nucleotide, SEQ ID NO: 76, protein |
| Ketoacyl-ACP synthase I (KASI) | SEQ ID NO: 49126, nucleotide SEQ ID NO: 49127, protein |
| Ketoacyl-ACP synthase II (KASII) | SEQ ID NO: 77, nucleotide, SEQ ID NO: 78, protein |
| Ketoacyl-ACP reductase (KAR) | SEQ ID NO: 79, nucleotide, SEQ ID NO: 80, protein |
| 3-hydroxyacyl-ACP dehydrase (HD) | SEQ ID NO: 81, nucleotide, SEQ ID NO: 82, protein |
| Enoyl-ACP reductase (ENR) | SEQ ID NO: 83, nucleotide, SEQ ID NO: 84, protein |
| Stearoyl-ACP desaturase (SAD) | SEQ ID NO: 85, nucleotide, SEQ ID NO: 86, protein |
| Glycerol-3-phosphate acyltransferase (GPAT) | SEQ ID NO: 87, nucleotide, SEQ ID NO: 38, protein |
| 1-Acyl-sn-glycerol-3-phosphate acyltransferase (LPAAT) | SEQ ID NO: 89, nucleotide, SEQ ID NO: 90, protein |
| Diacylglycerol acyltransferase 2 (DGAT2) | SEQ ID NO: 91, nucleotide, SEQ ID NO: 92, protein |
| Diacylglycerol acyltransferase (DGAT) | SEQ ID NO: 93, nucleotide, SEQ ID NO: 94, protein |

TABLE 1-continued

Chlorella protothecoides Lipid Pathway Genes and Proteins

| Sequence description | SEQ ID NO |
|---|---|
| Fatty-acyl-ACP Thioesterase (FATA) | SEQ ID NO: 49128, nucleotide SEQ ID NO: 49129, protein |
| Fatty Acid (Oleate) Desaturase (FAD2) | SEQ ID NO: 95, nucleotide, SEQ ID NO: 96, protein |
| Pyruvate dehydrogenase | SEQ ID NO: 49130, 49131, 49132, nucleotide SEQ ID NO: 49133, 49134 protein |
| Acetate kinase | SEQ ID NO: 49135, nucleotide SEQ ID NO: 49136, protein |
| Phosphate acetyltransferase | SEQ ID NO: 49137, nucleotide SEQ ID NO: 49138, protein |
| Ketoacyl-ACP synthase III | SEQ ID NO: 49139, nucleotide SEQ ID NO: 49140, protein |
| Ketoacyl-ACP reductase (KAR) | SEQ ID NO: 49141, nucleotide SEQ ID NO: 49142, protein |
| Ketoacyl-CoA reductase (KCR) | SEQ ID NO: 49143, nucleotide SEQ ID NO: 49144, protein |
| Enoyl-CoA Reductase (ECR) | SEQ ID NO: 49145, nucleotide, SEQ ID NO: 49146, protein |
| Long-chain Acyl-CoA Synthetase (LACS) | SEQ ID NO: 49147, nucleotide SEQ ID NO: 49148, protein |
| Diacylglycerol Kinase (DGK) | SEQ ID NO: 49149, nucleotide SEQ ID NO: 49150, protein |
| Choline Kinase | SEQ ID NO: 49151, nucleotide SEQ ID NO: 49152, protein |
| Lipoate Synthase (LS) | SEQ ID NO: 49153, nucleotide SEQ ID NO: 49154, protein |
| Leafy cotyledon2 (LEC2) | SEQ ID NO: 49155, nucleotide SEQ ID NO: 49156, protein |
| Malic Enzyme | SEQ ID NO: 49157, nucl SEQ ID NO: 49158, protein |
| Acyl-CoA Binding protein (ACBP) | SEQ ID NO: 49159, nucl SEQ ID NO: 49160, protein |
| Phosphatidate cytidylyltransferase | SEQ ID NO: 49161, nucl SEQ ID NO: 49162, protein |
| Enoyl-CoA hydratase | SEQ ID NO: 49163, nucl SEQ ID NO: 49164, protein |
| Acyl-CoA oxidase | SEQ ID NO: 49165, nucl SEQ ID NO: 49166, protein |
| FAD3 Desaturase (Linoleate) | SEQ ID NO: 49167, nucl SEQ ID NO: 49168, protein |
| Glyoxysomal fatty acid beta-oxidation multifunctional protein | SEQ ID NO: 49169, nucl SEQ ID NO: 49170, protein |
| Monoglyceride lipase (MGL) | SEQ ID NO: 49171, nucl SEQ ID NO: 49172, protein |
| Triacylglycerol lipase 1 and 2 (TGL1, TGL2) | SEQ ID NO: 49173, 49174, nucleotide SEQ ID NO: 49175, 49176, protein |
| Lipid droplet protein 1, LDP1 | SEQ ID NO: 49177, nucleotide SEQ ID NO: 49178, protein |
| Nitrogen Response Regulator (NRR) | SEQ ID NO: 49179, nucleotide SEQ ID NO: 49180 protein |
| Monoacylglycerol Acyltransferase (MGAT1) | SEQ ID NO: 49181, nucleotide SEQ ID NO: 49182, protein |
| PDAT/LCAT/PDCT | SEQ ID NO: 49183, nucleotide SEQ ID NO: 49184, protein |
| Citrate Synthase | SEQ ID NO: 49185, nucleotide |

TABLE 1-continued

Chlorella protothecoides Lipid Pathway Genes and Proteins

| Sequence description | SEQ ID NO |
|---|---|
| Cellulase/Endoglucanase (EG1)/ Expansin | SEQ ID NO: 49186, protein SEQ ID NO: 49187, nucleotide |
| Rab/RAN GTPase | SEQ ID NO: 49188, protein SEQ ID NO: 49189, nucleotide SEQ ID NO: 49190, protein |
| ACP-P Promoter | SEQ ID NO: 49191, nucleotide |

A. Acetyl-CoA—Malonyl-CoA to Acyl-ACP

The early stages of fatty acid synthesis involve the conversion of a fixed carbon (e.g., glucose, sucrose, etc.) or other carbon sources into pyruvate. Next, the pyruvate dehydrogenase complex (PDH), comprising pyruvate dehydrogenase, dihydrolipoyl transacetylase, and dihydrolipoyl dehydrogenase, converts the three carbon metabolite pyruvate into the two carbon metabolite acetyl-CoA. The acetyl-CoA carboxylase (ACC) complex, utilizing bicarbonate as a substrate, generates the 3-carbon compound malonyl-CoA. Malonyl-CoA:ACP acyltransferase (MAT) then catalyzes the transfer of a malonyl group from malonyl-CoA to the acyl carrier protein (ACP), thereby generating malonyl-ACP. ACP is used as the acyl carrier for the various intermediate reactions in fatty acid biosynthesis. The metabolites acetyl-CoA and malonyl-CoA and the ACP protein are thus important starting points for fatty acid biosynthesis.

To genetically engineer a microbe for increased production of fatty acids and lipids, recombinant modifications may be made, either individually or in combination to obtain increased acetyl-CoA/malonyl-CoA/ACP production. For example, to increase malonyl-CoA production, an expression cassette may be generated and used to transform a microbe to overexpress polynucleotides encoding one or more components of the ACC enzyme complex under the control of a constitutive or regulated promoter. Additional examples of enzymes suitable for up-regulation according to embodiments of the invention include enzymes of the pyruvate dehydrogenase complex (examples, some from microalgae, include GenBank Accession Numbers NP_415392; AAA53047; Q1XDM1; and CAF05587). Up-regulation of pyruvate dehydrogenase can increase production of acetyl-CoA, and thereby increase fatty acid synthesis.

The acetyl-CoA carboxylase complex catalyzes the initial step in fatty acid synthesis. Accordingly, one or more enzymes comprising this complex may be up-regulated to increase production of fatty acids (examples, some from microalgae, include GenBank accession numbers BAA94752; AAA75528; AAA81471; YP_537052; YP_536879; NP_045833; and BAA57908). Enzymes of the ACCase complex may include the heteromeric ACCase BC subunit 1, the heteromeric ACCase BCC subunit, the heteromeric ACCase a-CT subunit, and the heteromeric ACCase b-CT subunit 1.

Enzymes that deplete pools of pyruvate or acetyl-CoA for the synthesis of metabolites other than fatty acids may compete with lipid biosynthesis pathway enzymes for precursor metabolites. Attenuation of these competitor enzymes may increase the production of fatty acids or lipids. To genetically engineer a microbe for increased production of fatty acids and lipids, recombinant modifications can be made, either individually or in combination to attenuate enzymes that compete for metabolite precursors. For example, to decrease the use of acetyl-CoA for acetate production, an expression cassette can be generated to ablate the gene or genes encoding acetate kinase enzymes. Attenuation of acetate kinase can also be achieved through the construction and use of expression cassettes comprising an antisense RNA under the control of a constitutive or regulated promoter. Additional examples of enzymes suitable for down-regulation according to the methods of the invention include lactate dehydrogenase, which synthesizes lactate from pyruvate or phosphate acetyltransferase (PTA), which catalyzes the conversion of acetyl-CoA to acetylphosphate, a step in the metabolism of acetate.

B. Acyl-ACP to Fatty Acid

The growing acyl-ACP chain is elongated in 2-carbon increments through a set of four enzymatic reactions involving condensation, a first reduction reaction, dehydration, and a second reduction reaction. These reactions are catalyzed by a condensing enzyme (0-ketoacyl-ACP synthase, KAS), a first reductase enzyme (β-ketoacyl-ACP reductase, KAR), a dehydrase (β-hydroxyacyl-ACP dehydrase, HR) and a second reductase (enoyl-ACP reductase, ENR). Up-regulation of KASI can be used to enhance fatty acid biosynthesis, and hence lipid production. Replacement of KASI by heterologous KAS genes with varying specificities can also be used to alter oil profile.

The initial condensation reaction between malonyl-ACP and acetyl-CoA to produce a 4-carbon compound is catalyzed by β-ketoacyl-ACP synthase (KAS) III. Successive 2-carbon additions to the elongating acyl-ACP chain, through C16:0, are catalyzed by KAS I. The enzyme KASII performs a 2-carbon extension of C16:0-ACP to C18:0-ACP. Depending on the desired length of fatty acid to be produced, one or more genes encoding KAS enzymes can be attenuated or over-expressed in the microbe.

Fatty acyl-ACP thioesterase (TE) enzymes terminate elongation by hydrolyzing the acyl-ACP into free fatty acids and ACP. TEs may show specificity for acyl-ACPs of certain carbon lengths and degree of saturation or may be broad TEs, able to cleave acyl-ACP chains of varying length and level of saturation. The substrate specificity of TEs is an important contributor to establishing the chain length and degree of saturation of fatty acids. Depending on the desired length or degree of saturation of the fatty acid to be produced, one or more genes encoding acyl-ACP thioesterases can be attenuated or over-expressed in the microbe. For example, an endogenous fatty acyl-ACP thioesterase gene showing preference for C18-ACP (FATA may be knocked out or reduced in expression while concomitantly a different TE, showing specificity for saturated C12 and C14-ACPs is overexpressed in the microbe, thereby altering the population of fatty acids in the microbe).

C. Unsaturated Fatty Acids and Fatty Acyl Chains

The introduction of carbon-carbon double bonds into a fatty acid, fatty acyl-CoA, or fatty acyl-ACP chains relies on the activity of desaturases. Desaturase enzymes may show specificity for the carbon chain length and degree of saturation of their substrates. Specific desaturases can convert saturated fatty acids or saturated fatty acyl-ACPs to unsaturated fatty acids or unsaturated fatty acyl-ACPs. Other desaturases enzymes may increase the number of carbon-carbon double bonds of unsaturated fatty acids.

Stearoyl-ACP desaturase (see, e.g., GenBank Accession numbers AAF15308; ABM45911; AAY86086, for example, catalyzes the conversion of stearoyl-ACP to oleoyl-ACP. Up-regulation of this gene can increase the proportion of monounsaturated fatty acids produced by a cell; whereas down-regulation can reduce the proportion of monounsaturates. For illustrative purposes, SADs are responsible for the synthesis of C18:1 fatty acids from C18:0 precursors.

Additional desaturases are the fatty acyl desaturases (FADs), including the phosphatidylglycerol desaturase (FAD4), the plastidial oleate desaturase (FADE), the plastidial linoleate desaturase (FAD7/FAD8), endoplasmic reticulum oleate desaturase (FAD2), the endoplasmic reticulum linolate desaturase (FAD3), the delta 12 fatty acid desaturase (Δ12 FAD) and the delta 15 fatty acid desaturase (Δ15 FAD). These desaturases also provide modifications with respect to lipid saturation. For illustrative purposes, Δ12 fatty acid desaturases are responsible for the synthesis of C18:2 fatty acids from C18:1 precursors and Δ15 fatty acid desaturases are responsible for the synthesis of C18:3 fatty acids from C18:2 precursors.

Still additional desaturases, including the palmitate-specific monogalactosyldiacylglycerol desaturase (FADS), the linoleoyl desaturase, ω-6 fatty acid desaturases, ω-3 fatty acid desaturases, and ω-6-oleate desaturases, provide modifications with respect to lipid saturation. The expression of one or more desaturases, such as ω-6 fatty acid desaturase, ω-3 fatty acid desaturase, or ω-6-oleate desaturase, can be controlled to alter the ratio of unsaturated to saturated fatty acids.

Acyl-ACPs synthesized in the plastid are either used directly within that organelle to form lipids, including glycerolipids, or exported outside the plastid for synthesis of lipids including phospholipids, triacygylcerol, or waxes. Lipid biosynthesis genes may show specificity for activity in specific subcellular locations.

D. Fatty acid to Fatty Acyl-CoA

Fatty acids are activated to Acyl-CoAs by Long-Chain Fatty acid CoA synthetases, (LACS) also known as long-chain fatty acids CoA ligases. LACS is involved in the channeling of fatty acids to various metabolic pathways, including breakdown of fatty acids. It is also involved in the uptake of exogenous fatty acids. In particular, LACS are involved in re-cycling of medium chain fatty acids in transgenic strains expressing heterologous medium-chain thioesterases. Thus, it is particularly useful to attenuate or knock out LACS expression in the transgenic strain to reduce futile cycling of medium-chain fatty acids. This approach provides higher productivity and yield combined with increased medium chain fatty acids in a transgenic strain expressing a medium-chain thioesterase.

E. Lipid Biosynthesis

Triacylglycerides may be formed through three sequential acyl-CoA-dependent acylations of a sn-glycerol-3-phosphate molecule. The first acylation, the rate-limiting step of glycerolipid synthesis, is catalyzed by glycerol-3-phosphate acyltransferase (GPAT) to produce lyso-phosphatidic acid. The second acylation step is catalyzed by the enzyme acyl-CoA:lyso-phosphatidic acid acyltransferase (LPAAT). Prior to the third acylation step, the enzyme phosphatidic acid phosphatase (PAP) (or lipins) carries out the removal of the phosphate group from phosphatidic acid to generate sn-1,2-diacylglycerol (DAG). The final acyl-CoA-dependent acylation is catalyzed by acyl-CoA: diacylglycerol acyltransferase (DGAT).

Microbes may be genetically engineered for increased production of lipids. For example, to increase the production of TAGs, an expression cassette may be generated and used to transform a microbe to polynucleotides operable to increase the expression of GPAT. This expression cassette may comprise a constitutive or inducible promoter active to drive expression of GPAT and may be utilized in the genetic background of a strain in which endogenous GPAT activity has been attenuated.

Microbes may be genetically engineered for increased production of triacylglycerol molecules with desired properties. Certain acyltransferase enzymes, including GPATs, LPAATs, and DGATs may demonstrate specificity for a subcellular localization or substrate specificity for the length and degree of saturation of the acyl-CoA chain they transfer to the substituted glycerol backbone. Additionally, LPAAT and DGAT enzymes may show substrate specificity for the form of substituted glycerol to which they transfer an acyl-CoA. Depending on the desired properties of the triacylglyceridesto be produced, one or more genes encoding GPATs, LPAATs, DGATs, or other acyltranferases may be attenuated or over-expressed in the microbe. For example, to increase the production of TAGs with midchain fatty acids esterified at the sn-2 position, an expression cassette may be generated and used to transform a microbe to overexpress an LPAAT having specificity for transferring midchains. This expression cassette may comprise a constitutive or inducible promoter active to drive expression of LPAAT and may be utilized in the genetic background of a strain in which endogenous LPAAT activity has been attenuated.

In a similar fashion, to increase production of TAGs, an expression cassette may be generated and used to transform a microbe to overexpress polynucleotides encoding a DGAT, active to transfer a acyl-CoA to a DAG molecule. This expression cassette may comprise a constitutive or inducible promoter active to drive expression of DGAT2. According to the desired characteristics of the fatty acids or lipids to be produced by the recombinant microbe, it may be advantageous to couple up-regulation of a TE characterized by substrate specificity with one or more GPAT, LPAAT, or DGAT enzymes showing the same substrate specificity.

The Monoacylglycerol Acyltransferase (MGAT) gene, catalyzed the synthesis of diacyglycerol, and can generally also catalyze the final step in triacylglycerol biosynthesis. Hence, upregulation of the MGAT gene provided in this invention may be desirable.

Alternate lipid pathway enzymes can generate triacylglyceride molecules through a route separate from that above. Enzymes of the fatty acyl-CoA-independent triacylglycerol pathway transfer fatty acyl groups between phosphatidylcholine (PC) moieties employing acyl-lysophosphatidylcholine acyl transferases that may exhibit selective substrate specificity, ultimately transferring them to diacylglycerol.

The PDAT (Phospholipid:Diacylglycerol Acyltransferase) gene represents an important alternative pathway for lipid biosynthesis. This enzyme is involved in membrane lipid turnover and can catalyze the production of TAG via 1) transacylation of DAG by acyl groups from phospholipids and galactolipids, and 2) DAG:DAG transacylation. It may also contain broad specificity, including PDCT activity (PhosphatidylCholine:Diacylglycerol Acyltransferase), meaning that this enzyme plays a key role in recycling of membrane components into TAG. The PDAT in algae is often unrecognizable when searching by homology using a PDAT from plants, and instead LCAT (Lecithin:Cholesterol Acyltransferase) genes may have PDAT activity in algae. We provide here a PDAT/PDCT/LCAT enzyme from *Auxenochlorella protothecoides* that is useful for overexpression to enhance lipid biosynthesis. Furthermore, expression of this gene will enhance conversion of membrane components to TAG during the lipid production phase, a highly desirable goal. Finally, this enzyme may be modified, altered in expression, or replaced with a heterologous PDAT to alter final TAG profiles and regiospecficity, by first providing additional genes to alter membrane components (chaing length, desaturation levels) that will then find their way in to TAG molecules.

F. Additional Lipid Molecules

In addition to their incorporation into DAGs and TAGs, fatty acids or fatty acyl molecules may be incorporated into a range of lipid molecules including but not limited to phospholipids, phosphatidylcholine (PC), phosphatidylserine (PS), phosphatidylinositol (PI), sphingolipids (SL), monogalactosyldiacylglycerol, digalactosyldiacylglycerol, and wax esters. Enzymes that synthesize molecules of PC, PS, PI, SL, wax esters, or the galactolipids monogalactosyldiacylglycerol (MGDG) or digalactosyldiacylglycerol (DGDG) may compete with enzymes that lead to or ultimately synthesize DAGs and TAGs for substrates including fatty acids or fatty acyl molecules. Genes encoding proteins involved in the synthesis, utilization, or degradation of PC, PS, PI, SL, monogalactosyldiacylglycerol, digalactosyldiacylglycerol, or wax esters may include diacylglycerol cholinephosphotransferase (DAG-CPT), cytidine diphosphate diacylglycerol synthase (CTP-DAG synthase), phosphatidylinositol synthase (PI synthase), choline kinase (CK), phosphatidylinositol-3-kinase (PI3-Kinase), phosphatidylinositol-4-kinase (PI4-Kinase), diacyerolglycerol kinase (DGK), phosphatidylglycerol-3-phosphate phosphatase (PGPP), cholinephosphate cytidylyltransferase (CPCT), phosphatidylserine decarboxylase (PSD), phospholipase C (PliC), phospholipase D (PliD), sphingolipid desaturase (SD), monogalactosyldiacylglycerol synthase (MGDG synthase), digalactosyldiacylglycerol synthase (DGDG synthase), ketoacyl-CoA synthase (KCS), 3-ketoacyl reductase (KR), and wax synthase (WS). Depending on the desired properties of the lipid molecule to be produced, one or more genes encoding enzymes that utilize fatty acids or fatty acyl molecules as substrates to produce lipid molecules may be attenuated or over-expressed in the microbe, for example using RNAi, hairpin constructs, or double or single knockouts.

In one embodiment, provided are sequences, compositions, and methods for inhibition of Diacylglycerol Kinase (DGK), which converts DAG to PA. For example, DGK can be inhibited through use of RNAi, hairpin constructs, or double or single knockouts. DGK provides a key regulatory point for the flow of lipid precursors into either synthesis of Phosphatidic Acid (PA) to form phospholipids, or to triacylglycerol biosynthesis. Thus, manipulation of the timing and expression level of DGK is highly desirable. In particular, a preferred promoter such as, but not limited to, the ACP-P promoter, driving and RNAi construct for DGK, is used to allow for efficient expression of DGK during growth phase, followed by attenuation during the lipid production. This shifts the cell from phospholipid production, during the growth phase, to higher levels of TAG production during the lipid production phase. Depending on the nature of the DGK subunit, it may also be desirable in some cases to overexpress a DGK. For example, DGK epsilon subunit stimulated lipogenesis. In other embodiments, provided are sequences, compositions, and methods for overexpression of DGK epsilon subtype (DGKe). In some aspects, overexpression of DGKe results in selective removal of DAGs with certain acyl groups such as C20:4.

To engineer a microbe for the increased production of triglycerides, it may be advantageous to attenuate enzymes that support phospholipid synthesis. For example, to decrease production of the phospholipid cytidine diphosphate (CDP)-diacylglycerol, an expression cassette may be generated and used to transform a microbe to attenuate phosphatidate cytidylyltransferase, which catalyzes condensation of phosphatidic acid and cytidine triphosphate to produce to CDP-diacylglycerol.

Further, additional lipid moieties other than triacylglycerides may utilize derivations of phosphorylated glycerol as a backbone. Enzymes such as phosphatidylglycerophosphate synthase (PGP Synthase), involved in the synthesis of phopholipids may compete with enzymes that provide for triacylglycerols for substrates including phosphorylated forms of glycerol. Depending on the desired properties of the lipid molecule to be produced, one or more genes encoding phosphatidylglycerophosphate synthase may be attenuated or over-expressed in the microbe. Lipoate Synthase (LS), also called Lipoyl Synthase or Lipoic Acid Synthase, is generally localized to the mitochondria and utilized in the synthesis of lipoic acid. Lipoic acid is an important co-factor and antioxidant.

G. Fatty Acid Degradation

To genetically engineer a microbe for increased production of specific fatty acids and lipids, recombinant modifications may be made, either individually or in combination, to decrease the degradation of fatty acids and lipids. As proteins such as acyl-CoA oxidase, 3-ketoacyl-CoA thiolase, acyl-CoA dehydrogenase, glyoxysomal fatty acid beta-oxidation multifunctional protein, and enoyl-CoA hydratase are involved in the degradation of fatty acids, these and other proteins may be attenuated in the microbe to slow or prevent fatty acid degradation. For example, to engineer a microbe to decrease fatty acid degradation, an expression cassette may be generated and used to transform a microbe to down-regulate one or more of acyl-CoA oxidase, enoyl-CoA hydratase, and glyoxysomal fatty acid beta-oxidation multifunctional protein, either through a knockout or knockdown approach. According to the desired chain length and degree of saturation of the fatty acids to be produced by the recombinant microbe, it may be advantageous to down-regulate fatty acid or lipid degradation enzymes in the genetic background of a microbe that has been engineered to alter additional lipid pathway genes or gene products.

Long-chain acyl-CoA synthetases (also known in the art as long-chain acyl-CoA ligases) convert free fatty acids into acyl-CoA thioesters. These acyl-CoA thioesters may then be degraded by enzymes involved in fatty β-oxidation. To engineer a microbe for decreased fatty acid degradation, an expression cassette may be generated and used to transform a microbe to down-regulate long-chain acyl-CoA synthetase, either through a knockout or knockdown approach.

H. Monoglyceride, Triglyceride, and Lipid Degradation

A strategy to increase the recombinant microbial production of triglycerides is to prevent or reduce the enzymatic degradation of these molecules. Enzymes such as monoglyceride lipase and triacylglycerol lipase that hydrolyze triglycerides to fatty acids and glycerol are examples of proteins that may be attenuated in a microbe to slow or prevent degradation of triglycerides. For example, to engineer a microbe to decrease triglyceride degradation an expression cassette may be generated and used to transform a microbe to down-regulate monoglyceride lipase or triacylglycerol lipase, either through a knockout or knockdown approach. According to embodiments of the present invention, it may be advantageous to attenuate one or more lipases under specific culture conditions, for example during lipid production.

I. Global Regulators

Furthermore, up- and/or down-regulation of genes may be applied to global regulators controlling the expression of the genes of the lipid biosynthetic pathway. Accordingly, one or more global regulators of lipid synthesis may be up- or down-regulated, as appropriate, to inhibit or enhance, respectively, the expression of a plurality of fatty acid synthetic genes and, ultimately, to increase lipid production. Examples include sterol regulatory element binding proteins (SREBPs), such as SREBP-1a and SREBP-1c (for examples see GenBank accession numbers NP_035610 and Q9WTN3). In one embodiment, a global regulator such as the endogenous LEC2 homolog (Leafy Cotyledon 2 homolog), a B3 DNA-binding domain protein, may be upregulated to increase lipid production. Decoupling or alteration of nitrogen sensing from the process of lipid biosynthesis may also be of value (Boyle et al, J. Biol. Chem., May 4, 2012). Also presented in this invention is a Nitrogen Response Regulator, NRR1, a Squamosa Binding protein. In some instance it may be desirable, for example, to increase the response to nitrogen starvation by enhancing expression of NRR1.

J. Lipid Droplet Proteins

Eukaryotic cells store triacylglycerol molecules in distinct organelles, often called lipid droplets. Proteins associated with lipid droplet proteins, such as lipid droplet protein 1 (LDP1, are crucial to lipid droplet structure, formation, size, and number. In some instances, attenuation of lipid droplet proteins results in increases in lipid droplet size. In other instances, overexpression of mutated sequences of lipid droplet proteins results in increased lipid droplet size and number. To genetically engineer a microbe for the production of fatty acids and lipids, recombinant modifications can be made, either individually or in combination to alter the expression of lipid droplet proteins. For example, an expression cassette can be generated to attenuate or ablate the gene or genes lipid droplet proteins. Attenuation through the use of RNAi may be coupled to an inducible or constitutive promoter. In an additional embodiment, an expression cassette can be generated to overexpress one or more lipid droplet proteins. Overexpression of lipid droplet proteins may be driven by constitutive or inducible promoters.

K. Altering Carbon Metabolism

Numerous enzymatic pathways are involved in metabolizing sugars and metabolites into intermediates suitable for use in fatty acid or lipid synthesis or for other cellular pathways. In one embodiment of the present invention, it is advantageous to alter the regulation or activity of enzymes that contribute to production of metabolites involved in lipid synthesis or that utilize the intermediates or metabolites of lipid synthesis for pathways other than the fatty acid and lipid pathways. The Kreb's cycle is such a metabolic pathway that consumes acetyl-CoA to ultimately produce carbon dioxide. Enzymatic participants of the Kreb's Cycle include fumarate hydratase (also known in the art as fumarase). To engineer a microbe for the increased production of specific fatty acids or lipids, an expression cassette may be generated and used to transform a microbe to attenuate fumarate hydratase, either through a knockout or knockdown approach. According to embodiments of the present invention, it may be advantageous to attenuate fumarate hydratase under specific culture conditions, for example during lipid production. This can be achieved with the use of tunable promoters disclosed herein, for instance the promoter for ACP will be up-regulated strongly during lipid production, and hence and RNAi construct bearing an RNAi for fumarate hydratase, under control of the ACP promoter, will activate less strongly during the growth phase and will be activated strongly during the lipid production phase.

An additional example of an enzyme involved in carbon metabolism is NAD-dependent glycerol-3-phosphate dehydrogenase that reversibly converts sn-glycerol 3-phosphate to dihydrohyxacetone phosphate, (also known in the art as glycerone phosphate). To increase the level of the triacylglycerol backbone precursor molecule, the sn-glycerol 3-phosphate metabolite, an expression cassette may be generated and used to transform a microbe to enhance expression of NAD-dependent glycerol-3-phosphate dehydrogenase. According to embodiments of the present invention, it may be advantageous to attenuate NAD-dependent glycerol-3-phosphate dehydrogenase under specific culture conditions, for example during lipid production. In some embodiments, it may be advantageous to combine the expression of several pathway enzymes for triacylglycerol production, for example the PAP, G3PDH, GPAT, LPPAT, and DGAT combination.

Other proteins, such as glycerophosphodiester phosphodiesterase, synthesize intermediates of the lipid pathway. Glycerophosphodiester phosphodiesterase hydrolyses a glycerophosphodiester to form sn-glycerol 3-phosphate, which may be used in lipid synthesis. To engineer a microbe for increased production of lipids, an expression cassette may be generated and used to transform a microbe to overexpress polynucleotides encoding glycerophosphodiester phosphodiesterase. Celluases, such as endoglucanase, are useful for breaking down cellulosic compounds into sugar utilizable by the cell. Provided is an endogenous endoglucanase that may potentially find uses in secretion to break down cellulosic material, or as a mechanism for loosening cell walls to allow for enhanced lipid droplet formation.

L. Other Genes

ACBPs (Acyl-CoA Binding Proteins) may also transport fatty acids to the nucleus where they may influence transcription and the activity of DNA polymerase and other enzymes. ACBPs influence the incorporation of fatty acids into triacylglycerol and have varying substrate affinities. The ACBP may be over-expressed, knocked out, or replaced with a heterologous ACBP with a different substrate preference, (e.g. Bovine ACBP).

In another embodiment, it is desirable to attenuate Citrate synthase. Citrate synthase competes with the pathway for lipid biosynthesis, competing with the ATP-Citrate Lyase, a critical enzyme in lipid production. Down-regulation of Citrate synthase reduces the competition for this pathway and enhances total lipid biosynthesis.

M. Cell Cycle & Cell Size

One method for enhancing lipid biosynthesis provided herein is to alter the cell cycle of the host cell so that it becomes arreseted during cell division. This produces cells that are larger and contain more lipid per cell. Since this also provides more lipid volume per unit surface area and requires reduced numbers of membrane components, proteins, nuclear components, organelles, and translational machinery, it provide increased productivity and yield. We provide here a small Rab/RAN GTPase involved in cell cycle. Overexpression of this gene using a suitable promoter is expected to lead to cell cycle arrest during lipid production and create larger cells.

Another method for increasing cell size is to overexpress Expansin. We present here an endoglucanase/expansin gene that is useful for 1) secreting from the cell to break down external cellulose feedstocks and 2) overexpressing to loosen the host cell wall and provide for expansion of the cell; larger cells can support a larger volume of lipid with a reduced surface area of membrane, providing enhanced productitivity and yield.

N. Fatty Acid Elongation

Fatty acid elongation proceeds from long-chain fatty acyl-CoAs, taking place in the endoplasmic reticulum. It is catalyzed by the Ketoacyl-CoA Synthases (KCS), Enoyl-CoA Reductase (ECR) and Ketoacyl-CoA Reductase (KCR). These genes are provided in Table 1. Manipulation of the fatty acid elongation pathway is highly desirable for the production of Very-Long Chain Fatty Acids (VLCFAs) such as Erucic Acid. The uses of Erucid acid include but are not limited to: oil paints, surfactatants, lubricants, appetite suppressants. In some preferred embodiments, heterologous KCS genes are introduced into the transgenic strain, and existing KCS genes may be replaced or attenuated, to produce high levels of VLCFAs such as Eruic acid. It may also be desirable knockout or attenuate the endogenous FAD gene(s), also provided in Table 1, to reduce competition with the elongation pathway.

Section III. Cultivation

In certain embodiments, the present invention generally relates to cultivation of microbes, e.g., oleaginous microbes, such as microalgae, including *Chlorella* and *Prototheca* species and strains, and yeast, fungi, and bacteria species and strains, for the production of microbial oil (lipids). In particular embodiments, the microbes are recombinant microbes.

1. *Chlorella protothecoides* Species and Strains

Species of *Chlorella protothecoides* can be identified by amplification of certain target regions of the genome. For example, identification of a specific *Chlorella protothecoides* species or strain can be achieved through amplification and sequencing of nuclear and/or chloroplast DNA using primers and methodology using any region of the genome, for example using the methods described in Wu et al., *Bot. Bull. Acad. Sin.* (2001) 42:115-121, "Identification of *Chlorella* spp. isolates using ribosomal DNA sequences". Well established methods of phylogenetic analysis, such as amplification and sequencing of ribosomal internal transcribed spacer (ITS1 and ITS2 rDNA), 23S rRNA, 18S rRNA, and other conserved genomic regions can be used by those skilled in the art to identify species of not only *Chlorella protothecoides*, but other hydrocarbon and lipid producing organisms with similar lipid profiles and production capability. For examples of methods of identification and classification of algae also see for example *Genetics*, 2005 August; 170(4):1601-10 and *RNA*, 2005 April; 11(4): 361-4.

Thus, genomic DNA comparison can be used to identify suitable species of microalgae to be used in the present invention. Regions of conserved genomic DNA, such as but not limited to DNA encoding for 23S rRNA, can be amplified from microalgal species and compared to consensus sequences in order to screen for microalgal species that are taxonomically related to the preferred microalgae used in the present invention. Examples of such DNA sequence comparison for species within the *Chlorella protothecoides* genus are shown below. Genomic DNA comparison can also be useful to identify microalgal species that have been misidentified in a strain collection. Often a strain collection will identify species of microalgae based on phenotypic and morphological characteristics. The use of these characteristics may lead to miscategorization of the species or the genus of a microalgae. The use of genomic DNA comparison can be a better method of categorizing microalgae species based on their phylogenetic relationship.

In some embodiments the microalgae have genomic DNA sequences encoding for 23S rRNA that have at least 99%, least 95%, at least 90%, or at least 85% nucleotide identity to at least one of the sequences listed in SEQ ID NOs: 1-9 and 60.

For sequence comparison to determine percent nucleotide or amino acid identity, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., supra).

Another example algorithm that is suitable for determining percent sequence identity and sequence similarity is the BLAST algorithm, which is described in Altschul et al., *J. Mol. Biol.* 215:403-410 (1990). Software for performing BLAST analyses is publicly available through the National Center for Biotechnology Information (at the web address www.ncbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra.). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below due to the accumulation of one or more negative-scoring residue alignments; or the end of either sequence is reached. For identifying whether a nucleic acid or polypeptide is within the scope of the invention, the default parameters of the BLAST programs are suitable. The BLASTN program (for nucleotide sequences) uses as defaults a word length (W) of 11, an expectation (E) of 10, M=5, N=-4, and a comparison of both strands. For amino acid sequences, the BLASTP program uses as defaults a word length (W) of 3, an expectation (E) of 10, and the BLOSUM62 scoring matrix. The TBLASTN program (using protein sequence to find nucleotide sequence) uses as defaults a word length (W) of 3, an expectation (E) of 10, and a BLOSUM 62 scoring matrix. (see Henikoff & Henikoff, *Proc. Natl. Acad. Sci. USA* 89:10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

Other considerations affecting the selection of microorganisms for use in the invention include, in addition to production of suitable lipids or hydrocarbons for production of oils, fuels, and oleochemicals: (1) high lipid content as a percentage of cell weight; (2) ease of growth; (3) ease of genetic engineering; and (4) ease of biomass processing. In particular embodiments, the wild-type or genetically engineered microorganism yields cells that are at least 40%, at least 45%, at least 50%, at least 55%, at least 60%, at least 65%, or at least 70% or more lipid. Preferred organisms grow heterotrophically (on sugars in the absence of light).

2. Bioreactor

Microorganisms are cultured both for purposes of conducting genetic manipulations and for production of hydrocarbons (e.g., lipids, fatty acids, aldehydes, alcohols, and alkanes). The former type of culture is conducted on a small scale and initially, at least, under conditions in which the starting microorganism can grow. Culture for purposes of hydrocarbon production is usually conducted on a large scale (e.g., 10,000 L, 40,000 L, 100,000 L or larger bioreactors) in a bioreactor. Microalgae, including *Chlorella protothecoides* species are typically cultured in the methods of the invention in liquid media within a bioreactor. Typically, the bioreactor does not allow light to enter.

The bioreactor or fermenter is used to culture microalgal cells through the various phases of their physiological cycle. Bioreactors offer many advantages for use in heterotrophic growth and propagation methods. To produce biomass for use in food, microalgae are preferably fermented in large quantities in liquid, such as in suspension cultures as an example. Bioreactors such as steel fermentors can accommodate very large culture volumes (40,000 liter and greater capacity bioreactors are used in various embodiments of the invention). Bioreactors also typically allow for the control of culture conditions such as temperature, pH, oxygen tension, and carbon dioxide levels. For example, bioreactors are typically configurable, for example, using ports attached to tubing, to allow gaseous components, like oxygen or nitrogen, to be bubbled through a liquid culture. Other culture parameters, such as the pH of the culture media, the identity and concentration of trace elements, and other media constituents can also be more readily manipulated using a bioreactor.

Bioreactors can be configured to flow culture media though the bioreactor throughout the time period during which the microalgae reproduce and increase in number. In some embodiments, for example, media can be infused into the bioreactor after inoculation but before the cells reach a desired density. In other instances, a bioreactor is filled with culture media at the beginning of a culture, and no more culture media is infused after the culture is inoculated. In other words, the microalgal biomass is cultured in an aqueous medium for a period of time during which the microalgae reproduce and increase in number; however, quantities of aqueous culture medium are not flowed through the bioreactor throughout the time period. Thus in some embodiments, aqueous culture medium is not flowed through the bioreactor after inoculation.

Bioreactors equipped with devices such as spinning blades and impellers, rocking mechanisms, stir bars, means for pressurized gas infusion can be used to subject microalgal cultures to mixing. Mixing may be continuous or intermittent. For example, in some embodiments, a turbulent flow regime of gas entry and media entry is not maintained for reproduction of microalgae until a desired increase in number of said microalgae has been achieved.

Bioreactor ports can be used to introduce, or extract, gases, solids, semisolids, and liquids, into the bioreactor chamber containing the microalgae. While many bioreactors have more than one port (for example, one for media entry, and another for sampling), it is not necessary that only one substance enter or leave a port. For example, a port can be used to flow culture media into the bioreactor and later used for sampling, gas entry, gas exit, or other purposes. Preferably, a sampling port can be used repeatedly without altering compromising the axenic nature of the culture. A sampling port can be configured with a valve or other device that allows the flow of sample to be stopped and started or to provide a means of continuous sampling. Bioreactors typically have at least one port that allows inoculation of a culture, and such a port can also be used for other purposes such as media or gas entry.

Bioreactors ports allow the gas content of the culture of microalgae to be manipulated. To illustrate, part of the volume of a bioreactor can be gas rather than liquid, and the gas inlets of the bioreactor to allow pumping of gases into the bioreactor. Gases that can be beneficially pumped into a bioreactor include air, air/$CO_2$ mixtures, noble gases, such as argon, and other gases. Bioreactors are typically equipped to enable the user to control the rate of entry of a gas into the bioreactor. As noted above, increasing gas flow into a bioreactor can be used to increase mixing of the culture.

Increased gas flow affects the turbidity of the culture as well. Turbulence can be achieved by placing a gas entry port below the level of the aqueous culture media so that gas entering the bioreactor bubbles to the surface of the culture. One or more gas exit ports allow gas to escape, thereby preventing pressure buildup in the bioreactor. Preferably a gas exit port leads to a "one-way" valve that prevents contaminating microorganisms from entering the bioreactor.

3. Media

Microalgal culture media typically contains components such as a fixed nitrogen source, a fixed carbon source, trace elements, optionally a buffer for pH maintenance, and phosphate (typically provided as a phosphate salt). Other components can include salts such as sodium chloride, particularly for seawater microalgae. Nitrogen sources include organic and inorganic nitrogen sources, including, for example, without limitation, molecular nitrogen, nitrate, nitrate salts, ammonia (pure or in salt form, such as, $(NH_4)_2SO_4$ and $NH_4OH$), protein, soybean meal, cornsteep liquor, and yeast extract. Examples of trace elements include zinc, boron, cobalt, copper, manganese, and molybdenum in, for example, the respective forms of $ZnCl_2$, $H_3BO_3$, $CoCl_2.6H_2O$, $CuCl_2.2H_2O$, $MnCl_2.4H_2O$ and $(NH_4)_6Mo_7O_{24}.4H_2O$.

Microorganisms useful in accordance with the methods of the present invention are found in various locations and environments throughout the world. As a consequence of their isolation from other species and their resulting evolutionary divergence, the particular growth medium for optimal growth and generation of lipid and/or hydrocarbon constituents can be difficult to predict. In some cases, certain strains of microorganisms may be unable to grow on a particular growth medium because of the presence of some inhibitory component or the absence of some essential nutritional requirement required by the particular strain of microorganism.

Solid and liquid growth media are generally available from a wide variety of sources, and instructions for the preparation of particular media that is suitable for a wide variety of strains of microorganisms can be found, for example, online at www.utex.org/, a site maintained by the University of Texas at Austin, 1 University Station A6700, Austin, Tex., 78712-0183, for its culture collection of algae (UTEX). For example, various fresh water and salt water media include those described in PCT Pub. No. WO 2008/151149, incorporated herein by reference.

In a particular example, Proteose Medium is suitable for axenic cultures, and a 1 L volume of the medium (pH ~6.8) can be prepared by addition of 1 g of proteose peptone to 1 liter of Bristol Medium. Bristol medium comprises 2.94 mM $NaNO_3$, 0.17 mM $CaCl_2.2H_2O$, 0.3 mM $MgSO_4.7H_2O$, 0.43 mM, 1.29 mM $KH_2PO_4$, and 1.43 mM NaCl in an aqueous solution. For 1.5% agar medium, 15 g of agar can be added to 1 L of the solution. The solution is covered and autoclaved, and then stored at a refrigerated temperature prior to use. Another example is the *Chlorella protothecoides* isolation medium (PIM), which comprises 10 g/L postassium hydrogen phthalate (KHP), 0.9 g/L sodium hydroxide, 0.1 g/L magnesium sulfate, 0.2 g/L potassium hydrogen phosphate, 0.3 g/L ammonium chloride, 10 g/L glucose 0.001 g/L thiamine hydrochloride, 20 g/L agar, 0.25 g/L 5-fluorocytosine, at a pH in the range of 5.0 to 5.2 (see Pore, 1973, App. Microbiology, 26: 648-649). Other suitable media for use with the methods of the invention can be readily identified by consulting the URL identified above, or by consulting other organizations that maintain cultures of microorganisms, such as SAG, CCAP, or CCALA. SAG refers to the Culture Collection of Algae at the University of Gottingen (Gottingen, Germany), CCAP refers to the culture collection of algae and protozoa managed by the Scottish Association for Marine Science (Scotland, United Kingdom), and CCALA refers to the culture collection of algal laboratory at the Institute of Botany (Třeboň, Czech Republic). Additionally, U.S. Pat. No. 5,900,370 describes media formulations and conditions suitable for heterotrophic fermentation of *Chlorella protothecoides* species.

For oil production, selection of a fixed carbon source is important, as the cost of the fixed carbon source must be sufficiently low to make oil production economical. Thus, while suitable carbon sources include, for example, acetate, floridoside, fructose, galactose, glucuronic acid, glucose, glycerol, lactose, mannose, N-acetylglucosamine, rhamnose, sucrose, and/or xylose, selection of feedstocks containing those compounds is an important aspect of the methods of the invention. Suitable feedstocks useful in accordance with the methods of the invention include, for example, black liquor, corn starch, depolymerized cellulosic material, milk whey, molasses, potato, sorghum, sucrose, sugar beet, sugar cane, rice, and wheat. Carbon sources can also be provided as a mixture, such as a mixture of sucrose and depolymerized sugar beet pulp. The one or more carbon source(s) can be supplied at a concentration of at least about 50 µM, at least about 100 µM, at least about 500 µM, at least about 5 mM, at least about 50 mM, and at least about 500 mM, of one or more exogenously provided fixed carbon source(s). Highly concentrated carbon sources as feedstock for fermentation are preferred. For example, in some embodiments glucose levels of at least 300 g/L, at least 400 g/L, at least 500 g/L, or at least 600 g/L or more of glucose level of the feedstock prior to the cultivation step, is added to a fed batch cultivation, in which the highly concentrated fixed carbon source is fed to the cells over time as the cells grow and accumulate lipid. In other embodiments, sucrose levels of at least 500 g/L, at least 600 g/L, at least 700 g/L, at least 800 g/L or more of sucrose prior to the cultivation is added to a fed batch cultivation, in which the highly concentrated fixed carbon source is fed to the cells over time as the cells grow and accumulate lipid. Non-limiting examples of highly concentrated fixed carbon source such as sucrose include thick cane juice, sugar cane juice, sugar beet juice and molasses. Carbon sources of particular interest for purposes of the present invention include cellulose (in a depolymerized form), glycerol, sucrose, and sorghum, each of which is discussed in more detail below.

In accordance with the present invention, microorganisms can be cultured using depolymerized cellulosic biomass as a feedstock. Cellulosic biomass (e.g., stover, such as corn stover) is inexpensive and readily available; however, attempts to use this material as a feedstock for yeast have failed. In particular, such feedstocks have been found to be inhibitory to yeast growth, and yeast cannot use the 5-carbon sugars produced from cellulosic materials (e.g., xylose from hemi-cellulose). By contrast, microalgae can grow on processed cellulosic material. Cellulosic materials generally include about 40-60% cellulose; about 20-40% hemicellulose; and 10-30% lignin.

Suitable cellulosic materials include residues from herbaceous and woody energy crops, as well as agricultural crops, i.e., the plant parts, primarily stalks and leaves, not removed from the fields with the primary food or fiber product. Examples include agricultural wastes such as sugarcane bagasse, rice hulls, corn fiber (including stalks, leaves, husks, and cobs), wheat straw, rice straw, sugar beet pulp, citrus pulp, citrus peels; forestry wastes such as hardwood and softwood thinnings, and hardwood and softwood residues from timber operations; wood wastes such as saw mill wastes (wood chips, sawdust) and pulp mill waste; urban wastes such as paper fractions of municipal solid waste, urban wood waste and urban green waste such as municipal grass clippings; and wood construction waste. Additional cellulosics include dedicated cellulosic crops such as switchgrass, hybrid poplar wood, and miscanthus, fiber cane, and fiber sorghum. Five-carbon sugars that are produced from such materials include xylose.

Cellulosic materials are treated to increase the efficiency with which the microbe can utilize the sugar(s) contained within the materials. The invention provides novel methods for the treatment of cellulosic materials after acid explosion so that the materials are suitable for use in a heterotrophic culture of microbes (e.g., microalgae and oleaginous yeast). As discussed above, lignocellulosic biomass is comprised of various fractions, including cellulose, a crystalline polymer of beta 1,4 linked glucose (a six-carbon sugar), hemicellulose, a more loosely associated polymer predominantly comprised of xylose (a five-carbon sugar) and to a lesser extent mannose, galactose, arabinose, lignin, a complex aromatic polymer comprised of sinapyl alcohol and its derivatives, and pectins, which are linear chains of an alpha 1,4 μlnked polygalacturonic acid. Because of the polymeric structure of cellulose and hemicellulose, the sugars (e.g., monomeric glucose and xylose) in them are not in a form that can be efficiently used (metabolized) by many microbes. For such microbes, further processing of the cellulosic biomass to generate the monomeric sugars that make up the polymers can be very helpful to ensuring that the cellulosic materials are efficiently utilized as a feedstock (carbon source).

In another embodiment of the methods of the invention, the carbon source is glycerol, including acidulated and non-acidulated glycerol byproduct from biodiesel transesterification. In one embodiment, the carbon source includes glycerol and at least one other carbon source. In some cases, all of the glycerol and the at least one other fixed carbon source are provided to the microorganism at the beginning of the fermentation. In some cases, the glycerol and the at least one other fixed carbon source are provided to the microorganism simultaneously at a predetermined ratio. In some cases, the glycerol and the at least one other fixed carbon source are fed to the microbes at a predetermined rate over the course of fermentation.

Some microalgae undergo cell division faster in the presence of glycerol than in the presence of glucose (see PCT Pub. No. 2008/151149). In these instances, two-stage growth processes in which cells are first fed glycerol to rapidly increase cell density, and are then fed glucose to accumulate lipids can improve the efficiency with which lipids are produced. The use of the glycerol byproduct of the transesterification process provides significant economic advantages when put back into the production process. Other feeding methods are provided as well, such as mixtures of glycerol and glucose. Feeding such mixtures also captures the same economic benefits. In addition, the invention provides methods of feeding alternative sugars to microalgae such as sucrose in various combinations with glycerol.

In another embodiment of the methods of the invention, the carbon source is invert sugar. Invert sugar is produced by splitting the sucrose into its monosaccharide components, fructose and glucose. Production of invert sugar can be achieved through several methods that are known in the art. One such method is heating an aqueous solution of sucrose. Often, catalysts are employed in order to accelerate the conversion of sucrose into invert sugar. These catalysts can be biological, for example enzymes such as invertases and sucrases can be added to the sucrose to accelerate the hydrolysis reaction to produce invert sugar. Acid is an example of non-biological catalyst, when paired with heat, can accelerate the hydrolysis reaction. Once the invert sugar is made, it is less prone to crystallization compared to sucrose and thus, provides advantages for storage and in fed batch fermentation, which in the case of heterotrophic cultivation of microbes, including microalgae, there is a need for concentrated carbon source. In one embodiment, the carbon source is invert sugar, preferably in a concentrated form, preferably at least 800 g/liter, at least 900 g/liter, at least 1000 g/liter or at least 1100 g/liter prior to the cultivation step, which is optionally a fed batch cultivation. The invert sugar, preferably in a concentrated form, is fed to the cells over time as the cells grow and accumulate lipid.

In another embodiment of the methods of the invention, the carbon source is sucrose, including a complex feedstock containing sucrose, such as thick cane juice from sugar cane processing. Because of the higher densities of the cultures for heterotrophic oil production, the fixed carbon source (e.g., sucrose, glucose, etc.) is preferably in a concentrated form, preferably at least 500 g/liter, at least 600 g/liter, at least 700 g/liter or at least 800 g/liter of the fixed carbon source prior to the cultivation step, which is optionally a fed batch cultivation in which the material is fed to the cells over time as the cells grow and accumulate lipid. In the some cases, the carbon source is sucrose in the form of thick cane juice, preferably in a concentrated form, preferably at least 60% solids or about 770 g/liter sugar, at least 70% solids or about 925 g/liter sugar, or at least 80% solids or about 1125 g/liter sugar prior to the cultivation step, which is optionally a fed batch cultivation. The concentrated thick cane juice is fed to the cells over time as the cells grow and accumulate lipid In one embodiment, the culture medium further includes at least one sucrose utilization enzyme. In some cases, the culture medium includes a sucrose invertase. In one embodiment, the sucrose invertase enzyme is a secrectable sucrose invertase enzyme encoded by an exogenous sucrose invertase gene expressed by the population of microorganisms. Thus, in some cases, as described in more detail in Section IV, below, the microalgae has been genetically engineered to express a sucrose utilization enzyme, such as a sucrose transporter, a sucrose invertase, a hexokinase, a glucokinase, or a fructokinase.

Complex feedstocks containing sucrose include waste molasses from sugar cane processing; the use of this low-value waste product of sugar cane processing can provide significant cost savings in the production of hydrocarbons and other oils. Another complex feedstock containing sucrose that is useful in the methods of the invention is sorghum, including sorghum syrup and pure sorghum. *Sorghum* syrup is produced from the juice of sweet sorghum cane. Its sugar profile consists of mainly glucose (dextrose), fructose and sucrose.

Section IV. Genetic Engineering Methods and Materials

In some embodiments, present invention provides methods and materials for genetically modifying microalgal cells to enhance lipid production, modify the properties or proportions of components generated by the microorganism, or to improve or provide de novo growth characteristics on a variety of feedstock materials. Recombinant host cells useful in the methods provided herein include but not limited to recombinant *Chlorella protothecoides, Chlorella minutissima, Chlorella sorokiniana, Chlorella ellipsoidea, Chlorella* sp., *Chlorella emersonii, Prototheca moriformis, Prototheca zopfii, Prototheca wickerhamii, Prototheca blaschkaea, Prototheca krugani* (or *kruegani*), and *Prototheca stagnora* host cells.

Promoters, cDNAs, and 3'UTRs, as well as other elements of the vectors, can be generated through cloning techniques using fragments isolated from native sources (see for example Molecular Cloning: A Laboratory Manual, Sambrook et al. (3d edition, 2001, Cold Spring Harbor Press; and U.S. Pat. No. 4,683,202). Alternatively, elements can be generated synthetically using known methods (see for example Gene. 1995 Oct. 16; 164(1):49-53).

1. Engineering Methods—Transformation

Cells can be transformed by any suitable technique including, e.g., biolistics, electroporation (see Maruyama et al. (2004), Biotechnology Techniques 8:821-826), glass bead transformation and silicon carbide whisker transformation. Another method that can be used involves forming protoplasts and using $CaCl_2$ and polyethylene glycol (PEG) to introduce recombinant DNA into microalgal cells (see Kim et al. (2002), Mar. Biotechnol. 4:63-73, which reports the use of this method for the transformation of *Chorella ellipsoidea*). Co-transformation of microalgae can be used to introduce two distinct vector molecules into a cell simultaneously (see for example Jakobiak et al. (2004) Protist 155(4):381-93).

Biolistic methods (see, for example, Sanford, Trends In Biotech. (1988) 6:299-302, U.S. Pat. No. 4,945,050; electroporation (Fromm et al., Proc. Nat'l. Acad. Sci. (USA) (1985) 82:5824-5828); use of a laser beam, microinjection or any other method capable of introducing DNA into a microalgae can also be used for transformation of a cell provided herein.

2. Engineering Methods—Homologous Recombination

Homologous recombination is the ability of complementary DNA sequences to align and exchange regions of homology. Transgenic DNA ("donor") containing sequences homologous to the genomic sequences being targeted ("template") is introduced into the organism and then undergoes recombination into the genome at the site of the corresponding genomic homologous sequences. The mechanistic steps of this process, in most cases, include: (1) pairing of homologous DNA segments; (2) introduction of double-stranded breaks into the donor DNA molecule; (3) invasion of the template DNA molecule by the free donor DNA ends followed by DNA synthesis; and (4) resolution of double-strand break repair events that result in final recombination products.

The ability to carry out homologous recombination in a host organism has many practical implications for what can be carried out at the molecular genetic level and is useful in the generation of an oleaginous microbe that can produced tailored oils. By its very nature homologous recombination is a precise gene targeting event, hence, most transgenic lines generated with the same targeting sequence will be essentially identical in terms of phenotype, necessitating the screening of far fewer transformation events. Homologous recombination also targets gene insertion events into the host chromosome, resulting in excellent genetic stability, even in the absence of genetic selection. Because different chromosomal loci will likey impact gene expression, even from heterologous promoters/UTRs, homologous recombination can be a method of querying loci in an unfamiliar genome environment and to assess the impact of these environments on gene expression.

Particularly useful genetic engineering applications using homologous recombination is to co-opt specific host regulatory elements such as promoters/UTRs to drive heterologous gene expression in a highly specific fashion. For example, ablation or knockout of desaturase genes/gene families with a heterologous gene encoding a selective marker might be expected to increase overall percentage of saturated fatty acids produced in the host cell. *protothecoides* Another approach to decreasing expression of an endogenous gene is to use an RNA-induced down-regulation or silencing of gene expression including, but not limited to an RNAi or antisense approach, as well as a dsRNA approach. Antisense, RNAi, RNA hairpin, and dsRNA approaches are well known in the art and include the introduction of an expression construct that when expressed as mRNA would lead to the formation of hairpin RNA or an expression construct containing a portion of the target gene that would be transcribed in the antisense orientation. All four approaches would result in the decreased expression of the target gene. Examples 3 and 4 describe expression constructs and working examples of the attenuation, or down-regulation of endogenous *Prototheca moriformis* lipid biosynthesis genes by an RNA hairpin approach.

Because homologous recombination is a precise gene targeting event, it can be used to precisely modify any nucleotide(s) within a gene or region of interest, so long as sufficient flanking regions have been identified. Therefore, homologous recombination can be used as a means to modify regulatory sequences impacting gene expression of RNA and/or proteins. It can also be used to modify protein coding regions in an effort to modify enzyme activites such as substrate specificity, affinities and Km, and thus affecting the desired change in metabolism of the host cell. Homologous recombination provides a powerful means to manipulate the host nuclear or organellar genome resulting in gene targeting, gene conversion, gene deletion, gene duplication, gene inversion and exchanging gene expression regulatory elements such as promoters, enhancers and 3'UTRs.

Homologous recombination can be achieved by using targeting constructs containing pieces of endogenous sequences to "target" the gene or region of interest within the endogenous host cell genome. Such targeting sequences can either be located 5' of the gene or region of interest, 3' of the gene/region of interest or even flank the gene/region of interest. Such targeting constructs can be transformed into the host cell either as a supercoiled plasmid DNA with additional vector backbone, a PCR product with no vector backbone, or as a linearized molecule. In some cases, it may be advantageous to first expose the homologous sequences within the transgenic DNA (donor DNA) with a restriction enzyme. This step can increase the recombination efficiency and decrease the occurance of undesired events. Other methods of increasing recombination efficiency include using PCR to generate transforming transgenic DNA containing linear ends homologous to the genomic sequences being targeted.

For purposes of non-limiting illustration, regions of donor DNA sequences that are useful for homologous recombination include the KE858 region of DNA in *Prototheca moriformis*. KE858 is a 1.3 kb, genomic fragment that encompasses part of the coding region for a protein that shares homology with the transfer RNA (tRNA) family of proteins. Southern blots have shown that the KE858 sequence is present in a single copy in the *Prototheca moriformis* (UTEX 1435) genome. This region and Examples of using this region for homologous recombination targeting has been described in PCT Publication No. WO 2010/063032 Another region of donor DNA that is useful is portions of the 6S genomic sequence. The use of this sequence in homologous recombination in *Prototheca morifomis* is described below in the Examples. These regions are potentially useful for integrating *Auxenochlorella prototothecoides* lipid biosynthesis genes into *Prototheca moriformis*. These corresponding regions can also be identified by homology and used in *Auxenochlorella protothecoides* as transgene integration sites.

For purposes of non-limiting illustration, regions of DNA sequences that are useful for homologous recombination include the photosynthetic related genes in *Chlorella protothecoides* plastid sequences. These include the gene regions corresponding to psbB, psbT, psbN, psbH, psbD, chlL, psbI, psaI, psbj, psbL, psbE, psbZ, psaM, psaK, chlB, psaA, psaB, and psaC (SEQ ID NO. 49111-49117). The intergenic regions between these may also be targeted.

3. Vectors and Vector Components

Vectors for transformation of microorganisms in accordance with the present invention can be prepared by known techniques familiar to those skilled in the art in view of the disclosure herein. A vector typically contains one or more genes, in which each gene codes for the expression of a desired product (the gene product) and is operably linked to one or more control sequences that regulate gene expression or target the gene product to a particular location in the recombinant cell. To aid the reader, this subsection is divided into subsections. Subsection A describes control sequences typically contained on vectors as well as novel control sequences provided by the present invention. Subsection B describes genes typically contained in vectors as well as novel codon optimization methods and genes prepared using them provided by the invention. Subsection C describes selectable markers contained on vectors and provided by the present invention. Subsection D describes methods and procedures used to identify genes.

A. Control Sequences

Control sequences are nucleic acids that regulate the expression of a coding sequence or direct a gene product to a particular location in or outside a cell. Control sequences that regulate expression include, for example, promoters that regulate transcription of a coding sequence and terminators that terminate transcription of a coding sequence. Another control sequence is a 3' untranslated sequence located at the end of a coding sequence that encodes a polyadenylation signal. Control sequences that direct gene products to particular locations include those that encode signal peptides, which direct the protein to which they are attached to a particular location within or outside the cell.

Thus, an exemplary vector design for expression of an exogenous gene in a microalgae contains a coding sequence for a desired gene product (for example, a selectable marker, a lipid pathway enzyme, or a sucrose utilization enzyme) in operable linkage with a promoter active in microalgae. Alternatively, if the vector does not contain a promoter in operable linkage with the coding sequence of interest, the coding sequence can be transformed into the cells such that it becomes operably linked to an endogenous promoter at the point of vector integration. The promoterless method of transformation has been proven to work in microalgae (see for example Lumbreras, et. al. Plant Journal (1998) 14(4): pp. 441-447).

Many promoters are active in microalgae, including promoters that are endogenous to the algae being transformed, as well as promoters that are not endogenous to the algae being transformed (i.e., promoters from other algae, promoters from higher plants, and promoters from plant viruses or algae viruses). Illustrative exogenous and/or endogenous promoters that are active in microalgae (as well as antibiotic resistance genes functional in microalgae) are described in PCT Pub. No. WO 2008/151149 and references cited therein The promoter used to express an exogenous gene can be the promoter naturally linked to that gene or can be a heterologous gene. Some promoters are active in more than one species of microalgae. Other promoters are species-specific. Illustrative promoters include promoters such as β-tubulin from *Chlamydomonas reinhardtii*, used in the Examples below, and viral promoters, such as cauliflower mosaic virus (CMV) and *chlorella* virus, which have been shown to be active in multiple species of microalgae (see for example Plant Cell Rep. 2005 March; 23(10-11):727-35; J. Microbiol. 2005 August; 43(4):361-5; Mar Biotechnol (NY). 2002 January; 4(1):63-73). Another promoter that is suitable for use for expression of exogenous genes in *Prototheca* is the *Chlorella sorokiniana* glutamate dehydrogenase promoter/5'UTR. Optionally, at least 10, 20, 30, 40, 50, or 60 nucleotides or more of these sequences containing a promoter are used. Illustrative promoters useful for expression of exogenous genes in *Prototheca* are listed in the sequence listing of this application, such as the promoter of the *Chlorella* HUP1 gene (SEQ ID NO:10) and the *Chlorella ellipsoidea* nitrate reductase promoter (SEQ ID NO:11).

*Chlorella* virus promoters can also be used to express genes in *Prototheca*, such as SEQ ID NOs: 1-7 of U.S. Pat. No. 6,395,965. Additional promoters active in *Prototheca* can be found, for example, in Biochem Biophys Res Commun. 1994 Oct. 14; 204(1):187-94; Plant Mol. Biol. 1994 October; 26(1):85-93; Virology. 2004 Aug. 15; 326(1):150-9; and Virology. 2004 Jan. 5; 318(1):214-23. Other useful promoters are described in detail in the Examples below.

A promoter can generally be characterized as either constitutive or inducible. Constitutive promoters are generally active or function to drive expression at all times (or at certain times in the cell life cycle) at the same level. Inducible promoters, conversely, are active (or rendered inactive) or are significantly up- or down-regulated only in response to a stimulus. Both types of promoters find application in the methods of the invention. Inducible promoters useful in the invention include those that mediate transcription of an operably linked gene in response to a stimulus, such as an exogenously provided small molecule (e.g, glucose, as in SEQ ID NO:10), temperature (heat or cold), lack of nitrogen in culture media, etc. Suitable promoters can activate transcription of an essentially silent gene or upregulate, preferably substantially, transcription of an operably linked gene that is transcribed at a low level. Examples below describe additional inducible promoters that are useful in *Auxenochlorella* or *Prototheca* cells, including the ACP-P promoter.

Inclusion of termination region control sequence is optional, and if employed, then the choice is be primarily one of convenience, as the termination region is relatively interchangeable. The termination region may be native to the transcriptional initiation region (the promoter), may be native to the DNA sequence of interest, or may be obtainable from another source. See, for example, Chen and Orozco, Nucleic Acids Res. (1988) 16:8411.

The present invention also provides in some embodiments control sequences and recombinant genes and vectors containing them that provide for the compartmentalized expression of a gene of interest. Organelles for targeting are chloroplasts (plastids) mitochondria. The endoplasmic reticulum is another key cellular compartment that may be desirable for targeting. Targeting sequences encode peptides that direct the expressed protein from its expression site to the targeted organelle. Chloroplast targeting sequences, plastid targeting sequences, mitochondrial targeting sequences and endoplasmic reticulum targeting sequences encode transit peptides that direct the expressed protein to the chloroplast, plastid, mitochondria or endoplasmic reticulum, respectively. In some embodiments, the present invention provides control sequences and recombinant genes and vectors containing them that provide for the secretion of a protein outside the cell. Secreted proteins include, for example, a sucrose invertase enzyme.

Proteins expressed in the nuclear genome can be targeted to the plastid using plastid targeting signals. Plastid targeting sequences endogenous to *Chlorella* are known, such as genes in the *Chlorella* nuclear genome that encode proteins that are targeted to the plastid; see for example GenBank Accession numbers AY646197 and AF499684, and in one embodiment, such control sequences are used in the vectors of the present invention to target expression of a protein to an *Auxenochlorella* or *Prototheca* plastid.

In another embodiment, the expression of polypeptide in *Auxenochlorella* is targeted to the plastid genome via homologous recombination. In place of using plastid targeting signals, recombination and expression of the lipid biosynthesis enzyme occurs within the plastid in this case. In some embodiments, a sequence is targeted to a site in the plastid encoding a protein related to photosynthetic growth.

In another embodiment, the expression of polypeptide in *Chlorella* is targeted to the plastid genome. In place of using plastid targeting signals as in the case of recombination in the nuclei, genetic recombination and expression of lipid biosynthesis enzymes occur within the plastid. In some embodiments, a sequence is targeted to a site in the plastid encoding a protein related to photosysntheic growth.

The Examples below describe the use of algal plastid targeting sequences to target heterologous proteins to the correct compartment in the host cell. cDNA libraries were made using *Prototheca moriformis* and *Chlorella protothecoides* cells and are described in PCT Publication No. WO 2010/063032.

In another embodiment, the expression of a polypeptide in *Prototheca* is targeted to the endoplasmic reticulum. The inclusion of an appropriate retention or sorting signal in an expression vector ensure that proteins are retained in the endoplasmic reticulum (ER) and do not go downstream into Golgi. For example, the IMPACTVECTOR1.3 vector, from Wageningen UR—Plant Research International, includes the well known KDEL (SEQ ID NO: 49104) retention or sorting signal. With this vector, ER retention has a practical advantage in that it has been reported to improve expression levels 5-fold or more. The main reason for this appears to be that the ER contains lower concentrations and/or different proteases responsible for post-translational degradation of expressed proteins than are present in the cytoplasm. ER retention signals functional in green microalgae are known. For example, see Proc Natl Acad Sci U.S.A. 2005 Apr. 26; 102(17):6225-30.

In another embodiment of the present invention, a polypeptide is targeted for secretion outside the cell into the culture media. See Hawkins et al., Current Microbiology Vol. 38 (1999), pp. 335-341 for examples of secretion signals active in *Chlorella* that can be used, in accordance with the methods of the invention, in *Chlorella protothecoides*.

B. Genes and Codon Optimization

Typically, a gene includes a promoter, coding sequence, and termination control sequences. When assembled by recombinant DNA technology, a gene may be termed an expression cassette and may be flanked by restriction sites for convenient insertion into a vector that is used to introduce the recombinant gene into a host cell. The expression cassette can be flanked by DNA sequences from the genome or other nucleic acid target to facilitate stable integration of the expression cassette into the genome by homologous recombination. Alternatively, the vector and its expression cassette may remain unintegrated, in which case, the vector typically includes an origin of replication, which is capable of providing for replication of the heterologous vector DNA.

A common gene present on a vector is a gene that codes for a protein, the expression of which allows the recombinant cell containing the protein to be differentiated from cells that do not express the protein. Such a gene, and its corresponding gene product, is called a selectable marker. Any of a wide variety of selectable markers can be employed in a transgene construct useful for transforming microalgae. Examples of suitable selectable markers include the G418 resistance gene, the nitrate reductase gene (see Dawson et al. (1997), Current Microbiology 35:356-362), the hygromycin phosphotransferase gene (HPT; see Kim et al. (2002), Mar. Biotechnol. 4:63-73), the neomycin phosphotransferase gene, and the ble gene, which confers resistance to phleomycin (Huang et al. (2007), Appl. Microbiol. Biotechnol.

72:197-205). Methods of determining sensitivity of microalgae to antibiotics are well known. For example, Mol Gen Genet. 1996 Oct. 16; 252(5):572-9.

Other selectable markers that are not antibiotic-based can also be employed in a transgene construct useful for transforming microalgae. Genes that confers the ability to utilize certain carbon sources that were previously unable to be utilized by the microalgae can also be used as a selectable marker. By way of illustration, *Prototheca moriformis* strains typically grow poorly, if at all, on sucrose. Using a construct containing a sucrose invertase gene can confer the ability of positive transformants to grow on sucrose as a carbon substrate. Additional details on using sucrose utilization as a selectable marker along with other selectable markers are discussed below. We provide herein an example of *Auxenochlorella prototheocoides* transformed with sucrose invertase used as a selectable marker.

For purposes of the present invention, the expression vector used to prepare a recombinant host cell of the invention will include at least two, and often three, genes, if one of the genes is a selectable marker. For example, a genetically engineered *Prototheca* cell can be made by transformation with vectors of the invention that comprise, in addition to a selectable marker, one or more exogenous genes, such as, for example, sucrose invertase gene or acyl ACP-thioesterase gene. One or both genes can be expressed using an inducible promoter, which allows the relative timing of expression of these genes to be controlled to enhance the lipid yield and conversion to fatty acid esters. Expression of the two or more exogenous genes may be under control of the same inducible promoter or under control of different inducible (or constitutive) promoters. In the latter situation, expression of a first exogenous gene can be induced for a first period of time (during which expression of a second exogenous gene may or may not be induced) and expression of a second exogenous gene can be induced for a second period of time (during which expression of a first exogenous gene may or may not be induced).

In other embodiments, the two or more exogenous genes (in addition to any selectable marker) are: a fatty acyl-ACP thioesterase and a fatty acyl-CoA/aldehyde reductase, the combined action of which yields an alcohol product. Further provided are other combinations of exogenous genes, including without limitation, a fatty acyl-ACP thioesterase and a fatty acyl-CoA reductase to generate aldehydes. In one embodiment, the vector provides for the combination of a fatty acyl-ACP thioesterase, a fatty acyl-CoA reductase, and a fatty aldehyde decarbonylase to generate alkanes. In each of these embodiments, one or more of the exogenous genes can be expressed using an inducible promoter.

Other illustrative vectors of the invention that express two or more exogenous genes include those encoding both a sucrose transporter and a sucrose invertase enzyme and those encoding both a selectable marker and a secreted sucrose invertase. The recombinant *Prototheca* transformed with either type of vector produce lipids at lower manufacturing cost due to the engineered ability to use sugar cane (and sugar cane-derived sugars) as a carbon source. Insertion of the two exogenous genes described above can be combined with the disruption of polysaccharide biosynthesis through directed and/or random mutagenesis, which steers ever greater carbon flux into lipid production. Individually and in combination, trophic conversion, engineering to alter lipid production and treatment with exogenous enzymes alter the lipid composition produced by a microorganism. The alteration can be a change in the amount of lipids produced, the amount of one or more hydrocarbon species produced relative to other lipids, and/or the types of lipid species produced in the microorganism. For example, microalgae can be engineered to produce a higher amount and/or percentage of TAGs.

Transgenes that alter the fatty acid profiles of host organisms may be expressed in numerous eukaryotic microbes. Examples of expression of transgenes in eukaryotic microbes including *Chlamydomonas reinhardtii, Chlorella ellipsoidea, Chlorella saccarophila, Chlorella vulgaris, Chlorella kessleri, Chlorella sorokiniana, Haematococcus pluvialis, Gonium pectorale, Volvox carteri, Dunaliella tertiolecta, Dunaliella viridis, Dunaliella salina, Closterium peracerosum-strigosum-littorale complex, Nannochloropsis* sp., *Thalassiosira pseudonana, Phaeodactylum tricornutum, Navicula saprophila, Cylindrotheca fusiformis, Cyclotella cryptica, Symbiodinium microadriacticum, Amphidinium* sp., *Chaetoceros* sp., *Mortierella alpina,* and *Yarrowia lipolytica* may be found in the scientific literature. These expression techniques may be combined with the teachings of the present invention to produce engineered microorganisms with altered fatty acid profiles.

Transgenes that alter the fatty acid profiles of host organisms or alter the regiospecific distribution of glycerolipids produced by host organisms can also be expressed in numerous prokaryotic microbes. Examples of expression of transgenes in oleaginous microbes including *Rhodococcus opacus* may be found in the literature. These expression techniques may be combined with the teachings of the present invention to produce engineered microorganisms with altered fatty acid profiles.

For optimal expression of a recombinant protein, it is beneficial to employ coding sequences that produce mRNA with codons preferentially used by the host cell to be transformed. Thus, proper expression of transgenes can require that the codon usage of the transgene matches the specific codon bias of the organism in which the transgene is being expressed. The precise mechanisms underlying this effect are many, but include the proper balancing of available aminoacylated tRNA pools with proteins being synthesized in the cell, coupled with more efficient translation of the transgenic messenger RNA (mRNA) when this need is met. When codon usage in the transgene is not optimized, available tRNA pools are not sufficient to allow for efficient translation of the heterologous mRNA resulting in ribosomal stalling and termination and possible instability of the transgenic mRNA. Methods of recoding genes for expression in microalgae are described in U.S. Pat. No. 7,135,290. In some cases it is preferable to use the most preferred codon in all instances. In other cases it may be preferable to use the entire codon usage table, such that rare codons are still used, albeit rarely, and to provide additional algorithmhs that seek to minimize secondary structure of the mRNA transcript, particularly in the 5' leader region. An exemplary program for this operation is PySplicer. In other cases, it may be desirable to produce and screen a library of different variations of the codon-optimized gene. Additional information for codon optimization is available, e.g., at the codon usage database of GenBank. As non-limiting examples, codon usage in *Chlorella pyrenoidosa, Dunaliella saltha, Chlorella prototheocoides*, and *Chlorella prototheocoides* plastid are shown in Tables 2-6. For genes targeted to the nuclear genome, the nuclear codon usage table is preferred. For lipid biosynthesis genes directly targeted to the plastid genome by plastid transformation methods, the plastid codon usage table is preferred.

Codon usage in *Prototheca* species was analyzed by studying cDNA sequences isolated from *Prototheca mori-*

*formis*. This analysis represents the interrogation over 24,000 codons and resulted in Table 2 below. In addition, the gene predictions for the entire nuclear genome were analyzed for codon usage, resulting in Table 5b below.

Codon usage in *Chlorella protothecoides* plastid was analyzed by studying the entire plastid genome sequence isolated from *Chlorella protothecoides*. This analysis represents the interrogation 20,889 codons resulting in Tables 5c-d below.

TABLE 2

Illustrative preferred codon usage in *Prototheca* strains.

| Ala | GCG | 345 (0.36) | Asn | AAT | 8 (0.04) |
|---|---|---|---|---|---|
|  | GCA | 66 (0.07) |  | AAC | 201 (0.96) |
|  | GCT | 101 (0.11) | Pro | CCG | 161 (0.29) |
|  | GCC | 442 (0.46) |  | CCA | 49 (0.09) |
| Cys | TGT | 12 (0.10) |  | CCT | 71 (0.13) |
|  | TGC | 105 (0.90) |  | CCC | 267 (0.49) |
| Asp | GAT | 43 (0.12) | Gln | CAG | 226 (0.82) |
|  | GAC | 316 (0.88) |  | CAA | 48 (0.18) |
| Glu | GAG | 377 (0.96) | Arg | AGG | 33 (0.06) |
|  | GAA | 14 (0.04) |  | AGA | 14 (0.02) |
| Phe | TTT | 89 (0.29) |  | CGG | 102 (0.18) |
|  | TTC | 216 (0.71) |  | CGA | 49 (0.08) |
| Gly | GGG | 92 (0.12) |  | CGT | 51 (0.09) |
|  | GGA | 56 (0.07) |  | CGC | 331 (0.57) |
|  | GGT | 76 (0.10) | Ser | AGT | 16 (0.03) |
|  | GGC | 559 (0.71) |  | AGC | 123 (0.22) |
| His | CAT | 42 (0.21) |  | TCG | 152 (0.28) |
|  | CAC | 154 (0.79) |  | TCA | 31 (0.06) |
| Ile | ATA | 4 (0.01) |  | TCT | 55 (0.10) |
|  | ATT | 30 (0.08) |  | TCC | 173 (0.31) |
|  | ATC | 338 (0.91) | Thr | ACG | 184 (0.38) |
| Lys | AAG | 284 (0.98) |  | ACA | 24 (0.05) |
|  | AAA | 7 (0.02) |  | ACT | 21 (0.05) |
| Leu | TTG | 26 (0.04) |  | ACC | 249 (0.52) |
|  | TTA | 3 (0.00) | Val | GTG | 308 (0.50) |
|  | CTG | 447 (0.61) |  | GTA | 9 (0.01) |
|  | CTA | 20 (0.03) |  | GTT | 35 (0.06) |
|  | CTT | 45 (0.06) |  | GTC | 262 (0.43) |
|  | CTC | 190 (0.26) | Trp | TGG | 107 (1.00) |
| Met | ATG | 191 (1.00) | Tyr | TAT | 10 (0.05) |
|  |  |  |  | TAC | 180 (0.95) |
|  |  |  | Stop | TGA/TAG/TAA |  |

TABLE 3

Codon usage in *Chlorella pyrenoidosa*.

| Phe | UUU | 39 (0.82) | Ser | UCU | 50 (1.04) |
|---|---|---|---|---|---|
|  | UUC | 56 (1.18) |  | UCC | 60 (1.25) |
| Leu | UUA | 10 (0.20) |  | UCA | 6 (0.96) |
|  | UUG | 46 (0.91) |  | UCG | 43 (0.89) |
| Tyr | UAU | 15 (0.59) | Cys | UGU | 46 (0.77) |
|  | UAC | 36 (1.41) |  | UGC | 73 (1.23) |
| ter | UAA | 9 (0.00) | ter | UGA | 43 (0.00) |
| ter | UAG | 15 (0.00) | Trp | UGG | 69 (1.00) |
| Leu | CUU | 49 (0.97) | Pro | CCU | 80 (0.98) |
|  | CUC | 73 (1.45) |  | CCC | 88 (1.08) |
|  | CUA | 22 (0.44) |  | CCA | 93 (1.14) |
|  | CUG | 103 (2.04) |  | CCG | 65 (0.80) |
| His | CAU | 50 (0.88) | Arg | CGU | 39 (0.76) |
|  | CAC | 3 (1.12) |  | CGC | 63 (1.23) |
| Gln | CAA | 59 (0.84) |  | CGA | 46 (0.90) |
|  | CAG | 2 (1.16) |  | CGG | 47 (0.92) |
| Ile | AUU | 24 (0.69) | Thr | ACU | 32 (0.67) |
|  | AUC | 61 (1.76) |  | ACC | 76 (1.60) |
|  | AUA | 19 (0.55) |  | ACA | 41 (0.86) |
| Met | AUG | 42 (1.00) |  | ACG | 41 (0.86) |
| Asn | AAU | 26 (0.75) | Ser | AGU | 23 (0.48) |
|  | AAC | 3 (1.25) |  | AGC | 67 (1.39) |
| Lys | AAA | 32 (0.54) | Arg | AGA | 51 (1.00) |
|  | AAG | 86 (1.46) |  | AGG | 61 (1.19) |
| Val | GUU | 36 (0.75) | Ala | GCU | 57 (0.79) |
|  | GUC | 54 (1.13) |  | GCC | 97 (1.34) |

TABLE 3-continued

Codon usage in *Chlorella pyrenoidosa*.

|  | GUA | 30 (0.63) |  | GCA | 89 (1.23) |
|---|---|---|---|---|---|
|  | GUG | 71 (1.49) |  | GCG | 47 (0.65) |
| Asp | GAU | 60 (0.95) | Gly | GGU | 35 (0.60) |
|  | GAC | 66 (1.05) |  | GGC | 78 (1.33) |
| Glu | GAA | 41 (0.68) |  | GGA | 54 (0.92) |
|  | GAG | 80 (1.32) |  | GGG | 67 (1.15) |

TABLE 4

Preferred codon usage in *Dunaliella salina*.

| TTC (Phe) | TAC (Tyr) | TGC (Cys) | TAA (Stop) |
|---|---|---|---|
| TGG (Trp) | CCC (Pro) | CAC (His) | CGC (Arg) |
| CTG (Leu) | CAG (Gln) | ATC (Ile) | ACC (Thr) |
| AAC (Asn) | AGC (Ser) | ATG (Met) | AAG (Lys) |
| GCC (Ala) | GAC (Asp) | GGC (Gly) | GTG (Val) |
| GAG (Glu) |  |  |  |

TABLE 5a

Preferred codon usage in *Chlorella protothecoides*.

| TTC (Phe) | TAC (Tyr) | TGC (Cys) | TGA (Stop) |
|---|---|---|---|
| TGG (Trp) | CCC (Pro) | CAC (His) | CGC (Arg) |
| CTG (Leu) | CAG (Gln) | ATC (Ile) | ACC (Thr) |
| GAC (Asp) | TCC (Ser) | ATG (Met) | AAG (Lys) |
| GCC (Ala) | AAC (Asn) | GGC (Gly) | GTG (Val) |
| GAG (Glu) |  |  |  |

TABLE 5b

Codon usage in *Auxenochlorella protothecoides* Nuclear genome

| Amino Acid | Codon | Number (Fraction) |
|---|---|---|
| Gly | GGG | 53727.00 (0.26) |
|  | GGA | 35897.00 (0.18) |
|  | GGT | 24027.00 (0.12) |
|  | GGC | 90622.00 (0.44) |
| Glu | GAG | 70388.00 (0.83) |
|  | GAA | 14074.00 (0.17) |
| Asp | GAT | 16562.00 (0.23) |
|  | GAC | 55282.00 (0.77) |
| Val | GTG | 57084.00 (0.54) |
|  | GTA | 6904.00 (0.07) |
|  | GTT | 8591.00 (0.08) |
|  | GTC | 33104.00 (0.31) |
| Ala | GCG | 78923.00 (0.31) |
|  | GCA | 39748.00 (0.15) |
|  | GCT | 40702.00 (0.16) |
|  | GCC | 96742.00 (0.38) |
| Arg | AGG | 35406.00 (0.16) |
|  | AGA | 14056.00 (0.06) |
|  | CGG | 51465.00 (0.23) |
|  | CGA | 26066.00 (0.12) |
|  | CGT | 20310.00 (0.09) |
|  | CGC | 72278.00 (0.33) |
| Ser | AGT | 9434.00 (0.07) |
|  | AGC | 39915.00 (0.27) |
|  | TCG | 24945.00 (0.17) |
|  | TCA | 17117.00 (0.12) |
|  | TCT | 14344.00 (0.10) |
|  | TCC | 39776.00 (0.27) |
| Lys | AAG | 39479.00 (0.77) |
|  | AAA | 11529.00 (0.23) |
| Asn | AAT | 4955.00 (0.18) |
|  | AAC | 22524.00 (0.82) |
| Met | ATG | 30760.00 (1.00) |
| Ile | ATA | 2327.00 (0.06) |
|  | ATT | 5116.00 (0.12) |
|  | ATC | 34530.00 (0.82) |

TABLE 5b-continued

Codon usage in *Auxenochlorella protothecoides* Nuclear genome

| Amino Acid | Codon | Number (Fraction) |
|---|---|---|
| Thr | ACG | 33535.00 (0.32) |
|  | ACA | 15840.00 (0.15) |
|  | ACT | 11762.00 (0.11) |
|  | ACC | 45187.00 (0.42) |
| Trp | TGG | 50365.00 (1.00) |
| Stop | TGA | 14946.00 (0.87) |
|  | TAG | 1427.00 (0.08) |
|  | TAA | 815.00 (0.05) |
| Cys | TGT | 11915.00 (0.23) |
|  | TGC | 40379.00 (0.77) |
| Tyr | TAT | 3961.00 (0.15) |
|  | TAC | 22665.00 (0.85) |
| Leu | TTG | 11031.00 (0.06) |
|  | TTA | 1058.00 (0.01) |
| Phe | TTT | 11436.00 (0.29) |
|  | TTC | 27674.00 (0.71) |
| Gln | CAG | 52937.00 (0.72) |
|  | CAA | 20035.00 (0.28) |
| His | CAT | 21799.00 (0.37) |
|  | CAC | 36516.00 (0.63) |
| Leu | CTG | 96752.00 (0.56) |
|  | CTA | 8161.00 (0.05) |
|  | CTT | 15436.00 (0.09) |
|  | CTC | 39575.00 (0.23) |
| Pro | CCG | 48421.00 (0.26) |
|  | CCA | 36278.00 (0.20) |
|  | CCT | 41156.00 (0.22) |
|  | CCC | 60326.00 (0.32) |

TABLE 5c

Preferred codon usage in *Chlorella protothecoides* plastid

| TTT (Phe) | TAT (Tyr) | TGT (Cys) | CGT (Arg) |
|---|---|---|---|
| TGG (Trp) | CCA (Pro) | CAT (His) | ACA/ACT (Thr) |
| TTA (Leu) | CAA (Gln) | ATT (Ile) | AAA (Lys) |
| GAT (Asp) | TCT (Ser) | ATG (Met) | GTT (Val) |
| GCT (Ala) | AAT (Asn) | GGT (Gly) |  |
| GAA (Glu) |  |  |  |

TABLE 5d

Codon usage in *Chlorella protothecoides* plastid

| Ala | GCA | 494 (0.37) | Asn | AAC | 228 (0.20) |
|---|---|---|---|---|---|
|  | GCC | 69 (0.05) |  | AAT | 926 (0.80) |
|  | GCG | 129 (0.10) | Pro | CCA | 419 (0.46) |
|  | GCT | 638 (0.48) |  | CCC | 54 (0.06) |
| Cys | TGC | 39 (0.22) |  | CCG | 101 (0.11) |
|  | TGT | 136 (0.78) |  | CCT | 340 (0.37) |
| Asp | GAC | 125 (0.15) | Gln | CAA | 791 (0.92) |
|  | GAT | 722 (0.85) |  | CAG | 72 (0.08) |
| Glu | GAA | 937 (0.84) | Arg | AGA | 203 (0.21) |
|  | GAG | 178 (0.16) |  | AGG | 26 (0.03) |
| Phe | TTC | 137 (0.12) |  | CGA | 198 (0.21) |
|  | TTT | 1038 (0.88) |  | CGC | 86 (0.09) |
| Gly | GGA | 358 (0.26) |  | CGG | 69 (0.07) |
|  | GGC | 119 (0.09) |  | CGT | 371 (0.39) |
|  | GGG | 183 (0.13) | Ser | AGC | 64 (0.05) |
|  | GGT | 724 (0.52) |  | AGT | 350 (0.26) |
| His | CAC | 105 (0.25) |  | TCA | 387 (0.28) |
|  | CAT | 317 (0.75) |  | TCC | 37 (0.03) |
| Ile | ATA | 411 (0.25) |  | TCG | 84 (0.06) |
|  | ATC | 129 (0.08) |  | TCT | 439 (0.32) |
|  | ATT | 1090 (0.67) | Thr | ACA | 511 (0.44) |
| Lys | AAA | 1331 (0.93) |  | ACC | 67 (0.06) |
|  | AAG | 94 (0.07) |  | ACG | 68 (0.06) |
| Leu | CTA | 146 (0.07) |  | ACT | 512 (0.44) |
|  | CTC | 34 (0.02) | Val | GTA | 498 (0.39) |
|  | CTG | 18 (0.01) |  | GTC | 30 (0.02) |
|  | CTT | 399 (0.18) |  | GTG | 87 (0.07) |

TABLE 5d-continued

Codon usage in *Chlorella protothecoides* plastid

|  | TTA | 1481 (0.67) |  | GTT | 654 (0.52) |
|---|---|---|---|---|---|
|  | TTG | 132 (0.06) | Trp | TGG | 309 (1.00) |
| Met | ATG | 394 (1.00) | Tyr | TAC | 124 (0.17) |
|  |  |  |  | TAT | 596 (0.83) |

C. Selectable Markers

Sucrose Utilization

In one embodiment, the recombinant cell provided herein further contains one or more exogenous sucrose utilization genes. In various embodiments, the one or more genes encode one or more proteins selected from the group consisting of a fructokinase, a glucokinase, a hexokinase, a sucrose invertase, a sucrose transporter. For example, expression of a sucrose transporter and a sucrose invertase allows the cell to transport sucrose into the cell from the culture media and hydrolyze sucrose to yield glucose and fructose. Optionally, a fructokinase can be expressed as well in instances where endogenous hexokinase activity is insufficient for maximum phosphorylation of fructose. Examples of suitable sucrose transporters are GenBank accession numbers CAD91334, CAB92307, and CAA53390. Examples of suitable fructokinases are GenBank accession numbers P26984, P26420 and CAA43322.

In one embodiment, the present invention provides a *Prototheca* host cell that secretes a sucrose invertase. Secretion of a sucrose invertase obviates the need for expression of a transporter that can transport sucrose into the cell. This is because a secreted invertase catalyzes the conversion of a molecule of sucrose into a molecule of glucose and a molecule of fructose, both of which can be transported and utilized by microbes provided by the invention. For example, expression of a sucrose invertase with a secretion signal (such as that of SEQ ID NO:12 (from yeast), SEQ ID NO:13 (from higher plants), SEQ ID NO:14 (eukaryotic consensus secretion signal), and SEQ ID NO:15 (combination of signal sequence from higher plants and eukaryotic consensus) generates invertase activity outside the cell. Expression of such a protein, as enabled by the genetic engineering methodology disclosed herein, allows cells already capable of utilizing extracellular glucose as an energy source to utilize sucrose as an extracellular energy source.

*Prototheca* species expressing an invertase in media containing sucrose are a preferred microalgal species for the production of oil. The expression and extracellular targeting of this fully active protein allows the resulting host cells to grow on sucrose, whereas their non-transformed counterparts cannot. Thus, the present invention provides *Prototheca* recombinant cells with a codon-optimized invertase gene (SEQ ID NO:16), including but not limited to the yeast invertase gene, integrated into their genome such that the invertase gene is expressed as assessed by invertase activity and sucrose hydrolysis.

Examples of suitable sucrose invertases include those identified by GenBank accession numbers CAB95010, NP 012104 (SEQ ID NO:17), and CAA06839. Non-limiting examples of suitable invertases are include those described in PCT Publication No. WO 2010/063032, incorporated herein by reference.

The secretion of an invertase to the culture medium by *Prototheca* enable the cells to grow as well on waste molasses from sugar cane processing as they do on pure reagent-grade glucose; the use of this low-value waste product of sugar cane processing can provide significant cost savings in the production of lipids and other oils. Thus, the present invention provides a microbial culture containing a population of *Prototheca* microorganisms, and a culture medium comprising (i) sucrose and (ii) a sucrose invertase enzyme. In various embodiments the sucrose in the culture comes from sorghum, sugar beet, sugar cane, molasses, or depolymerized cellulosic material (which may optionally contain lignin). In another aspect, the methods and reagents of the invention significantly increase the number and type of feedstocks that can be utilized by recombinant *Prototheca*. While the microbes exemplified here are altered such that they can utilize sucrose, the methods and reagents of the invention can be applied so that feedstocks such as cellulosics are utilizable by an engineered host microbe of the invention with the ability to secrete cellulases, pectinases, isomerases, or the like, such that the breakdown products of the enzymatic reactions are no longer just simply tolerated but rather utilized as a carbon source by the host.

D. Sequence Determination

A variety of methods may be employed for the identification of gene sequences and amino acid sequences of lipid biosynthetic pathway genes and enzymes. Sequences of polynucleotides (e.g., genomic DNA, cDNA, RNA, PCR-amplified nucleotides) may be determined through sequencing technologies including but not limited to Sanger sequencing, pyrosequencing, sequencing by synthesis, sequencing by oligonucleotide probe ligation, and real time sequencing. One skilled in the art may compare nucleotide sequences to published databases of genomic sequences or expressed sequences. Where a DNA sequence is determined or disclosed, one skilled in the art may compare segments from published exon sequences, or may assemble exon sequences into a reconstructed sequence that does not contain intronic sequences. Sequences of polynucleotides may also be translated into amino acids, peptides, polypeptides or proteins through a variety of methods including but not limited to manual translation or computer-automated translation with bioinformatics software commonly known in the art. Comparison methods of sequenced DNA, RNA, amino acids, peptides, or proteins may include but are not limited to manual evaluation of the sequence or computer-automated sequence comparison and identification using algorithms such as BLAST (Basic Local Alignment Search Tool; Altschul, S. E, et al, (1993)/. *Mol. Biol.* 215:403-410; see also www.ncbi.nlm.nih.gov/BLAST/).

The instant specification teaches partial or complete amino acid and nucleotide sequences encoding one or more particular microbial genes and proteins. The skilled artisan, having the benefit of the sequences as reported herein, may now use all or a portion of the disclosed sequences for purposes known to those skilled in this art.

Genomic DNA from *Chlorella protothecoides* (UTEX 250) was isolated using standard protocols, and sequenced using Illumina HiSeq Paired-End sequencing, with 100 bp reads and approximatgely 450 by fragments. Genomic DNA is prepared using standard protocols and fragmented by hydrodynamic shearing. Sequencing reads were quality trimmed and filtered using FastX tools. Genome data was assembled using Velvet (Zerbino et al, Velvet: algorithms for de novo short read assembly using de Bruijn graphs, Genome Research, May 2008) using an optimized kmer and other default parameters. The assembly resulted in 31619 continuous sequences (SEQ ID NO: 17485-49103). Further sequencing was provided using Illumina HiSeq sequencing (100 bp paired end reads, ~450 bp fragment size) using a Mobio clean-up kit to remove secondary contaminants. Data was analyzed using FastQC. Data was cleaned and de-duplicated using a custom read processing pipeline that removes PCR duplicates, trims ends based on quality scores, and trims problematic 5' regions from reads. Illumina data was assembled using velvet with a minimum coverage cutoff to assemble only plastid components that are present in high-coverage, and with a maximum coverage cutoff that focuses the assembly on lower-coverage components, thus providing an enhanced assembly of the nuclear genome.

Annotation was performed using the MAKER pipeline, and genes and proteins (e.g. SEQ ID NO: 61-17484) were identified by BLAST (NCBI database). Briefly, MAKER runs gene modeling programs SNAP and Augustus, using default HMMs (eukaryotic general and *Chlamydomonas* were used here respectively) and then provides gene models for each gene on the genome. These gene models were further annotated by blasting them against the NCBI nr database to provide functional annotation. Genomic assemblies were further annotated using Augustus with a HMM trained on a *Prototheca* species to provide gene modeling that is closer to the native (*Auxenochlorella*) organism. These gene models were trained through multiple rounds of bootstrapping. Gene models obtained were of generally high quality. These gene models were annotated with BLAST (blastp vs. nr at NCBI, as of November 2013) and Interpro.

Given a gene or transcriptome fragment, one of skill in the art may retreive full-length transcripts (cDNA) or sequence genomic regions using various techniques. RACE (Rapid Amplification of cDNA ends) can be used to obtain a full-length cDNA, given even a short segment of a transcript. RAGE (Rapid Amplification of Genomic Ends) can be used to identify, even given a short segment of a transcript, the flanking genomic regions corresponding to a gene.

A given base position is indicated with a code as shown in the table below.

Base Codes

| | |
|---|---|
| A | Adenine |
| C | Cytosine |
| G | Guanine |
| T (or U) | Thymine (or Uracil) |
| R | A or G |
| Y | C or T |
| S | G or C |
| W | A or T |
| K | G or T |
| M | A or C |
| B | C or G or T |
| D | A or G or T |
| H | A or C or T |
| V | A or C or G |
| N | any base |
| . or - | gap |
| * | stop/nonsense codon |
| ? | unknown amino acid |

In some cases the sequence may contain Ns, representing unknown bases in a gap of size defined by the paired ends. These bases can be filled in by standard gap-filling techniques. N's will be represented as X's and any invalid codons will be represented as question marks ("?") in the translated amino acid sequence.

Section V. Genetically Engineered Cells

In a first aspect, the present invention provides a genetically engineered cell in one or more lipid biosynthesis genes have been modified to increase or decrease expression of such one or more genes such that the fatty acid profile of the genetically engineered strain differs from that of the strain from which it was derived. In one embodiment, at least two genes have been modified. In various embodiments, the genetic modifications include one or more of the following modifications: (i) attenuation of a gene or its enzymatic product; and (ii) increased expression of a gene or its enzymatic product; (iii) altered activity of a gene or its enzymatic product.

In various embodiments, the genetically engineered cell has one or more attenuated genes, wherein the genes attenuated have been attenuated by a means selected from the group consisting of a homologous recombination event and introduction of an exogenous gene that codes for an interfering RNA. In various embodiments, one or more alleles of a gene are attenuated.

In various embodiments, the genetically engineered cell has one or more over-expressed genes, wherein the genes over-expressed have been up-regulated by a means selected from the group consisting of introduction of additional copies of said gene into said cell; introduction of new expression control elements for said gene; and alteration of the protein-coding sequence of the gene. In various embodiments, one or more alleles of a gene are over-expressed.

In various embodiments, the modified genes of the genetically engineered cell are selected from the group consisting of lipid biosynthesis genes presented in Table 1. In various embodiments, the genetically engineered cell comprises an exogenous gene selected from the group consisting of lipid biosynthesis genes presented in Table 1. In various embodiments, the genetically engineered cell comprises one or more over-expressed alleles of a gene, the gene selected from the group consisting of lipid biosynthesis genes presented in Table 1. In various embodiments, the genetically engineered cell has an attenuated gene selected from the group consisting of lipid biosynthesis genes presented in Table 1. In various embodiments, the genetically engineered cell has one or more attenuated alleles of a gene, the gene selected from the group consisting of lipid biosynthesis genes presented in Table 1.

In various embodiments, the genetically engineered cell has one or more overexpressed genes, wherein the expression of the genes have been increased by a means selected from the group consisting of introduction of additional copies of said gene into said cell; and introduction of new expression control elements for said gene. In various embodiments, the overexpressed gene is an exogenous gene.

In various embodiments, the modified genes of the genetically engineered cell are selected from the group consisting of lipid biosynthesis genes presented in Table 1.

In various embodiments, the genetically engineered cell has an up-regulated gene selected from the group consisting of lipid biosynthesis genes presented in Table 1. In various embodiments, the genetically engineered cell has an attenuated gene selected from the group consisting of lipid biosynthesis genes presented in Table 1. In various embodiments, the genetically engineered cell has a fatty acid profile selected from the group consisting of: 3% to 60% C8:0, 3% to 60% C10:0, 3% to 70% C12:0, 3% to 95% C14:0, 3% to 95% C16:0, 3% to 95% C18:0, 3% to 95% C18:1, 3% to 60% C18:2, 1% to 60% C18:3 or combinations thereof. In various embodiments, the ratio of C10:0 to C12:0 is at least 3:1. In some cases, the ratio of C10:0 to C14:0 is at least 10:1. In various embodiments, the genetically engineered cell has a fatty acid profile of at least 40% saturated fatty acids, of at least 60% saturated fatty acids, or at least 85% saturated fatty acids.

The present invention also provides recombinant cells that have been modified to contain one or more exogenous genes encoding lipid biosyntheis enzymes such as, for example, a fatty acyl-ACP thioesterase (see Example 4) or a ketoacyl-ACP synthase II (see Example 5). In some embodiments, genes encoding a fatty acyl-ACP thioesterase and a naturally co-expressed acyl carrier protein are transformed into a *Prototheca* cell, optionally with one or more genes encoding other lipid biosynthesis genes. In other embodiments, the ACP and the fatty acyl-ACP thioesterase may have an affinity for one another that imparts an advantage when the two are used together in the microbes and methods of the present invention, irrespective of whether they are or are not naturally co-expressed in a particular tissue or organism. Thus, the present invention contemplates both naturally co-expressed pairs of these enzymes as well as those that share an affinity for interacting with one another to facilitate cleavage of a length-specific carbon chain from the ACP.

In still other embodiments, an exogenous gene encoding a desaturase is transformed into a cell in conjunction with one or more genes encoding other lipid biosynthesis genes to provide modifications with respect to lipid saturation. In other embodiments, an endogenous desaturase gene is over-expressed (e.g., through the introduction of additonal copies off the gene) in a cell. In some embodiments, the desaturase can be selected with reference to a desired carbon chain length, such that the desaturase is capable of making location specific modifications within a specified carbon-length substrate, or substrates having a carbon-length within a specified range. In another embodiment, if the desired fatty acid profile is an increase in monounsaturates (such as C16:1 and/or C18:1) overexpression of a SAD or expression of a heterologous SAD can be coupled with the silencing or inactivation (e.g., through mutation, RNAi, antisense, or knockout of an endogenous desaturase gene, etc.) of a fatty acyl desaturase (FAD) or another desaturase gene.

In other embodiments, the cell has been modified to have an attenuated endogenous desaturase gene, wherein the attenuation renders the gene or desaturase enzyme inactive. In some cases, the mutated endogenous desaturase gene is a fatty acid desaturase (FAD). In other cases, the mutated endogenous desaturase gene is a stearoyl Acyl carrier protein desaturase (SAD). Example 3 below describes the targeted ablation or knockout of stearoyl-ACP desaturases and delta 12 fatty acid desaturases. Example 3 also describes the use of RNAi or antisense constructs to decrease the expression of an endogenous desaturase gene.

In some cases, it may be advantageous to pair one or more of the genetic engineering techniques in order to achieve a trangenic cell that produces the desired lipid profile. In one embodiment, a cell comprises an attenuated endogenous thioestease gene and one or more exogenous gene. In non-limiting examples, a cell with an attenuated endogenous thioesterase gene can also express an exogenous fatty acyl-ACP thioesterase gene and/or a sucrose invertase gene. Example 4 below describes a transgenic cell containing a targeted ablation or knockout of an endogenous thioesterase and also expresses a *Cuphea wrightii* FatB2 C10:0-C14:0 preferring thioesterase and a sucrose invertase.

In other embodiments, one allele of a lipid biosyntheis gene has been attenuated. In additional embodiments, two or more alleles of a lipid biosyntheis gene have been attenuated. Example 3 below describes the targeted knockout of multiple alleles of stearoyl-ACP desaturase. In some cases, the targeted knockout of different alleles of a gene may result in different effects on fatty acid profiles.

In other embodiments, the targeted knockout gene is located on the plastid genome. This could be paired with one or more genetic engineering techniques targeting the nuclear genome. In non-limiting examples, a cell optinally having an attenuated endogenous thioesterase gene can also express an exogenous fatty acyl-ACP thioesterase gene from within the plastid.

In other embodiments, the targeted knockout gene is located on the plastid genome. This could be paired with one or more genetic engineering techniques targeting the nuclear genome. In non-limiting examples, a cell optinally having an attenuated endogenous thioesterase gene can also express an exogenous fatty acyl-ACP thioesterase gene from within the plastid. Expression of the thioesterase in the plastid increases total copy number (due to presence of multiple plastid organelles per cell) and negates the need for a plastid transit peptide. In this case a preferred method is to use the plastid codon usage table provided herein. The entire plastid sequece for *Auxenochlorella protothecoides*, useful for providing targeting regions and gene targets for overexpression or knockdown, and for comprehensive identification of strain identity, is disclosed in SEQ ID NO: 49118.

Section VI. Microbial Oils

For the production of oil in accordance with the methods of the invention, it is preferable to culture cells in the dark, as is the case, for example, when using extremely large (40,000 liter and higher) fermentors that do not allow light to strike the culture. Species provided herein are grown and propagated for the production of oil in a medium containing a fixed carbon source and in the absence of light; such growth is known as heterotrophic growth.

As an example, an inoculum of lipid-producing microalgal cells are introduced into the medium; there is a lag period (lag phase) before the cells begin to propagate. Following the lag period, the propagation rate increases steadily and enters the log, or exponential, phase. The exponential phase is in turn followed by a slowing of propagation due to decreases in nutrients such as nitrogen, increases in toxic substances, and quorum sensing mechanisms. After this slowing, propagation stops, and the cells enter a stationary phase or steady growth state, depending on the particular environment provided to the cells. For obtaining lipid rich biomass, the culture is typically harvested well after then end of the exponential phase, which may be terminated early by allowing nitrogen or another key nutrient (other than carbon) to become depleted, forcing the cells to convert the carbon sources, present in excess, to lipid. Culture condition parameters can be manipulated to optimize total oil production, the combination of lipid species produced, and/or production of a specific oil.

As discussed above, a bioreactor or fermenter is used to allow cells to undergo the various phases of their growth cycle. As an example, an inoculum of lipid-producing cells can be introduced into a medium followed by a lag period (lag phase) before the cells begin growth. Following the lag period, the growth rate increases steadily and enters the log, or exponential, phase. The exponential phase is in turn followed by a slowing of growth due to decreases in nutrients and/or increases in toxic substances. After this slowing, growth stops, and the cells enter a stationary phase or steady state, depending on the particular environment provided to the cells. Lipid production by cells disclosed herein can occur during the log phase or thereafter, including the stationary phase wherein nutrients are supplied, or still available, to allow the continuation of lipid production in the absence of cell division.

Preferably, microorganisms grown using conditions described herein and known in the art comprise at least about 20% by weight of lipid, preferably at least about 40% by weight, more preferably at least about 50% by weight, and most preferably at least about 60% by weight. Process conditions can be adjusted to increase the yield of lipids suitable for a particular use and/or to reduce production cost. For example, in certain embodiments, a microalgae is cultured in the presence of a limiting concentration of one or more nutrients, such as, for example, nitrogen, phosphorous, or sulfur, while providing an excess of fixed carbon energy such as glucose. Nitrogen limitation tends to increase microbial lipid yield over microbial lipid yield in a culture in which nitrogen is provided in excess. In particular embodiments, the increase in lipid yield is at least about: 10%, 50%, 100%, 200%, or 500%. The microbe can be cultured in the presence of a limiting amount of a nutrient for a portion of the total culture period or for the entire period. In particular embodiments, the nutrient concentration is cycled between a limiting concentration and a non-limiting concentration at least twice during the total culture period. Lipid content of cells can be increased by continuing the culture for increased periods of time while providing an excess of carbon, but limiting or no nitrogen.

In another embodiment, lipid yield is increased by culturing a lipid-producing microbe (e.g., microalgae) in the presence of one or more cofactor(s) for a lipid pathway enzyme (e.g., a fatty acid synthetic enzyme). Generally, the concentration of the cofactor(s) is sufficient to increase microbial lipid (e.g., fatty acid) yield over microbial lipid yield in the absence of the cofactor(s). In a particular embodiment, the cofactor(s) are provided to the culture by including in the culture a microbe (e.g., microalgae) containing an exogenous gene encoding the cofactor(s). Alternatively, cofactor(s) may be provided to a culture by including a microbe (e.g., microalgae) containing an exogenous gene that encodes a protein that participates in the synthesis of the cofactor. In certain embodiments, suitable cofactors include any vitamin required by a lipid pathway enzyme, such as, for example: biotin, pantothenate. Genes encoding cofactors suitable for use in the invention or that participate in the synthesis of such cofactors are well known and can be introduced into microbes (e.g., microalgae), using constructs and techniques such as those described above.

The specific examples of bioreactors, culture conditions, and heterotrophic growth and propagation methods described herein can be combined in any suitable manner to improve efficiencies of microbial growth and lipid and/or protein production.

Microalgal biomass with a high percentage of oil/lipid accumulation by dry weight has been generated using different methods of culture, which are known in the art (see PCT Pub. No. WO 2008/151149). Microalgal biomass generated by the culture methods described herein and useful in accordance with the present invention comprises at least 10% microalgal oil by dry weight. In some embodiments, the microalgal biomass comprises at least 25%, at least 50%, at least 55%, or at least 60% microalgal oil by dry weight. In some embodiments, the microalgal biomass contains from 10-90% microalgal oil, from 25-75%

The microalgal oil of the biomass described herein, or extracted from the biomass for use in the methods and compositions of the present invention can comprise glycerolipids with one or more distinct fatty acid ester side chains. Glycerolipids are comprised of a glycerol molecule esterified to one, two or three fatty acid molecules, which can be of varying lengths and have varying degrees of saturation. The length and saturation characteristics of the fatty acid molecules (and the microalgal oils) can be manipulated to modify the properties or proportions of the fatty acid molecules in the microalgal oils of the present invention via culture conditions or via lipid pathway engineering, as described in more detail in Section IV, below. Thus, specific blends of algal oil can be prepared either within a single species of algae by mixing together the biomass or algal oil from two or more species of microalgae, or by blending algal oil of the invention with oils from other sources such as soy, rapeseed, canola, palm, palm kernel, coconut, corn, waste vegetable, Chinese tallow, olive, sunflower, cottonseed, chicken fat, beef tallow, porcine tallow, microalgae, macroalgae, microbes, *Cuphea*, flax, peanut, choice white grease, lard, Camelina sativa, mustard seed, cashew nut, oats, lupine, kenaf, calendula, help, coffee, linseed (flax), hazelnut, euphorbia, pumpkin seed, coriander, camellia, sesame, safflower, rice, tung tree, cocoa, copra, pium poppy, castor beans, pecan, jojoba, macadamia, Brazil nuts, avocado, petroleum, or a distillate fraction of any of the preceding oils.

The oil composition, i.e., the properties and proportions of the fatty acid constituents of the glycerolipids, can also be manipulated by combining biomass or oil from at least two distinct species of microalgae. In some embodiments, at least two of the distinct species of microalgae have different glycerolipid profiles. The distinct species of microalgae can be cultured together or separately as described herein, preferably under heterotrophic conditions, to generate the respective oils. Different species of microalgae can contain different percentages of distinct fatty acid constituents in the cell's glycerolipids Generally, *Prototheca* strains have very little or no fatty acids with the chain length C8-C14. For example, *Prototheca moriformis* (UTEX 1435), *Prototheca krugani* (UTEX 329), *Prototheca stagnora* (UTEX 1442) and *Prototheca zopfli* (UTEX 1438) contains no (or undetable amounts) C8 fatty acids, between 0-0.01% C10 fatty acids, between 0.03-2.1% C12 fatty acids and between 1.0-1.7% C14 fatty acids.

Microalgal oil can also include other constituents produced by the microalgae, or incorporated into the microalgal oil from the culture medium. These other constituents can be present in varying amount depending on the culture conditions used to culture the microalgae, the species of microalgae, the extraction method used to recover microalgal oil from the biomass and other factors that may affect microalgal oil composition. Non-limiting examples of such constituents include carotenoids, present from 0.025-0.3 mcg/g, preferably from 0.05 to 0.244 micrograms/gram, of oil; chlorophyll A present from 0.025-0.3 mcg/g, preferably from 0.045 to 0.268 micrograms/gram, of oil; total chlorophyll of less than 0.03 mcg/g, preferably less than 0.025 micrograms/gram, of oil; gamma tocopherol present from 35-175 mcg/g, preferably from 38.3-164 micrograms/gram, of oil; total tocopherols present from 50-300 mcg/g, preferably from 60.8 to 261.7 microgram/gram, of oil; less than 0.5%, preferably less than 0.25%, brassicasterol, campesterol, stigmasterol, or betasitosterol; total tocotrienols less than 300 micrograms/gram of oil; and total tocotrienols present from 225-350 mcg/g, preferably from 249.6 to 325.3 micrograms/gram, of oil.

Other constituents can include, without limitation, phospholipids, tocopherols, tocotrienols, carotenoids (e.g., alpha-carotene, beta-carotene, lycopene, etc.), xanthophylls (e.g., lutein, zeaxanthin, alpha-cryptoxanthin and beta-crytoxanthin), and various organic or inorganic compounds. In some cases, the oil extracted from a species provided herein comprises between 0.001 to 0.05, preferably from 0.003 to 0.039, microgram lutein/gram of oil, less than 0.005, preferably less than 0.003, micrograms lycopene/gram of oil; and less than 0.005, preferably less than 0.003, microgram beta carotene/gram of oil.

In one aspect, the present invention provides methods for obtaining microbial oil comprising culturing a genetically engineered cell under conditions such that oil is produced. In various embodiments, the microbial oil has a fatty acid profile selected from the group consisting of: 3% to 60% C8:0, 3% to 60% C10:0, 3% to 60% C12:0, 3% to 95% C14:0, 3% to 95% C16:0, 3% to 95% C18:0, 3% to 95% C18:1, 3% to 60% C18:2, 1% to 60% C18:3 or combinations thereof. In various embodiments, the ratio of C10:0 to C12:0 is at least 3:1. In some cases, the ratio of C10:0 to C14:0 is at least 10:1. In various embodiments, the genetically engineered cell has a fatty acid profile of at least 40% saturated fatty acids, of at least 60% saturated fatty acids, or at least 85% saturated fatty acids.

In another aspect, the present invention provides microbial oils and foods, fuels, and chemicals containing said oil or a chemical derived therefrom.

The oils produced according to the above methods in some cases are made using a microalgal host cell. As described above, the microalga can be, without limitation, fall in the classification of Chlorophyta, Trebouxiophyceae, Chlorellales, Chlorellaceae, or Chlorophyceae. It has been found that microalgae of Trebouxiophyceae can be distinguished from vegetable oils based on their sterol profiles. Oil produced by *Chlorella protothecoides* was found to produce sterols that appeared to be brassicasterol, ergosterol, campesterol, stigmasterol, and β-sitosterol, when detected by GC-MS. However, it is believed that all sterols produced by *Chlorella* have C24β stereochemistry. Thus, it is believed that the molecules detected as campesterol, stigmasterol, and β-sitosterol, are actually 22,23-dihydrobrassicasterol, proferasterol and clionasterol, respectively. Thus, the oils produced by the microalgae described above can be distinguished from plant oils by the presence of sterols with C24β stereochemistry and the absence of C24α stereochemistry in the sterols present. For example, the oils produced may contain 22,23-dihydrobrassicasterol while lacking campesterol; contain clionasterol, while lacking in β-sitosterol, and/or contain poriferasterol while lacking stigmasterol. Alternately, or in addition, the oils may contain significant amounts of $\Delta^7$-poriferasterol.

In one embodiment, the oils provided herein are not vegetable oils. Vegetable oils are oils extracted from plants and plant seeds. Vegetable oils can be distinguished from the non-plant oils provided herein on the basis of their oil content. A variety of methods for analyzing the oil content can be employed to determine the source of the oil or whether adulteration of an oil provided herein with an oil of a different (e.g. plant) origin has occurred. The determination can be made on the basis of one or a combination of the analytical methods. These tests include but are not limited to analysis of one or more of free fatty acids, fatty acid profile, total triacylglycerol content, diacylglycerol content, peroxide values, spectroscopic properties (e.g. UV absorption), sterol profile, sterol degradation products, antioxidants (e.g. tocopherols), pigments (e.g. chlorophyll), d13C values and sensory analysis (e.g. taste, odor, and mouth feel). Many such tests have been standardized for commercial oils such as the Codex Alimentarius standards for edible fats and oils.

Sterol profile analysis is a particularly well-known method for determining the biological source of organic matter. Campesterol, b-sitosterol, and stigamsterol are common plant sterols, with b-sitosterol being a principle plant sterol. For example, b-sitosterol was found to be in greatest abundance in an analysis of certain seed oils, approximately 64% in corn, 29% in rapeseed, 64% in sunflower, 74% in cottonseed, 26% in soybean, and 79% in olive oil (Gul et al. J. Cell and Molecular Biology 5:71-79, 2006).

Oil isolated from *Prototheca moriformis* strain UTEX1435 were separately clarified (CL), refined and bleached (RB), or refined, bleached and deodorized (RBD) and were tested for sterol content according to the procedure described in JAOCS vol. 60, no. 8, August 1983. Results of the analysis are shown below (units in mg/100 g):

| | Sterol | Crude | Clarified | Refined & bleached | Refined, bleached, & deodorized |
|---|---|---|---|---|---|
| 1 | Ergosterol | 384 (56%) | 398 (55%) | 293 (50%) | 302 (50%) |
| 2 | 5,22-cholestadien-24-methyl-3-ol (Brassicasterol) | 14.6 (2.1%) | 18.8 (2.6%) | 14 (2.4%) | 15.2 (2.5%) |
| 3 | 24-methylcholest-5-en-3-ol (Campersterol or 22,23-dihydrobrassicasterol) | 10.7 (1.6%) | 11.9 (1.6%) | 10.9 (1.8%) | 10.8 (1.8%) |
| 4 | 5,22-cholestadien-24-ethyl-3-ol (Stigmaserol or poriferasterol) | 57.7 (8.4%) | 59.2 (8.2%) | 46.8 (7.9%) | 49.9 (8.3%) |
| 5 | 24-ethylcholest-5-en-3-ol (β-Sitosterol or clionasterol) | 9.64 (1.4%) | 9.92 (1.4%) | 9.26 (1.6%) | 10.2 (1.7%) |
| 6 | Other sterols | 209 | 221 | 216 | 213 |
| | Total sterols | 685.64 | 718.82 | 589.96 | 601.1 |

These results show three striking features. First, ergosterol was found to be the most abundant of all the sterols, accounting for about 50% or more of the total sterols. The amount of ergosterol is greater than that of campesterol, β-sitosterol, and stigamsterol combined. Ergosterol is steroid commonly found in fungus and not commonly found in plants, and its presence particularly in significant amounts serves as a useful marker for non-plant oils. Secondly, the oil was found to contain brassicasterol. With the exception of rapeseed oil, brassicasterol is not commonly found in plant based oils. Thirdly, less than 2% β-sitosterol was found to be present. β-sitosterol is a prominent plant sterol not commonly found in microalgae, and its presence particularly in significant amounts serves as a useful marker for oils of plant origin. In summary, *Prototheca moriformis* strain UTEX1435 has been found to contain both significant amounts of ergosterol and only trace amounts of β-sitosterol as a percentage of total sterol content. Accordingly, the ratio of ergosterol: β-sitosterol or in combination with the presence of brassicasterol can be used to distinguish this oil from plant oils.

In some embodiments, the oil content of an oil provided herein contains, as a percentage of total sterols, less than 20%, 15%, 10%, 5%, 4%, 3%, 2%, or 1% β-sitosterol. In other embodiments the oil is free from β-sitosterol.

In some embodiments, the oil is free from one or more of β-sitosterol, campesterol, or stigmasterol. In some embodiments the oil is free from β-sitosterol, campesterol, and stigmasterol. In some embodiments the oil is free from campesterol. In some embodiments the oil is free from stigmasterol.

In some embodiments, the oil content of an oil provided herein comprises, as a percentage of total sterols, less than 20%, 15%, 10%, 5%, 4%, 3%, 2%, or 1% 24-ethylcholest-5-en-3-ol. In some embodiments, the 24-ethylcholest-5-en-3-ol is clionasterol. In some embodiments, the oil content of an oil provided herein comprises, as a percentage of total sterols, at least 1%, 2%, 3%, 4%, 5%, 6%, 7%, 8%, 9%, or 10% clionasterol.

In some embodiments, the oil content of an oil provided herein contains, as a percentage of total sterols, less than 20%, 15%, 10%, 5%, 4%, 3%, 2%, or 1% 24-methylcholest-5-en-3-ol. In some embodiments, the 24-methylcholest-5-en-3-ol is 22,23-dihydrobrassicasterol. In some embodiments, the oil content of an oil provided herein comprises, as a percentage of total sterols, at least 1%, 2%, 3%, 4%, 5%, 6%, 7%, 8%, 9%, or 10% 22,23-dihydrobrassicasterol.

In some embodiments, the oil content of an oil provided herein contains, as a percentage of total sterols, less than 20%, 15%, 10%, 5%, 4%, 3%, 2%, or 1% 5,22-cholestadien-24-ethyl-3-ol. In some embodiments, the 5,22-cholestadien-24-ethyl-3-ol is poriferasterol. In some embodiments, the oil content of an oil provided herein comprises, as a percentage of total sterols, at least 1%, 2%, 3%, 4%, 5%, 6%, 7%, 8%, 9%, or 10% poriferasterol.

In some embodiments, the oil content of an oil provided herein contains ergosterol or brassicasterol or a combination of the two. In some embodiments, the oil content contains, as a percentage of total sterols, at least 5%, 10%, 20%, 25%, 35%, 40%, 45%, 50%, 55%, 60%, or 65% ergosterol. In some embodiments, the oil content contains, as a percentage of total sterols, at least 25% ergosterol. In some embodiments, the oil content contains, as a percentage of total sterols, at least 40% ergosterol. In some embodiments, the oil content contains, as a percentage of total sterols, at least 5%, 10%, 20%, 25%, 35%, 40%, 45%, 50%, 55%, 60%, or 65% of a combination of ergosterol and brassicasterol.

In some embodiments, the oil content contains, as a percentage of total sterols, at least 1%, 2%, 3%, 4% or 5% brassicasterol. In some embodiments, the oil content contains, as a percentage of total sterols less than 10%, 9%, 8%, 7%, 6%, or 5% brassicasterol.

In some embodiments the ratio of ergosterol to brassicasterol is at least 5:1, 10:1, 15:1, or 20:1.

In some embodiments, the oil content contains, as a percentage of total sterols, at least 5%, 10%, 20%, 25%, 35%, 40%, 45%, 50%, 55%, 60%, or 65% ergosterol and less than 20%, 15%, 10%, 5%, 4%, 3%, 2%, or 1% β-sitosterol. In some embodiments, the oil content contains, as a percentage of total sterols, at least 25% ergosterol and less than 5% β-sitosterol. In some embodiments, the oil content further comprises brassicasterol.

Sterols contain from 27 to 29 carbon atoms (C27 to C29) and are found in all eukaryotes. Animals exclusively make C27 sterols as they lack the ability to further modify the C27 sterols to produce C28 and C29 sterols. Plants however are able to synthesize C28 and C29 sterols, and C28/C29 plant sterols are often referred to as phytosterols. The sterol profile of a given plant is high in C29 sterols, and the primary sterols in plants are typically the C29 sterols b-sitosterol and stigmasterol. In contrast, the sterol profile of non-plant organisms contain greater percentages of C27 and C28 sterols. For example the sterols in fungi and in many microalgae are principally C28 sterols. The sterol profile and particularly the striking predominance of C29 sterols over C28 sterols in plants has been exploited for determining the proportion of plant and marine matter in soil samples (Huang, Wen-Yen, Meinschein W. G., "Sterols as ecological indicators"; Geochimica et Cosmochimia Acta. Vol 43. pp 739-745).

In some embodiments the primary sterols in the microalgal oils provided herein are sterols other than b-sitosterol and stigmasterol. In some embodiments of the microalgal oils, C29 sterols make up less than 50%, 40%, 30%, 20%, 10%, or 5% by weight of the total sterol content.

In some embodiments the microalgal oils provided herein contain C28 sterols in excess of C29 sterols. In some embodiments of the microalgal oils, C28 sterols make up greater than 50%, 60%, 70%, 80%, 90%, or 95% by weight of the total sterol content. In some embodiments the C28 sterol is ergosterol. In some embodiments the C28 sterol is brassicasterol.

Section VII. Nucleic Acids

In one aspect, the present invention provides recombinant nucleic acids useful in methods for making genetically modified *Prototheca* and other cells. The nucleic acids of the invention comprise all or some portion of a coding sequence of a *C. prototheocoides* lipid biosynthesis gene.

In various embodiments, these nucleic acids include expression cassettes, which consist of a coding sequence and control sequences that regulate expression of the coding sequence, which may code for an mRNA that encodes a lipid biosynthesis enzyme or for an RNAi that acts to suppress expression of a fatty acid biosynthesis gene.

In other embodiments, these nucleic acids are expression vectors that include one or more expression cassettes and stably replicate in a *Prototheca* or other host cell, either by integration into chromosomal DNA of the host cell or as freely replicating vectors.

In other embodiments, these nucleic acids comprise only a portion of a *Prototheca* lipid biosynthesis gene, which portion may be a portion of a coding sequence, an exon, or a control element. Such nucleic acids are useful in the construction of expression cassettes for *Prototheca* and non-*Prototheca* host cells, for integration of exogenous DNA into *Prototheca* host cells, and for construction of nucleic acids useful for inactivating *Prototheca* fatty acid biosynthetic genes by homologous recombination.

EXAMPLES

Example 1

Methods for Culturing *Prototheca*

The methods below can be used to culture *Auxenochlorella* or *Prothetheca* strains. For example, *Prototheca* strains were cultivated to achieve a high percentage of oil by dry cell weight. Cryopreserved cells were thawed at room temperature and 500 ul of cells were added to 4.5 ml of medium (4.2 g/L $K_2HPO_4$, 3.1 g/L $NaH_2PO_4$, 0.24 g/L $MgSO_4.7H_2O$, 0.25 g/L Citric Acid monohydrate, 0.025 g/L $CaCl_2$ $2H_2O$, 2 g/L yeast extract) plus 2% glucose and grown for 7 days at 28° C. with agitation (200 rpm) in a 6-well plate. Dry cell weights were determined by centrifuging 1 ml of culture at 14,000 rpm for 5 min in a pre-weighed Eppendorf tube. The culture supernatant was discarded and the resulting cell pellet washed with 1 ml of deionized water. The culture was again centrifuged, the supernatant discarded, and the cell pellets placed at −80° C. until frozen. Samples were then lyophilized for 24 hrs and dry cell weights calculated. For determination of total lipid in cultures, 3 ml of culture was removed and subjected to analysis using an Ankom system (Ankom Inc., Macedon, N.Y.) according to the manufacturer's protocol. Samples were subjected to solvent extraction with an Amkom XT10 extractor according to the manufacturer's protocol. Total lipid was determined as the difference in mass between acid hydrolyzed dried samples and solvent extracted, dried samples. Percent oil dry cell weight measurements are shown in Table 6.

TABLE 6

Percent oil by dry cell weight

| Species | Strain | % Oil |
|---|---|---|
| Prototheca stagnora | UTEX 327 | 13.14 |
| Prototheca moriformis | UTEX 1441 | 18.02 |
| Prototheca moriformis | UTEX 1435 | 27.17 |

Microalgae samples from multiple strains from the genus *Prototheca* were genotyped. Genomic DNA was isolated from algal biomass as follows. Cells (approximately 200 mg) were centifuged from liquid cultures 5 minutes at 14,000×g. Cells were then resuspended in sterile distilled water, centrifuged 5 minutes at 14,000×g and the supernatant discarded. A single glass bead ~2 mm in diameter was added to the biomass and tubes were placed at −80° C. for at least 15 minutes. Samples were removed and 150 µl of grinding buffer (1% Sarkosyl, 0.25 M Sucrose, 50 mM NaCl, 20 mM EDTA, 100 mM Tris-HCl, pH 8.0, RNase A 0.5 ug/ul) was added. Pellets were resuspended by vortexing briefly, followed by the addition of 40 ul of 5M NaCl. Samples were vortexed briefly, followed by the addition of 66 µl of 5% CTAB (Cetyl trimethylammonium bromide) and a final brief vortex. Samples were next incubated at 65° C. for 10 minutes after which they were centrifuged at 14,000×g for 10 minutes. The supernatant was transferred to a fresh tube and extracted once with 300 µl of Phenol:Chloroform:Isoamyl alcohol 12:12:1, followed by centrifugation for 5 minutes at 14,000×g. The resulting aqueous phase was transferred to a fresh tube containing 0.7 vol of isopropanol (~190 µl), mixed by inversion and incubated at room temperature for 30 minutes or overnight at 4° C. DNA was recovered via centrifugation at 14,000×g for 10 minutes. The resulting pellet was then washed twice with 70% ethanol, followed by a final wash with 100% ethanol. Pellets were air dried for 20-30 minutes at room temperature followed by resuspension in 50 µl of 10 mM TrisCl, 1 mM EDTA (pH 8.0).

Five µl of total algal DNA, prepared as described above, was diluted 1:50 in 10 mM Tris, pH 8.0. PCR reactions, final volume 20 µl, were set up as follows. Ten µl of 2× iProof HF master mix (BIO-RAD) was added to 0.4 µl primer SZ02613 (5'-TGTTGAAGAATGAGCCGGCGAC-3') (SEQ ID NO: 49105) at 10 mM stock concentration. This primer sequence runs from position 567-588 in GenBank accession no. L43357 and is highly conserved in higher plants and algal plastid genomes. This was followed by the addition of 0.4 µl primer SZ02615 (5'-CAGTGAGCTATTACGCACTC-3') (SEQ ID NO:49106) at 10 mM stock concentration. This primer sequence is complementary to position 1112-1093 in GenBank accession no. L43357 and is highly conserved in higher plants and algal plastid genomes. Next, 5 µl of diluted total DNA and 3.2 µl $dH_2O$ were added. PCR reactions were run as follows: 98° C., 45"; 98° C., 8"; 53° C., 12"; 72° C., 20" for 35 cycles followed by 72° C. for 1 min and holding at 25° C. For purification of PCR products, 20 µl of 10 mM Tris, pH 8.0, was added to each reaction, followed by extraction with 40 μl of Phenol:Chloroform:isoamyl alcohol 12:12:1, vortexing and centrifuging at 14,000×g for 5 minutes. PCR reactions were applied to S-400 columns (GE Healthcare) and centrifuged for 2 minutes at 3,000×g. Purified PCR products were subsequently TOPO cloned into PCR8/GW/TOPO and positive clones selected for on LB/Spec plates. Purified plasmid DNA was sequenced in both directions using M13 forward and reverse primers. In total, twelve *Prototheca* strains were selected to have their 23S rRNA DNA sequenced and the sequences are listed in the Sequence Listing. A summary of the strains and Sequence Listing Numbers is included below. The sequences were analyzed for overall divergence from the UTEX 1435 (SEQ ID NO: 5) sequence. Two pairs emerged (UTEX 329/UTEX 1533 and UTEX 329/UTEX 1440) as the most divergent. In both cases, pairwise alignment resulted in 75.0% pairwise sequence identity. The percent sequence identity to UTEX 1435 is also included below:

| Species | Strain | % nt identity | SEQ ID NO. |
|---|---|---|---|
| *A. prototheocoides* | UTEX 250 | 88.7 | SEQ ID NO: 60 |
| *Prototheca kruegani* | UTEX 329 | 75.2 | SEQ ID NO: 1 |
| *Prototheca wickerhamii* | UTEX 1440 | 99 | SEQ ID NO: 2 |
| *Prototheca stagnora* | UTEX 1442 | 75.7 | SEQ ID NO: 3 |
| *Prototheca moriformis* | UTEX 288 | 75.4 | SEQ ID NO: 4 |
| *Prototheca moriformis* | UTEX 1439; 1441; 1435; 1437 | 100 | SEQ ID NO: 5 |
| *Prototheca wikerhamii* | UTEX 1533 | 99.8 | SEQ ID NO: 6 |
| *Prototheca moriformis* | UTEX 1434 | 75.9 | SEQ ID NO: 7 |
| *Prototheca zopfii* | UTEX 1438 | 75.7 | SEQ ID NO: 8 |
| *Prototheca moriformis* | UTEX 1436 | 88.9 | SEQ ID NO: 9 |

Two other highly conserved plastid regions are the Accd and cyst gene which can be used for phylogenetic comparison. The sequences for these two genes are listed under sequence ID 49109 and 49110 and 49119-49125. They have been observed in all members of the genus *Prototheca* sequenced. The percent sequence identity to UTEX 250 is also included below:

| Species | Strain | % nt identity | SEQ ID NO. |
|---|---|---|---|
| *A prothecoides* | UTEX 250 | 100 | SEQ ID NO: 49119 |
| *zopfii* | SAG 263.7 | 71.5 | SEQ ID NO: 49120 |
| *blaschkaea* | SAG 2064 | 73.5 | SEQ ID NO: 49121 |
| *zopfii* | SAG 263-4 | 73.8 | SEQ ID NO: 49122 |
| *wickerhamii* | SAG 263-11 | 88.2 | SEQ ID NO: 49123 |
| *stagnora* | CBS 605.66 | 75.3 | SEQ ID NO: 49124 |
| *moriformis* | UTEX 376 | 84.5 | SEQ ID NO: 49125 |

Lipid samples from a subset of the above-listed strains were analyzed for fatty acid profile using HPLC. Results are shown below in Table 7.

TABLE 7

Diversity of fatty acid chains in *Prototheca* species

| Strain | C14:0 | C16:0 | C16:1 | C18:0 | C18:1 | C18:2 | C18:3 | C20:0 | C20:1 |
|---|---|---|---|---|---|---|---|---|---|
| *Auxenochlorella prototheocoides* UTEX 250 | 1.07 | 14.82 | | 2.65 | 66.46 | 12.18 | 1.34 | | |
| UTEX 327 | 0 | 12.01 | 0 | 0 | 50.33 | 17.14 | 0 | 0 | 0 |
| UTEX 1441 | 1.41 | 29.44 | 0.70 | 3.05 | 57.72 | 12.37 | 0.97 | 0.33 | 0 |
| UTEX 1435 | 1.09 | 25.77 | 0 | 2.75 | 54.01 | 11.90 | 2.44 | 0 | 0 |

Oil extracted from *Prototheca moriformis* UTEX 1435 (via solvent extraction or using an expeller press) was analyzed for carotenoids, chlorophyll, tocopherols, other sterols and tocotrienols. The results are summarized below in Table 8.

TABLE 8

Carotenoid, chlorophyll, tocopherol/sterols and tocotrienol analysis in oil extracted from *Prototheca moriformis* (UTEX 1435).

| | Pressed oil (mcg/ml) | Solvent extracted oil (mcg/ml) |
|---|---|---|
| cis-Lutein | 0.041 | 0.042 |
| trans-Lutein | 0.140 | 0.112 |
| trans-Zeaxanthin | 0.045 | 0.039 |
| cis-Zeaxanthin | 0.007 | 0.013 |
| t-alpha-Crytoxanthin | 0.007 | 0.010 |
| t-beta-Crytoxanthin | 0.009 | 0.010 |
| t-alpha-Carotene | 0.003 | 0.001 |
| c-alpha-Carotene | none detected | none detected |
| t-beta-Carotene | 0.010 | 0.009 |
| 9-cis-beta-Carotene | 0.004 | 0.002 |
| Lycopene | none detected | none detected |
| Total Carotenoids | 0.267 | 0.238 |
| Chlorophyll | <0.01 mg/kg | <0.01 mg/kg |
| Tocopherols and Sterols | | |
| | Pressed oil (mg/100 g) | Solvent extracted oil (mg/100 g) |
| gamma Tocopherol | 0.49 | 0.49 |
| Campesterol | 6.09 | 6.05 |
| Stigmasterol | 47.6 | 47.8 |
| Beta-sitosterol | 11.6 | 11.5 |
| Other sterols | 445 | 446 |
| Tocotrienols | | |
| | Pressed oil (mg/g) | Solvent extracted oil (mg/g) |
| alpha Tocotrienol | 0.26 | 0.26 |
| beta Tocotrienol | <0.01 | <0.01 |
| gamma Tocotrienol | 0.10 | 0.10 |
| detal Tocotrienol | <0.01 | <0.01 |
| Total Tocotrienols | 0.36 | 0.36 |

Oil extracted from *Prototheca moriformis*, from four separate lots, was refined and bleached using standard vegetable oil processing methods. Briefly, crude oil extracted from *Prototheca moriformis* was clarified in a horizontal decanter, where the solids were separated from the oil. The clarified oil was then transferred to a tank with citric acid and water and left to settle for approximately 24 hours. After 24 hours, the mixture in the tank formed 2 separate layers. The bottom layer was composed of water and gums that were then removed by decantation prior to transferring the degummed oil into a bleaching tank. The oil was then heated along with another dose of citric acid. Bleaching clay was then added to the bleaching tank and the mixture was further heated under vacuum in order to evaporate off any water that was present. The mixture was then pumped through a leaf filter in order to remove the bleaching clay. The filtered oil was then passed through a final 5 μm polishing filter and then collected for storage until use. The refined and bleached (RB) oil was then analyzed for carotenoids, chlorophyll, sterols, tocotrienols and tocopherols. The results of these analyses are summarized in Table 9 below. "Nd" denotes none detected and the sensitivity of detection is listed below:

Sensitivity of Detection

Carotenoids (mcg/g) nd=<0.003 mcg/g

Chlorophyll (mcg/g) nd=<0.03 mcg/g

Sterols (%) nd=0.25%

Tocopherols (mcg/g); nd=3 mcg/g

TABLE 9

Carotenoid, chlorophyll, sterols, tocotrienols and tocopherol analysis from refined and bleached *Prototheca moriformis* oil.

| | Lot A | Lot B | Lot C | Lot D |
|---|---|---|---|---|
| Carotenoids (mcg/g) | | | | |
| Lutein | 0.025 | 0.003 | nd | 0.039 |
| Zeaxanthin | nd | nd | nd | nd |
| cis-Lutein/Zeaxanthin | nd | nd | nd | nd |
| trans-alpha-Cryptoxanthin | nd | nd | nd | nd |
| trans-beta-Cryptoxanthin | nd | nd | nd | nd |
| trans-alpha-Carotene | nd | nd | nd | nd |
| cis-alpha-Carotene | nd | nd | nd | nd |
| trans-beta-Carotene | nd | nd | nd | nd |
| cis-beta-Carotene | nd | nd | nd | nd |
| Lycopene | nd | nd | nd | nd |
| Unidentified | 0.219 | 0.066 | 0.050 | 0.026 |
| Total Carotenoids | 0.244 | 0.069 | 0.050 | 0.065 |
| Chlorophyll (mcg/g) | | | | |
| Chlorophyll A | 0.268 | 0.136 | 0.045 | 0.166 |
| Chlorophyll B | nd | nd | nd | nd |
| Total Chlorophyll | 0.268 | 0.136 | 0.045 | 0.166 |
| Sterols (%) | | | | |
| Brassicasterol | nd | nd | nd | nd |
| Campesterol | nd | nd | nd | nd |
| Stigmasterol | nd | nd | nd | nd |
| beta-Sitosterol | nd | nd | nd | nd |
| Total Sterols | nd | nd | nd | nd |
| Tocopherols (mcg/g) | | | | |
| alpha-Tocopherol | 23.9 | 22.8 | 12.5 | 8.2 |
| beta-Tocopherol | 3.72 | nd | nd | nd |
| gamma-Tocopherol | 164 | 85.3 | 43.1 | 38.3 |
| delta-Tocopherol | 70.1 | 31.1 | 18.1 | 14.3 |
| Total Tocopherols | 262 | 139.2 | 73.7 | 60.8 |
| Tocotrienols (mcg/g) | | | | |
| alpha-Tocotrienol | 190 | 225 | 253 | 239 |
| beta-Tocotrienol | nd | nd | nd | nd |
| gamma-Tocotrienol | 47.3 | 60.4 | 54.8 | 60.9 |
| delta-Tocotrienol | 12.3 | 16.1 | 17.5 | 15.2 |
| Total Tocotrienols | 250 | 302 | 325 | 315 |

The same four lots of *Prototheca moriformis* oil was also analyzed for trace elements and the results are summarized below in Table 10.

TABLE 10

Elemental analysis of refined and bleached *Prototheca moriformis* oil.

| | Lot A | Lot B | Lot C | Lot D |
|---|---|---|---|---|
| Elemental Analysis (ppm) | | | | |
| Calcium | 0.08 | 0.07 | <0.04 | 0.07 |
| Phosphorous | <0.2 | 0.38 | <0.2 | 0.33 |
| Sodium | <0.5 | 0.55 | <0.5 | <0.5 |
| Potassium | 1.02 | 1.68 | <0.5 | 0.94 |
| Magnesium | <0.04 | <0.04 | <0.04 | 0.07 |
| Manganese | <0.05 | <0.05 | <0.05 | <0.05 |
| Iron | <0.02 | <0.02 | <0.02 | <0.02 |
| Zinc | <0.02 | <0.02 | <0.02 | <0.02 |
| Copper | <0.05 | <0.05 | <0.05 | <0.05 |
| Sulfur | 2.55 | 4.45 | 2.36 | 4.55 |
| Lead | <0.2 | <0.2 | <0.2 | <0.2 |
| Silicon | 0.37 | 0.41 | 0.26 | 0.26 |
| Nickel | <0.2 | <0.2 | <0.2 | <0.2 |
| Organic chloride | <1.0 | <1.0 | <1.0 | 2.2 |
| Inorganic chloride | <1.0 | <1.0 | <1.0 | <1.0 |
| Nitrogen | 4.4 | 7.8 | 4.2 | 6.9 |
| Lithium | <0.02 | <0.02 | <0.02 | <0.02 |
| Boron | 0.07 | 0.36 | 0.09 | 0.38 |
| Aluminum | — | <0.2 | <0.2 | <0.2 |
| Vanadium | <0.05 | <0.05 | <0.05 | <0.05 |
| Lovibond Color (°L) | | | | |
| Red | 5.0 | 4.3 | 3.2 | 5.0 |
| Yellow | 70.0 | 70.0 | 50.0 | 70.0 |
| Mono & Diglycerides by HPLC (%) | | | | |
| Diglycerides | 1.68 | 2.23 | 1.25 | 1.61 |
| Monoglycerides | 0.03 | 0.04 | 0.02 | 0.03 |
| Free fatty acids (FFA) | 1.02 | 1.72 | 0.86 | 0.83 |
| Soaps | 0 | 0 | 0 | |
| Oxidized and Polymerized Triglycerides | | | | |
| Oxidized Triglycerides (%) | 3.41 | 2.41 | 4.11 | 1.00 |
| Polymerized Triglycerides (%) | 1.19 | 0.45 | 0.66 | 0.31 |
| Peroxide Value (meq/kg) | 0.75 | 0.80 | 0.60 | 1.20 |
| p-Anisidine value (dimensionless) | 5.03 | 9.03 | 5.44 | 20.1 |
| Water and Other Impurities (%) | | | | |
| Karl Fisher Moisture | 0.8 | 0.12 | 0.07 | 0.18 |
| Total polar compounds | 5.02 | 6.28 | 4.54 | 5.23 |
| Unsaponifiable matter | 0.92 | 1.07 | 0.72 | 1.04 |
| Insoluble impurities | <0.01 | <0.01 | 0.01 | <0.01 |
| Total oil (%) | | | | |
| Neutral oil | 98.8 | 98.2 | 99.0 | 98.9 |

Example 2

General Methods for Biolistic Transformation of *Auxenochlorella* or *Prototheca*

Seashell Gold Microcarriers (550 nanometers) were prepared according to the protocol from manufacturer. Plasmid (20 μg) was mixed with 50 μl of binding buffer and 60 μl (30 mg) of S550d gold carriers and incubated in ice for 1 min. Precipitation buffer (100 μl) was added, and the mixture was incubated in ice for another 1 min. After vortexing, DNA-coated particles were pelleted by spinning at 10,000 rpm in an Eppendorf 5415C microfuge for 10 seconds. The gold pellet was washed once with 500 µl of cold 100% ethanol, pelleted by brief spinning in the microfuge, and resuspended with 50 µl of ice-cold ethanol. After a brief (1-2 sec) sonication, 10 µl of DNA-coated particles were immediately transferred to the carrier membrane.

Prototheca strains were grown in proteose medium (2 g/L yeast extract, 2.94 mM NaNO3, 0.17 mM CaCl2.2H2O, 0.3 mM MgSO4.7H$_2$O, 0.4 mM K2HPO4, 1.28 mM KH2PO4, 0.43 mM NaCl) with 2% glucose on a gyratory shaker until it reaches a cell density of 2×10$^6$ cells/ml. The cells were harvested, washed once with sterile distilled water, and resuspended in 50 µl of medium. 1×10$^7$ cells were spread in the center third of a non-selective proteose media plate. The cells were bombarded with the PDS-1000/He Biolistic Particle Delivery system (Bio-Rad). Rupture disks (1350 psi) were used, and the plates are placed 6 cm below the screen/macrocarrier assembly. The cells were allowed to recover at 25° C. for 12-24 h. Upon recovery, the cells were scraped from the plates with a rubber spatula, mixed with 100 µA of medium and spread on plates containing the appropriate antibiotic selection. After 7-10 days of incubation at 25° C., colonies representing transformed cells were visible on the plates. Colonies were picked and spotted on selective (either antibiotic or carbon source) agar plates for a second round of selection.

Example 3

Fatty Acid analysis by Fatty Acid Methyl Ester Detection

Lipid samples were prepared from dried biomass. 20-40 mg of dried biomass was resuspended in 2 mL of 5% H$_2$SO$_4$ in MeOH, and 200 ul of toluene containing an appropriate amount of a suitable internal standard (C19:0) was added. The mixture was sonicated briefly to disperse the biomass, then heated at 70-75° C. for 3.5 hours. 2 mL of heptane was added to extract the fatty acid methyl esters, followed by addition of 2 mL of 6% K$_2$CO$_3$ (aq) to neutralize the acid. The mixture was agitated vigorously, and a portion of the upper layer was transferred to a vial containing Na$_2$SO$_4$ (anhydrous) for gas chromatography analysis using standard FAME Example 4

Altering the Levels of Saturated Fatty Acids in the Microalgae Auxenochlorella protothecoides or Prototheca moriformis A. Decreasing Stearoyl ACP Desaturase and Delta 12 Fatty Acid Desaturase Expression by a Gene Knockout Approach As part of a genomics screen using a bioinformatics based approach based on cDNAs, Illumia transcriptome and Roche 454 sequencing of genomic DNA from Prototheca moriformis (UTEX 1435), as well as Illumina sequencing of genomic DNA from Auxenochlorella protothecoides, two specific groups of genes involved in fatty acid desaturation were identified: stearoyl ACP desaturases (SAD) and delta 12 fatty acid desaturases (Δ12 FAD). Stearoyl ACP desaturase enzymes are part of the lipid synthesis pathway and they function to introduce double bonds into the fatty acyl chains, for example, the synthesis of C18:1 fatty acids from C18:0 fatty acids. Delta 12 fatty acid desaturases are also part of the lipid synthesis pathway and they function to introduce double bonds into already unsaturated fatty acids, for example, the synthesis of C18:2 fatty acids from C18:1 fatty acids. Southern blot analysis using probes based on the two classes of fatty acid desaturase genes identified during the bioinformatics efforts indicated that each class of desaturase genes was likely comprised of multiple family members. Additionally the genes encoding stearoyl ACP desaturases fell into two distinct families. Based on these results, three gene disruption constructs were designed to potentially disrupt multiple gene family members by targeting more highly conserved coding regions within each family of desaturase enzymes.

Three homologous recombination targeting constructs were designed using: (1) highly conserved portions of the coding sequence of delta 12 fatty acid desaturase (d12FAD) family members and (2) two constructs targeting each of the two distinct families of SAD, each with conserved regions of the coding sequences from each family. This strategy would embed a selectable marker gene into these highly conserved coding regions (targeting multiple family members) rather than a classic gene replacement strategy where the homologous recombination would target flanking regions of the targeted gene.

All constructs were introduced into the cells by biolistic transformation using the methods described above and constructs were linearized before being shot into the cells. Transformants were selected on sucrose containing plates/media and changes in lipid profile were assayed using the above-described method. Relevant sequences from each of the three targeting constructs are listed below.

| Description | SEQ ID NO: |
|---|---|
| 5' sequence from coding region of d12FAD targeting construct | SEQ ID NO: 18 |
| 3' sequence from coding region of d12FAD targeting construct | SEQ ID NO: 19 |
| d12FAD targeting construct cDNA sequence | SEQ ID NO: 20 |
| 5' sequence from coding region of SAD2A | SEQ ID NO: 21 |
| 3' sequence from coding region of SAD2A | SEQ ID NO: 22 |
| SAD2A targeting construct cDNA sequence | SEQ ID NO: 23 |
| 5' sequence from coding region os SAD2B | SEQ ID NO: 24 |
| 3' sequence from coding region of SAD2B | SEQ ID NO: 25 |
| SAD2B targeting construct cDNA sequence | SEQ ID NO: 26 |

Representative positive clones from transformations with each of the constructs were picked and the fatty acid profiles for these clones were determined. Lipid samples were prepared from dried biomass from each transformant and fatty acid profiles from these samples were analyzed using standard fatty acid methyl ester gas chromatography flame ionization (FAME GC/FID) detection methods as described in Example 3. The fatty acid profiles (expressed as Area % of total fatty acids) from the transgenic lines arising from transformation are shown in Table 11.

TABLE 11

Fatty acid profiles of desaturase knockouts.

| Fatty Acid | d12FAD KO | SAD2A KO | SAD2B KO | wt UTEX 1435 |
|---|---|---|---|---|
| C8:0 | 0 | 0 | 0 | 0 |
| C10:0 | 0.01 | 0.01 | 0.01 | 0.01 |
| C12:0 | 0.03 | 0.03 | 0.03 | 0.03 |
| C14:0 | 1.08 | 0.985 | 0.795 | 1.46 |
| C16:0 | 24.42 | 25.335 | 23.66 | 29.87 |
| C18:0 | 6.85 | 12.89 | 19.555 | 3.345 |
| C18:1 | 58.35 | 47.865 | 43.115 | 54.09 |
| C18:2 | 7.33 | 10.27 | 9.83 | 9.1 |
| C18:3 alpha | 0.83 | 0.86 | 1 | 0.89 |
| C20:0 | 0.48 | 0.86 | 1.175 | 0.325 |

Each construct had a measurable impact on the desired class of fatty acid and in all three cases C18:0 levels increased markedly, particularly with the two SAD knockouts. Further comparison of multiple clones from the SAD knockouts indicated that the SAD2B knockout lines had significantly greater reductions in C18:1 fatty acids than the C18:1 fatty acid levels observed with the SAD2A knockout lines.

Additional Δ12 FAD knockouts were generated in a *Prototheca moriformis* background using the methods described above. In order to identify potential homologous of Δ12FADs, the following primers were used in order to amplify a genomic region encoding a putative FAD:

Primer 1  5'-TCACTTCATGCCGGCGGTCC-3' SEQ ID NO: 27

Primer 2  5'-GCGCTCCTGCTTGGCTCGAA-3' SEQ ID NO: 28

The sequences resulting from the genomic amplification of *Prototheca moriformis* genomic DNA using the above primers were highly similar, but indicated that multiple genes or alleles of Δ12FADs exist in *Prototheca*.

Based on this result, two gene disruption constructs were designed that sought to inactivate one or more Δ12FAD genes. The strategy would embed a sucrose invertase (suc2 from *S. cerevisiae*) cassette (SEQ ID NO: 29), thus conferring the ability to hydrolyze sucrose as a selectable marker, into highly conserved coding regions rather than use a classic gene replacement strategy. The first construct, termed pSZ1124, contained 5' and 3' genomic targeting sequences flanking a *C. reinhardtii* β-tubulin promoter (SEQ ID NO: 30) driving the expression of the *S. cerevisiae* suc2 gene (SEQ ID NO: 31) and a *Chlorella vulgaris* nitrate reductase 3'UTR (SEQ ID NO: 32). The second construct, termed pSZ1125, contained 5' and 3' genomic targeting sequences flanking a *C. reinhardtii* β-tubulin promoter driving the expression of the *S. cerevisiae* suc2 gene and a *Chlorella vulgaris* nitrate reductase 3'UTR. The relevant sequences of the constructs are listed in the Sequence Listing:

| | |
|---|---|
| *S. cerevisiae* suc2 cassette | SEQ ID NO: 29 |
| pSZ1124 (FAD2B) 5' genomic targeting sequence | SEQ ID NO: 33 |
| pSZ1124 (FAD2B) 3' genomic targeting sequence | SEQ ID NO: 34 |
| pSZ1125 (FAD2C) 5' genomic targeting sequence | SEQ ID NO: 35 |
| pSZ1125 (FAD2C) 3' genomic targeting sequence | SEQ ID NO: 36 | pSZ1124 and pSZ1125 were each introduced into a *Prototheca moriformis* background. Positive clones were selected based on the ability to hydrolyze sucrose. Table 12 summarizes the fatty acid profiles (in Area %, generated using methods described above) obtained in two transgenic lines in which pSZ1124 and pSZ1125 targeting vectors were utilized.

expected to decrease, only decreased by about one area %. However, the C18:1 fatty acid levels increased significantly, almost exclusively at the expense of the C16:0 levels, which decreased significantly. The transgenic containing the FAD2C (pSZ1125) construct also gave a change in lipid profile: the levels of C18:2 are reduced significantly along with a corresponding increase in C18:1 levels.

B. RNA Hairpin Approach to Down-Regulation of Delta 12 Desaturase (FADc) in *Auxenochlorella* or *Prototheca* Cells Vectors constructed to down-regulate FADc (delta 12 desaturase gene) gene expression by long hairpin RNAs were introduced into a *Prototheca moriformis* UTEX 1435 genetic background. The *Saccharomyces cerevisiae* suc2 sucrose invertase gene was utilized as a selectable marker, conferring the ability to grow on sucrose as a sole-carbon source to positive clones, and two types of constructs were used. The first type of construct utilized a portion of the first exon of the FADc coding region linked in cis to its first intron followed by a repeat unit of the first exon in reverse orientation. This type of construct was designed to form a hairpin when expressed as mRNA. Two constructs of this first type were created, one driven by the *Prototheca moriformis* Amt03 promoter (SEQ ID NO:37), termed pSZ1468, and a second driven by the *Chlamydomonas reinhardtii* β-tubulin promoter (SEQ ID NO:30), termed pSZ1469. The second type of construct utilized the large FADc exon 2 in the antisense orientation driven by either the *Prototheca moriformis* Amt03 promoter (SEQ ID NO:37), termed pSZ1470, or driven by the *Chlamydomonas reinhardtii* β-tubulin promoter (SEQ ID NO:30), termed pSZ1471. All four constructs had a *S. cerevisiae* suc2 sucrose invertase cassette (SEQ ID NO:29) and a 5' (SEQ ID NO:38) and 3' (SEQ ID NO:39) homologous recombination targeting sequences (flanking the construct) to the 6S genomic region for integration into the nuclear genome. Sequences of the FADc portions of each long hairpin RNA construct along with the relevant portions of each construct are listed in the Sequence Listing as:

| Description | SEQ ID NO: |
|---|---|
| pSZ1468 FADc RNA hairpin cassette | SEQ ID NO: 40 |
| Relevant portions of the pSZ1468 construct | SEQ ID NO: 41 |
| pSZ1469 FADc RNA hairpin cassette | SEQ ID NO: 42 |
| Relevant portions of the pSZ1469 construct | SEQ ID NO: 43 |
| pSZ1470 FADc exon 2 RNA hairpin cassette | SEQ ID NO: 44 |
| Relevant portions of the pSZ1470 construct | SEQ ID NO: 45 |
| pSZ1471 FADc exon 2 RNA hairpin cassette | SEQ ID NO: 46 |
| Relevant portions of the pSZ1471 construct | SEQ ID NO: 47 |

Each of the four constructs was transformed into a *Prototheca moriformis* (UTEX 1435) background and positive clones were screened using plates with sucrose as the sole carbon source. Positive clones were picked from each trans-

TABLE 12

Fatty acid profiles of Δ12 FAD knockouts

| | C10:0 | C12:0 | C14:0 | C16:0 | C16:1 | C18:0 | C18:1 | C18:2 | C18:3α |
|---|---|---|---|---|---|---|---|---|---|
| parent | 0.01 | 0.03 | 1.15 | 26.13 | 1.32 | 4.39 | 57.20 | 8.13 | 0.61 |
| FAD2B | 0.02 | 0.03 | 0.80 | 12.84 | 1.92 | 0.86 | 74.74 | 7.08 | 0.33 |
| FAD2C | 0.02 | 0.04 | 1.42 | 25.85 | 1.65 | 2.44 | 66.11 | 1.39 | 0.22 |

The transgenic containing the FAD2B (pSZ1124) construct gave a very interesting and unexpected result in fatty acid profile, in that the C18:2 levels, which would be formation and a subset were selected to determine the impact of the hairpin and antisense cassettes contained in pSZ1468, pSZ1469, pSZ1470 and pSZ1471 on fatty acid profiles. The selected clones from each transformation were grown under lipid producing conditions and the fatty acid profiles were determined using direct transesterification methods as described above. Representative fatty acid profiles from each of the transformations are summarized below in Table 13. Wildtype 1 and 2 cells were untransformed *Prototheca moriformis* (UTEX 1435) cells that were run with each of the transformants as a negative control.

TABLE 13

Fatty acid profiles of *Prototheca moriformis* cells containing long hairpin RNA constructs to down-regulate the expression of delta 12 desaturase gene (FADc).

| Strain | C10:0 | C12:0 | C14:0 | C16:0 | C18:0 | C18:1 | C18:2 |
|---|---|---|---|---|---|---|---|
| wildtype 1 | 0.01 | 0.03 | 1.20 | 27.08 | 4.01 | 57.58 | 7.81 |
| pSZ1468 clone A | 0.01 | 0.04 | 1.33 | 25.95 | 3.68 | 65.60 | 1.25 |
| pSZ1468 clone B | 0.01 | 0.03 | 1.18 | 23.43 | 2.84 | 65.32 | 4.91 |
| pSZ1468 clone C | 0.01 | 0.04 | 1.34 | 23.18 | 4.27 | 63.65 | 5.17 |
| pSZ1468 clone D | 0.01 | 0.03 | 1.24 | 23.00 | 3.85 | 61.92 | 7.62 |
| pSZ1470 clone A | 0.01 | 0.03 | 1.23 | 24.79 | 4.33 | 58.43 | 8.92 |
| pSZ1470 clone B | 0.01 | 0.03 | 1.26 | 24.91 | 4.14 | 57.59 | 9.64 |
| pSZ1470 clone C | 0.01 | 0.03 | 1.21 | 23.35 | 4.75 | 58.52 | 9.70 |
| wildtype 2 | 0.01 | 0.03 | 0.98 | 24.65 | 3.68 | 62.48 | 6.26 |
| pSZ1469 clone A | 0.01 | 0.03 | 1.05 | 21.74 | 2.71 | 71.33 | 1.22 |
| pSZ1469 clone B | 0.01 | 0.03 | 1.01 | 22.60 | 2.98 | 70.19 | 1.27 |
| pSZ1469 clone C | 0.01 | 0.03 | 1.03 | 19.82 | 2.38 | 72.95 | 1.82 |
| pSZ1469 clone D | 0.01 | 0.03 | 1.03 | 20.54 | 2.66 | 70.96 | 2.71 |
| pSZ1471 clone A | 0.01 | 0.03 | 1.03 | 18.42 | 2.63 | 66.94 | 8.55 |
| pSZ1471 clone B | 0.01 | 0.03 | 0.94 | 18.61 | 2.58 | 67.13 | 8.66 |
| pSZ1471 clone C | 0.01 | 0.03 | 1.00 | 18.31 | 2.46 | 67.41 | 8.71 |
| pSZ1471 clone D | 0.01 | 0.03 | 0.93 | 18.82 | 2.54 | 66.84 | 8.77 |

The above results show that the hairpin constructs pSZ1468 and pSZ1469 showed expected phenotypes: a reduction in C18:2 fatty acid levels and an increase in C18:1 fatty acid levels as compared to wildtype 1 and wildtype 2, respectively. The antisense constructs, pSZ1470 and pSZ1471 did not result in a decrease in C18:2 fatty acid levels but instead showed a slight increase when compared to wildtype 1 and wildtype 2, respectively and a slight decrease in C16:0 fatty acid levels.

We provide herein the sequences of *Auxenochlorella* fatty acid desaturase (FAD2 and FAD3). These genes can be used in *Auxenochlorella*, as in the above examples featuring *Prototheca*, in order to increase C18:2 or C18:3 levels through overexpression of FAD2 or FAD3 respectively. They can be used as target regions for homologous recombination, for example to reduce C18:2 accumulation and increase C18:1 levels by knocking out one or both alleles of FAD2, or by introducing a downward promoter in front of FAD2 that will allow for expression of FAD2 during the growth phase, allowing for normal growth, but with FAD2 being shut off during the lipid production phase, to minimize C18:2 levels and increase C18:1 levels.

As just one illustrative example of the above, provided is a vector containing the ACP-P promoter, the ApFAD2 (*Auxenochlorella protothecoides* SAD gene) and the CvNR terminator or other suitable terminator, that is transformed into *Auxenchlorella protothecoides* or *Prototheca* using biolistic transformation as described herein. The cells are then tested for elevated C18:2 levels using standard GC/MS FAME profiling methods as described in this application.

Example 5

Engineered Microalgae with Altered Fatty Acid Profiles

As described above, integration of heterologous genes to attenuate specific endogenous lipid pathway genes, through knockout or knockdown, in *Prototheca* species can alter fatty acid profiles. Plasmid constructs (listed in Table 14) were created to assess whether the fatty acid profile of a host cell may be affected as a result of a knockout an endogenous fatty acyl-ACP thioesterase gene, FATA1.

A classically mutagenized derivative of *Protheca moriformis* UTEX 1435, Strain J, was transformed with one of the following plasmid constructs in Table 14 using the methods of Example 2. Each construct contained a region for integration into the nuclear genome to interrupt the endogenous FATA1 gene and a *S. cerevisiae* suc2 sucrose invertase coding region under the control of *C. reinhardtii* β-tubulin promoter/5'UTR (SEQ ID NO: 30) and *Chlorella vulgaris* nitrate reductase 3' UTR (SEQ ID NO: 32). This *S. cerevisiae* suc2 expression cassette is listed as SEQ ID NO: 29 and served as a selection marker. All protein coding regions were codon optimized to reflect the codon bias inherent in *Prototheca moriformis* UTEX 1435 (see Table 2) nuclear genes. Relevant sequences for the targeting regions for the FATA1 gene used for nuclear genome integration are shown below.

| Description | SEQ ID NO: |
|---|---|
| 5' sequence for integration into FATA1 locus | SEQ ID NO: 48 |
| 3' sequence for integration into FATA1 locus | SEQ ID NO: 49 |

TABLE 14

Plasmid constructs used to transform *Protheca moriformis* (UTEX 1435) STRAIN J.

| Plasmid Construct | Relevant Sequence Elements | SEQ ID NO: |
|---|---|---|
| pSZ1883 | FATA1-CrbTub_yInv_nr-FATA1 | SEQ ID NO: 50 |
| pSZ1925 | FATA1-CrbTub_yInv_nr::amt03_CwTE2_nr-FATA1 | SEQ ID NO: 51 |

To introduce the *Cuphea wrightii* ACP-thioesterase 2 (CwFatB2) gene (Accession No: U56104) into STRAIN J at the FATA1-1 locus, a construct was generated to express the protein coding region of the CwFatB2 gene under the control of the *Prototheca moriformis* Amt03 promoter/5'UTR (SEQ ID NO: 37) and *C. vulgaris* nitrate reductase 3'UTR (SEQ ID NO: 32). Relevant portions of this construct are provided in the Sequence Listing as SEQ ID NO: 51. The codon-optimized cDNA sequences and amino acid sequences of the *Cuphea wrightii* FatB2 thioesterase are listed in the Sequence Listing as SEQ ID NO: 52 and SEQ ID NO: 53, respectively.

Upon transformation of FATA1-CrbTub_yInv_nr-FATA1 into STRAIN J, primary transformants were clonally purified and grown under standard lipid production conditions at pH 5.0 similar to the conditions as disclosed in Example 1. Lipid samples were prepared from dried biomass from each transformant and fatty acid profiles from these samples were analyzed using standard fatty acid methyl ester gas chromatography flame ionization (FAME GC/FID) detection methods as described in Example 3. The fatty acid profiles (expressed as Area % of total fatty acids) from the transgenic lines arising from transformation with pSZ1883 into Strain J are shown in Table 15.

TABLE 15

Fatty acid profiles of *Prototheca moriformis* cells containing a selectable marker to disrupt an endogenous FATA1 allele.

| Transformation | % C14:0 | % C16:0 | % C18:0 | % C18:1 | % C18:2 |
|---|---|---|---|---|---|
| Wildtype | 1.23 | 25.68 | 2.83 | 60.54 | 7.52 |
| Transformant 1 | 0.86 | 16.95 | 1.75 | 68.44 | 9.78 |
| Transformant 2 | 0.85 | 17.33 | 1.71 | 68.57 | 9.31 |
| Transformant 3 | 0.82 | 17.40 | 1.78 | 68.55 | 9.22 |
| Transformant 4 | 0.84 | 17.43 | 1.78 | 68.25 | 9.53 |
| Transformant 5 | 0.75 | 17.64 | 2.02 | 69.02 | 8.61 |

These results show that ablation of the host's endogenous FATA1-1 allele alters the fatty acid profile of the engineered microalgae. The impact of targeting a selectable marker to the endogenous FATA1 allele is a clear diminution of C16:0 fatty acid production with an increase in C18:1 fatty acid production.

Upon transformation of FATA1-CrbTub_yInv_nr::amt03_CwTE2_nr-FATA1 into STRAIN J, primary transformants were clonally purified and grown under standard lipid production conditions at pH 7.0 with different carbon sources provided to a total concentration of 40 g/L. The sucrose concentration was 40 g/L. Where only glucose was used as the carbon source, glucose was provided at 40 g/L. Where glucose and fructose was used as the carbon source, glucse was provided at 20 g/L and fructose was provided at 20 g/L. Lipid samples were prepared from dried biomass from each transformant and fatty acid profiles from these samples were analyzed using standard fatty acid methyl ester gas chromatography flame ionization (FAME GC/FID) detection methods as described in Example 3. The fatty acid profiles (expressed as Area % of total fatty acids) from the transgenic line arising from transformation with pSZ1925 into Strain J are shown in Table 16. The resulting fatty acid profiles are listed in Table 16.

TABLE 16

Fatty acid profiles of *Prototheca moriformis* cells containing a selectable marker and an exogenous thioesterase to disrupt an endogenous FATA1 allele.

| Transformant | | Carbon source | % C10:0 | % C12:0 | % C14:0 | % C16:0 | % C18:0 | % C18:1 | % C18:2 |
|---|---|---|---|---|---|---|---|---|---|
| Strain J | Wildtype | Glucose | 0.01 | 0.04 | 1.38 | 28.83 | 3.00 | 56.05 | 8.21 |
| | Wildtype | Glucose | 0.01 | 0.04 | 1.50 | 29.38 | 3.00 | 55.29 | 8.23 |
| | Wildtype | Glucose/Fructose | 0.01 | 0.05 | 1.48 | 28.58 | 3.20 | 57.14 | 7.27 |
| | Wildtype | Glucose/Fructose | 0.01 | 0.04 | 1.54 | 29.05 | 3.23 | 56.47 | 7.32 |
| >2 copies | 1 | Glucose/Fructose | 4.29 | 19.98 | 9.17 | 20.68 | 3.47 | 34.38 | 6.37 |
| | 2 | Glucose/Fructose | 3.11 | 16.17 | 9.91 | 15.97 | 1.57 | 45.72 | 5.81 |
| | 3 | Sucrose | 4.84 | 24.22 | 11.56 | 19.48 | 2.67 | 29.56 | 6.02 |
| | 4 | Sucrose | 3.24 | 16.67 | 10.39 | 16.34 | 1.43 | 44.41 | 6.00 |
| 1-2 copies | 1 | Glucose/Fructose | 0.18 | 1.64 | 1.85 | 14.43 | 2.12 | 70.30 | 7.63 |
| | 2 | Glucose/Fructose | 0.18 | 1.56 | 1.74 | 13.56 | 2.25 | 71.04 | 7.72 |
| | 3 | Sucrose | 0.19 | 1.69 | 1.89 | 13.79 | 3.15 | 69.97 | 7.68 |
| | 4 | Sucrose | 0.15 | 1.26 | 1.49 | 13.44 | 2.73 | 71.46 | 7.77 |

Concordant with targeting a selectable marker alone to the host's FATA1-1allele, integration of a selectable marker concomitant with an exogenous thioesterase alters the fatty acid profile of the engineered microalgae. As above, targeting an exogenous gene to the FATA1-1 allele results in a clear diminution of C16:0 fatty acid production. The additional expression of the CwTE2 thioesterase at the FATA1-1 locus also impacts mid chain fatty acids and C18:1 fatty acid production to an extent that is dependent upon the level of exogenous thioesterase activity present in the transformants analyzed. Genes bordered by repeat units such as the C. vulgaris nitrate reductase 3' UTR in constructs such as FATA1-CrbTub_yInv_nr::amt03_CwTE2_nr-FATA1, may be amplified upon integration in the host genome. There is good concordance between copy number of the amplified transgene at the target integration site and thioesterase levels as revealed either by impacts on fatty acid profiles or recombinant protein accumulation as assessed by western blotting.

Transgenic lines in which the CwTE2 gene has undergone amplification show a marked increase in mid chain (C10:0-C14:0) fatty acids and a concurrent decrease in C18:1 fatty acids. In contrast, those transformants in which CwTE2 has undergone little or no amplification (likely 1-2 copies) are consistent with lower expression of the exogenous thioesterase, resulting in a slight increase in mid chain fatty acids and a far greater impact on the increase of C18:1 fatty acids.

Collectively, these data show that ablation of the host's endogenous FATAL-1 allele alters the lipid profile of the engineered microalgae. Provided herein is the sequence of the FATA gene of *Axuenochlorella prototehcoides*. As with the *Prototheca*, the FATA gene of *Auxenochlorella protothecoides* can be ablated to alter fatty acid profiles. In addition, heterologous thioesterases, such as the CwFATB2 thioesterase, can be introduced to alter fatty acid profiles to produce mid chain fatty acids. In one non-limiting example, a suitable promoter such as the ACP-P promoter is fused to a plastid transit peptide selected from *A. prototheocoides*, CwFATB2 codon-optimized using the codon optimization table for *A. prototheocoides* and methods provided herein, and a suitable terminator such as the CvNR terminator. This construct is expressed in *A. prototheocoides* and then tested for increased mid-chain fatty acid accumulation.

Example 6

Altering Fatty Acid Profiles of Microalgae Through Overexpression of a an *Auxenochlorella* or *Prototheca* Lipid Biosynthesis Gene As described above, the β-ketoacyl-ACP synthase II (KASII) catalyzes the 2-carbon extension of C16:0-ACP to C18:0-ACP during fatty acid biosynthesis. It is an important lipid biosynthesis enzyme in establishing the fatty acid profile of the host organism and is critical for stearate and oleate production. Plasmid constructs were created to assess whether the fatty acid profile of a host cell may be affected as a result of expression of a KASII gene. Sources of KASII gene sequences were selected from *Protheca moriformis* UTEX 1435 or from higher plants (*Glycine max, Helianthus annus*, or *Ricinus communis*).

A classically mutagenized derivative of *Protheca moriformis* UTEX 1435, STRAIN J, was transformed individually with one of the following plasmid constructs in Table 17 using the methods of Example 2. Each construct contained a region for integration into the nuclear genome at the 6S locus and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 29 and served as a selection marker. For each construct, the KASII coding region was under the control of the *Prototheca moriformis* Amt03 promoter/5'UTR (SEQ ID NO: 37) and *C. vulgaris* nitrate reductase 3'UTR (SEQ ID NO: 32). The native transit peptide of each KASII enzyme was replaced with the *Chlorella prototheocoides* stearoyl-ACP desaturase transit peptide (SEQ ID NO: 54). All protein coding regions were codon optimized to reflect the codon bias inherent in *Prototheca moriformis* UTEX 1435 nuclear genes (see Table 2). Relevant sequences for the targeting regions to the 6S locus for nuclear genome integration are shown below.

| Description | SEQ ID NO: |
| --- | --- |
| 5' sequence for integration into 6S locus | SEQ ID NO: 38 |
| 3' sequence for integration into 6S locus | SEQ ID NO: 39 |

TABLE 17

Plasmid constructs used to transform *Protheca moriformis* (UTEX 1435) STRAIN J.

| Plasmid Construct | Source of KASII enzyme | Sequence Elements | SEQ ID. NO: |
| --- | --- | --- | --- |
| pSZ1747 | *Glycine max* | 6S::β-tub:suc2:nr::Amt03:S106SAD:GlmKASII:nr::6S | SEQ ID NO: 55 |
| pSZ1750 | *Helianthus annuus* | 6S::β-tub:suc2:nr::Amt03:S106SAD:HaKASII:nr::6S | SEQ ID NO: 56 |
| pSZ1754 | *Ricinus communis* | 6S::β-tub:suc2:nr::Amt03:S106SAD:RcKASII:nr::6S | SEQ ID NO: 57 |
| pSZ2041 | *Protheca moriformis* | 6S::β-tub:suc2:nr::Amt03:S106SAD:PmKASII:nr::6S | SEQ ID NO: 58 |

The relevant nucleotide sequence of the construct 6S::β-tub:suc2:nr::Amt03:S106SAD:PmKASII:nr::6S is provided in the sequence listings as SEQ ID. NO: 58. Upon individual transformation of each plasmid construct into Strain J, positive clones were screened on plates with sucrose as the sole carbon source. As in the previous examples, primary transformants were clonally purified and grown under standard lipid production conditions. Here, transformants were cultivated at pH 7 and lipid samples were prepared from dried biomass from each transformant as described above. Fatty acid profiles (expressed as Area %) of several positive transformants as compared to a wildtype negative control are summarized for each plasmid construct in Table 18 below.

TABLE 18

Fatty acid profiles of *Prototheca moriformis* cells engineered to overexpress KASII genes.

| Plasmid Construct | KASII Source | Transformant | % C14:0 | % C16:0 | % C18:0 | % C18:1 | % C18:2 |
| --- | --- | --- | --- | --- | --- | --- | --- |
| None | no over-expression | 1 | 1.36 | 28.69 | 2.92 | 56.36 | 8.16 |
| | | 2 | 1.35 | 28.13 | 3.57 | 55.63 | 8.79 |
| | | 3 | 1.22 | 25.74 | 2.82 | 60.6 | 7.31 |
| | | 4 | 1.22 | 25.74 | 2.82 | 60.6 | 7.31 |
| pSZ1747 | Glm | 1 | 2.23 | 25.34 | 2.69 | 57.35 | 9.53 |
| | | 2 | 2.18 | 25.46 | 2.74 | 57.35 | 9.46 |
| | | 3 | 2.18 | 25.33 | 2.89 | 57.34 | 9.5 |
| | | 4 | 2.2 | 25.69 | 2.66 | 57.28 | 9.43 |
| | | 5 | 2.17 | 25.38 | 3.03 | 56.99 | 9.72 |
| pSZ1750 | Ha | 1 | 2.43 | 26.82 | 2.72 | 55.17 | 9.87 |
| | | 2 | 2.44 | 27.14 | 2.62 | 54.89 | 9.81 |
| | | 3 | 2.61 | 26.9 | 2.67 | 54.43 | 10.25 |
| | | 4 | 1.96 | 30.32 | 2.87 | 53.87 | 8.26 |
| | | 5 | 2.55 | 27.64 | 2.98 | 53.82 | 10.07 |

TABLE 18-continued

Fatty acid profiles of *Prototheca moriformis* cells engineered to overexpress KASII genes.

| Plasmid Construct | KASII Source | Transformant | % C14:0 | % C16:0 | % C18:0 | % C18:1 | % C18:2 |
|---|---|---|---|---|---|---|---|
| pSZ1754 | Rc | 1 | 1.84 | 24.41 | 2.89 | 59.26 | 9.08 |
|  |  | 2 | 1.3 | 25.04 | 2.81 | 58.75 | 9.65 |
|  |  | 3 | 1.27 | 25.98 | 2.76 | 58.33 | 9.22 |
|  |  | 4 | 1.95 | 25.34 | 2.77 | 58.15 | 9.22 |
|  |  | 5 | 1.3 | 26.53 | 2.75 | 57.87 | 9.09 |
| pSZ2041 | Pm | 1 | 1.63 | 11.93 | 3.62 | 70.95 | 9.64 |
|  |  | 2 | 1.85 | 11.63 | 3.34 | 69.88 | 10.93 |
|  |  | 3 | 1.84 | 12.01 | 3.81 | 69.56 | 10.45 |
|  |  | 4 | 1.63 | 14.22 | 3.72 | 68.86 | 9.6 |
|  |  | 5 | 1.67 | 15.04 | 3.05 | 68.63 | 9.24 |

The data presented in Table 18 show that none of the higher plant KASII genes effected a change in the fatty acid profile of the transformed microalgal cells. Additional plasmid constructs expressing KASII genes from higher plants driven by promoters other than the *Prototheca* Amt03 promoter also failed to alter fatty acid profiles in transformed cells. In stark contrast, a clear diminution of C16:0 chain lengths with a concomitant increase in C18:1 length fatty acids was observed upon overexpression of the *Prototheca moriformis* KASII gene codon optimized using the codon frequency denoted in Table 2. Similar fatty acid profile changes were observed upon transformation of constructs expressing the PmKASII gene driven by a β-tublin promoter.

These results show that exogenous expression of a *Prototheca* lipid biosynthesis gene can alter the fatty acid profile of genetically engineered microalgae.

The KASII gene and other key lipid biosynthesis genes from *Auxenochlorella protothecoides* are presented here. They provide various uses, for example KASII can be overexpressed to increase accumulation of C18:1 fatty acids.

Example 7

Genetic Engineering of *Chlorella protothecoides* to Express an Exogenous Sucrose Invertase Strains and Media: *Chlorella protothecoides* (UTEX 250) was obtained from the Culture Collection of Alga at the University of Texas (Austin, Tex., USA). The stock cultures were maintained on modified Proteose medium. Modified Proteose medium consists of 0.25 g NaNO$_3$, 0.09 g K$_2$HPO$_4$, 0.175 g KH$_2$PO$_4$ 0.025 g, 0.025 g CaCl$_2$.2H$_2$O, 0.075 g MgSO$_4$.7H$_2$O, and 2 g yeast extract per liter (g/L).

Plasmid Construction: To express the secreted form of invertase in *Chlorella protothecoides*, a *Saccharomyces cerevisiae* SUC2 gene was placed under the control of three different promoters: Cauliflower mosaic virus $^{35}$S promoter (CMV), *Chlorella* virus promoter (NC-1A), and *Chlorella* HUP1 promoter. A yeast SUC2 gene was synthesized to accommodate codon usage optimized for *C. protothecoides* and includes a signal sequence required for directing extracellular secretion of invertase. Each construct was built in pBluescript KS+, and EcoRI/AscI, AscI/XhoI, and XhoI/BamHI sites were introduced to each promoter, invertase gene, and CMV 3'UTR, respectively, by PCR ampilication using specific primers. Purified PCR products were cloned sequentially.

Transformation of *Chlorella protothecoides*: A *Chlorella protothecoides* culture was grown in modified Proteose medium on a gyratory shaker under continuous light at 75 µmol photons m$^{-2}$ sec$^{-1}$ till it reached a cell density of 6×10$^6$ cells/ml.

For biolistic transformation, S550d gold carriers from Seashell Technology were prepared according to the protocol from the manufacturer. Briefly, a linearized construct (20 µg) by BsaI was mixed with 50 µL of binding buffer and 60 µL (3 mg) of S550d gold carriers and incubated in ice for 1 min. Precipitation buffer (100 µL) was added, and the mixture was incubated in ice for another 1 min. After mild vortexing, DNA-coated particles were pelleted by spinning at 10,000 rpm in an Eppendorf microfuge for 10 seconds. The gold pellet was washed once with 500 µL of cold 100% ethanol, pelleted by brief spinning in the microfuge, and resuspended with 50 µL of ice-cold ethanol. After a brief (1-2 sec) sonication, 10 µL of DNA-coated particles were immediately transferred to the carrier membrane. The cells were harvested, washed once with sterile distilled water, resuspended in 50 µL of medium (1×10$^7$ cells), and were spread in the center third of a non-selective Proteous plate. The cells were bombarded with the PDS-1000/He Biolistic Particle Delivery system (Bio-Rad). Rupture disks (1100 and 1350 psi) were used, and the plates were placed 9-12 cm below the screen/macrocarrier assembly. The cells were allowed to recover at 25° C. for 12-24 hours. Upon recovery, the cells were scraped from the plates with a rubber spatula, mixed with 100 µL of medium and spread on modified Proteose plates with 1% sucrose. After 7-10 days of incubation at 25° C. in the dark, colonies representing transformed cells were visible on the plates.

For transformation with electroporation, cells were harvested, washed once with sterile distilled water, and resuspended in a Tris-phosphate buffer (20 m M Tris-HCl, pH 7.0; 1 mM potassium phosphate) containing 50 mM sucrose to a density of 4×10$^8$ cells/mL. About 250 µL cell suspension (1×10$^8$ cells) was placed in a disposable electroporation cuvette of 4 mm gap. To the cell suspension, 5 µg of linearized plasmid DNA and 200 µg of carrier DNA (sheared salmon sperm DNA) were added. The electroporation cuvette was then incubated in an ice water bath at 16° C. for 10 min. An electrical pulse (1100 V/cm) was then applied to the cuvette at a capacitance of 25 µF (no shunt resistor was used for the electroporation) using a Gene Pulser II (Bio-Rad Labs, Hercules, Calif.) electroporation apparatus. The cuvette was then incubated at room temperature for 5 minutes, following which the cell suspension was transferred to 50 mL of modified Proteose media, and shaken on a gyratory shaker for 2 days. Following recovery, the cells were harvested at low speed (4000 rpm), resuspended in modified Proteose media, and plated out at low density on modified Proteose plates with 1% sucrose. After 7-10 days of incubation at 25° C. in the dark, colonies representing transformed cells were visible on the plates.

Screening Transformants and Genotyping: The colonies were picked from dark grown-modified Proteose plates with 1% sucrose, and approximately the same amount of cells were transferred to 24 well-plates containing 1 mL of modified Proteose liquid media with 1% sucrose. The cultures were kept in dark and agitated by orbital shaker from Labnet (Berkshire, UK) at 430 rpm for 5 days.

Growth in Liquid Culture: After five days growth in darkness, the genotype-positive transformants showed growth on minimal liquid Proteose media+1% sucrose in darkness, while wild-type cells showed no growth in the same media in darkness.

Example 8

Engineered Microalgae Plastids with Altered Fatty Acid Profiles

As described above, integration of heterologous genes to attenuate specific endogenous lipid pathway genes, through knockout or knockdown, in *Auxenochlorella* or *Prototheca* species can alter fatty acid profiles. Plasmid constructs can be created to assess whether the fatty acid profile of a host cell can be affected as a result of a knockout of an endogenous plastid psaA and insertion of a *Cuphea wrightii* ACP-thioesterase 2 (CwFatB2) gene.

*Auxenochlorella protothecoides* UTEX 250, can be transformed with plasmid constructs. The construct can contain a region for integration into the plastid genome to interrupt the endogenous psaA gene, a neomycin phosphotransferase gene coding region under the control of *Auxenochlorella protothecoides* Accd promoter/5'UTR (SEQ ID NO: 49194) and *Auxenochlorella protothecoides* Accd 3' UTR (SEQ ID NO: 49195) or various other 3' UTR including but not limited to plastid 3'UTRs such as cysT. This *Auxenochlorella protothecoides* plastid expression cassette can serve as a selection marker. All protein coding regions are codon optimized (see Tables 5c-d) to reflect the codon bias inherent in *Auxenochlorella protothecoides* UTEX 250 plastid genes. Relevant sequences for the targeting regions for the psaA gene used for nuclear genome integration are shown below.

| Description | SEQ ID NO: |
| --- | --- |
| 5' sequence for integration into psaA locus | SEQ ID NO: 49192 |
| 3' sequence for integration into psaA locus | SEQ ID NO: 49193 |

To introduce the *Cuphea wrightii* ACP-thioesterase 2 (CwFatB2) gene (Accession No: U56104) into *Auxenochlorella protothecoides* at the psaA plastid locus, a construct can be generated to express the protein coding region of the CwFatB2 gene under the control of the Accd promoter/5'UTR and *Auxenochlorella protothecoides* Accd 3' UTR (SEQ ID NO: 49194). For a selectable marker the neomycin phosphotransferase gene can be included in the cassette. Relevant portions of this construct are provided in the sequence listing as SEQ ID (49192 through 49196). The plastid codon-optimized cDNA sequences and amino acid sequences of the *Cuphea wrightii* FatB2 thioesterase are listed in the Sequence Listing as SEQ ID NO: 49196 and SEQ ID NO: 53, respectively.

Upon transformation of the cassette into *Auxenochlorella protothecoides*, primary transformants can be clonally purified and grown under standard lipid production conditions at pH 5.0 similar to the conditions as disclosed in Example 1. Lipid samples can be prepared from dried biomass from each transformant and fatty acid profiles from these samples are analyzed using standard fatty acid methyl ester gas chromatography flame ionization (FAME GC/FID) detection methods as described in Example 3. The fatty acid profiles (expressed as Area % of total fatty acids) from the transgenic lines arising from transformation should be similar to pSZ1883 transformed into Strain J as shown in Table 16.

These results can show that ablation of the host's endogenous plastid psaA and insertion of *Cuphea wrightii* FatB2 thioesterase alters the fatty acid profile of the engineered microalgae. The impact of targeting a selectable marker to the endogenous psaA and introduction of CwTE2 can alter C18:1 fatty acid production.

Upon transformation of the cassette psaA-pAccd_NeoR_nr::AccD_CwTE2_nr-psaA into *Auxenochlorella protothecoides*, primary transformants can be clonally purified and grown under standard lipid production conditions at pH 7.0 with different carbon sources provided to a total concentration of 40 g/L with a sucrose concentration of 40 g/L. Where only glucose is used as the carbon source, glucose is provided at 40 g/L. Where glucose and fructose are used as the carbon source, glucose is provided at 20 g/L and fructose is provided at 20 g/L. Lipid samples can be prepared from dried biomass from each transformant and fatty acid profiles from these samples can be analyzed using standard fatty acid methyl ester gas chromatography flame ionization (FAME GC/FID) detection methods as described in Example 3. The fatty acid profiles can be altered similarly (expressed as Area % of total fatty acids) from the transgenic line arising from transformation with pSZ1925 into Strain J as shown in Table 17.

Concordant with targeting a selectable marker alone to the host's psaA plastid gene, integration of a selectable marker concomitant with an exogenous thioesterase can alter the fatty acid profile of the engineered microalgae. The additional expression of the CwTE2 thioesterase at the psaA locus may also impact mid chain fatty acids and C18:1 fatty acid production to an extent that is dependent upon the level of exogenous thioesterase activity present in the transformants analyzed. This would be observed to a further extent if the exogenous thioesterase is removed through homologous recombination.

Transgenic lines in which the CwTE2 gene has undergone amplification will show a marked increase in mid chain (C10:0-C14:0) fatty acids and a concurrent decrease in C18:1 fatty acids. In contrast, those transformants in which CwTE2 has undergone little or no amplification (likely 1-2 copies) are consistent with lower expression of the exogenous thioesterase, resulting in a slight increase in mid chain fatty acids and a reduced impact on the decrease of C18:1 fatty acids. When the plastid is targeted for expression of CwTE2 multiple copies may not be necessary as there are already multiple copies of the plastid per cell, and likely multiple copies of the plastid genome per plastid.

Provided herein is the sequence of the psaA plastid gene of *Axuenochlorella protothecoides*. The psaA gene of *Auxenochlorella protothecoides* can be ablated to in order to insert other lipid biosynthesis genes to alter fatty acid profiles. In addition, heterologous thioesterases, such as the CwFATB2 thioesterase, can be introduced to alter fatty acid profiles to produce mid chain fatty acids. In one non-limiting example, a suitable promoter such as the Accd promoter and CwFATB2 codon-optimized using the codon optimization table for *A. protothecoides* plastid and methods provided herein, and a suitable terminator such as the Accd terminator are uesd. This construct can be expressed in *A. protothecoides* and then tested for increased mid-chain fatty acid accumulation.

Provided herein are preferred loci for nuclear integration via homologous recobminatoin in *Auxenochlorella protothecoides*. These loci near KAS1, SAD2, FATA1, Thi4a and FAD sequences are listed under Seq ID: 49197 through 49201. These loci are expected to perform similarly to the data presented for *Prototheca moriformis*. The interruption of these genes will result in changes to the fatty acid profiles similar to the results shown for *Prototheca moriformis*.

Example 9

Engineered Microalgae Plastids with Altered Fatty Acid Profiles

As described above, integration of heterologous genes to attenuate specific endogenous lipid pathway genes, through knockout or knockdown, in *Auxenochlorella* or *Prototheca* species can alter fatty acid profiles. Plasmid constructs can be created to assess whether the fatty acid profile of a host cell can be affected as a result of a knockout of an endogenous plastid psaA and insertion of an *Auxenochlorella protothecoides* Ketoacyl-ACP Synthase II gene (KASII).

*Auxenochlorella protothecoides* UTEX 250 can be transformed with plasmid constructs. The construct can contain a region for integration into the plastid genome to interrupt the endogenous psaA gene, a neomycin phosphotransferase gene coding region under the control of *Auxenochlorella protothecoides* Accd promoter/5'UTR (SEQ ID NO: 49194) and *Auxenochlorella protothecoides* Accd 3' UTR (SEQ ID NO: 49195) or various other 3' UTR including but not limited to plastid 3'UTRs such as cysT. This *Auxenochlorella protothecoides* plastid expression cassette can serve as a selection marker. All protein coding regions are codon optimized (see Tables 5c-d) to reflect the codon bias inherent in *Auxenochlorella protothecoides* UTEX 250 plastid genes. Relevant sequences for the targeting regions for the psaA gene used for nuclear genome integration are shown below.

| Description | SEQ ID NO: |
|---|---|
| 5' sequence for integration into psaA locus | SEQ ID NO: 49202 |
| 3' sequence for integration into psaA locus | SEQ ID NO: 49203 |

To introduce the *Auxenochlorella protothecoides* KetoacylACP-Synthase II gene (Seq ID NO: 49204) into *Auxenochlorella protothecoides* at the psaA plastid locus, a construct can be generated to express the protein coding region of the CwFatB2 gene under the control of the Accd promoter/5'UTR and *Auxenochlorella protothecoides* Accd 3' UTR (SEQ ID NO: 49194). For a selectable marker the neomycin phosphotransferase gene can be included in the cassette. Relevant portions of this construct are provided in the sequence listing as SEQ ID (XX through XX). The plastid codon-optimized cDNA sequences and amino acid sequences of the *Auxenochlorella protothecoides* Ketoacyl-ACP Synthase II are listed in the Sequence Listing as SEQ ID NO: 49204 and SEQ ID NO: 78, respectively.

Upon transformation of the cassette into *Auxenochlorella protothecoides*, primary transformants can be clonally purified and grown under standard lipid production conditions at pH 5.0 similar to the conditions as disclosed in Example 1. Lipid samples can be prepared from dried biomass from each transformant and fatty acid profiles from these samples are analyzed using standard fatty acid methyl ester gas chromatography flame ionization (FAME GC/FID) detection methods as described in Example 3. The fatty acid profiles (expressed as Area % of total fatty acids) from the transgenic lines arising from transformation will be similar to pSZ1883 transformed into Strain J as shown in Table 16.

These results can show that ablation of the host's endogenous plastid psaA and insertion of *Auxenochlorella prothecoides* Ketoacyl-ACP Synthase II alters the fatty acid profile of the engineered microalgae. The impact of targeting a selectable marker to the endogenous psaA and introduction of KASII can alter C18:1 fatty acid production.

Upon transformation of the cassette psaA-pAccd_NeoR_nr::AccD_KASII_nr-psaA into mutagenized *Auxenochlorella protothecoides*, primary transformants can be clonally purified and grown under standard lipid production conditions at pH 7.0 with different carbon sources provided to a total concentration of 40 g/L with a sucrose concentration of 40 g/L. Where only glucose is used as the carbon source, glucose is provided at 40 g/L. Where glucose and fructose are used as the carbon source, glucose is provided at 20 g/L and fructose is provided at 20 g/L. Lipid samples are prepared from dried biomass from each transformant and fatty acid profiles from these samples are analyzed using standard fatty acid methyl ester gas chromatography flame ionization (FAME GC/FID) detection methods as described in Example 3. The fatty acid profiles can be altered similarly (expressed as Area % of total fatty acids) from the transgenic line arising from transformation with pSZ1925 into Strain J as shown in Table 17.

Concordant with targeting a selectable marker alone to the host's psaA plastid gene, integration of a selectable marker concomitant with an exogenous thioesterase can alter the fatty acid profile of the engineered microalgae. The additional expression of the *Auxenochlorella prothecoides* Ketoacyl-ACP Synthase II at the psaA locus can also impact mid chain fatty acids. This would be observed to a further extent if the exogenous KASII is removed through homologous recombination.

Transgenic lines in which the KASII gene has undergone amplification will show a markedly improved conversion from C16:0-ACP to C18:0-ACP fatty acids hence increasing C18:1 levels. In contrast, those transformants in which KASII has undergone little or no amplification (likely 1-2 copies) are consistent with lower expression of the exogenous KASII, resulting in a slight increase in mid chain fatty acids and a reduced impact on the increase of C18:1 fatty acids. When the plastid is targeted for expression of KASII multiple copies may not be necessary as there are already multiple copies of the plastid per cell, and likely multiple copies of the plastid genome per plastid.

Provided herein is the sequence of the psaA plastid gene of *Axuenochlorella prototehcoides*. The psaA gene of *Auxenochlorella protothecoides* can be ablated to in order to insert other lipid biosynthesis genes to alter fatty acid profiles. In addition, heterologous KASII can be introduced to alter fatty acid profiles to produce higher levels of oleic acid. In one non-limiting example, a suitable promoter such as the Accd promoter, the KASII gene codon-optimized using the codon optimization table for *A. protothecoides* plastid and methods provided herein, and a suitable terminator such as the Accd terminator are used. This construct may be expressed in *A. protothecoides* and then tested for increased oleic acid accumulation.

Although this invention has been described in connection with specific embodiments thereof, it will be understood that it is capable of further modifications. This application is intended to cover any variations, uses, or adaptations of the invention following, in general, the principles of the invention and including such departures from the present disclosure as come within known or customary practice within the art to which the invention pertains and as may be applied to the essential features hereinbefore set forth.

All references cited herein, including patents, patent applications, and publications, including GenBank Accession numbers, are hereby incorporated by reference in their entireties, whether previously specifically incorporated or not. The publications mentioned herein are cited for the purpose of describing and disclosing reagents, methodologies and concepts that may be used in connection with the present invention. Nothing herein is to be construed as an admission that these references are prior art in relation to the inventions described herein.

SEQUENCE LISTING (49204 sequences)

SEQ ID NO: 1 - DNA, 541 bp, Prototheca kruegani
tgttgaagaatgagccggcgagttaaaaagagtggcatggttaaagaaaatactctggagccatagcgaaagcaagtttagtaagcttaggtcattctttttagacccgaaaccgagtgatctacccatgatcagggtgaagtgttagtaaaataacatggaggcccgaaccgactaatgttgaaaaattagcggatgaattgtgggtaggggcgaaaaaccaatcgaactcggagttagctggttctccccgaaatgcgtttaggcgcagcagtagcagtacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgggtatgtcaaaacctccagcaggttagcttagaagcagcaatcctttcaagagtgcgtaatagctcactg

SEQ ID NO: 2 - DNA, 573 bp, Prototheca wickerhamii
tgttgaagaatgagccggcgacttaaaataaatggcaggctaagagatttaataactcgaaacctaagcgaaagcaagtcttaatagggcgtcaatttaacaaaactttaaataaattataaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 3 - DNA, 541 bp, Prototheca stagnora
tgttgaagaatgagccggcgagttaaaaaaaatggcatggttaaagatatttctctgaagccatagcgaaagcaagttttacaagctatagtcattttttttagacccgaaaccgagtgatctacccatgatcagggtgaagtgttggtcaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggacgtgagtatgtcaaaacctccagcaggttagcttagaagcagcaatcctttcaagagtgcgtaatagctcactg

SEQ ID NO: 4 - DNA, 541 bp, Prototheca moriformis
tgttgaagaatgagccggcgagttaaaaagagtggcatggttaaagataattctctggagccatagcgaaagcaagtttaacaagctaaagtcaccctttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgggtatgttaaaacctccagcaggttagcttagaagcagcaatcctttcaagagtgcgtaatagctcactg

SEQ ID NO: 5 - DNA, 573 bp, Prototheca moriformis
tgttgaagaatgagccggcgacttaaaataaatggcaggctaagagaattaataactcgaaacctaagcgaaagcaagtcttaatagggcgctaatttaacaaaacattaaataaaatctaaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 6 - DNA, 573 bp, Prototheca wickerhamii
tgttgaagaatgagccgtcgacttaaaataaatggcaggctaagagaattaataactcgaaacctaagcgaaagcaagtcttaatagggcgctaatttaacaaaacattaaataaaatctaaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 7 - DNA, 541 bp, Prototheca moriformis
tgttgaagaatgagccggcgagttaaaaagagtggcgtggttaaagaaaattctctggaaccatagcgaaagcaagtttaacaagcttaagtcactttttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggctccgaaagttgtacctcaaagtggcaaactctgaatactctatttagatatctactagtgagaccttgggggataagctccttggtcgaaagggaaacagcccagatcaccagttaaggccccaaaatgaaaatgatagtgactaaggatgtgagtatgtcaaaacctccagcaggttagcttagaagcagcaatcctttcaagagtgcgtaatagctcactg

SEQ ID NO: 8 - DNA, 541 bp, Prototheca zopfii
tgttgaagaatgagccggcgagttaaaaagagtggcatggttaaagaaaattctctggagccatagcgaaagcaagtttaacaagcttaagtcactttttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttctttcgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgagtatgtcaaaacctccagcaggttagcttagaagcagcaatcctttcaagagtgcgtaatagctcactg

SEQ ID NO: 9 - DNA, 565 bp, Prototheca moriformis
tgttgaagaatgagccggcgacttagaaaaggtggcatggttaaggaaatattccgaagccgtagcaaaagcgagtctgaatagggcgataaaatatattaatatttagaatctagtcattttttctagacccgaacccgggtgatctaaccatgaccaggatgaagcttgggtgataccaagtgaaggtccgaaccgaccgatgttgaaaaatcggcggatgagttgtggttagcggtgaaataccagtcgaacccggagctagctggttctccccgaaatgcgttgaggcgcagcagtacatctagtctatctaggggtaaagcactgtttcggtgcgggctgtgagaacggtaccaaatcgtggcaaactctgaatactagaaatgacgatgtagtagtgagactgtgggggataagctccattgtcaagagggaaacagcccagaccaccagctaaggccccaaaatggtaatgtagtgacaaaggaggtgaaaatgcaaatacaaccaggaggttggcttagaagcagccatcctttaaagagtgcgtaatagctcactg

SEQ ID NO: 10 - DNA, 1187 bp, Chlorella kessleri
gatcagacgggcctgacctgcgagataatcaagtgctcgtaggcaaccaactcagcagctgcttggtgttgggtctgcaggatagtgttgcagggccccaaggacagcaggggaacttacaccttgtccccgacccagttttatggagtgcattgcctcaagagcctagccggagcgctaggctacatacttgccgcaccggtatgaggggatatagtactcgcactgcgctgtctagtgagatgggcagtgctgcccataaacaactggctgctcagccatttgttggcggaccattctgggggggccagcaatgcctgactttcgggtagggtgaaaactgaacaaagactaccaaaacagaatttcttcctccttggaggtaagcgcaggccggcccgcctgcgcccacatggcgctccgaacacctccatagctgtaagggcgcaaacatggccggactgttgtcagcactctttcatggccatacaaggtcatgtcgagattagtgctgagtaagacactatcaccccatgttcgattgaagccgtgacttcatgccaacctgcccctgggcgtagcagacgtatgccatcatgaccactagccgacatgcgctgtcttttgccaccaaaacaactggtacaccgctcgaagtcgtgccgcacacctccgggagtgagtccggcgactcctccccggcgggccgcggccctacctgggtagggtcgccatacgcccacgaccaaacgacgcaggaggggattggggtagggaatcccaaccagcctaaccaagacggcacctataataataggtggggggactaacagccctatatcgcaagctttgggtgcctatcttgagaagcacgagttggagtggctgtgtacggtcgaccctaaggtgggtgtgccgcagcctgaaacaaagcgtctagcagctgcttctataatgtgtcagccgttgtgtttcagttatattgtatgctattgtttgttcgtgctagggtggcgcaggcccacctactgtggcgggccattggttggtgcttgaattgcctcaccatctaaggtctgaacgctcactcaaacgcctttgtacaactgcagaactttccttggcgctgcaactacagtgtgcaaaccagcacatagcactcccttacatcacccagcagtacaaca

SEQ ID NO: 11 - DNA, 1414 bp, Chlorella ellipsoidea
cgctgcgcaccagggccgccagctcgctgatgtcgctccaaatgcggtcccccgattttttgttcttcatcttctccaccttggtggccttcttggccagggccttcagctgcatgcgcacagaccgttgagctcctgatcagcatcctcaggaggccctttgacaagcaagcccctgtgcaagcccattcacggggtaccagtggtgctgaggtagatgggtttgaaaaggattgctcggtcgattgctgctcatggaattggcatgtgcatgcatgttcacaatatgccaccaggctttggagcaagagagcatgaatgccttcaggcaggttgaaagttcctgggggtgaagaggcagggccgaggattggaggaggaaagcatcaagtcgtcgctcatgctcatgttttcagtcagagtttgccaagctcacaggagcagagacaagactggctgctcaggtgttgcatcgtgtgtgtggtgggggggggggggttaatacggtacgaaatgcacttggaattcccacctcatgccagcggacccacatgcttgaattcgaggcctgtggggtgagaaatgctcactctgccctcgttgctgaggtacttcaggccgctgagctcaaagtcgatgccctgctcgtctatcagggcctgcacctctgggctgaccggctcagcctccttcgcgggcatggagtaggcgccggcagcgttcatgtccgggcccagggcagcggtggtgccataaatgtcggtgatggtggggaggggggccgtcgccacaccattgccgttgctggctgacgcatgcacatgtggcctggctggcaccggcagcactggtctccagccagccagcaagtggctgttcaggaaagcggccatgttgttggtccctgcgcatgtaattccccagatcaaaggagggaacagcttggatttgatgtagtgcccaaccggactgaatgtgcgatggcaggtccctttgagtctcccgaattactagcagggcactgtgacctaacgcagcatgccaaccgcaaaaaaatgattgacagaaaatgaagcggtgtgtcaatatttgctgtatttattcgttttaatcagcaaccaagttcgaaacgcaactatcgtggtgatcaagtgaacctcatcagacttacctcgttcggcaaggaaacggaggcaccaaattccaatttgatattatcgcttgccaagctagagctgatctttgggaaaccaactgccagacagtggactgtgatggagtgccccgagtggtggagcctcttcgattcggttagtcattactaacgtgaaccctcagtgaagggaccatcagaccagaaagaccagatctcctcctcgacaccgagagagtgttgcggcagtaggacgacaag

SEQ ID NO: 12 - protein, 20 aa, Unknown
  Description of Unknown: Yeast secretion signal peptide
MLLQAFLFLLAGFAAKISAS

SEQ ID NO: 13 - protein, 18 aa, Unknown
  Description of Unknown: Higher plants secretion signal peptide
MANKSLLLLLLLGSLASG

SEQ ID NO: 14 - protein, 10 aa, Unknown
  Description of Unknown: Consensus eukaryotic secretion signal peptide
MARLPLAALG

SEQ ID NO: 15 - protein, 20 aa, Unknown
  Description of Unknown: Combination higher plant/eukaryotic secretion signal peptide
MANKLLLLLLLLLLPLAASG

SEQ ID NO: 16 - DNA, 1599 bp, Artificial Sequence
  Description of Artificial Sequence: Synthetic polynucleotide
atgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtga

SEQ ID NO: 17 - protein, 512 aa, Saccharomyces cerevisiae
MTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 18 - DNA, 1092 bp, Artificial Sequence
  Description of Artificial Sequence: Synthetic polynucleotide
gctcttcgggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgcc

SEQ ID NO: 19 - DNA, 1400 bp, Artificial Sequence
  Description of Artificial Sequence: Synthetic polynucleotide
caattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggagcatcgaggtggtcatctccgacctcgcgttggtggcggtgctcagcgggctcagcgtgctgggccgcaccatgggctgggcctggctggtcaagacctacgtggtgccctacatgatcgtgaacatgtggctggtgctcatcacgctgctccagcacacgcacccggccctgccgcactacttcgagaaggactgggactggctacgcggcgccatggccaccgtcgaccgctccatgggcccgcccttcatggacagcatcctgcaccacatctccgacacccacgtgctgcaccacctcttcagcaccatcccgcactaccacgccgaggaggcctccgccgccatccggcccatcctgggcaagtactaccaatccgacagccgctgggtcggccgcgccctgtgggaggactggcgcgactgccgctacgtcgtccccgacgcgcccgaggacgactccgcgctctggttccacaagtgagcgcgcctgcgcgaggacgcagaacaacgctgccgccgtgtcttttgcacgcgcgactccggcgcttcgctggtggcacccccataaagaaaccctcaattctgtttgtggaagacacggtgtacccccacccacccacctgcacctctattattggtattattgacgcgggagtgggcgttgtaccctacaacgtagcttctctagttttcagctggctcccaccattgtaaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 20 - DNA, 4091 bp, Artificial Sequence
  Description of Artificial Sequence: Synthetic polynucleotide
gctcttcgggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggagcatcgaggtggtcatctccgacctcgcgttggtggcggtgctcagcgggctcagcgtgctgggccgcaccatgggctgggcctggctggtcaagacctacgtggtgccctacatgatcgtgaacatgtggctggtgctcatcacgctgctccagcacacgcacccggccctgccgcactacttcgagaaggactgggactggctacgcggcgccatggccaccgtcgaccgctccatgggcccgcccttcatggacagcatcctgcaccacatctccgacacccacgtgctgcaccacctcttcagcaccatcccgcactaccacgccgaggaggcctccgccgccatccggcccatcctgggcaagtactaccaatccgacagccgctgggtcggccgcgccctgtgggaggactggcgcgactgccgctacgtcgtccccgacgcgcccgaggacgactccgcgctctggttccacaagtgagcgcgcctgcgcgaggacgcagaacaacgctgccgccgtgtcttttgcacgcgcgactccggcgcttcgctggtggcacccccataaagaaaccctcaattctgtttgtggaagacacggtgtacccccacccacccacctgcacctctattattggtattattgacgcgggagtgggcgttgtaccctacaacgtagcttctctagttttcagctggctcccaccattgtaaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 21 - DNA, 510 bp, Artificial Sequence
  Description of Artificial Sequence: Synthetic polynucleotide
gctcttccgcctggagctggtgcagagcatgggtcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtacc

SEQ ID NO: 22 - DNA, 1186 bp, Artificial Sequence
  Description of Artificial Sequence: Synthetic polynucleotide
caattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaggatcgtagagctccagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggagagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 23 - DNA, 3615 bp, Artificial Sequence
  Description of Artificial Sequence: Synthetic polynucleotide
gctcttccgcctggagctggtgcagagcatgggtcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaggatcgtagagctccagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggagagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 24 - DNA, 511 bp, Artificial Sequence
  Description of Artificial Sequence: Synthetic polynucleotide
gctcttcccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtacc

SEQ ID NO: 25 - DNA, 761 bp, Artificial Sequence
  Description of Artificial Sequence: Synthetic polynucleotide
cagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 26 - DNA, 3599 bp, Artificial Sequence
  Description of Artificial Sequence: Synthetic polynucleotide
gctcttcccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggacagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 27 - DNA, 20 bp, Artificial Sequence
  Description of Artificial Sequence: Synthetic primer
tcacttcatgccggcggtcc

SEQ ID NO: 28 - DNA, 20 bp, Artificial Sequence
  Description of Artificial Sequence: Synthetic primer
gcgctcctgcttggctcgaa

SEQ ID NO: 29 - DNA, 2327 bp, Artificial Sequence
  Description of Artificial Sequence: Synthetic polynucleotide
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatgga

SEQ ID NO: 30 - DNA, 312 bp, Artificial Sequence
  Description of Artificial Sequence: Synthetic polynucleotide
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaac

SEQ ID NO: 31 - DNA, 1599 bp, Artificial Sequence; identical to SEQ ID NO: 16
  Description of Artificial Sequence: Synthetic polynucleotide

SEQ ID NO: 32 - DNA, 408 bp, Artificial Sequence
  Description of Artificial Sequence: Synthetic polynucleotide
gcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcc

SEQ ID NO: 33 - DNA, 733 bp, Artificial Sequence
  Description of Artificial Sequence: Synthetic polynucleotide
gctcttcgagacgtggtctgaatcctccaggcgggtttccccgagaaagaaagggtgccgatttcaaagcagagccatgtgccgggccctgtggcctgtgttggcgcctatgtagtcaccccccctcacccaattgtcgccagtttgcgcaatccataaactcaaaactgcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtacc

SEQ ID NO: 34 - DNA, 739 bp, Artificial Sequence
  Description of Artificial Sequence: Synthetic polynucleotide
ccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtgagaagagc

SEQ ID NO: 35 - DNA, 735 bp, Artificial Sequence
  Description of Artificial Sequence: Synthetic polynucleotide
gctcttcgaggggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtacc

SEQ ID NO: 36 - DNA, 739 bp, Artificial Sequence; identical to SEQ ID NO: 34
  Description of Artificial Sequence: Synthetic polynucleotide

SEQ ID NO: 37 - DNA, 1065 bp, Artificial Sequence
  Description of Artificial Sequence: Synthetic polynucleotide
ggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagcc

SEQ ID NO: 38 - DNA, 726 bp, Artificial Sequence
  Description of Artificial Sequence: Synthetic polynucleotide
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtacc

SEQ ID NO: 39 - DNA, 749 bp, Artificial Sequence
  Description of Artificial Sequence: Synthetic polynucleotide
gagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 40 - DNA, 595 bp, Artificial Sequence
  Description of Artificial Sequence: Synthetic polynucleotide
actagtatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgcgtacgggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccat

SEQ ID NO: 41 - DNA, 6101 bp, Artificial Sequence
  Description of Artificial Sequence: Synthetic polynucleotide
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgcgtacgggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 42 - DNA, 595 bp, Artificial Sequence; identical to SEQ ID NO: 40
  Description of Artificial Sequence: Synthetic polynucleotide

SEQ ID NO: 43 - DNA, 5348 bp, Artificial Sequence
  Description of Artificial Sequence: Synthetic polynucleotide
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgcgtacgggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 44 - DNA, 1220 bp, Artificial Sequence
  Description of Artificial Sequence: Synthetic polynucleotide
actagttcacttgtggaaccagagcgcggagtcgtcctcgggcgcgtccgggacgacgtagcggcagtcgcgccagtcctcccacagggcgcggccgacccagcggctgtcggactggtagtacttgcccaggatgggcctgatggcggcggaggcctcctcggcgtggtagtgcgggatggtgctgaagaggtggtgcagcacgtgggtgtcggagatgtggtgcaggatgttgtccatgaagggcgggcccatggagcggtccacggtggccatggcgccgcgcagccagtcccagtccttctcgaagtagtgcggcagcgccgggtgcgtgtgctggagcagcgtgatgagcacgagccacatgttcacgatcaggtagggcaccacgtaggtcttgaccagccaggcccagcccatggtgcggcccagcacgctgagcccgctgagcaccgccaccagcgccaggtcggagatgaccacctcgatgcgctcgcgcttgctgaagatgggcgaccacgggtcaaagtggttggcgaagcgcgggtacggccgcgaggcgacgttgaacatgaggtacagcggccagcccagggtcagggtgaccagcaccttgcccatgcggatgggcagccactcctcccactccaggccctcgtgcgccactgcgcggtgcggcggcacaaacacctcgtccttgtccaggcaccccgtgttggagtggtggcggcggtgcgagtgcttccaggagtagtagggcaccagcagcaggctgtggaacaccaggcccacgccgtcgttgatggcctggctggaggaaaaggcctggtggccgcactcgtgcgcgcacacccagacacccgtgccgaaggcgccctggaaggtgccgggagggtagccgggggggtcagcgggacaggcgccttctcctccatgcgcgccaccaggacctcaatacgggcaaccaaaaccctcaaacacacctggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccat

SEQ ID NO: 45 - DNA, 6726 bp, Artificial Sequence
  Description of Artificial Sequence: Synthetic polynucleotide
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagttcacttgtggaaccagagcgcggagtcgtcctcgggcgcgtccgggacgacgtagcggcagtcgcgccagtcctcccacagggcgcggccgacccagcggctgtcggactggtagtacttgcccaggatgggcctgatggcggcggaggcctcctcggcgtggtagtgcgggatggtgctgaagaggtggtgcagcacgtgggtgtcggagatgtggtgcaggatgttgtccatgaagggcgggcccatggagcggtccacggtggccatggcgccgcgcagccagtcccagtccttctcgaagtagtgcggcagcgccgggtgcgtgtgctggagcagcgtgatgagcacgagccacatgttcacgatcaggtagggcaccacgtaggtcttgaccagccaggcccagcccatggtgcggcccagcacgctgagcccgctgagcaccgccaccagcgccaggtcggagatgaccacctcgatgcgctcgcgcttgctgaagatgggcgaccacgggtcaaagtggttggcgaagcgcgggtacggccgcgaggcgacgttgaacatgaggtacagcggccagcccagggtcagggtgaccagcaccttgcccatgcggatgggcagccactcctcccactccaggccctcgtgcgccactgcgcggtgcggcggcacaaacacctcgtccttgtccaggcaccccgtgttggagtggtggcggcggtgcgagtgcttccaggagtagtagggcaccagcagcaggctgtggaacaccaggcccacgccgtcgttgatggcctggctggaggaaaaggcctggtggccgcactcgtgcgcgcacacccagacacccgtgccgaaggcgccctggaaggtgccgggagggtagccgggggggtcagcgggacaggcgccttctcctccatgcgcgccaccaggacctcaatacgggcaaccaaaaccctcaaacacacctggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 46 - DNA, 1220 bp, Artificial Sequence; identical to SEQ ID NO: 44
  Description of Artificial Sequence: Synthetic polynucleotide

SEQ ID NO: 47 - DNA, 5973 bp, Artificial Sequence
  Description of Artificial Sequence: Synthetic polynucleotide
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagttcacttgtggaaccagagcgcggagtcgtcctcgggcgcgtccgggacgacgtagcggcagtcgcgccagtcctcccacagggcgcggccgacccagcggctgtcggactggtagtacttgcccaggatgggcctgatggcggcggaggcctcctcggcgtggtagtgcgggatggtgctgaagaggtggtgcagcacgtgggtgtcggagatgtggtgcaggatgttgtccatgaagggcgggcccatggagcggtccacggtggccatggcgccgcgcagccagtcccagtccttctcgaagtagtgcggcagcgccgggtgcgtgtgctggagcagcgtgatgagcacgagccacatgttcacgatcaggtagggcaccacgtaggtcttgaccagccaggcccagcccatggtgcggcccagcacgctgagcccgctgagcaccgccaccagcgccaggtcggagatgaccacctcgatgcgctcgcgcttgctgaagatgggcgaccacgggtcaaagtggttggcgaagcgcgggtacggccgcgaggcgacgttgaacatgaggtacagcggccagcccagggtcagggtgaccagcaccttgcccatgcggatgggcagccactcctcccactccaggccctcgtgcgccactgcgcggtgcggcggcacaaacacctcgtccttgtccaggcaccccgtgttggagtggtggcggcggtgcgagtgcttccaggagtagtagggcaccagcagcaggctgtggaacaccaggcccacgccgtcgttgatggcctggctggaggaaaaggcctggtggccgcactcgtgcgcgcacacccagacacccgtgccgaaggcgccctggaaggtgccgggagggtagccgggggggtcagcgggacaggcgccttctcctccatgcgcgccaccaggacctcaatacgggcaaccaaaaccctcaaacacacctggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 48 - DNA, 612 bp, Artificial Sequence
  Description of Artificial Sequence: Synthetic polynucleotide
gctcttcggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggtacc

SEQ ID NO: 49 - DNA, 528 bp, Artificial Sequence
  Description of Artificial Sequence: Synthetic polynucleotide
gacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggtgaagagc

SEQ ID NO: 50 - DNA, 3499 bp, Artificial Sequence
  Description of Artificial Sequence: Synthetic polynucleotide
gctcttcggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcgtagagctcactagtatcgatttcgaagacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggtgaagagc

SEQ ID NO: 51 - DNA, 6514 bp, Artificial Sequence
  Description of Artificial Sequence: Synthetic polynucleotide
gctcttcggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggtggccgccgccgccagcagcgccttcttccccgtgcccgccccccgccccacccccaagcccggcaagttcggcaactggcccagcagcctgagccagcccttcaagcccaagagcaaccccaacggccgcttccaggtgaaggccaacgtgagcccccacgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaagacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggtgaagagc

SEQ ID NO: 52 - DNA, 1236 bp, Artificial Sequence
  Description of Artificial Sequence: Synthetic polynucleotide
atggtggtggccgccgccgccagcagcgccttcttccccgtgcccgccccccgccccacccccaagcccggcaagttcggcaactggcccagcagcctgagccagcccttcaagcccaagagcaaccccaacggccgcttccaggtgaaggccaacgtgagcccccacgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctga

SEQ ID NO: 53 - protein, 408 aa, Cuphea wrightii
MVVAAAASSAFFPVPAPRPTPKPGKFGNWPSSLSQPFKPKSNPNGRFQVKANVSPHPKANGSAVSLKSGSLNTLEDPPSSPPPRTFLNQLPDWSRLRTAITTVFVAAEKQFTRLDRKSKRPDMLVDWFGSETIVQDGLVFRERFSIRSYEIGADRTASIETLMNHLQDTSLNHCKSVGLLNDGFGRTPEMCTRDLIWVLTKMQIVVNRYPTWGDTVEINSWFSQSGKIGMGREWLISDCNTGEILVRATSAWAMMNQKTRRFSKLPCEVRQEIAPHFVDAPPVIEDNDRKLHKFDVKTGDSICKGLTPGWNDFDVNQHVSNVKYIGWILESMPTEVLETQELCSLTLEYRRECGRESVVESVTSMNPSKVGDRSQYQHLLRLEDGADIMKGRTEWRPKNAGTNRAIST

SEQ ID NO: 54 - DNA, 120 bp, Artificial Sequence
  Description of Artificial Sequence: Synthetic polynucleotide
actagtatggccaccgcatccactttctcggcgttcaatgcccgctgcggcgacctgcgtcgctcggcgggctccgggccccggcgcccagcgaggcccctccccgtgcgcgggcgcgcc

SEQ ID NO: 55 - DNA, 1503 bp, Artificial Sequence
  Description of Artificial Sequence: Synthetic polynucleotide
atggccaccgcatccactttctcggcgttcaatgcccgctgcggcgacctgcgtcgctcggcgggctccgggccccggcgcccagcgaggcccctccccgtgcgcgggcgcgcctccacccactccggcaagaccatggccgtggccctgcagcccacccaggagatcaccaccatcaagaagccccccaccaagcagcgccgcgtggtggtgaccggcctgggcgtggtgacccccctgggccacgagcccgacatcttctacaacaacctgctggacggcgcctccggcatctccgagatcgagaccttcgactgcgccgagtaccccacccgcatcgccggcgagatcaagtccttctccaccgacggctgggtggcccccaagctgtccaagcgcatggacaagttcatgctgtacatgctgaccgccggcaagaaggccctggtggacggcggcatcaccgacgacgtgatggacgagctgaacaaggagaagtgcggcgtgctgatcggctccgccatgggcggcatgaaggtgttcaacgacgccatcgaggccctgcgcatctcctacaagaagatgaaccccttctgcgtgcccttcgccaccaccaacatgggctccgccatgctggccatggacctgggctggatgggccccaactactccatctccaccgcctgcgccacctccaacttctgcatcctgaacgccgccaaccacatcatccgcggcgaggccgacgtgatgctgtgcggcggctccgacgccgccatcatccccatcggcctgggcggcttcgtggcctgccgcgccctgtcccagcgcaacaccgaccccaccaaggcctcccgcccctgggacatcaaccgcgacggcttcgtgatgggcgagggcgccggcgtgctgctgctggaggagctggagcacgccaaggagcgcggcgccaccatctacgccgagttcctgggcggctccttcacctgcgacgcctaccacgtgaccgagccccgccccgacggcgccggcgtgatcctgtgcatcgagaaggccctggcccagtccggcgtgtccaaggaggacgtgaactacatcaacgcccacgccacctccacccccgccggcgacctgaaggagtaccaggccctgatgcactgcttcggccagaaccccgagctgcgcgtgaactccaccaagtccatgatcggccacctgctgggcgccgccggcggcgtggaggccgtggccaccatccaggccatccgcaccggctgggtgcaccccaacatcaacctggagaaccccgacaacggcgtggacgccaaggtgctggtgggctccaagaaggagcgcctggacgtgaaggccgccctgtccaactccttcggcttcggcggccacaactcctccatcatcttcgccccctacatggactacaaggaccacgacggcgactacaaggaccacgacatcgactacaaggacgacgacgacaagtga

SEQ ID NO: 56 - DNA, 1530 bp, Artificial Sequence
  Description of Artificial Sequence: Synthetic polynucleotide
atggccaccgcatccactttctcggcgttcaatgcccgctgcggcgacctgcgtcgctcggcgggctccgggccccggcgcccagcgaggcccctccccgtgcgcgggcgcgcctgccgccgcggcggccgcgtggccatggccatcgccatccagccctcctccatcgagatggaggaggagaccaccctgaccaagcgcaagcagccccccaccaagcagcgccgcgtggtggtgaccggcatgggcgtggagacccccatcggcaacaaccccgaccagttctacaacaacctgctgcagggcgtgtccggcatcacccagatcgaggccttcgactgctcctcctaccccacccgcatcgccggcgagatcaagaacttctccaccgacggctgggtggcccccaagctgtccaagcgcatggaccgcttcatgctgtacatgctgaccgccggcaagaaggccctggccgacgccggcatctccccctccgactccgacgagatcgacaagtcccgctgcggcgtgctgatcggctccgccatgggcggcatgaaggtgttcaacgacgccatcgaggccctgcgcgtgtcctaccgcaagatgaaccccttctgcgtgcccttcgccaccaccaacatgggctccgccatgctggccatggacctgggctggatgggccccaactactccatctccaccgcctgcgccacctccaacttctgcatcctgaacgccgccaaccacatcatccgcggcgaggccgacatgatgctgtgcggcggctccgacgccgtgatcatccccatcggcctgggcggcttcgtggcctgccgcgccctgtccgagcgcaacaccgaccccgccaaggcctcccgcccctgggactccggccgcgacggcttcgtgatgggcgagggcgccggcgtgctgctgctggaggagctggagcacgccaagaagcgcggcgccaagatctacgccgagttcctgggcggctccttcacctgcgacgcctaccacatgaccgagccccaccccgagggcgccggcgtgatcctgtgcatcgagaaggccctgtcccaggccggcgtgcgccgcgaggacgtgaactacatcaacgcccacgccacctccacccccgccggcgacctgaaggagtaccacgccctgctgcactgcttcggcaacaaccaggagctgcgcgtgaactccaccaagtccatgatcggccacctgctgggcgccgccggcgccgtggaggccgtggccaccgtgcaggccatccgcaccggctggatccaccccaacatcaacctggagaaccccgaccagggcgtggacaccaaggtgctggtgggctccaagaaggagcgcctgaacgtgaaggtgggcctgtccaactccttcggcttcggcggccacaactcctccatcctgttcgcccccttccagatggactacaaggaccacgacggcgactacaaggaccacgacatcgactacaaggacgacgacgacaagtga

SEQ ID NO: 57 - DNA, 1584 bp, Artificial Sequence
  Description of Artificial Sequence: Synthetic polynucleotide
atggccaccgcatccactttctcggcgttcaatgcccgctgcggcgacctgcgtcgctcggcgggctccgggccccggcgcccagcgaggcccctccccgtgcgcgggcgcgcctcccactactactcctccaacggcctgttccccaacacccccctgctgcccaagcgccacccccgcctgcaccaccgcctgccccgctccggcgaggccatggccgtggccgtgcagcccgagaaggaggtggccaccaacaagaagcccctgatgaagcagcgccgcgtggtggtgaccggcatgggcgtggtgtcccccctgggccacgacatcgacgtgtactacaacaacctgctggacggctcctccggcatctcccagatcgactccttcgactgcgcccagttccccacccgcatcgccggcgagatcaagtccttctccaccgacggctgggtggcccccaagctgtccaagcgcatggacaagttcatgctgtacatgctgaccgccggcaagaaggccctggccgacggcggcatcaccgaggacatgatggacgagctggacaaggcccgctgcggcgtgctgatcggctccgccatgggcggcatgaaggtgttcaacgacgccatcgaggccctgcgcatctcctaccgcaagatgaaccccttctgcgtgcccttcgccaccaccaacatgggctccgccatgctggccatggacctgggctggatgggccccaactactccatctccaccgcctgcgccacctccaacttctgcatcctgaacgccgccaaccacatcatccgcggcgaggccgacatcatgctgtgcggcggctccgacgccgccatcatccccatcggcctgggcggcttcgtggcctgccgcgccctgtcccagcgcaacgacgaccccaccaaggcctcccgcccctgggacatgaaccgcgacggcttcgtgatgggcgagggcgccggcgtgctgctgctggaggagctggagcacgccaagaagcgcggcgccaacatctacgccgagttcctgggcggctccttcacctgcgacgcctaccacatgaccgagccccgccccgacggcgtgggcgtgatcctgtgcatcgagaaggccctggcccgctccggcgtgtccaaggaggaggtgaactacatcaacgcccacgccacctccacccccgccggcgacctgaaggagtacgaggccctgatgcgctgcttctcccagaaccccgacctgcgcgtgaactccaccaagtccatgatcggccacctgctgggcgccgccggcgccgtggaggccatcgccaccatccaggccatccgcaccggctgggtgcaccccaacatcaacctggagaaccccgaggagggcgtggacaccaaggtgctggtgggccccaagaaggagcgcctggacatcaaggtggccctgtccaactccttcggcttcggcggccacaactcctccatcatcttcgccccctacaagatggactacaaggaccacgacggcgactacaaggaccacgacatcgactacaaggacgacgacgacaagtga

SEQ ID NO: 58 - DNA, 7008 bp, Artificial Sequence
  Description of Artificial Sequence: Synthetic polynucleotide
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgccgccgccgccgacgccaaccccgcccgccccgagcgccgcgtggtgatcaccggccagggcgtggtgacctccctgggccagaccatcgagcagttctactcctccctgctggagggcgtgtccggcatctcccagatccagaagttcgacaccaccggctacaccaccaccatcgccggcgagatcaagtccctgcagctggacccctacgtgcccaagcgctgggccaagcgcgtggacgacgtgatcaagtacgtgtacatcgccggcaagcaggccctggagtccgccggcctgcccatcgaggccgccggcctggccggcgccggcctggaccccgccctgtgcggcgtgctgatcggcaccgccatggccggcatgacctccttcgccgccggcgtggaggccctgacccgcggcggcgtgcgcaagatgaaccccttctgcatccccttctccatctccaacatgggcggcgccatgctggccatggacatcggcttcatgggccccaactactccatctccaccgcctgcgccaccggcaactactgcatcctgggcgccgccgaccacatccgccgcggcgacgccaacgtgatgctggccggcggcgccgacgccgccatcatcccctccggcatcggcggcttcatcgcctgcaaggccctgtccaagcgcaacgacgagcccgagcgcgcctcccgcccctgggacgccgaccgcgacggcttcgtgatgggcgagggcgccggcgtgctggtgctggaggagctggagcacgccaagcgccgcggcgccaccatcctggccgagctggtgggcggcgccgccacctccgacgcccaccacatgaccgagcccgacccccagggccgcggcgtgcgcctgtgcctggagcgcgccctggagcgcgcccgcctggcccccgagcgcgtgggctacgtgaacgcccacggcacctccacccccgccggcgacgtggccgagtaccgcgccatccgcgccgtgatcccccaggactccctgcgcatcaactccaccaagtccatgatcggccacctgctgggcggcgccggcgccgtggaggccgtggccgccatccaggccctgcgcaccggctggctgcaccccaacctgaacctggagaaccccgcccccggcgtggaccccgtggtgctggtgggcccccgcaaggagcgcgccgaggacctggacgtggtgctgtccaactccttcggcttcggcggccacaactcctgcgtgatcttccgcaagtacgacgagatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 59 - DNA, 1203 bp, Prototheca moriformis
atggcgtctgccgtcacctttgcgtgcgcccctccccgcggcgcggtcgccgcgccgggtcgccgcgctgcctcgcgtcccctggtggtgcacgccgtcgccagcgaggccccgctgggcgtgccgccctcggtgcagcgcccctcccccgtggtctactccaagctggacaagcaacaccgcctgacgcccgagcgcctggagctggtgcagagcatgggtcagttgcggaggagagggtgctccccgtgctgcaccccgtggacaagctgtggcagccgcaggacttcctggcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgcgaccaagtacagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggatctccggacgcgagattatggtctag

SEQ ID NO: 60 - DNA, 362 bp, Chlorella protothecoides
ggcgtggttaaggaaaaattccgaagccttagcgaaagcgagtctgaatagggcgatcaaatattttaatatttacaatttagtcattttttctagacccgaacccgggtgatctaaccatgaccaggatgaaacttgggtgataccaagtgaaggtccgaaccgaccgatgttgaaaaatcggcggatgagttgtggttagcggtgaaataccagtcgaacccggagctagctggttctccccgaaatgcgttgaggcgcagcagtacatctagtctatctaggggtaaagcactgtttcggtgcgggctgtgaaaacggtaccaaatcgtggcaaactctgaatactagaaatgacggtg

SEQ ID NO: 61 - DNA, 492 bp, Chlorella protothecoides
atggggaggggcaccgacctggcccacctggagctgaagctccccgggttccagctgcgcgtgcggcgcagcctgagcaaggctgcctcccctgccgcggcagccgccgcccccgtcgcggcgccggccccagtacccgcgcccgcccccgcgcccgccaccccccctcccgttgccagtgccgacgaggccgatgagtcgcgcctggcggtcgtggcgaccaaggtgggcgtcttccggcgcgggcgctatgtcaagggcaagcgcgtgggcaagggcccactggcggctgcgggcgacagcgtgaagaagggtcaggtgctggccttcgtggagcagctgggcacgcactggcccgtggaggcgccacagtcgggggaactggagggcttcctgctggaggacggcgaccccgtagagtacaaccagactgtgctggagctgacccccttctttgggggccacatcatcggcgacaagaagtaccggtga

SEQ ID NO: 62 - protein, 163 aa, Chlorella protothecoides
MGRGTDLAHLELKLPGFQLRVRRSLSKAASPAAAAAAPVAAPAPVPAPAPAPATPPPVASADEADESRLAVVATKVGVFRRGRYVKGKRVGKGPLAAAGDSVKKGQVLAFVEQLGTHWPVEAPQSGELEGFLLEDGDPVEYNQTVLELTPFFGGHIIGDKKYR

SEQ ID NO: 63 - DNA, 1749 bp, Chlorella protothecoides
atgccggagctgcctgacgcactggacgcgactccgacctgcatccgcttcatcggcccgccctccggcccgatggcggcgctgggggacaaggtggggtccaccatcctggcccaggcggcgggcgtgcccaccctggcctggtccgggtccggggtcagcatcgcctaccgcgactgccccggcggcgagatcccggcggccacctacgcggcggcctgcgtgtccgggttggacgccgcgctggcctcctgcgaggccatcggctaccccgccatgctcaaggcgtcgtggggcgggggcggcaagggcatccgccgcgtgctgaacgcggaggacgtgcgcgccgccttcccccaggtgcagggcgaggtgcctgggtcgccggtgttcgccatgcgcctggcgccccagagccggcacctggaggtgcagctgctggcggaccggcacggggctgtggcctccctcttctcccgcgactgctccgtccagcgccggcaccagaagatcgtggaggagggccccgtcaccgccgccccggccgccgtgctggaggacatggaggcgcgggcgcgcgcgctggcgcgcgccgtgggctacgtcggcgcggccaccgtggagtacctgtacctggtggagagcggggagtacgccttcctggagctgaacccgcggctgcaggttgagcaccccgtgacggagtggatcgccggggtcaacatccccgccgcccagctgctcatcgcggcgggggtgcccctgcaccgcctccccgacctgcgcacgctgtacggcgccgaccccgcgggggactcgcccatcgacttcgagggccccggccgccgcccgcccgcgggccacgtcgtggcggtccgcatcacggccgagaacgcgcacgacggcttcaagcccaccgcgggcgcgatcgacgaggtgtccttccgctccacgcccgacgtctggggctacttctcggtcaaggccgggtcggcggtgcacgagtttgccgactcccagttcggccacctgttcgcgcgcggggattgccgggaggccgccatccgcgccatggtggtggcgctgaaggaggtcaagatccggggcgagatccacacccccgtggactacgtggccgacatgatccagagccccgacttcctaggcaacatgcaccacacgggctggctggacgcccgcatcgcggcccaggtccgcgcccagcgcccgccctggcacctggtggtggcggcgggggcggtgctgcgcgccacgcagcgcgtcgccgcgcgcgccgccgagttcctggccttcctgcagaaaggccagctgccgccggaccgcgtttccctcatccacctgacggaggagtttgtggtggacggcgtcaagtacgcggtggacgtgcggcggcgcgggccgcaggcctaccgcctgacgctgggcggcgtgggcgtggacgccaccgcgcgcacgctcaaggacggcggcctgctgctgcagctggacgggcaggcccacgtgctgcacgcggaggaggaggccctgggcacacgcatcaccgtagggtcccagacctgcctgctcagcaacgagcacgaccccagccaggtgggtaggtggggggggggacaggagggggggtgcggtgggcaaacccaaccgccctggaccaaggcactgaaagcctgtctaccgcttggtgacgcaagcctccccccaccctccccacaacgtcccgacagctga

SEQ ID NO: 64 - protein, 582 aa, Chlorella protothecoides
MPELPDALDATPTCIRFIGPPSGPMAALGDKVGSTILAQAAGVPTLAWSGSGVSIAYRDCPGGEIPAATYAAACVSGLDAALASCEAIGYPAMLKASWGGGGKGIRRVLNAEDVRAAFPQVQGEVPGSPVFAMRLAPQSRHLEVQLLADRHGAVASLFSRDCSVQRRHQKIVEEGPVTAAPAAVLEDMEARARALARAVGYVGAATVEYLYLVESGEYAFLELNPRLQVEHPVTEWIAGVNIPAAQLLIAAGVPLHRLPDLRTLYGADPAGDSPIDFEGPGRRPPAGHVVAVRITAENAHDGFKPTAGAIDEVSFRSTPDVWGYFSVKAGSAVHEFADSQFGHLFARGDCREAAIRAMVVALKEVKIRGEIHTPVDYVADMIQSPDFLGNMHHTGWLDARIAAQVRAQRPPWHLVVAAGAVLRATQRVAARAAEFLAFLQKGQLPPDRVSLIHLTEEFVVDGVKYAVDVRRRGPQAYRLTLGGVGVDATARTLKDGGLLLQLDGQAHVLHAEEEALGTRITVGSQTCLLSNEHDPSQVGRWGGGQEGGCGGQTQPPWTKALKACLPLGDASLPPPSPQRPDS

SEQ ID NO: 65 - DNA, 573 bp, Chlorella protothecoides
atggcggtgagcacggggaagctggtgcggcacctggtggaggacgggcagcacgtggcgtcggacgcaccgtacgcggaggtggaggtgatgaagatgatgatgacgctgctggcccccgcggcggggttggtggcctgggaggcgcccgagggcgccaccctggccccgggcctcctgctcgcgcgcctgacgctggacgacccgggcgcggtgcggcgcgcggtgccctgcgcgctgcccttccccgagctgggcccgcccagccccgactacgacggcctggtggcgcgctgcgcggcggcgttggaggccgccgagaacgtgctggcagggtacgacgccgacgtgcccgccgtggtgtcggcgctcctggccgcgctggacgaccccgcgctggccctggtgcagtgggaggcggcctacggcgtggtggccccgcgcctgccggccccgcttgcggcccgcctggacgcgctgctggccgagggtctggccgagctggcgggggcctcgccgcgcgtgggcgtcgcggctgagcagatggtggtggtgcccggggtcggcgccggg

SEQ ID NO: 66 - protein, 191 aa, Chlorella protothecoides
MAVSTGKLVRHLVEDGQHVASDAPYAEVEVMKMMMTLLAPAAGLVAWEAPEGATLAPGLLLARLTLDDPGAVRRAVPCALPFPELGPPSPDYDGLVARCAAALEAAENVLAGYDADVPAVVSALLAALDDPALALVQWEAAYGVVAPRLPAPLAARLDALLAEGLAELAGASPRVGVAAEQMVVVPGVGAG

SEQ ID NO: 67 - DNA, 1413 bp, Chlorella protothecoides
  modified_base (434)..(443): a, c, t, g, unknown or other
  modified_base (635)..(644): a, c, t, g, unknown or other
atgcaccatggatgggcatgtcatgcaggaaccgatggacccacgcaccccacggacgagactcccacacagcgtctggcgggcagggagcttcgggatgttgtggggttcacgaggcgccgagcactgggcttgggtgcctggcttgcagcaggcccctggaagggcgccacgcggagcaccgcatgtctgttcaccagggaggagcgggcttgcatgaggcccacgcggtgtagccttggcacttgcactgatcgaggtcccgcaagggaggagggtgtcacctcacgacagcatgcacaactttccaatcacggaattatgtttcgagatagggtgttccacgcttgctggctgcagcatgcgtcagggctggcaggactctcagggcatcacatccgacagcatcggccacaccacatatgcacagctcnnnnnnnnnncctcagggcatcacatccgagagcatcggccacaccacatatgcacagctcctacaacccagcatgcaacgatggtctggaacaggactcgcatgccccggcggatggacgggtggttactgcggttatacatacctacgattctgtcacccggggcgtggctgttcactaccgcgttgggcacccggttgnnnnnnnnnnggttggattaagcaaccagagaagatattatactcgtctcggggatacaggcgtgcctgttcactaccgcgttgggcacccggttgagatcatggcgcgccgacagatttccacggtcgacgcaagatgtaggtggtcatcaaactggcaaacccggttctcgagcacggaaggacgtcgaagtgaacgtacgttacctagaatagagtcgattttgcttgggatacccctcagtagtgtccttcgaggtgtagcgatggcgtctacgacactgaatatggctcaggcgagccgagtagccagcgctaagtttggcaggcccaccccgaccccgtgcccaccccgcgcccacctgggccgtgctgccgcctgggccggcacccacccaaggcccacaccctgcgcagccggcccccggcccagcctgcggtccacggccagggtgacggtgcgggcggaggccggcaccaatgggtctgctgccgaccatggggtgcccatcaccaaggtgctcatcgccaaccggggggagattgcggtgcgcgtcatcagggcctgccgcgagatggggatcaagagcgtcgccgtctactctgtggccgacaaggactgcctgcacgtgcaggtgggtgggtggcctgcagatggtgttggtgcacatgagggggatgcattgattgtgcagccatcaagtagcgtctgtccttgtttgggagctgtgcgtgcattgaggggggacccagaatgttgtcagtcagaccagctctga

SEQ ID NO: 68 - protein, 470 aa, Chlorella protothecoides
  MOD_RES (145)..(148): Any amino acid
  MOD_RES (212)..(215): Any amino acid
MHHGWACHAGTDGPTHPTDETPTQRLAGRELRDVVGFTRRRALGLGAWLAAGPWKGATRSTACLFTREERACMRPTRCSLGTCTDRGPAREEGVTSRQHAQLSNHGIMFRDRVFHACWLQHASGLAGLSGHHIRQHRPHHICTAXXXXLRASHPRASATPHMHSSYNPACNDGLEQDSHAPADGRVVTAVIHTYDSVTRGVAVHYRVGHPVXXXXVGLSNQRRYYTRLGDTGVPVHYRVGHPVEIMARRQISTVDARCRWSSNWQTRFSSTEGRRSERTLPRIESILLGIPLSSVLRGVAMASTTLNMAQASRVASAKFGRPTPTPCPPRAHLGRAAAWAGTHPRPTPCAAGPRPSLRSTARVTVRAEAGTNGSAADHGVPITKVLIANRGEIAVRVIRACREMGIKSVAVYSVADKDCLHVQVGGWPADGVGAHEGDALIVQPSSSVCPCLGAVRALRGDPECCQSDQL

SEQ ID NO: 69 - DNA, 570 bp, Chlorella protothecoides
atggccctgccgactgcttttcattctcgcttcagcgcccatggtcggcctggacggacggcagccctgctctgtgctcctgccctgcaacctgcccaggccacccgcctgaagtttctctcctcacaccactcctttgattcttactcactccgtccccacctgaatcacccgcagctgcgcaaggagacgtacgccaagctgacgcccatccagcggctgcaggtggcacgccaccccaaccgccccaccttcctggacatcgcgctgaacatcaccgacaagtttgtggagctgcacggcgaccgcatgggcctggacgacccggccctggtctgcggcattgcttccatggacgagacctccttcatgttcatcgggcaccagaaggggcgcaacaccaaggagaatatctaccgcaactttggcatgccccagcccaacggctaccggaaggccctgcgcttcatgcgcatggccgacaagtttggcttccctatcatcacctttgtcgacacgcccggcgcctacgccgggctcaaggccgaggagcttgggcaggtgggctag

SEQ ID NO: 70 - protein, 189 aa, Chlorella protothecoides
MALPTAFHSRFSAHGRPGRTAALLCAPALQPAQATRLKFLSSHHSFDSYSLRPHLNHPQLRKETYAKLTPIQRLQVARHPNRPTFLDIALNITDKFVELHGDRMGLDDPALVCGIASMDETSFMFIGHQKGRNTKENIYRNFGMPQPNGYRKALRFMRMADKFGFPIITFVDTPGAYAGLKAEELGQVG

SEQ ID NO: 71 - DNA, 1464 bp, Chlorella protothecoides
  modified_base (35)..(44): a, c, t, g, unknown or other
  modified_base (999)..(1008): a, c, t, g, unknown or other
  modified_base (1199)..(1208): a, c, t, g, unknown or other
  modified_base (1319)..(1328): a, c, t, g, unknown or other
atggaaacttggagaatattgaatctacgaactgnnnnnnnnnnggcaggaacacgtcacgagggtggaggggcgggggctttgccgcgagtgccctgggcgcatgagtcggtgctcgagtcctgcagcgtctgcactgcacttgacttctgtaatgccgtcatcatggaaacttggagggtgcaggcgaggaacaggcttcggattcgcatgccctccaccccctgcatgtggcgacgagggcgggcagggttcgggtggaaagtgagtcacgcacttgctccacataaacagggcgtcccaatgccggccctcctcgcctggtctaccccaacccttgcacgagacgccggatcgggagtagctggagtcatggctttcttgcagcgcaccgtggccgctgtgcgacagggcgtggtggcccgcctcaacctgaacgcaaccccctccctcaccagcctgcgcgggtttgctgccgcgtcatacttggataaggatgaggtggtcaagcgggtgacggatgtcatcaagaactttgaccgcgtggacggcagcaaggtgcgtgcgggagggatgacgcagttacggaatgcatatgatacctgtgaagacgtagcaatgagctccgggcacatcttctcatggatggcaatcgatgcttatgttcgctctagagatgcgagcatgcagggtgcagcgcgcagaggctcgacgctggcccccactggtccccaaccccccacatgcatgggtgtggtgacagaatccgcagcgtttgccagcgatcttggcctggactccctggacagtgtggagctggtgatggcgttggaggaggagtttgccattgagatcccggaccaagaggcggacaagatcacatctgtcgccgaggccgtgtcctacatctctgccaaccccatggccaaggtcactgggcctcaggcccagctttgccttgatagtttatggcatgctggtctcacgggattgggattnnnnnnnnnngaatgcaccacctctggtcacctgctcggggtggaccaaactagtgtcggacggcgcgattttatggcatgctggtcttacgggattgggatcggagcgagacggcagggattgtcagctgcaaccgttgtgagcagagtctcagcacggcctgtgggagtcctcgatgagaagcttggagatgtgcactnnnnnnnnnngagacggcagggattgtcagctgcaaccgtagtgagcagagtctcagcgcggcctgtgggagccctcgatgagaagcttggagatgtgcaccccctggcacaatgcaaggnnnnnnnnnnctggcacaatgtgtgtttgaggggcaggagtgtgcacgaagaattctgtgatatgggaatagactgttcgcaccacttgcctgtagacaagataggtttcttcaaaaattgcttggcactcattgattcgcagtga

SEQ ID NO: 72 - protein, 487 aa, Chlorella protothecoides
  MOD_RES (12)..(15): Any amino acid
  MOD_RES (333)..(336): Any amino acid
  MOD_RES (400)..(403): Any amino acid
  MOD_RES (440)..(443): Any amino acid
METWRILNLRTXXXXAGTRHEGGGAGALPRVPWAHESVLESCSVCTALDFCNAVIMETWRVQARNRLRIRMPSTPCMWRRGRAGFGWKVSHALAPHKQGVPMPALLAWSTPTLARDAGSGVAGVMAFLQRTVAAVRQGVVARLNLNATPSLTSLRGFAAASYLDKDEVVKRVTDVIKNFDRVDGSKVRAGGMTQLRNAYDTCEDVAMSSGHIFSWMAIDAYVRSRDASMQGAARRGSTLAPTGPQPPTCMGVVTESAAFASDLGLDSLDSVELVMALEEEFAIEIPDQEADKITSVAEAVSYISANPMAKVTGPQAQLCLDSLWHAGLTGLGXXXXECTTSGHLLGVDQTSVGRRDFMACWSYGIGIGARRQGLSAATVVSRVSARPVGVLDEKLGDVHXXXXRRQGLSAATVVSRVSARPVGALDEKLGDVHPLAQCKXXXXWHNVCLRGRSVHEEFCDMGIDCSHHLPVDKIGFFKNCLALIDSQ

SEQ ID NO: 73 - DNA, 264 bp, Chlorella protothecoides
atgtacccaatgtccataccgcaggacaaggcgagcgtgctgtccaacgtgcgctctatcatcgcagagcagctcggcaccgatcttgacaaggtggccgccgacgccaagttctccgacctgggcgccgactccctggacaccgtggagatcatgatggcccttgaggagaagttcgagctgcagctggatgaggagggtgccgagaagatctccaccgtccaggaggccgcggacctcatctccgcgcagatcggtgcctga

SEQ ID NO: 74 - protein, 87 aa, Chlorella protothecoides
MYPMSIPQDKASVLSNVRSIIAEQLGTDLDKVAADAKFSDLGADSLDTVEIMMALEEKFELQLDEEGAEKISTVQEAADLISAQIGA

SEQ ID NO: 75 - DNA, 5043 bp, Chlorella protothecoides
  modified_base (594)..(603): a, c, t, g, unknown or other
  modified_base (991)..(1000): a, c, t, g, unknown or other
  modified_base (1970)..(1979): a, c, t, g, unknown or other
  modified_base (2582)..(2591): a, c, t, g, unknown or other
  modified_base (2895)..(2904): a, c, t, g, unknown or other
atgccgcgcgacatgactgccacggggaggtaccctcccgtccccaagcacccgcccatcgccttctactccgccgtgcgactcggcgaccccgagcagctggcgctgatcatggccactgacccctacttcatcacccaggacaacggtgcaggagcccccgtgcactttgcgaccacctacaagcagctggacatggtgcgagtggtggggtgtcggaggaaaggtgggggggtggtgggatggcctccaggggtgctgcccgcaggagcaggtggatccttggagcaggccttcccggcgcccctccacacccaccacctcatgccaactccccacccgctgccgcagctgcaccacctgttgaacaacggtgccgaggtcaaccagagggacgagaaggggttcacccccctgcaccgcgccgcctacctggcacactttgacgggtacctggagatctacgagtatctgctggtacgccctgtgatgagggaaacacactttgtgaaagtggcagtgcttcctctgtgttccacagctcaattatccttctgctgtctgccctttgagaaatgcttggcactcacggcnnnnnnnnnntcctctgtgttccacagctcaattatcctttatgctggctgccctttgagaaacgcttggcactcacgcctgacccccccacttcaccgtcacctcgtccccccgcagtctcgcggcgcggacccctccatcaccaccaacgactttgacccctacctctcccccggggtcaagctgcccgtggaggtggccaacgacgaccaggccatccgcgacaagctgctggccttggagaagaaacctgggacgcagagtaccagcacccctaccccgagcaggtcaagcgcgagcgcgacgcggcggcgcgcaaggccgccaaggcggagcaccgccgcgccaaggcggcagcgctggccgccggcggcctgcccgccaccaagaaggccannnnnnnnnngccaaggcggagcaccgccgcgccaaggcgacagcgctggccgctggcggcctgcccgccgccaagaaggccccagcccccgccggccccatcgccttcctgttcccgggccagggctcgcaggccgtgggcatgctgaaccagtccaaggacatccctgcagtcaaggccatgctggaaagggccgagcgcgtgctgggctacgacctgctggcgctctgcaccgaagggcccaaggagaagctggacgacaccatctactcccaggttggttggggatggcgggggtaggagcaggtgagagggtagggatcgggggggggtccctgagcggctgcattcagctaccggagagggcaggcactgaaaggcggtggaaaggacgggctcctgtggtccaggcggcgtggaggctgcccccatcttacggcgctgagactcaagtgttccccccctccgcgacatctcatttcccaaccccacccacccaccagcctgcgctgtttgtggcgggactggcggccgtggagaagctgcgcgccgagaacccggcggccgtggatggggccgcctcggccgcgggcctctccctgggcgagtacactgccctcgtcttctccggtgccatctccttcgaggatgggctcaaggtggtcaaggtccgcgccagctccatggcggcggccgccaagtcgggccgaccccacggcatgctcagcgtggtggggctgaacgacgctgacctggagaaggtggtggcggaagtcaatacgaagctgccggacagcgtctgccgcgtggcaaactacctgttcccctctggccgcgtcgtctccggtggttctgaagggttggggcgcacgtgtgcggctggtgagagggacagagatccagcgtggtgcactggcttagctcttcatccattgcgcactcaaacccctaatccaatccttgccacaacctgcctcannnnnnnnnntgcggctggtgagagggacagagatccagcatgggcacaaggatgctctggaggaggcccagaaggcggccgtggccgccggcgccatcaaggccgtgtcgctggcagtgagcggcgctttccacaccacgctcatgcagcccgctcgcgaggcgctggaggaggtgggctaggatctgctggtgcgcatgaagaagcaacacgctcccccatcgtcctccgcgcaggtgctgaacagcatcgagatcaaggagcctcgcatcccggtgtacagcaacgtcacgggcaaggtgttcaaggacgccaaggaaatcgcagcgctgctgccccgacagctggtggagcccgtgagatgggagcctaccatccgtgccctcgttgctgcgggtacggtgaagggagtgggacagcgtgtacttgcttgcctttgccttgctgcgagagtccaccagtccaatcaccacctccacattcatactttcctacaggcaagaatcagctgttcgagctggggccgggtgcgcagatcaaggccatggtcaagcgcattgaccctggcgcatggggggcgttcaagaatacacactgctcgaattataagannnnnnnnnngtggcggcctgacctagatatgtggctgtgcggcatctgtaacggaccagaattgatgccaagttgcagggatattgagcttgttgaacacagacacgctgcccaaactacaagccctgctcaggttgtcctcaagagggcccattgtttctcgccctcttgccctcaactccgtccacataaggcacctgcggttgggttggtcagcgacgaggggaatgggtgggatgccgtgctcgagatattgagcttgccgcttcccggggaagaggcacacacatccagaatgcctccatccaccccnnnnnnnnnnccgccacagcaaatcacagcatgctcggggatgaaattgtggcagcgccacttgctcagtactggaaggcggcgtcaccctccacatccaaggagcctacacgcttggcgggagccaggaagaggaggatgcagcccttggcgatgcgctccaggtgcggcagcttctgcaggcgctggaagaaggcggggttctccacgtcaggcacctgcggtgaggttggtcagcgacgagggggatgggtgggatgccgtgctcaagatattgagcttgccacttcccgggggagaggcacacacattcagggaagatgcgctccgtggtgttgtttgtctccaggatgacgtgcttgttgaagcgcgtggtgtccatgcccagcgactcgtagaagaaggagcgctggtggtcgttgaggtacatggtgatgtatacggacaggcagaagaagcgggaccagagacgcgccgccgtgccctcaaggagctccggctggcacttcagggtggccgccagaaagtcaccgtgccgggactcatcctgagcatgtgggggttggggtgcggaaggagggctcaggacagccttgacctggcaatccctccacatgatgcactccccaggcaggtcgtgtggccaaccatctcaccagcctgcacctccaggccggtccaagccccaccccttgcccctcacctggcaccaattctcaaagtactcaaagagggggtacagctggcagtcggggttgcgctggagatggcggtagatgctgatgtagcgccagtacccgatcttctcggacagataggtggcatagatgatgaactgcagggggtgggcagggaaagtggggtaattgagggaagtgcctctgaggcagactcaccagctggagagccaacgtccatgacaggccaagacgtcagactggagatgcctgaacactccccaatgagaatcattgcgctgaatcccatgcctcccaccttgggcttgaagaaagtgtacttgcggttgcgggtcaggaagcccagatccaacgccaggttgaagtctttggacaatgggagaaatggattcgacgtcacattgtgcttcagatatacacatgtgtcgtcgctattccaaccgccagtcattgtgagcacagaatcaaaccaagcctttcaacaggcaaaaaagccaacgtggcccagtcaaatatggtcacaccacccaccccaaagcacactcaccgctcatggacttgttgatgaaacccgcgtgccgcgcctcgtcgcgcgagaggagggtgaagatctcggcgagcacggggttggccttcttcaggcgccgtcccagctccttgtagagcaggaagccggagaactcagcagtgcaggacctctccaggaactcgatgaagatcttgcgcgtgttccccgtcagcttcttggccgcctcagggaaggtagcgttgcgcacaaagtggcactggttgtagtcacgcctgaactccgccagcatcgcctccagctcatccattttcaggttggggttctcctccagggagtacatcttctccatctcctcgaagtcggtggtgtagaatctggggcggatccgggatggacgcgtgatgacatcggccgcgcacccacgcgggatctgatgctttggcccaccaggtgcattggcccaagccgtactgtgttgctgtgtcacacatccaagcatgcgttcacaccggaccacaccgcgcaccgtggcgtcaggatggtctccccgctgaactccttcacgcccttgcgcatgagcttgaaacccagctcgtccctcagctcatcgccagaagcaccggcggtggaggccgccctcatgggctgtgcgaaggatccccgtcggggcacagccctggggccctgcgcgaaccctgcgccgtgggccgtgaaaggcttgcaggccatcgtggtggacatcatcgcgctctgcattgcaactcagtttctaatgatcctgagtctcttgcagcttttctatccgctcagggggcttggagacgtgtaccttcacgtatggggtgatcatggaacgggccacgtatcggataaggagcgatgcgcgggaaatcgtatcttgagcctgcccgcgaaaccatag

SEQ ID NO: 76 - protein, 1680 aa, Chlorella protothecoides
  MOD_RES (199)..(201): Any amino acid
  MOD_RES (331)..(334): Any amino acid
  MOD_RES (657)..(660): Any amino acid
  MOD_RES (861)..(864): Any amino acid
  MOD_RES (966)..(968): Any amino acid
MPRDMTATGRYPPVPKHPPIAFYSAVRLGDPEQLALIMATDPYFITQDNGAGAPVHFATTYKQLDMVRVVGCRRKGGGVVGWPPGVLPAGAGGSLEQAFPAPLHTHHLMPTPHPLPQLHHLLNNGAEVNQRDEKGFTPLHRAAYLAHFDGYLEIYEYLLVRPVMRETHFVKVAVLPLCSTAQLSFCCLPFEKCLALTAXXXSSVFHSSIILYAGCPLRNAWHSRLTPPLHRHLVPPQSRGADPSITTNDFDPYLSPGVKLPVEVANDDQAIRDKLLALEKKPGTQSTSTPTPSRSSASATRRRARPPRRSTAAPRRQRWPPAACPPPRRPXXXXQGGAPPRQGDSAGRWRPARRQEGPSPRRPHRLPVPGPGLAGRGHAEPVQGHPCSQGHAGKGRARAGLRPAGALHRRAQGEAGRHHLLPGWLGMAGVGAGERVGIGGGSLSGCIQLPERAGTERRWKGRAPVVQAAWRLPPSYGAETQVFPPSATSHFPTPPTHQPALFVAGLAAVEKLRAENPAAVDGAASAAGLSLGEYTALVFSGAISFEDGLKVVKVRASSMAAAAKSGRPHGMLSVVGLNDADLEKVVAEVNTKLPDSVCRVANYLFPSGRVVSGGSEGLGRTCAAGERDRDPAWCTGLALHPLRTQTPNPILATTCLXXXXAAGERDRDPAWAQGCSGGGPEGGRGRRRHQGRVAGSERRFPHHAHAARSRGAGGGGLGSAGAHEEATRSPIVLRAGAEQHRDQGASHPGVQQRHGQGVQGRQGNRSAAAPTAGGAREMGAYHPCPRCCGYGEGSGTACTCLPLPCCESPPVQSPPPHSYFPTGKNQLFELGPGAQIKAMVKRIDPGAWGAFKNTHCSNYKXXXXWRPDLDMWLCGICNGPELMPSCRDIELVEHRHAAQTTSPAQVVLKRAHCFSPSCPQLRPHKAPAVGLVSDEGNGWDAVLEILSLPLPGEEAHTSRMPPSTPXXXPPQQITACSGMKLWQRHLLSTGRRRHPPHPRSLHAWREPGRGGCSPWRCAPGAAASAGAGRRRGSPRQAPAVRLVSDEGDGWDAVLKILSLPLPGGEAHTFREDALRGVVCLQDDVLVEARGVHAQRLVEEGALVVVEVHGDVYGQAEEAGPETRRRALKELRLALQGGRQKVTVPGLILSMWGLGCGRRAQDSLDLAIPPHDALPRQVVWPTISPACTSRPVQAPPLAPHLAPILKVLKEGVQLAVGVALEMAVDADVAPVPDLLGQIGGIDDELQGVGRESGVIEGSASEADSPAGEPTSMTGQDVRLEMPEHSPMRIIALNPMPPTLGLKKVYLRLRVRKPRSNARLKSLDNGRNGFDVTLCFRYTHVSSLFQPPVIVSTESNQAFQQAKKPTWPSQIWSHHPPQSTLTAHGLVDETRVPRLVAREEGEDLGEHGVGLLQAPSQLLVEQEAGELSSAGPLQELDEDLARVPRQLLGRLREGSVAHKVALVVVTPELRQHRLQLIHFQVGVLLQGVHLLHLLEVGGVESGADPGWTRDDIGRAPTRDLMLWPTRCIGPSRTVLLCHTSKHAFTPDHTAHRGVRMVSPLNSFTPLRMSLKPSSSLSSSPEAPAVEAALMGCAKDPRRGTALGPCANPAPWAVKGLQAIVVDIIALCIATQFLMILSLLQLFYPLRGLGDVYLHVWGDHGTGHVSDKERCAGNRILSLPAKP

SEQ ID NO: 77 - DNA, 552 bp, Chlorella protothecoides
atgtcgggcgatgcgcaccatgtgacgcagccgccgcccgacgggcggggggcggcgctggccatgcgccgcgcgctgcgctccgcgcgctgcgacccggacgaggtggcctacgtcaatgcgcacgccacctccacgccacaaggcacgggagcttggtgttttgtacaggggatggggagtctagggaccttgtgcctggccattcaccaaccctcctgccaacccccaggtgacgccgtcgaggcccgggccatcgcccaggtatttggcggccggccgtccctggccgtgtcatccaccaagggggccatgggccacctcctgggggctgcaggggcggtggaggccgccatggcggtgctggccctgtaccatggcgtggcgcctcccacgctcaacctggaggaccctgagccggcagggctgctgccgggcctggtgggcccgacgcccctcacgctgccgcccggggccggggcggtgctcacgaattctttcggcttcgggggcacaaatgcggccctggttttcaccaggcatgcagcctga

SEQ ID NO: 78 - protein, 183 aa, Chlorella protothecoides
MSGDAHHVTQPPPDGRGAALAMRRALRSARCDPDEVAYVNAHATSTPQGTGAWCFVQGMGSLGTLCLAIHQPSCQPPGDAVEARAIAQVFGGRPSLAVSSTKGAMGHLLGAAGAVEAAMAVLALYHGVAPPTLNLEDPEPAGLLPGLVGPTPLTLPPGAGAVLTNSFGFGGTNAALVFTRHAA

SEQ ID NO: 79 - DNA, 819 bp, Chlorella protothecoides
atgatgcccgcatcgtgtcggtcgggggcatcctcctcgctcacctcttccctctctcaacctcctcatctcccccccctcccccttccccaggcggctgacgcgcaggccctgatccaggccgccgtatcggagtggggcaccatcgatgcgctggtcaacaacgcgggcatcacaagggacacgctgatgctgcgcatgaagccggagcagtggcaggcggtgatcgacgtgaacctgtcgggcgtgttctacgccacgcaggccgccacgaaggtcatggccaagaagcggaagggcaggatcgtcaacatctcctctgtggtggggctgactgggaacgcggggcaggtgaactacgccgccgccaaggcgggcctcatcggcatgacgcgctccgtggcccgggagtttgcggggcggggtctgctggtcaacgccatcgcgcccgggttcatcgagtcggagatgacgggcgtgctgtcctccgaggttgaggccgccatcctcgccaagatccccctgggtgcgctggtggtttggtgggcggtgtgcggttgggcggggtgtgttaagaagaggaggggagtggggagtgcagacgttggagccgccccatggggtctcacatgtgagaaccctcacatgcagagctgcgcctacatgcatgcacacagaccctctcgccaccatgcaataggcacgtacggcaagcccgaggaggtggctggtctggtcaagttcttgctgacagaccccgctgcaggctacatcactggccaggtcatcagcatcgatggcggcatgagcatgcaatga

SEQ ID NO: 80 - protein, 272 aa, Chlorella protothecoides
MMPASCRSGASSSLTSSLSQPPHLPPLPLPQAADAQALIQAAVSEWGTIDALVNNAGITRDTLMLRMKPEQWQAVIDVNLSGVFYATQAATKVMAKKRKGRIVNISSVVGLTGNAGQVNYAAAKAGLIGMTRSVAREFAGRGLLVNAIAPGFIESEMTGVLSSEVEAAILAKIPLGALVVWWAVCGWAGCVKKRRGVGSADVGAAPWGLTCENPHMQSCAYMHAHRPSRHHAIGTYGKPEEVAGLVKFLLTDPAAGYITGQVISIDGGMSMQ

SEQ ID NO: 81 - DNA, 678 bp, Chlorella protothecoides
atggccagcaggcatgctgggaggcaccgccggaccctccttgtcccacaggtttcccttcctcctggtggaccgggtgctggaatgggagagcggcaagtatgctgtcggctacaagtgcatcaccatcaacgacaactttttccccggccacttcccaaaccgcgccatcatgccaggcacgggatgggtgtgagcttgggaaggccgaggcagaggggatgggagcctgacctcatggagaaggccatcgagcgtgtgctgcaggtggaggccctggcccagctggggggcatcgccatgattgaccccgccgacaagggccagcagaacaacttcttcttcggcggcgtggacggggtccgctggaagaagccagtggtgcccggcgatgtcctggactgccacccttggtgtgctcccatcatggagggattggccgccaggcgtaagccaccagaaccccattggcatcatgacaagggatggttcgatcacttgtcatgtccaaccaccacttgccgcatcacgggacaattcttcccaaccttccagatgatgagggtggacgtggtcaagttcaacaagaggcatggcatctgcaaggtggatgccaaggcatatgtgggcacggacttggtgtgtcaaggtgaactgacgctggtgatgctgaagtga

SEQ ID NO: 82 - protein, 225 aa, Chlorella protothecoides
MASRHAGRHRRTLLVPQVSLPPGGPGAGMGERQVCCRLQVHHHQRQLFPRPLPKPRHHARHGMGVSLGRPRQRGWEPDLMEKAIERVLQVEALAQLGGIAMIDPADKGQQNNFFFGGVDGVRWKKPVVPGDVLDCHPWCAPIMEGLAARRKPPEPHWHHDKGWFDHLSCPTTTCRITGQFFPTFQMMRVDVVKFNKRHGICKVDAKAYVGTDLVCQGELTLVMLK

SEQ ID NO: 83 - DNA, 711 bp, Chlorella protothecoides
atgcctgccgccccatgcctgcgcacctggaacctcaccgccccattgtgctccaaacccttcccctccccccttatctttaacccccaccaccccaccaccccatccccaccccagatcgccgagaacaagcgctacgccgggaacgaggggtacaccgtgtcggaagccgccgagaagctggcccgcgacgtgggcaagatcgacatcctggtgcactccctggccaacggccccgaggtccagaagccgctgctggagaccagccggcgcggctacctggccgccctctccgcctcctcctactccctcatctccatgctccagcgcttcggcccgctgctcaaccccggcggcgcggtcatctcgctgacctacctggccggcgcgcgcgtcatccccggctacggcggcggcatgagctccgccaaggccgcgctggagtccgacaccaaggtccttgcctttgaggcggggcgcaagtggaacgtgcgcgtgaacaccatctcagcgggccccctgggctcgcgcgcggccaaggccatcggcttcatcgacgacatgatcaggggaaggctcctcgctccaacaaccggtcgcttgcccggcctgtgccgattctttcattccatctcgaaggggcacccacctccaccgccacctccaccgccaccaccacccacatacaaccccctcaacatccctaaatga

SEQ ID NO: 84 - protein, 236 aa, Chlorella protothecoides
MPAAPCLRTWNLTAPLCSKPFPSPLIFNPHHPTTPSPPQIAENKRYAGNEGYTVSEAAEKLARDVGKIDILVHSLANGPEVQKPLLETSRRGYLAALSASSYSLISMLQRFGPLLNPGGAVISLTYLAGARVIPGYGGGMSSAKAALESDTKVLAFEAGRKWNVRVNTISAGPLGSRAAKAIGFIDDMIRGRLLAPTTGRLPGLCRFFHSISKGHPPPPPPPPPPPPTYNPLNIPK

SEQ ID NO: 85 - DNA, 1209 bp, Chlorella protothecoides
atgaagaccatccagtctcagcacgccgctctcatcggacatgtgcagtcgggtcgtcgatcggcggggcgcgcgggatcccgcatggtgacccccgtggccgcagctaccgtcgcagcccctcgctcggccctcaacctctcccccaccatcattcgacaggaggtgctccactccgccagcgcccagcaactagactgcgtggcctccctggcgcccgtcttcgagtcccagatcctccccctcctgacgcccgtggacgagatgtggcaacctaccgacttcctccccgcctcgaactcggaggcattcttcgaccagatcggcgacctgcgggcgcgatcggcggccatccccgacgacctgctggtctgcctggtgggggacatgatcacggaggaggccctgcccacctacatggccatgctgaacaccctggacgtcgtgcgcgatgagacagggcacagccagcacccctacgccaagtggaccaggtacgcgcctcgaccccagggctatgagaaccgccatggcgacctgctgaacaagtacatgtggctgacggggcgggtggacatgctggcggtggagcgcaccatccagcgcctcatctcctcgggcatggacccgggcacggagaaccacccctaccacgcctttgtgttcaccagcttccaggagcgcgccaccaagctgagccatggctccaccgcccgcctggcggtcgccgccggggacgaggccctggccaagatctgcgggaccattgcgcgggacgagtcgcgccacgaggcggcgtacacgcggaccatggacgccatcttccagcgcgaccccagcggggccatggtggcgtttgcgcacatgatgatgcgcaagatcaccatgcccgcccacctcatggacgacggccagcacggcgcgcgcaacggggggcgcaacttgttcgacgactttgcggcagtggcggagcgggcaggggtgtacaccgccggcgactacatcggcatcctgcgccacctcatccggcgctgggacgtggagggcaagacggggctgaccccggagggccgcgccgcccaggagctgctctgctctctgccagcgcggttcgagaagctggcgcagcgcaaggccaagaaggcggaggccgcgccgcccgcgaccgtggagttctcctggatcttcaacaggcccgtgtatgcctga

SEQ ID NO: 86 - protein, 402 aa, Chlorella protothecoides
MKTIQSQHAALIGHVQSGRRSAGRAGSRMVTPVAAATVAAPRSALNLSPTIIRQEVLHSASAQQLDCVASLAPVFESQILPLLTPVDEMWQPTDFLPASNSEAFFDQIGDLRARSAAIPDDLLVCLVGDMITEEALPTYMAMLNTLDVVRDETGHSQHPYAKWTRYAPRPQGYENRHGDLLNKYMWLTGRVDMLAVERTIQRLISSGMDPGTENHPYHAFVFTSFQERATKLSHGSTARLAVAAGDEALAKICGTIARDESRHEAAYTRTMDAIFQRDPSGAMVAFAHMMMRKITMPAHLMDDGQHGARNGGRNLFDDFAAVAERAGVYTAGDYIGILRHLIRRWDVEGKTGLTPEGRAAQELLCSLPARFEKLAQRKAKKAEAAPPATVEFSWIFNRPVYA

SEQ ID NO: 87 - DNA, 2727 bp, Chlorella protothecoides
  modified_base (12)..(21): a, c, t, g, unknown or other
  modified_base (1661)..(1670): a, c, t, g, unknown or other
atgttgcccagnnnnnnnnnngagctggagtccttgacagacgagatttttcagtaccgcaacgggggcctcatcgccttgcccagggaccttgaagcacagccaccacgacgtacagctcctgttgggcatgaagtccagagccaccacactgcgtgcctcctccgccaaggggcgggtgaatcgcccgatgccagcacccagttccacaacatccaggccgtccacagaccccaggagcttgagcacctgctcgagggggtgtggaccctcagagtgacagcttgccctagagccacgtcagcagtcacggcaacgagacccacgacacacctctggcctttccagtttgtcaatatccgcagcctggctgtcgagcatcatcgactccaccgtggcgttgctcgagtgctccgcccagtagctcttctgggcttctcgttcctggggagttcccatggcagcagtggcggctcgtaccctctggcgactgccgatgcgggataccgtcgagttcacgacaaatactgcgaggtcagcgggtatgctcccgatcaatccgcagggaagctggatcgatatatccagtgggggggcgacgtctgtcgccagcagagcgcgctacgaaagcacgaaaatctatgcagcagcgagtcggaaacccgaaaaccagtccttccccacgacacaaacccggcgtcatcgcactcggtgctgctggaagctgttctgcgtaacttgacgagtcggaggaaatcacttttaagccacttccctcaagcacctgtaccacatctcggaaggatgcgcccgcaatgcagcctcaagaatatccacttgagctcgatagacctccctcacctcgacggcggactgaaggagggcgttagccccgacgtccagcgacaaatcgaggcactggtcgaccaggcaaggtccgagtttcccgaccatgcagggtccaacttgctggtccaacttgctggccatgccctggctcctacacgaaacacccctgtgtggccctcaggatctgccgcatgctggcccctggaacatggcggggtggccaggctgcatgccatctggccaccattgcagcacacaacccccccaccaccacccttaaacccccccacacaacaccacaggtctgacgtgctggacatcagcagccccctgaacgatgccgccagcgccatcgtggacgactccttcctccgctgcttcacctccgccgtggacgagccctggaattggaacttctacctgctccccctctggatcctgggcgtcgtcctgcgcaacgcaatcatcttccccctgcgcctgctcaccctcctcctgggcgccctcgtcttcatcgtggccttcatggttgcggaggccctgcccgccaaacaccgcaccctggccgagcgcagggtggtgcagttcatggcccagatcttcgtcacctcctggacaggcatgcgggagggggaatgttctgtggttggcaaactgagcagaggggctgtgtatggggtgtttgaagagttcatggctgtctcggcacacgctgacgcagcggtgcgcgctgtcatcccacatcgggtagattccacgacgcagcgtcctcatcgccctctgtgcatcgagcccacccggccatcaccagnnnnnnnnnntgctgtgcatggggtgtttgaagagttcttggctgtctcggcacatgctgacgcagtggtgcgcgctgtcgtcccacatcgggtagatcccacggcgcagcgtcctcatcgccctttgtgcatcgagcccacccggccatcaccagacagccctttcggggccatccgtgtcccagcacgcactgtcaccccaccaccaccactctgggcatgtttcctaccctccagcaacctcactcccccccataaaatcccgctttcccgcgcaggcgtgatccggtaccacgggccccgccccgtctccacggccaaccgcgtgtgggtggccaaccacacctccatgatcgactacgcggtgctgtgcgcctacacgccctttgccgccatcatgcagctccaccccggctgggtgggcctgttccagaagcgctacctcaactccctgggctgcctgtacttcaaccgcacgcaggccaaggaccggacgctggtgcaccagcgcatgcgcgaccacgtggccgaccccaactccatgcccctgctcatcttcccggagggcacctgcgtgaacaacgagtactgcgtcatgttccggaagggagccttcgacctcggcgccacggtctgccccatcgccatcaagtacaacaagatcttcgtggacgcgttctggaacagcaagcgccagtccttcaccgctcacctgctcaagatcatgcgttcctgggcgttggtctgcgacgtctacttcctggagccgcagagtaagcagccgggggagagctcccaggagtttgccgagcgcgtgcaggccatgatcgcgaagcgggcgcggctcacggtcgccccctgggacggctacctcaagtactacaacctggccgagaaggtgcgggccgaggggcagaggtttgctggcggtgcatcgggcggctgttccagattggcagctggaaggggggactggaagagctcgccagcatgcccgtacaggggcccactggtggtgtcgggagggaacccgccgacaatgtgtgctatggctggcgtgggttga

SEQ ID NO: 88 - protein, 908 aa, Chlorella protothecoides
  MOD_RES (4)..(7): Any amino acid
  MOD_RES (554)..(557): Any amino acid
MLPXXXXELESLTDEIFQYRNGGLIALPRDLEAQPPRRTAPVGHEVQSHHTACLLRQGAGESPDASTQFHNIQAVHRPQELEHLLEGVWTLRVTACPRATSAVTATRPTTHLWPFQFVNIRSLAVEHHRLHRGVARVLRPVALLGFSFLGSSHGSSGGSYPLATADAGYRRVHDKYCEVSGYAPDQSAGKLDRYIQWGGDVCRQQSALRKHENLCSSESETRKPVLPHDTNPASSHSVLLEAVLRNLTSRRKSLLSHFPQAPVPHLGRMRPQCSLKNIHLSSIDLPHLDGGLKEGVSPDVQRQIEALVDQARSEFPDHAGSNLLVQLAGHALAPTRNTPVWPSGSAACWPLEHGGVARLHAIWPPLQHTTPPPPPLNPPTQHHRSDVLDISSPLNDAASAIVDDSFLRCFTSAVDEPWNWNFYLLPLWILGVVLRNAIIFPLRLLTLLLGALVFIVAFMVAEALPAKHRTLAERRVVQFMAQIFVTSWTGMREGECSVVGKLSRGAVYGVFEEFMAVSAHADAAVRAVIPHRVDSTTQRPHRPLCIEPTRPSPXXXXAVHGVFEEFLAVSAHADAVVRAVVPHRVDPTAQRPHRPLCIEPTRPSPDSPFGAIRVPARTVTPPPPLWACFLPSSNLTPPHKIPLSRAGVIRYHGPRPVSTANRVWVANHTSMIDYAVLCAYTPFAAIMQLHPGWVGLFQKRYLNSLGCLYFNRTQAKDRTLVHQRMRDHVADPNSMPLLIFPEGTCVNNEYCVMFRKGAFDLGATVCPIAIKYNKIFVDAFWNSKRQSFTAHLLKIMRSWALVCDVYFLEPQSKQPGESSQEFAERVQAMIAKRARLTVAPWDGYLKYYNLAEKVRAEGQRFAGGASGGCSRLAAGRGDWKSSPACPYRGPLVVSGGNPPTMCAMAGVG

SEQ ID NO: 89 - DNA, 978 bp, Chlorella protothecoides
atgaatcacccgcctgtcagtgcatgcaaggtgacacccaataagctcttccccgcccttcttgtcgtgcagcacatgtcttgtgccatggtgactctccctactcgccgacatggggatagccccctttccccgccgctacattcgcggaaaggacctcggaaatgcccagacctcttccaacttagtttcaaggggaaaatctcatcattcgaagcctctgaaaagggtcgacaggcatccactgtggtgaagtggcgttcgcgccgggaagactgccagggggctccaacgcccggccgacagcccaattggtcggcctccaaccggcggtgccacccgcaaggagagggtcaacaagattccccacgccactccatgccgagtttacgtatcggagcaatccgtcagcggcccacaaatggtctagatgcgggcactgcccctggggccgcgaagtcagaagtactaaccaagataggggaggcagggtgggcagctatgcctccaatgctggcgatcccactggctttaccgctgccatgcaacccatatttgtggacaccagaggtaggtctgaaaggtgccctggcagcgtttcgtgccttcctcttctacctcaacacctttgcttgggcgggtcccctctttgtcgtcatggtcttcctgacaccctacgtgctcgtttttgatcggaccaggtgctgccatggggacagatggcggtgccaagatgtgtgcaagcatgacgtcttccctgctcacccttgtaaacttgccacccaaccacacactgggaatcgcaggaggaaagcgcagcacttcttcaacacgctctgggccaagatcagctccttccccttctatcgcgtcgtcatctctggccttgagaatctgccgccacaagagcagccagctgtttatgttgccaaccaccagagcttccttgtgagttcagcagggtggcggctgtgctag

SEQ ID NO: 90 - protein, 325 aa, Chlorella protothecoides
MNHPPVSACKVTPNKLFPALLVVQHMSCAMVTLPTRRHGDSPLSPPLHSRKGPRKCPDLFQLSFKGKISSFEASEKGRQASTVVKWRSRREDCQGAPTPGRQPNWSASNRRCHPQGEGQQDSPRHSMPSLRIGAIRQRPTNGLDAGTAPGAAKSEVLTKIGEAGWAAMPPMLAIPLALPLPCNPYLWTPEVGLKGALAAFRAFLFYLNTFAWAGPLFVVMVFLTPYVLVFDRTRCCHGDRWRCQDVCKHDVFPAHPCKLATQPHTGNRRRKAQHFFNTLWAKISSFPFYRVVISGLENLPPQEQPAVYVANHQSFLVSSAGWRLC

SEQ ID NO: 91 - DNA, 1017 bp, Chlorella protothecoides
atggtcgaaacggaacggggggcgggacctatcccctcgacctcctcgcgcctcctgggccatgtcgggcactacctcgcgctgccggtctggatcttcggcctggtcgcgggggccctatggcccacattcaccttgctcctcctcttcttcttccccaagctgggcaccgtgagcctggccttgctggtcatcgccctgttcaccccgctggacgtgccctgccccaaattcatgacccggtatctgcgctactgcacaacggcggccagcgagtactaccccgtcaccatccgctacgtgaagcgggaggccttcaaggacaccaagaagcctttcgtgatcggtgcgccgagaccggggtcccaaccggtttcccgacaccaccaccgccctgcattctgtcacgcaggccgccctttcccggctctcgcatcccttgctccacccgcccaccctgacggaccccttccacccccccaccctgcagggtacgagccgcacagcgtcatgccgcaggccatgtccatgtttgggtcccagccccatccggatgtgctgccggagctgcagcacgcccgcctcctcgcctcctcggccggcttctgggcccccctcacccgtcacctctggtggtggctgggcgcgcgccccgtctcccgcgattccttcgccgcgcagctgcgctccggcagctccgtcgcgctctgccccggcggcgtgcaggagtgcctgtacatggagcgcggggccgaggtggtgtacctgcgccgccgccgcggcttcgtcaggctggcgctgcagcacggcacgcccctggtccccgtcttcgcctttggccagacggagacctactcgtatgtgcgccccttcatcgactggcgcaccagcctcatccccaagtccaagtacttcagctttgtgcgccgcattggctatgtgcccatgctcatcttcgggtcgcttggcacggccatgcccaagaagttccccatcaacatcgtgatcggagagtga

SEQ ID NO: 92 - protein, 338 aa, Chlorella protothecoides
MVETERGAGPIPSTSSRLLGHVGHYLALPVWIFGLVAGALWPTFTLLLLFFFPKLGTVSLALLVIALFTPLDVPCPKFMTRYLRYCTTAASEYYPVTIRYVKREAFKDTKKPFVIGAPRPGSQPVSRHHHRPAFCHAGRPFPALASLAPPAHPDGPLPPPHPAGYEPHSVMPQAMSMFGSQPHPDVLPELQHARLLASSAGFWAPLTRHLWWWLGARPVSRDSFAAQLRSGSSVALCPGGVQECLYMERGAEVVYLRRRRGFVRLALQHGTPLVPVFAFGQTETYSYVRPFIDWRTSLIPKSKYFSFVRRIGYVPMLIFGSLGTAMPKKFPINIVIGE

SEQ ID NO: 93 - DNA, 1860 bp, Chlorella protothecoides
  modified_base (468)..(477): a, c, t, g, unknown or other
atgccgtccagagaatggtctggatgtgtcttgttccagggtctcatgagcccgtccgcctcagcaggcctggccaaggcagtgtgcctgtgcctgattcagccatctgctcccctgttcctccctcgcgtgcccacaatccaagacaccacacccccgctcatccctgccctgtcccgcctcttgtcctcaaccagggcgccgggagtggcctgccttccaggactggtttggccggcagctggaggaggtgctgcctgcctggctggggtcgctggaggtggtccgggagggggcctcccagccgctggacccagagaaacgctatgtctttggctttgcagcgcacggcctctaccccctggcacctgcagcggcatcggatcgggtacagggaatggtgaggtacggtccccctactctttgcccatgcgcttatgtgtccatcatgagcgcaccacagccacnnnnnnnnnngcatgtgaaccagggttgtgtgggccggtccctccagcgactgtgtcggggctcagcacccgcagcagcatcggaccgggtacagggaacggcgaggtacggtccccccactcttcgcccatgcgctcatgtgtccatcatgagcgcaccacagccacccctccgacacccgaatccgctcctatgctcacaggggccggctacctcccagtgctcccctccttccggcgcctcctccctggcatccgccccgtcaccctcaccgcctcggtcgtcttcgtgctgcccgtgctgcgtgacatcctggcctggctggggctgagggtggtcacacgccgctctttcttgcgtgccctgcgcgagcggggctccgtcctgctcgtccccggcggccaggccgagctggtgcacacccaccgcatcttcaccgcccgcgagtactgcgtgtaccgcagccacaagggtgaggcgctctggggcggccccgtgcctcgacgccgctgtcttgcaggcacaggccagcctggtccccctcctagtgctgggcgagatcgactccctgcgcaacctcatcagcgccccggccatgctgcagtggacctacaagcgcctgggcttccctgtgccgtacctcatcgtggggcggtggggcctgacgccctttcctcagcccacgggactcaggtaggggtcctggggtgtgtttacctggtagggaagctcttggcctggaagaggcttgcatgcaggagtgatgttttcacgcgagggaagctcttggccgggaagaggcttgcatgcagaagagatgttttcacgcgaagtttcagtgcaagggacgccaggcagacctgccaggcagctccccgcacaggagggatgtggctggccattcaagtagcattgcccaagccagacactcctacactgtggtccacccccccgcagattcatcatcggggagcccatcccccccgtcgagctggggccgggggaggagcccacccaggagcaggtggacgctgtgcatacggcgttctacgacgccatgcaagcgctgtggcacaagcatgcccccagcttcccgggatcatccctctgaggaggcccatggcttgtgctgaccgctacatgctggcccccaggctgcatggcgtgggaaccccagcagatgcaagggttgccttactgccctgtatgccccagacaggagagaatgtgaggcgtcaagcctggcctgagacacaaatgcactgcctagctgcacaggaatggtgcctaatctcgttctacatcgccgtgcttgctactgatccatttattgtccgactccccagacgttcctgtcctccaccaatcggacgactggcccacactcgctag

SEQ ID NO: 94 - protein, 619 aa, Chlorella protothecoides
  MOD_RES (157)..(159): Any amino acid
MPSREWSGCVLFQGLMSPSASAGLAKAVCLCLIQPSAPLFLPRVPTIQDTTPPLIPALSRLLSSTRAPGVACLPGLVWPAAGGGAACLAGVAGGGPGGGLPAAGPRETLCLWLCSARPLPPGTCSGIGSGTGNGEVRSPYSLPMRLCVHHERTTATXXXACEPGLCGPVPPATVSGLSTRSSIGPGTGNGEVRSPHSSPMRSCVHHERTTATPPTPESAPMLTGAGYLPVLPSFRRLLPGIRPVTLTASVVFVLPVLRDILAWLGLRVVTRRSFLRALRERGSVLLVPGGQAELVHTHRIFTAREYCVYRSHKGEALWGGPVPRRRCLAGTGQPGPPPSAGRDRLPAQPHQRPGHAAVDLQAPGLPCAVPHRGAVGPDALSSAHGTQVGVLGCVYLVGKLLAWKRLACRSDVFTRGKLLAGKRLACRRDVFTRSFSARDARQTCQAAPRTGGMWLAIQVALPKPDTPTLWSTPPQIHHRGAHPPRRAGAGGGAHPGAGGRCAYGVLRRHASAVAQACPQLPGIIPLRRPMACADRYMLAPRLHGVGTPADARVALLPCMPQTGENVRRQAWPETQMHCLAAQEWCLISFYIAVLATDPFIVRLPRRSCPPPIGRLAHTR

SEQ ID NO: 95 - DNA, 609 bp, Chlorella protothecoides
ggaggaattctacgctcatccatcccaccctcatcacctggacgttgccgccatgcagccggttttcatacctgccattggagcacaggagggggagctgaccgctcccttccccgcctcacattcccccacacaggaggcgacggcagcgatcaagcccatcctgaaggagtactaccagaaggacgatcggtgggtgggacgcgctgtgtgggaggactacagcgcgtgccgctacgtcgccccggacaccaaggaggacgactctgcgctctggttccgcaagtgagcgggaggcggaagccctggaagcatgccgtcggacgtggcagccgctgcgcacctgtacagggcggactcgtcactggcccccagcgaaagcaatctcggtgtctcatgcctgtcccgtgggtagacagtgcgccttcagtggaaagctgcactcctagcgcagagggtcagcccttcatgactgtccaacctgctgcagtgcctgtatcttatagctcagggaaccaggggcagggtgaaggatggagggggccatcaacttcaaaggtgcgggaacgattgtccgaggtgtatccggtcgctcgcaaaacaccctga

SEQ ID NO: 96 - protein, 78 aa, Chlorella protothecoides
MQPVFIPAIGAQEGELTAPFPASHSPTQEATAAIKPILKEYYQKDDRWVGRAVWEDYSACRYVAPDTKEDDSALWFRK

SEQ ID NO: 97 - DNA, 1302 bp, Chlorella protothecoides
atgggccccatcccagactccctcccggtcacccccttcccccaccgcaaaatcctgcaggagcaacacgccgcccccatcatcaacaagtactgggagaaggcggagttcccgcacgagctgcgctccaagttcggcgagctgggcatcggcggcgcgcacatcaagagccacggctgccaggggctgaccaccatgggcgccgcggcggccatcgtcgagctgggccgcgtggacgggtcgctgtccaccttcttcctggtgcacagttacctgggcgtcatgacgctgggcctgctaggcagcgaggcccagaaggccgagctcctgccgggcctctccaacttctccaaggtcgccgcctgggcgctgaccgagccgagcaacgggtctgacgcctcggcgctgaccaccaccgcgcgcaaggtcccgggcggctggatcctggacggccgcaagcggtggatcggcaacgggaggggaatctgcgatgacccgctcctcgacgctcacacctccgctgttcccttctggtgccgccctctcaagcatttacccaaacccccttctcctccccgcccccccttcccacacacagccacctttgccgatgtggtcattgtgtgggcgcgcagcagcgagacggggcaggtgaacgccttcatcgtgcgcaagggcaaccccggcttccgcgccaccaagatcgagcacaagatctcgcttcgctgcgtgcagaacgccgacatccacctgacgggggcctttgtccccgacgccgaccgcctgccgggcgtggagtcctttgccgacgcggcgggcatgctggccatgtcgcgctgcatggtggcctggcagccagtgggcctggtgaccggcgtgtacgacatggtgctgcgctacacgagccagcgccgccagtttggcgcgccgctggcctccttccagctggtccaggagcggctggcgcgcatgcaggccaccatccaggccatgtacctcatgtgccaccgcctgagccagctgtacgacgcggggcgcatgagccacgagcaggccagcctggtcaaggcctggaccaccgcgcgtgcgcgcgaggtggtggcgctgggccgcgagtgcctgggcggcaacggcatcgtcgccgacttcctggtggccaaggcctttgtggacgcggaggcgtactacacctacgagggcacctacgacgtcaacgtcctcgtggccgcgcgggggcagaccgggtacgccgccttcaagaccgcgggcagggccaacaaggcgccgcccccaacacactag

SEQ ID NO: 98 - DNA, 570 bp, Chlorella protothecoides
atgctggcgggcaatgcgcacctggcttacgaggcctcccgcctcctcctccgcctcttctcccccgccgcggcgcgcagcgggctacccgcctggcaagccggcgggtgcgcggcttccctgctcgggcccggacccctgcctgacggcctcctgggcgcggcggggtccgggcctgacgacccgccgctcggcgcggaggacagcggcgaggaggtggcggccgcgcgcgcggccaaggcggtggtcttcatctccgactcgcgctgcgacgcactggttgccccgctggcggcgggcgaggctgcctcgcccctcctcgtcctgggcctggtggaggcggtggccgccgtggtttgcgagcccgggtcgcgctccaccgagcaggccacgctgaccgccatgctccaggcaggcggagctgatagagagcgggaagaaacatgtgcaggggaggcgaaggcggctgggctgcagggaaacgggaagtgggatgtgccaggcgtggcaaccccctctctctcacaagatgcacggaacccttgcgactgcccgtcccgcacggggtga

SEQ ID NO: 99 - DNA, 1005 bp, Chlorella protothecoides
atggctgaccaggcaacaccggagggttccctcatagccctcatcgcagaccaggatacggcaacgggcctgttgctcactggaatcgggcatgtagactatcgtgcagttgatgcttcaaggggactccaaatccctcccaccccaccatccctccacagaaacaccacaagggaagatagaggatgccttccgagtccttctctgccttgtcagaatgactataacctcatctctctcacttctatgtcttcattgttgcatggggtggtggccgggaccatccggcacctgctcaacaactacacgaagcccatccctgctgtgctcgagattcccagcaaggacactccctatgatcccagccaggattctgtgctttcaaggtatgcgcttcctcgactcggactcggcgcgggcaggtttcacaggcttgaatttcagaggctgaatcgcagggacggcacatgcaggcgacaagattggtcaaccagcaaggattctttcagattcatagtttggtgttttggggtggttcattgcggctggcgagttgagacgctcagcagctgctccgaggagagcagcatgaagtgcacacggaaactcgtcctcgtgaagaagagcgcagcatcccccgggacagcccctcgcctgctcacttcagcgtctcgatggcgtgacggacgacatggaaacccctgcaattattgggttggggggttgccgggtcaacatcaagctgggcgtaagcgattgcaacatcagcatattgaactccctcgcgttcaccaacatctggaacaggaaggcgagattgctaaccctcaagtgggcaggcttgcgtttgacttccaaaggatgtggctggtacacaagaggggtaatcgcaaggtccagccttggctcacacaagggtttgaagatgtcctgcagtcctgcgattcccacacatcaccagcagtcctcccgcccccccccagcatgtcccggcccccgacctga

SEQ ID NO: 100 - DNA, 921 bp, Chlorella protothecoides
atggctgctgcgattgcctccaagctggacatactcaaggcgaatgagggtctgctggacgccgagacgcgcgtcttggtgagcgccctgctggatgccgggcaggagcacctgttttcggggtggccggagcctggcaaggacgacgacaacaagcgccgtctcctcgctcagctgcggcagctggactccagctatgccggtggcctcctgaagtacatttcgaatgccaagaagctgttgaaggactccaaggaaggtgtgttgcctgtgcatgctgcaaaccaagatggggagtgcctctcagcactgcctgatacaatatacggacaccctatcttctcccagggtccaacccctttgagggctgcgtcccttctgtcccggaaggggagaagctggattccggcagcgatgccttcatcgagctcgagaacgcaggtgggccctcgcctgcagagcagggtggcagcatggatcttttttctcgagacttcactcccaggtgctgggcagctgcaggatggctcctcgccctgcgatacgggcagaaaccagctaaatgtgctcgtatttcgcagtattaccaccccaccgttcctcaacccgtcagggcttgccgctgcgggagacaccgccttcgtgctggtggccgggggcctcggtgagcggctggggtactccggcatcaagctggccctgcccgtcgagagcgccacggggggctgctacctgaagctgtacatcgagagcatccttgccctccagtctccacctagagatgtgctggttgtggtgtctgccttggcgtcaacatcctgctgcacaaacctccaggacccccattctatcaatgccccacctcccaatgcacccaagtgccaatgcccttgcccccccttccctcccacccgcaattaa

SEQ ID NO: 101 - DNA, 834 bp, Chlorella protothecoides
atgctcatgcaagcgaggtgccggacccacgcatccacccgtccccatgctttcagaggaggtgctgaacaagtgcgtgctgaatgtgtgcaaggcgggctccgagctgctggtggctggctactgcctctactcctccagcaccgtcctggtcctcacagtggcccccctcccccctcccattatgtaggcgacggcgtggtgggcttcacctttgacgccctggtgggcgagttcatcctctcccaccctgacatcaaggtcccagacaaaggcaagatctacgctttcaacgagggcaactacggggtgccctgcccagcaccccatcatgcacactggctcgtaactccccccgccccccccctttcctctgcacagcgctgggagcaaggcgtgaaggactacatcgactcgctcaaggacgagagcaagtggggcgggacgccttactccgctcgctacatcggctccctggtgggcgacttccaccgaaccctgctctacggtgaggtttggctgtggctaggagacctggaagcgaggaaggcagccggtggaatctgcgcggtggtcactcttgcatccgtgggtccctggaccccgccgtggcacccgtcagtttacccataccgcacctcaacagggggcatctacggctaccccgccgacacaaagaacaagacggggaagctgcggctactgtacgagtgcgcgcccatgagctacctcgctgagcaggtgacttggagggtggtaagatgctgtatcaccgatccctgcacggtggctgagagcctcgatacccagggttactgccggccgcctccgtag

SEQ ID NO: 102 - DNA, 1332 bp, Chlorella protothecoides
atgcgatgcggtgcgtccagcacaagtctcccccttgcctctgcttcctgcaaaggcccaatctcccagattaccaagcctgctgtcacagccgtgttctgcctcctcaatctcaccccatcggtcgaccgcaggttcgagcccagcgctggtgaggtcaacacgcgaggcggtgctggaggacgccgatgcgctgctggcgtgctacggggtcggggaggaaagcggggcacggctcacgcacaccgtggtggagctcctcttcaccacctcgatagagtgggtgtcggccggaaaggaggggctgcatagttcctccagcccggcctgctgctccgcggcgtggactttggggacgtggggtcacgtgacgtgcggggtgtgccacgccgctcctgggcgctgcgcgcctcccagcaggccgcttcggtcgcggcggggctcaccgagtggcaggccaatccctactactgcgccgggcgcgtgaccgtgcccgccctgatggacgccttcctctgctccaactttgtcaacaggggcctgccgcgtgagaccctggcggagctggcgggagatggcccctcggggggcacgggcggcgcggcgctgctgcagataccggtgccgcccgagcaccgtgggaagccgtacggggtcctgttccacaacctcctcgccgagcagggcctcatctgcctcggcctcctccgtgaaaaggtgagccagtgtttgccgggaaggggcaggcgccaagcgcctctgcttcgcaaaagggcattacgtacttgtgtggttgattgtcgcgctgtgggcacggcgccccacaccccgctcatccacgccctccctggctcagtcggagacccccagcagccgcctgccctacgtgcccaaccaggatgcctagcaggctggaacttgggccaggcatgcaccgttggggccaggggcccccaaggtgcatgccatcctgactggccaacagagtccttgatttcttggcagcgcctccccttgcgaccagccatgcgccgctcacttcacccaccctccctgctcggcctctccactggcacctctcggctcagttgcaacagtgactggaaagaatggactgtgagggctgggaatcacttgaagaaggactccaggtactccacctccgacttggacccgcagaagagaggcacgcgttggtggatcttctcgggcaccagatccagtacacgctgggtgccagttgagcccaggccgccagcctgcagagggtggaggggtgaagggaagcaaacattggcaaactgggatgctgatgagacggcgaaagtgtag

SEQ ID NO: 103 - DNA, 1035 bp, Chlorella protothecoides
atgcaaacagcgccagcattgaggtgcaatgcccatcaaaacgctagggcgcgaggtccaccgagatcacttcgtcgtcgccagcatggacatcaggccatgcaccctgaggctgccagggacacctcgcctccgccgacgatgccgttcggccaggtggtggtgggcccccccgggtcaggcaagtccacgtactgcgcggccttggcccggcacctggcatccagcgggaggagtgttgcggtggtgaatctggacccagcgaacgacgccctggtgtacgaggccgccctggatgtgtcggagctggtgggcctggaggcggtgcaggaggagacggggctgggccctaacgggggcctcatctgggcgatggagtatctggaaaccaacatcgactggctcctggatcggctaagacccctgactcagggtgaggaggggtgcatggactcgtatgggccgccgccgcagtgcacctctctagaggggtcgcggggatgtgctggagcagtgccgctggaatgctccaggacccgctttgcatgtgtttggggacacctgacggtggagctcttccagctgcacgccggcttcaagcgcatcctgggcacgctggagcgccagctcagcatgcgcctggtggctgtccagctcatcgacgcccacctgtgcgccgatgcgggcaagtacatggccgccctcctgctggccctgtccaccatgctgcacctggagctcccccaggtcaacgccttctccaagtatgacctgctggaccggcacggcgacctggccatgagccaggagttttacctggaggcccacgggctggagcacctggtggaaagcatgagcgttggctttccccctgcgttccaggatctgagccgggggctgtgcgaggtggtggaggactttggtctccttagcttcctccccttggaagtggagagtgcagagagcatgaagcgcctggtcgccgtggcagacaaagctaatggctactaccacatcccgcccaccatggcctga

SEQ ID NO: 104 - DNA, 2259 bp, Chlorella protothecoides
atggtccagggtgtgctcatgcacacgatggtgccgccaaagcgggactgggggcctgaaggcatggctctggtcctcgagtaccatgattgctcctcggccgcggctgcggcggggctccttgccgtgctgaccgagcacttttcggacgcagactggctagcaaagggtctgggcgtggcgctggtcgatggcagggacgtggtgcgagcccggcaggcactcgaggcgctcctggcggcccacagtcgcccaccccatggcccggcctcgcagttggcatttcccccgcccacgagcctgcacggcgccgcagtcttctccctggcctcggtccaggattcgacgcctgccatgctgggcatgcggctccacggcaggtctgggcgcctgcccaatgctgacctcgccgcgacgctgtcgagggtcgccgagcttacccccggccccgcccgcttcgaccgggccgggatcttcacgtgggcagtcctggaacccaccctgcgctccttcctcgccacggcggcgggggcgggagacggcctgcacgccgtcttcctagaggcgggcacggacgccgcgaccctggactggccactgcccgagccctcggaccggggcgccatgcgccaggcgctgcgcagcatggaaggcagcctgcgcgcactgagcaacctagaggagcgcctgcaccacgccagctccatgtactggccggcgggcgggcgccacgtcgtggacggagctgcacttctcgccgcaggaatcgcctgccttgttgcactcgctcttgagctagggcattccgaggatgcggatcccaatcccagttcccacacggtcgttggattgcccagccttgcagccctgtccctgaggcacgccctcagcgtccacctggcgtgccacctcggggcggctggcgcgctgtgcttgccacggctctccgccgaacgcatcggtgaggcgggcgttctggctgccgccgccgccgcctgggtgctggccgcgggtgaagccgccggtgccccacccggccccatcccgctgccgaaactcaccgccggtctgtgcctcgtcttcgggcctgccctgctcctgctgaatgccccgctgctgatcctgatgacgtgcgggtgcctctggacgctgagggccccgtcgccccttgcgcctctgccactcgccctggctgtcccgctctgccttgcatgggactgtgcaccaacccttgtcttcctttcggcgcagcttgcttccatcctgaggggagtgttcctcggtgaaggagatgccgccggtggctgggaagtcccctacgctgcgcaggcaatgcatcccgaggcgagccagagtggaggcctgaccatgatcacttccaatatgacgggcctgcgcaccgatgaggacatggagaccttcctcaacgtgaacaagagcaaaattgcgctgttcccaaactttctgcgcctggccggcgaggtgtgtgagaggccagtttctgcagcccgggtggcaggattgtgtgctattgcacccctccattgttccctcatcggtgaagagccaggagatggagtttgccgtggctcaggtggattacatgcagtctgcagcctcacatgtgaccttcaccccgaccctctccattttccggcgtggccggaaggtggacgagtttcacggatccagcccgcaacaaattcgggacagggtgtggcttcagaaagattgattcgcaaaggcactgcaagggttgattattttagcatgcttccgtactcctccccattttccctaatgattccaattattgtcaacgtgctgctggcactgctagacgagttggagcgctggtgtgaccatgggcagcatgaagcgaaaaactacgttgggggggtggtatgcgtgaagcccggctggtggttggcgacgaggagcaaacaggacaacccctcctctcagcctccaaagcccagcaattgctgccacgggcgcgctgcctcagatgcgggcgagcgctggagtctgggcctctgcaaaccaggacccatccctctctgcccagctcttgagcaggtggtgggctatggcatagggtggcggcaggaagaagggcatgccggccccatcgccgccattcagggggctggcggcgctgccgctgtttttgagagccttgcgcacgtctgcgagaagagggtggtgggggcatgggatggctgtgaggggcggccctctgcccataggttgagatga

SEQ ID NO: 105 - DNA, 669 bp, Chlorella protothecoides
atgtcaaggttggtggtgacggaggcaggtgaggacccgcaggccctaggcgggcagtctgacgagacggtccgacccaccgaccgggcgaaggtttggggcccgcccgcgcgtcaagattaccgatggtccatcccgcaccccctcgagcgatgcttttcccatctcaaacaccttgaacacaaaagaatctcatatcaggacacatccgatgctgagacggggccgcagctcccatcaaatcgcccgttaggtcctgaactccttggccgggggcctctgacagaggacggcatcatcgagagcgacagcttcactcacgttccttcaccatgcctttcgatgccaataggttacaggcaagtgcctcccaaggaaatcaccgacatccggcgtgacacagcctctggcgtgaccatcagccccacaggggccaacattcgtgaacttgtaggctgcctccgaggtgagcctgggagccctccacttcacggtgtcctccatgaaactgcaggccctcctgatactccatatgctggcggctacttctatgtgtccatcacacttggtacggggatgaggatggcatcctgtccaggcatcaatgcgcgggccgtgtataccggaaaggagagtgattactctcatctatcggggcttccagcgtga

SEQ ID NO: 106 - DNA, 948 bp, Chlorella protothecoides
atgacctttggtccacccagccttcaactcctcctcctcctctcggcctgctggaccgcatcaccttgcaccggtctggcactcgcacctcgccgcctgcgcctgtcgcgggggcccagcgactcgtcgcccctcactatcacctgggccacggagggcggcctcctgcccgccgccgtctgtgtggagtgggaggctgccttgccggctgctgggaggggcctggaccagccgaggctgggtcctggccctgctccccagcagcgctgtgccagtggtgccagcacgccattccacgaccccggcgtgaatgcaaccacccaggtcgtccacagcatggagctgcggggcgtggatttgcctcccggacaccccttcaggtaccgcgtggcgacggttgacgccgcggcagcagtggtcgtcgccgcggcagcggtgtggtcgccatggcaggcagcccatgtgccggggagcaacgatgaggaggtgggcggggtgaccgacgcaaccacctcttcgctccttccttctcgaccacagacccgcctcctggtgctgggcgacatggggctgtacaacgtccccgcgctgcctgccctgattcaggatgctgagtcggcggcccaggccggcgcccccttccatgccgccctgcacgtcggcgacctggcctacgacctgcactcctatggagggtcccgcgggtcgcgctttctggaagccgtgcaacccctcgccgcctccctgccctacatggtggctcccgggaaccacgaggccgggccacacaacttcactcactacaggtgtgtgttgcgggcgtgtggggtgtgggaaatggggggaggctcgggactggggttgagaggagcattcgcatgtgactccgaccccaacagtgtggtccgcagggatctgcaccgtttcacactccaacacctctgctga

SEQ ID NO: 107 - DNA, 528 bp, Chlorella protothecoides
atgcacgcagcggtacgtgcacgaggatatcgaatctttttcaagctgctactctcgttgcatggatgcatcctcgctgcgtgcgcagtgccttcccggctgcgccatcattgccagggtacacgagtcctagccagaccccatatccccacaccctccctcaggggtcccgcccgcccgtccaagcaccagcgcccgaggtccttctccgtcaacggcacctccaagctgtctgagagggagaccgcgggcagcaccaaggacgccagccccttcaccgtgggccgcctcttcacgctcaccacctggctgctggagcaggagaagcgggaggtgatcgactcggaggtggccatcgtcatctcctccatcgccctggcctgcaagcagatcgcgtccctggtcaaccgggcggggatcagcaacctgacggggctggctggcgctgccaaccagtctggggaggatcagaagaagctggatgtcgtggccaacgatgtttttgcaaactgcctgagatccacgtga

SEQ ID NO: 108 - DNA, 324 bp, Chlorella protothecoides
atgcaggagctacatgaacgctcagtcacgctgctggagggatcggccatctcttccgaggacctggtgactgcccatgccgagaaggcgcgtgccatcctcctcctggcagatcgattcaccacagatgctcaccaggaagacctgagcatcctgttccagacgttgcgccagagcacagtgacccagatccggccctttctggaccccagtcaagacatcgtggtgtccctggagcagacgcggtacagactgcttgccctctccgccgtctgccccggggccacgacgctcctgggtttgtggagggagggaattgaatag

SEQ ID NO: 109 - DNA, 315 bp, Chlorella protothecoides
atgaccctcaagactgcactgctgagcctgcagtcgctgctcagcagcccgcagccagatgaccctcaggtcaaacttgctcaccaacccccacaggatgccgtggtcgcccgccagtgtctcacagaccctgcagagttccaaagaacagcaaggttgtggacggagagctttgcgcaggagcgacgagctgatgcggccaagctggggcgattgacagacatggggtttgaccggggcgcggcagaggcagcgctgctcgcaggagggggagatgagaatgccgccctggaggcactgctgggaggagggtga

SEQ ID NO: 110 - DNA, 696 bp, Chlorella protothecoides
cccggccccacccccgcctcccgcctgctggtctcgcgccggctggcgggcctgccccccgccctggccgccaccctgacgcagctggaggtctgcccccagggcatggcggtcgcggaggggctggcgcggcgcgtggcggcgcacggcggcgccgcgctgctcatcgactacggccaggacgggccgtacgaggccagcctggccgccatcgcgcggcaccgcttccggcccctgctgcaggcacccgggtcggcggacctgtccgcacgcgtcgacttctcggcgctgcgccaggcggcgcggggcgcggggcagggtgtcgcgtgccacgggcccctgacccaggcctccttcctcctgggcctgggcatgggggccaggctggaagcgctcctgcgtggcgccgacgccgggcaagccagggacctggtggccggcttccggcggctggtgggggtggaggggccgcggatgagcagggaggctgaggacgctggagcagccgccggcggaggcgaggcgcggggaggggcagcgggcgccgcagggcaccccggcccgacggagggcgccgaaggggaagaggaggaaggaatgggcgtggcctacaaggccatgtgcatcagctccagcgacctgcccgtccctgcgccctttgacgtgctgccccccaggcagcagcatgatgctcaa

SEQ ID NO: 111 - DNA, 285 bp, Chlorella protothecoides
atggacgtgcacgtgctgggcgagggcgacgtcgatacggaggtcctggaccccgcccatgcggtgctcaagctgaactccggacacaccatcccggtggtcggactgggggtctacctctgcgaaccaggagcccaggcttacgaggctgtcctctccgcgctgcgactggggtacaggcacatcgacaccgcccaggtctacggcaacgagagtgatgttggaaggtgggtccctcgtctgggaccttgggaagtgactgaacctgcgtgggcccccctttga

SEQ ID NO: 112 - DNA, 279 bp, Chlorella protothecoides
atgcaggcatactcaccgctggcaaagggccagaagctggatgacccaaccgtgaagcagctcgcccagaagctcaatgtgacgccagcccagctcctgatacggtggggcatacaaaaggggtttgtgtcactgccaaagtccactgtgcctgcgcggcaggaggtcaacctgaatgtattctccatcaccattcctgatgatgacatggcgacgctggatggactggaggcggactttgtgaccggctgggatcccattcgcgatgcacctgtttga

SEQ ID NO: 113 - DNA, 684 bp, Chlorella protothecoides
atgcagctggacccgctgctgcgcgcggcgtatgacccggagggggacaccaatgatgacaccgggttctcgcccttcccagtctatctgagcgcacccctactcccccaaatactcgacgcaggcaacatcaaccagctcattgtgagcctggactcgtactgcgaggagctgcagaagaagggcggcgtgatcggggagtttgtcaaccccaagtacgccgatgccggccgcaccagcttcaagagcagcacgcgcctggagtgcatgatgcaggacttccctaaggacctcccctccactgccagggtggggtacacctccatcaaccaggtctgggccgcctactcccccgtcaagaactcgccagcggatgcggcagccaaggcggcggggggcaacccctcgcactccgccacgaccggagagctggattactacaaggcgaactgcaaggtggttggggagacagggtatcgcctaagcccatgccgccagcttgagcctctcaatgtcctcatcctactccacctcaacctcatgcggcagatgttggagcatgtgggagcgtgcatcgccggcccttccagcgcctccttcaacggtctcgaggatctggacttctggccccgcgtcgtctggccacctgcttgggccatcggattcgaccagctgaaggtgtga

SEQ ID NO: 114 - DNA, 1299 bp, Chlorella protothecoides
atggaggaccaatctttcacgggcaaccccctggtccggggcctgcgccggggggccaccctggagaccgccctgcgcagccccggggcccggttcctgcccgtctccgagcgcagggtgggcgtggaccccgacgggggcctggcctggctgacgccagggagcctggccggcgcgggcctgcggctggacccgggcgcggagcacctggccgcgcagggtgagatcgagctcccgctctacaccctgggcctggaccgcgaggcctggcactttgcggtggatgtctcgagcctgggacctgaagcccccgccctgccccgcctggccgaggtgcgcagcctcatgcccctcctgcccaccgaccagctggcgatcgcggggcaggcggtggcgctggcgcagtggcacgccgcccacgcgttttgtccccggtgcggggcccccacgcgatcggcagagggcggcgcgcggcgccagtgccagggcgacgcggcgcaccgcctctacccgcgcaccgacccggtggtcatcatgctggtggaaagcgcggacggcagtgcggcgctggtggggcgacccctcaactaccgcgcaggcaatatgctgacctgcctgagcgggtttgtggaccaggagattctggcgcgcctcgacccagcctgccctcgaaacgggcagcgtctccctacattgcccttcgtctgcgaaaacacacagggcgagtccatcgaggaggccgttttgcgcgaggtggctgaggaagccgggctgaagctggcgagggtggagatcctgggatcccagccttggcccataggtcgaggcgggtcctgcgagctcatgatcgggtgcgtcgcaaaagccaccagcaacgacatcgacatggacgcagctgagatggctatcgtgcagtggttgccgcgggaaggtgaggcactgaatagatggctggagggtggcatgcagctccccgcaagtgccatgagcgagattccgccggcacccctgcggtgccagcgatgcggcatccttctactgctttcatctcaacctatgggcagagggccgcccctcacagccatcccatgcccccaccaccctcttctcgcagacgtgcgcaaggctctcaaaaacagcggcagcgccgccagccccctgaatggcggcgatggggccggcatgcccttcttcctgccgccaccctatgccatagcccaccacctgctcaagagctgggcagagagggatgggtcctggtttgcagaggcccagactccagcgctcgcccgcatctga

SEQ ID NO: 115 - DNA, 543 bp, Chlorella protothecoides
atgtgcagcgagttcggcagcgtgatcgcagtcaagggacggattggggagaagaaaaaccaggcgtttgtggaattcgctgagctggagtcctccatcgccattgtcacccggtatcaaggccccgccgacccagcaagggggttgccactaggggtcttcgatcttgacgccaatcgatgcaatgtccctggcaatgactggcatacgtgtgggatgcagcgcctgagtgcctccacctgcactgggggtgcgcctggcaggctcaccatgagtctcaggcatccaggcgccagggcaccctcccgcccctcccacatgcgcaacacccccgctgacacacgccttcccgtcccatctgccagctgcggggccggccggtgttcatggcctacgcggggcgcgaacacctcaccaatgtcacctcctcctacaccagcccctcccccgtcgtcatggcccgcatcacccacatctcggtatggtgggtggggcttctattctgctacattcctcaaagtggtctgtccctcgtgtgcttga

SEQ ID NO: 116 - DNA, 1569 bp, Chlorella protothecoides
  modified_base (1197)..(1295): a, c, t, g, unknown or other
atgctcctgcttgatccctggcggctgcccggcgaggcaccgagtgcgcgcggacacccatatcagagcccgaagttgaggcgccggtgtcatgctggcacacggcccctcaggtccctttcttctgttaaccgggactcctcatcctgccctccctcgcatgcttccaaccctcccaaagagctcttccccccttcccccctcccgctcaaggaaaccttggccccgctgctgacgctggaggtgctgaacgcggtgttcgcggcctttggccccgtgctgaagatggcgctgcagccgcaggggcccagtgaggtactggccttcgtccagtacggcgacgcggcgcaggcgcaggccgcgaagggcggcctggccggcgcacggctccccgccggcgcgtttgaccccggcgccgcccccgccgcgccgggggatgcgccgctggtggaaggcctgcagtactgctccgcgcgcaacctggtcatccccgtgcagtcggcgcacacgcgtgacttcacgcgccccgagctggcctggggcgagcccaaccgcgcctacatcagctccctggtcccagccgccgacgcgggcggcgccacgcgcgtgctcagcatcacctttgaccaggccacctaccccgtgaccctggaggggctgcataccatctgctccacctacggcgcggtgcagaagatccacacctacgagcgcgacgcgcgaatcgtggccctggtgcaggtgtgtggaaaacgggaatcgagtgggtcgcagggcacccttttcgttgttctgccttgggagaggggcgagctggggaatgggccctggcgagggggagtatggacccagacgaaggggggctggggcgtgggagtgggagggtcatgcacatgtcatcagggtgagggcaggcaggccgggctgcccgtttatgcggagcagtcgaccgccaccgcggccaaggcggcgctggagggccaccccatgtacggcgacggcgccaacgtcatgcgcctggtctactcgcgccacaacgacctggtcatccgccccggcgagcggtcccgcgacttcgtgcagtacccgcccggcaccacaccgcccacgcccacgccgacgcatggggcggcggcgccgggcgccgccggcggtcagcagggcggccagccggcgccggcgcagcagtacgcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggccgggcggccaccccgccacgcagcagcagcagcagcagtaccaggcgcggccggggggttaccctggctacccgccgccggggtcctggggtggggcgatggccccgcagccctacgcagcctatggggggtactatcacccgcagcagtaccaggggtaccccccgccacgcccgccgcaccaccaggtggatcaggggggagggccggatgccccacggggggcagtgcggtggacgccgtgcacaacgctcgccactctccgtga

SEQ ID NO: 117 - DNA, 1290 bp, Chlorella protothecoides
  modified_base (856)..(865): a, c, t, g, unknown or other
  modified_base (931)..(940): a, c, t, g, unknown or other
atgcccccacccgcccactgccgacaggacaacgacatcgttctgtgcgacggtccttgcaaccgagcctaccactgcaagtgcatcgtgccgcccctggacgtcagcaccctgacagaggatgagggctggctgtgccctgcctgcgaccacaagtgtattgcagagcgtaaggccaggtgtcccccgatctgccacccttccccacctcctcttcacctcctttatcgccataggtggacatcctgtcgctcatcaatgacgagttcgacacggagtatggtctggaggacgggtggcagcagatcctggagcctggcagcctccctgccagtgacggggccgaggagggggaggctgtggccgtgggcgagggcggcgcgggcttgctggtgggcggcgccgacctgccttcggaggacgaggaggattcggatttcgaggggtgaggagcagggggagtggtatgggctctggtgcatgcaccctctgcacggatcgacacaagggcagcgctgcagggtgcccatctgtttgacctgcactgtgcctcctggcctcttctccgatcgcagtgacagcagctctgactcgggagtagcgtcccaggcgagcgaggatggacggaggggcgagggagccggggccgccacggcgtcaccgggctcagaccccacctccctcccctccagccccgcctcccagcgatcgggcgcgagctccggctccagcggcctcgattcggagggcagcctggggtcactgggcgacggcgtggggcaggacctggggcggcgccgcccggggcgccccgcgtccagcctcgcgaacagctccgcgggcgtcgggcccgagnnnnnnnnnngtttgacctgcactgtgcctcctggcctctcctccgagcgcagtgacagcagctccgactcggggnnnnnnnnnncctggggcggcgccgcccggggcgccccgcttccagcctggcgaccagctccgcgggcgtcgggcccgaagacccagaagcgcagacgctggtggtcgagggccgacgcaggcgtgcgcaagtggactaccgagccctgcatgccgctatgtttggcacggtgggtcggggcgaggcccatgctggtcatggctcatgtgtcttctcgcatacaagctttcccgcagcattcttcacaccctgccatcacccccgcctcgcaggcagaggcggaggatggctctggtgaggaggacgaggtgtggtcgccccgcacgcaaccggggctggccctggagtctccaggctag

SEQ ID NO: 118 - DNA, 1725 bp, Chlorella protothecoides
atgcctgccacggttgtcccgaaaccacacaacagcctcctccaaatggagcctgcgcgcaaggcccccttttcccccccacccgcaccccccaaccagggagctctcggtcgacccgatgccggggactggtacgagccagagcccgtgcccggcctcccctccgacctgatcggcgtggctgcggggcactacacctccttcgccctcactgctcgcggccaggtgtggagctggggcgccaacgaggccctgcagctgggccgccgccagcgagacgaggcctacacccactcccccccgggtccgatccccggcctaccccccatcgcgcgcctggccgcctcgggcgtggtcggcttcgccgtgaccacacacggcgagctccacgcctggggcaccagccggcgtggccagctggggctggggccgggggagacggccgcgccggcgccgcgtcgtgtggaggcgctggcggacgcggcggccgtgacccaggtgtccgccggctggggccatgcgctggcgctgaccgtggacggcggggtttgggcctggggctggccggccgcggggcagctgggacacacgcttcctcctgaggacgccgacgaggaggcgctggcggcggcctgcgtctgggcaccgcgccgggtgcatgcgctggatgggcgcggcatagtccaggtggcggcggggtacgaccacagcatggcgcttggggcggacggcaggctgtacacctttggcgacgactccctgggacagctgggcaggcgggaggctgatgtgggggttggggtggcgggaggggccaccatcgttcgggagtcaggctctccaaggccaggccaggcgccattggccagccaagggggtgccgccccattgccgggcattttgagagcccagcccggccgtcccaatgccgcagcgcccaccacacacacctcccagcctggcccggccgacgcgtggctggtgcggggcgctcccgcctttgccaaggtgacggcggggctggggcactgcctggccctcacgccctgcggccagctgtacagctggggctggaacggcgcaggccagctgggcctcggggcgggggaggcggccgaggtggtggccacgccgcagctcgtgtacggcctgccgcgcaacaggttcgtggaccggggaggaaccagcggcgccccgcctcgaatgcacgccaggcaacgcattggagggccagcgattgcactcctgcaggcgagtgaacgcactgctggccgcggggcgcgtgcactcggtgctggtcacggacgaacgggacgagcaggacggcgcggagctgaaggacaacgaccacgcgggggccatggccggcatgtgcgccagctggggcagcggcgccaacgggcggctgggcacggggcagctggaggaggtgcaccatccggagctgctgcccatgctggacggggaggaggtggccgagctggcggcggggctggaccacaccctcatcctggcgcggtgatgtcgtgtgggagcagtgcagggcagaggcatcctcgaaacaagcaaaaggatgtcggaatgtgggcttgccgtccgccaggtcggaatgtgacactggcaggcactcatctcgcacacgcgcaccaggccacgagggcaccggcagtcagcgggcagacatcacgctcaggcgagtccactgtgaatcgccatccatcctga

SEQ ID NO: 119 - DNA, 789 bp, Chlorella protothecoides
atggtgctggtgctcgcggtgcacaccgtgaaggaggtctccgccacggtgcccttctccacgatcttgctccaggacatcgtggtgcacaagaaggcccccgctgagcacaaatgtcgccaggtagcgagtggtagtgtgggagggcccttgacccgtggccttacgcgcttggcagggcccttgaccgccggcccagggtgcccgcattgcccaaggtccccacactgtctgatatcccctcctgaccctccccaccccccgcagctgatccctacctccggcagcacctccaccagcctgtgggacacccccgaccccgcggccctcctggcctggctggagggcgcagtggcggtggacgtggcccactccgtgcacgaggtccaggaggagttcgcgctggggctgggcgacgtcgcgcgcgcgcgcggcgccgatgtcgtggcggccgccgggcgcgacgtggctgacaagaccggccgcgccgtgctggaccttgacgcgcgcctgcacctgagcgagaaggcagggcgcgcggccgacgcggtgcgtgacagcgcggtgaccaagtccaccgtcgcggcgctgaacaaggcgggaacgcgggtggccgacgtgaccacccgcgtgctggagagcgaccgcgtgaccgccgccaccgacgccatgggcgcggggttcaagaagctgggcgcctccttcacgcgcttcgtgcgaccgggggagccggcagcggcggccggtgccggcggcgacgcggtgagtatgagatgtgggatggcttga

SEQ ID NO: 120 - DNA, 330 bp, Chlorella protothecoides
atgaagaggcggctctccgtcgccatcgcgctcatgggagaccctctggtggtgtacctggacgaaccctcgaccggcctggaccccgcatcaaggattactcagcccagggccgcgctgggttcccagagagcacacaggggggcacttcattctcctccccgccccttccacaggcggctgctgtggaacgtcatcaagaaggcgcggcgcgacaaggccgtggtactcaccacgcactccatggaggaggcggaggccctgtgcgaccgtctcggcatcttcgtcggtgggcggcttagttgcctgggagatcccaaggtgcgctga

SEQ ID NO: 121 - DNA, 393 bp, Chlorella protothecoides
atgcattttctcaccttgacatcaggcagagcaagcattcagcctcccagccctgcgtcgaagcagtatcagactatccatcctctcaacctccctctcgctcttttacaaacaggcgaaagcgtgaccaacactgaccttattggctgggtgacaataggggtgcagcatataccccgggcagaggatgtacctctcatctccaactttggtgcaaacttctacatcaaggtgaggtgcttagcgtcgagctgccgggatcatgttggttgcctgggtgacacactcgttgcatctcttgcctggtcgcctgattgtgctgcctgcaatactcaactttctattccctcgaaaacaccatgccgtgtgcagccttggaactatttcgacagc

SEQ ID NO: 122 - DNA, 831 bp, Chlorella protothecoides
  modified_base (118)..(127): a, c, t, g, unknown or other
ggccgcggcggcggccacgtcgctgcccccgccggcgcccacagccggtgtgcccgtcagcacgcctcccgtggcagtggccgcgacggcacactgagaccacccacgcttgagcttnnnnnnnnnnccgcccccgccggcgcccaccgccggcgtgcctgtcagcacgcctcccgtggcggtggccgcggtggcacactgagaccacccacgcttgagcttgaatcatgccgaggtgctctcaccctcgtcagccatgtcgtaggcgaagggtgggctgggacgactgcatgcatggctcaaggatggatcgtgaacgctgtctcccaggatcgctcgggatcgtgggagctttggtccatcggggccatggcctcggcacggagtcctcgggacgacgagcttgccgacgacctgctggagtacatcaatgacagcgacacccaattccatgccgtcgagcaagcaaaggccaggctggatgccgcagggtacatgcgcctcagcgagaggcaaagctgggacggtctgagtcctggtgggaggtattatttcactcgcaacgactccacgctcgtggcctttgcggaccaagcacagagcgctggtgacttgcaccctacaccttccctcccccacacatgcaaacgctttcgcctgctgcagcccctgcttcaagctgaagccggtgtccaagtgcaccaagagcggctatgccatggtgaatgtggagccgtatggcggcctgctccagcacacctggttcgaccgggacctctcagtggcgggccgcgtgctgatcaggacagaggaggggtccatgcagcataa

SEQ ID NO: 123 - DNA, 1992 bp, Chlorella protothecoides
  modified_base (943)..(952): a, c, t, g, unknown or other
  modified_base (1219)..(1228): a, c, t, g, unknown or other
  modified_base (1626)..(1635): a, c, t, g, unknown or other
atgtcttggtgtgggggaaagaacttgagagcggggcaggcaagggtttttgctcggttgcaggccctgtcccaccaatcgggattcgtaagccaagctcctgcaggtctgacggcattgtcagcctttggtcacgttcaacttcccatttccccaaagcacctcctttcttcaacccctcccccccaagacatggcgcatgcgctgcacccaaactacccagaccggcacgacgcagcgcacgcgccgcgcctgggcgatggcattgtcctgaagcacaacgccaaccagcgctatgcgaccaccgccgtgtcggccaccctcttcaggtgggaccgggggtgcggagggcttgatcgctttgaaccatccttggggagggcagcgtcgcagtgcataggccaggagaggggtcagggctggtggagtcccatgaagcatggttgtgactgggctagggtgtgctgtggtgctggaggtcccccacatccagtcccccttcccacaatcaccaactctgcacagggaggtttgccgccaggccggcgtgccgacggccgactttgctgtgaggagcgacatggggtgcgggtccaccatcggccccatcctggcctcggggctgggactcaggacggtggacgtgggcctgccccagctgtccatgcactccatccgggaggtgggtttggacggagtctgggcaagcatgggaggcgagggggtggagtggtgcctggcctagaggcaatggctggtgtggggactgtggaaactactcctctctctgtgccatcgcgtcggacctggcatcggacccccatgcccgcgtccgaccatctcggcgcgctcagatacctcgccgcccctcctttcctggcgccgcagatgtgcgccgtcgccgatgtgggccacggctacagggctttcctcgctttctacnnnnnnnnnngtactcctctctgtgtgccgttgcgccggacctgcatcggccccccatgcccgtgtccgaccatctctgcgcgctcagatacctcgccgccccttcttcctggcgccacagatgtgcgccgtcgccgacgtgggacacggctacagggctttcctcgctttctaccagaccgtcagtgccctggacgccgcactcgagggtgccgacgcaggcctggcctgatgacaactgcctgtactccaatccatgggccagtggcctgggttnnnnnnnnnncgccctggacgccgcactcgagggtgccaacgcaggcccggcctgattaccactgcctgcactccaatccatgggccagtggcctgggttctgacaagcgtgcacacatgcccgcccaggggcagcagtggtcctgggtcaggcccggggcaggggcccagccggcttcagcaggtgccggtactgatccacgtggtcgaggatcagcaggcgcggcccgggcggcacgcgcacctccgccagggagctgcgtggcacgaagaaagagggaatggagagtggatgagagcgatcgccacccgagactccagccggcacacctcggccacgtcgccccgcctggcagcccggatggacaggagccctatcgcatacctggagtcccagaggccgatggnnnnnnnnnnagggagttgagctgggaggagggggtttggacgaggcccgcccaaggggcagcagtgatcctggactctagccagcacacctcggccacgttgccccgcctggcagcccggatggacaggaaccctgtcgcatacctggagtcccagaggccgatggtcctgtcctccagcagccccttcttgaagttccgctcgtacttctgtggaggcgtgagcggggacactggggctgaggagccggcctgggcgccgcgccatgtgcagcctccccctccgagccctgggtggccgagccatctggccagccccctcaccgacatgcccagcgtgtcgagcatcgccttgaccttcacatag

SEQ ID NO: 124 - DNA, 336 bp, Chlorella protothecoides
atgccggccgccaggcaaacctgtgcgccaaacctagaccccggtgctgaaccccaacccccaaatctccagggccccgtcctgttctccggcgccggcctctccgtctccccggagagcagcacggcctttgtggccctgaatgcgggacccactgcctacggcggcgagccggggaaggccgtgaccgtcgcccgcctggccgggcggggggtcggtctcgtggccctcatccaggtggggggcattctggtggtcgagtggggacctcatggcgacaggggaagagaaaatgtgtggagaagttggtggaggcgccgagaggcaggctcgtga

SEQ ID NO: 125 - DNA, 348 bp, Chlorella protothecoides
atggattccccacccatcaacaatctgcatgtgcatgcccttgacccgcaccacccccgccctgccacccccgcaggcctgggtggggcgctggacgtcgccctggtcctccagttcttcgacgctgggcacgacgtgatcctggccctggacccggcggcaggcccggagctgcgggagctggcctcggagctgggggtggacgtggacgcggccgaggcgcgcgtgctggaccactctgcgtacgacggcgccctggccgcgacggcacacgacgttgtgcacgctgacgtcagcgtgggcctgaaccgccacgttttccccgccggcatccacgtgagaatttga

SEQ ID NO: 126 - DNA, 585 bp, Chlorella protothecoides
atgctctcctccttcccatgtgcgcagctgggtgagcgatttgcgggatgctcccgcgccgtcgatgacgactatgtgaaggtcaaggcgatgctcgacacgctgggcatgtcggtgagggggctggccagatggctcggccacccagggctcggagggggaggctgcacatggcgcggcgcccaggccggctcctcagccccagtgtccccgctcacgcctccacagaagtacgagcggaacttcaagaaggggctgctggaggacaggaccatcggcctctgggactccaggtatgcgacagggttcctgtccatccgggctgccaggcggggcaacgtggccgaggtatgcgatagggctcctgtccatccgggctgccaggcggggcgacgtggccgaggtgtgccggctggagtctcgggtggcgatcgctctcatccactctccattccctctttcttcgtgccacgcagctccctggcggaggtgcgcgtgccgcccgggccgcgcctgctgatcctcgaccacgtggatcagtaccggcacctgctgaagccggctgggcccctgccccgggcctga

SEQ ID NO: 127 - DNA, 768 bp, Chlorella protothecoides
atgctggccatccacctccaacgggatatcaactccacaggcttcaaccccaacaagcagacagagtgcacgccactcctggccctccaggggcgagcagccgactgtggtggagacaggtgcctggggcaaccgcatgacgcagcactcaacggcgcctgcctgacggctgccctgcaagacagcgagggccccgcagtgtcagagggtcggcaccacccctggctgctccacatcctagccaaggagctgggtgtgaggccagaagacatcgtcgactttgacctcaacgtgatcgacacgcaggctggcgtgatcgggggtgcgtcgggcggcagtgggatgtggcccctgaactctagcgtcccttacttcgctcccgccatcccacccacgccgtgcctctgtgccccaggcgcggagggtgcgtttgtgttcgtgggccggctcgacaacctgtgcagctcgtacctgggcctgcgggcgctgctggacagcgacgtcagcctggcgagcgaggcgggggtccgagtgctggcgctgtttgacaacgaggaggtggggtcggcctcggcccagggtgccgcgggcccggtgctgcaggacaccatcgcacgcgtggcggcggtgctgggtgggggcgcggagggggcggtgcagcgcgccctgcaggcctccttcctcctctcggcgggtgcggcgcttggggcatgcatgcgggaggggaggtgtagggtggagcagttcatcatggctggaggggactga

SEQ ID NO: 128 - DNA, 282 bp, Chlorella protothecoides
atggctaggccactgatcatgcctctaatgctgttggcatgctgcgtgctcgcgacctcggcctcccagagcagggtgctggtcctgatggacgagccgagcttggccgagacgcactcccgtttcctggggggtctgcgcgcgcagggccacgacctggacgtgcagcctatcgatgccgccagcctgcgcctggtccgatggggagactggatctacgacaagctggtcatcctagggggcaggaagggtgaggagggagggggtccgggggttcggtag

SEQ ID NO: 129 - DNA, 1062 bp, Chlorella protothecoides
  modified_base (214)..(223): a, c, t, g, unknown or other
atgctggggtccaccgggaatgatggcgtgaagcggtgggcggtgctgctcctcgacccggtcaccacccgagtgttctcctccgccgcgggcatcgctgacctcctggactacggcgtgtcccgtgagtgcagctctcttggggtcagggtgcctgttgcacgctcgtcctccggctgcactcggagatgtcaatccccacgagcgtcgaacnnnnnnnnnnttgcgcctgcagggtcagggtgcctgttgccggctcggcctctggctgcactcggagatgtccatccccacgagcgtcgaacccctccacctccccaacgccctccctcaccgcctgcagtggtggatgacgtgctgaagcagcgcgagccgctgaccacgctcagcggcgtctacttcgtggcccccacgccagaggctgtggcgcggatcatcgaggactttggcacctcgcgcaagccgctgtaccgcgacgcctacctctttttctcctcccccctccctcccgagctgctccagcgcctgcgtggctgcccaggcctgctagcccgcctgcgcaccatcaaggaggtgaacctggaatacctggtgctcaaccgccgcaccttcagcactgcgcaggacggcgcgttgcgcaccttcttcggcgccggcgcggagctggcccccgcctacgcctacgagatctcggtggcggccacgcgcctggcctcgctgttcgccagcctgaaggagatgccagccatccgcttccgcgccgccatcccccccggcgacgacttcccgccggggctggagatccggctgctggtcgctcagcgcgtcgcgctggagctccatgagcgcctactcatcctgcagcacgcggggctggtccctgaggccgacacctgtgagctggtaatcaccgatcgcggcgccgaccccgtggcgcccatcatccacgagtggacctacgaggccatggcccacgacctgctgggcccggacctgggctccaacaacgtcttctcctatgaggcggagacgcaaggaggtggggggggtgggagggggtga

SEQ ID NO: 130 - DNA, 1713 bp, Chlorella protothecoides
  modified_base (198)..(207): a, c, t, g, unknown or other
atgaagcaactttggtgtaggctgccggcggggcagccagaagcaggaggacggtgtgagccggctgaaacgggtcatcatgatcggggaccaccaccagctcccgcccgtggtgaagaacatggccatgcaggtgcgatgggagtgggtggaaaggcaggcgcggaccagccaggaagggggcggtcagttgggacnnnnnnnnnncgatgggagtgggtggaaaggcaggcgcgggccagccaggaggggggcggtcagttggaattgttggctcagggcacctctggccgcactgcagaacctctacctcccgccctgtcggcctttccaatccctgttggaggatgccggtgcgccatattgacctgctcttcccatgattacccacccaccccctcctcgttcgatacccaccgcagaagggcgcgcgcgacccagcctggccaggctgtacaactggcggtacagagacttgggggacctgccgcacgtcgcggcgctgccggcctttgccgcggccaacgcgggattcgcgcacgactaccagctgatcgacgtgcaggactacaacggacggggcgagacctcccccatgccctacttctaccaggcgggaggggaggggaggtggagcgggaggggggtgctgctgctgcctctgggccacacgtgtgtcatgaacaaagccctgcaacagctcccatccatgctcaggaccctactccccccccaaaaaacaacaagacccaatcctgtgccaacctccttacagaacctgggcgaggccgagtacctggtgtcggtgtaccagtacatgcgtctgctgggctacccggcctccagcgtcgcggtgctgaccacctacaacggccagaccgcgctgctgcgggacgtgttccagaggcgctgcgccgctcaccccgcctttggcatgccctccaaggtgggtatggtggggtcgaggcgggcagggactggagtggggtcgacttgggcggcaaagggagagtcccatgggatgggcgtgctgcgttgcacacgccacattactcactcacaccccccctccccatccaccccccaaccctcaaccctcagatcgcgacggtggacaagttccaggggcagcaggcggactacgtgctgctgtcgctggtgcgcaccgcccactttggccacctgcgcgatgttcggcgcctggtggtggccatgtcccgctcccgcctcggcctctacgtcttcggccgcgccgcgctcttctccgagtgctacgagctggcgcccaccttccgccagctcacggcgcggcccacggccctcgccctggcgccccacgagcgccacggcgcctgcccgcgccccgtgggggaggcccccccgtccccggtggtcgtgccggacgtgcaggccatggccgtgctggtggcacagatggtggcgcactgggaggcggcggccatggcggccgggtacggcggcggcgggcagtatcctgcgagcgcaccgccgggcgacgatgtcggagtggaggagggcgcagcggcggagggcgcaacgggggaagaccccgatgatgatggggtcgttgaggacgaagacgctgctgatcccgcggaagaaaaggcggacaacaaggccggggcggaggaacctgatgaggctggagaacagagagccgaggagggcgcagggccgatggcagaggactag

SEQ ID NO: 131 - DNA, 1074 bp, Chlorella protothecoides
  modified_base (414)..(423): a, c, t, g, unknown or other
atgagaaaacaatgcaaggcacgactgcttggcagtgatcaagcacactggcgcgtcaccaacctgactccccttcccaacaacatactgccagaccacctgcgggaggccttcccggagtgcgacgtcagcctgacgagctcgcgggctgatggccagctcgtccgccccttccgcgtcacctttccttccttccgggaggatgacgcaggggccaaggccaggcgccccacgttgcacgctgaggcctacaccgcggttgaccccgggccgtaccctgaggacgagccgccgcaaaacaacgtgcggttcaccccggtgcagacatctgccgtcctttccggcgtgcaaccggggctcaccatggtcgtggggccgccaggtaaaagggagggaggagggaccgtggtgggnnnnnnnnnntcaccatggtcgtggggccgccaggtaaaaagggaggggaggagggaccgcggtggaacggcctgcgaacaccgcgggaccttcagctgcctccgcccctcacttggtttgtccacgcagcctggactgtctcacctcccctttccaatctcctccaccacttcccccatactacccatctcccctcttcccccctcccctcccttcaacaggcactggaaagaccgacacggcggtgcagatcatgcatatcctgtaccacaactgccccggccagcgcacgctgatcatcacgcacagcaaccaggcactgaacgacctgttcaccaagatcgtggagcgcgacgtccccgcgcgctatctcctgcgcctgggcatgggcgaggccgacctggagacggaggaggtgttctcgcgcgtcgggcgcgtgaatgccatgctggcgcgccgcctgcagctgctggccgaggtcgagcgcctggcgcgcctgctgcgcgtctccgagtcggtggcctacacctgcgagaccgcggcccacttctggctcctgcacgtgctgtcgcgctgggagcggtttctggcggccgcgagaaagggcggcgaggcgggtgccgtggctgcgctcttcccctttgccgagtactttgctga

SEQ ID NO: 132 - DNA, 2064 bp, Chlorella protothecoides
  modified_base (267)..(276): a, c, t, g, unknown or other
  modified_base (1334)..(1343): a, c, t, g, unknown or other
  modified_base (1798)..(1807): a, c, t, g, unknown or other
atgctaccaagacgctgcatcctgccattggcgccttcatccaacccccactgcacccacccctcctctgccatctgcaggggagactgtgctggccctacccaagctcaacctccagttcctgaccatccaggactacctcatgcgcaacttcaacctgttcaggtgcgggtccccagggaggctgaagtgatggtgtgccattcgtgtgcatgccagcacagtcgttgtcgtgcctgtctgggtgtgccctggacatacacatcnnnnnnnnnntgttcaggatccaaggactcacccgccactcgtccccaattctgcaggctggaggccacgtatgagatcagggaagatatcgcagatgtgctccagcgtgtgcagccctatctgcgggagaacgatgaggtgggagggtctacactggagaggtcgcagagagatcggcatggcggcgtgggtgcaagtcctgtctgtatgtccgatcgtaactgccttgtgactagcattcgctgcacccattcaccttccaccgcccaggtggggttcaatggctgggcgcgcatggccaagaacctggagggcttcaccatcacggaggtgcagccgcccaaggttggggagatgaggccagccgccgtcagcgcggaggtggtcgtggacctgagctccctgcgcgaggatgtgcggcgtgagtgggaggaggtgaagcagcacgacgtgatgttcctgctgaccctgaggccgcctgatgcatatgcgcagtctgccgcagcagagtctggggcgggtgatggcggtacagcagagtctggggcaggtgatggcggtacaggtgagcttgggggtcagggctggggcatgcagcattcatccatcatcaaaggaatgccattggctgctgaccttggggcatggcactgcgagtctgcgcctgccactgccaagccgtccgcttccactcccctggccacaggcgccagcctgatgagaaagtacgggctggactatgtccgagggtgtgaggtcatcgaaatgcgggacgagggtgagtcgactgggaggactggaaatcggcctgtgcattgcctgagcggcgggtctgcatgtcttgtgccatcgactgcctggtctacctcgggcatggcctggcttgtgctgtcccacacgcccctccctcacgcagatggccagcttctgaatgacttcacggggagggtgcgccccgaccaggtcacacgtcccaagggctccatccgaaccatcacggtggccatggatgctgcgcagtaccagggggtgtgggtggttctttactcttgctgcaggctcccggnnnnnnnnnngctcgcttggcagggggtgtgggtggttctgtactcgtgctgctggctcccgtcggcgccccttgcttcatctaggtgtgcgtgcggcgacctggtgtcagcgacaccctctgttcctccttccttccatgcagatggacatggatgctgtagaggcatcgggtgcggaggatgtgtacggcaccttcaacctcctgctccggcgcaagcccaaggagaacaacttcaaggcggtgctggagagcatccgcgacctcatgaacgccgactgcgcggtgccggcctggctccacgacatcctgctgggctacggcgatccaggtggggaaagggagaatgttggaggggtaggacaggggagctcctgtcaaggggactagggcaggaggactgtattctgaccagtctgccctgctggggttgtgtgcttgttgttctccagcaacacggccaannnnnnnnnntgtcaaggggactagggcaggaggactgtactctgaccagtctgacctgctggggttgtgcgcttgttgttctccagcaacacggccactccagtctagtttgtcccctgtcatgggtggcaagccgtccccttgtccatgagatgccacacccttcttcacctgctcatacctcctcacacccctgcagatgcggcgctgtacaagaacatggaggacacgctgcagaccatcgacttcaaggataccttccttga

SEQ ID NO: 133 - DNA, 3288 bp, Chlorella protothecoides
  modified_base (62)..(71): a, c, t, g, unknown or other
  modified_base (1123)..(1132): a, c, t, g, unknown or other
  modified_base (1395)..(1404): a, c, t, g, unknown or other
atgcactgcagcacacctgcgcagggagggtgggctgtcgctgccgccccccagctcatccnnnnnnnnnnccgccatcagtcagcaatgcactgcagcacacctgcgcagggagggcgggctgtcgctgccgccccccagctcatcccggtatatctgctggacgagctcctcggagaaggcaggggcctccccacccgccagcaccgcgctgctccagtgtttgttggccagctgagtcagcttgtccttgctgatctgcgggtgaggtgtgcggcatgggtggggcttggtgcactgcgctgggagggcatcgtttggcaccccaccccaggaactggccatggagcatgcaaaaactcagcctcaggacggccacgacgggttccccacgttcaaattcatgtgcaaacaatggaatacatccaaatctatacctcggcgatggtgagggccccagactgtgctgccttggacttgggcgctgggcccgctcgttttggctttgtgttgcttgttttcgccatcgcgacgctaagccccgtcctcggacaccttgtcggaactgcagcacttgatgccgcagcagccaggcatgggcagggccacaagagcttcagcagacactcgcatgctgcgcgccccgatctctccaccgacaactgcaggagcagcgggcttgaggctgccttgccattactgctttgggtcatagatgaccttcatatgtcttggctaacagtgggagatgcgccagatacctggccagctcatggagctgataatcggtccttcccttctgacaatattcgcagccttttcatcgaggaggacatagaattcgatttgaaagacaccctgttgttaaaggtgcctgttgaacatggatgctcatgcgcgtcactactgtgccctgcacttcacagttgctcatgctcacagctggaatcgtggctggttcttacctcgaacacgcgagaacagcagccgcaacatccttgcaactataatgaaaattttgacgcatctgaagttctatcgatgcctaagacaagacctacagtagctccatgcatttggcgttcgcctctccctatgtctttgcacttccctccagcttccnnnnnnnnnnagcggctggttcttacctcgaacacacgagaacagcagccgcaagatccttgcaactataatgaataccttgacgcatctaaagttctatcgatgcctaagacaagacctgcagcagctccatgcatgtggcgttcgcctctacctatgtctttgcacttccctccagcttccccagaatcctcgatggattttttacgttattttggtctccgcggcccactcgtgtaccgacgtaccatggcgtcgcttggctatgagaannnnnnnnnnaatggatttttacgtcattttggtctccgcggcccacccgtgtaccaacgtattgtatgtaccatggcgtcgcttggctatgagaagatcgaaggacaagatcatggccactggctgctcatcatagcccgtccccgcgaggagagctacttcttcgcccccaccctcaaggcgctacaaaagcaaggcgacaccgtcagcgtgctatgcctcagcgcatgtaggtgcaaggagtctcctgaatcttgctccgacgtcttatttgtttcggacaggagtgatcatgtagggccggacgctcggggctgcccatgcctcacacaagccctccaccaaatgcactgcgcagtgagtgacgagtcactgaaaaaatctcgtcaacaagagctgagagatgcttgcagagtgctggggattgatgccgaccgggttcggtgcatcgatgacccttcgctgcgagaggatgcggagtgggcgactgaggttgtcgccggccatatacatgaggctgtgaattacttccgcccaactgggaaggaaaaggagagggtgctgagggtcaagatcctggtgagtatggactatcctggaggtgtcatggacctgtggtctgaaggcatcaacagttcctgtcctgtgagactctgtgcactcctccgtaaggattctttccaaaaatcctccaggaaaccattcccaagtgggcactctatgacgcgcggcgggcggcctccaagcacgtctcacagaagaagtggtattcgtgcttggcgagtgggagtcgggtgtacatgtttgcaaacaatgtccgtgacgatacggctcagtttgccaccggatcgacgggatagaggagacggagattgttggctgactgataagatgcatcttgtgtaccaaaattctgaccgaacggggcaacgcatctctacaggcgccttgatacaattgaaacctattcgcaccatccgtggcatgcagcagagatggcttctcgtcacggctcaccccgatgacgagtgcatgttctttgggcccacgatcgttggcctgaggcagacgggtgcctctgtcagcgtgctgtgcctctctacaggcaatgccgctggcttagggccacttaggcaacgggaactctttcgctcctgtgctgtgctcggggtgcctagcagccaggtcacatgcattgatgacccagagctccaggatggatcgagttggcagatttcaaaggcagccgttcatatacagaagagcctggaggtggtcgacccgacacatgtgctaacatttgacgctgctggagcatcgggccatcacaatcatatagctacacactgtgcggtgcagactgtcctcagctgcaggaaggacctgcagctctacctcctgctgattctgccttaccactggtccacttccacaagcaccgtacagccattgccgaagtcaccacacctcatggcaggagaccttccccctatggcagaagtactcgcccctgccatccctcgccggctgggcgtcacagctgctccacggccgagctgcaggtggctctgcacccaagatcacctttggcgccctgagccctgtggtgccctggagggccatgacctgccactcgagccagctggtatggtaccgctacctgtggctggcattctccgtgtacatggtgtacaaccgcctgagagtggtttgacacagggtatcacaaggaggatgtgttcaagagtcacagacagcttcagccgagcgctctgcacggcatcaaccagggagacacccatctacgagagacgaactatgcattttgcgtcgagctgtcacccccctcctcggggagtctctgcagggagctggcgggcagcaggggcatga

SEQ ID NO: 134 - DNA, 4584 bp, Chlorella protothecoides
  modified_base (1493)..(1597): a, c, t, g, unknown or other
  modified_base (1657)..(1666): a, c, t, g, unknown or other
  modified_base (1724)..(1733): a, c, t, g, unknown or other
  modified_base (1893)..(1932): a, c, t, g, unknown or other
atgagtgcacgacggcagatgcgatggtatatggttgcagttcatgtccagccctggccccaagacccccgtcccctccaccctccccagctcatatgcttctggctggcactcctgttttgcgtgaggcctatgagccggcagggcatgttcaggctgggggccatattcctccttgccagctccgcgggggtgggcctggcgctggcctcgctctacctcatcgtggccatcatgggggggagcaatgacaactccgccgtcaaggtgagaagtcgtgttgtgacggtctgtcgctgctgcagattgaagtgcgaccagtttccaggctgggggagcagacgccctgtggacatgctcactggagcccctccatgtcaccctgtccaccccaacccttccctccttaccccagctggtcgtgaccctgctgatttcctgccccgtcatctactgcctggctgtttaccgagtcatgcgcccgagccagaagttccccggcctgatcgtcctcatcttctatgccctcatcgcctgcggcgcctaccgcactcccgtggacctcctgccccagttcccacgctacctcctcttctacacctgcgtcgctgtggccatcacctgggccaccaccttcctcatagctcccccccccgcaggtgggcctgccgtgtgccggggaggccgtgccccgggcttggcccctctggcgttggccctgtcaccccgacgagcccacccctgcgagcacgcactctcgcaggcctgctggcgcggatggcgctcgccaacggcctgcgcgccaccgcgggggtcctggctgacatcctggacttgactctggagaagctgaacgaggaggggaagctggctgcggcctcaggcacgggcgattccggggccctcaacatcgactccggcctttacccccgcgtcatatccatccacatggcctcctacaactccgggaaaaggatcacggtgcgatggagggggaaatcatccggggaggaggaggatgtgattcctggcttgctcaggcgggggggatgttactcagcaagggttcatgagattgtgccttgtcagaggatccgccggccactctcatccacctcacgccccctaccatatagaatgcttccctcccctcctctttcatcacaccaatacccccgggcctgctcactgcaggctgcgcgggagcacagctccagcgcccggctggaactggacctctaccgccccacccacgtcctcgcttttcgtcccttctggaaggcctccctcctggcacgctccctgctcagcgccgtcaccgtcatgctgtacccagtgcaggcacgcggagggttggtgttctggggtggctggtccgggcccacatgcctggctgcctggcatgcagtggtggttgcctgctggctgcgcagccaggccattgggctttgcaccctccctcagtacattctcctcaggcaggcttttatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtttgtgcagtcctcccctcactgggctgtccaggcaccccacatcgggacagtccnnnnnnnnnnggcgtttgtgcagtcctcccctcactgggccgtccatgcacccacaccgggatactgnnnnnnnnnngctgcctggcatgcagtggtggttgcctgcaggctgtacagccaggccatggggctctgcaccctccctcagtacattctcctcagacaggctttcatggggggcgtggagggtggcgcatgggtctgtgtggcctagggtccctcttcctgggtgtcgnnnnnnnnnnnnnnnnnnnnnnnnnnnnnnnnnnnnnnnncccccccaccttctctcctcttcccccgcccaggccggtcagctccggctgtccatggtgcacgcccatgccgacctgtttgccagggtcagggacaacgcccgagtcagcctgtgccgggcggcggcctgcctgactgacaatgcgcccatcgaggacggcctgcaggcactgggcgacctgcatggcgccctgtgctgcctcatactcgcattccagaggctgccgaaggagctggccctcaccccagacagcatggcattccacatcatggccacaaacgtcctgacctcggctactcaggtacggggagtgttatggaggaagggcagagggtggggaccagggagcagcgggggatggctcgcccgtacggggagtgttatggaggaaggccaaagggtggggaccagggagcagtggggaaatgctcgcccccgagtctgggtgccctttgaccaaacaactgttcaaccatccatcttggcactgggacagtctgtcaaaaattcgtacctgcgcttgcagatccgcaagatctaccaggttctgcctgcggtgctggcaaaggaccagccgcagtccagcaaggccgtcaggagcttcctgctggcctacccagcggcagacatggcaaagattgcctacaccccggcccccgccaatgaggcggtgaggcagaaggggctgagagctatgagcaggctgaagcggaggggtttcacgcgggcgtgcccacgccctgggtgggcgtgcagaatcccgcgtgcatgctcctcctgtttccaaggcacaaaccctgggagaatcaacgtcatgcactgccctctcctgagcgcaggcggggagggaggctctgggcgccctgcaggcctccctcattcaccgcggctccaccgtccgccgctccgccatcggcctggacgagttcctgctcagcctcggcacgggcgaggagctgccgggcatgcgggagagacagtttggggctggagggtcctgtgcaggccatcaaggctggcgtgcagctcccgggaggccccacccccttgcaccggaaagttattaaccccgccagcccatgccaccctctcctcccgggcctgcgctctcaggctgcagcgccggagtgtggccagggtggaaccggtccccgctcttccccccgggcgctgggaccggctgatgggtggcctgacagcgcgcacgggaatcacccccctgcacctgcgcatcgcctgccagaccgccgcctcgtacggcctggtcatggtgctgacgggggtggacgcgtcgtacctggccctctgggagcgccccatctgggccatgctgaccaccatctctgtggcggagacctcaatcggcgcagtgtacaagaaggggtcgctgcgagtggtgggcacggtggtgggcatggcactgggcctggccaccctctaccttgcggtgctcatcaacgggctgaatcatgacaaccaccccgccaaggtgaggtgtcattgtgctggcgtccgggtgggtgatgtgggtgctgacgtggatgccggggagcgatttttcatcgtcaccacgatctgcctgacatgcatctcggcagtgggagcaacctgctgcgcttgggacccaggcaacacctttgcctacatggcaggattcttctgcctctttggctcggcgctgccgggctacatcggcgaccaggagctggtccctctgctggtcaatgacagcaacccagcacccccctctcgctgccttcccggaggctacttgtcctgcatgccactcccatgccccagcacggctcgcctccaggtacaatttcccctcctgtcttggaatcaaccctatgcagggcctgctgcgcagcctgatgacggtgctgggggtgctgatccacatgctggtggcgcaggtggtgttcccggtttcctcccgccagacggcgcggggactcatggcggccagcctgggcgcgctggccggccagggcgcggccatgctgcgccgcctggtgcccaccgagggggactgggccggcggcgacggccgacggccgcccaccctccagagcctgcacggggccgcaaccagcgaggcggtgccaggcgaggcggcgtcgggcgaggcgggccctggccgcagggtgaccctggaggcgcccgagcgcagcccccgggacggcctcgcccgcaggacgggctggtggccgcctggaaccagttccggattgaggccgggccgggcgtcatcagcgaggacccgcgccccgtggggcctgtgttcctggacctctacaagaccatctggccggtgagcggggccgggcgggcacgggcgtcggggggagcaagcgccccagtcaatgaatcgcgaggccttgctgctcacaagggccaagcctcaggctgctgcctcctccaagcatcgcaggccgccaccaagatcgcgggcatggccccgctggtggatgcactggcctttgagtacgagctcttccacgccccgcaccggctgccggtgcgctccgccttcaaagcgcagcgcctcttcaggtggggtggaggtttggcagcaggggaccgggatgggggggtggacagagggggagtgcacgctggccttggcacaaagtcacgggggtcatga

SEQ ID NO: 135 - DNA, 663 bp, Chlorella protothecoides
atgcccatcacccgattcttccaccgccctgcaccacaggaggtcttcccggcgttcttccgcgccttcctcgcgctgaaggccacggacggcgagctgcacatgcatgagcgcaccacctacctcctcttcgccatcaacgcctttcagtcgtttggggcgtggccgcggcgatgcccattaccgccccgccctcatcttccatctccacggagccctccactacggtcaccgccaccttgcgactctgcaaactccccaaactccacgcagtcgctggaggaggaggcggtgcgcaaggaggtcctgcgcctcgtttccctgcccctctggcacgccctctcccccggccgcctgcagctggagctgcacgatcacccggccctgctcaagcactggcgccacgcggcgcgacgcgaggccagggcggcggccgccgcgggcgacgcgcacatgcccgtgcagcgccgccccgaggccagcttcctgccggctctcgtggatgagttcctgagcgtgctgggcggcgtgcaggaggagggcacggaccgccgcaccacgctctacctcgagcgctttgtcgagttcctgaccgacctcctgtcccaggcacgatcctggggggggggaagggagggttggggggtgttgatagggggttga

SEQ ID NO: 136 - DNA, 264 bp, Chlorella protothecoides
atggccagttcctggggtggggtgccaaacgatgccctcccagcgcagtgcaccaagccccacccatgccgcacacctcacccgcagatcagcaaggacaagctgactcagctggccaacaaacactggagcagcgcggtgctggcgggtggggaggcccctgccttctccgaggagctcgtccagcagatataccgggatgagctggggggcggcagcgacagcccgccctccctgcgcaggtgtgctgcagtgcattgctga

SEQ ID NO: 137 - DNA, 171 bp, Chlorella protothecoides
atgcctcgtcatctaattagtgacgcgcatgaatggatcaatgagattcccactgtccctatctactatctagcgaaaccacagccaagggaacgggcttggaagaaacagcggggaaagaagaccctgttgagtttgactctagtccgactttgtgaaatgacttgggag

SEQ ID NO: 138 - DNA, 384 bp, Chlorella protothecoides
atgtcaagaacgaccaattctgtgcgcgcccacccatcacatttaccttcaactgtttgcaggcagaatggctttagcaaggcaggctctattcgcacttcgacccttagcatcatgggcctctcagtgagtgcggtccgtctgcaatctttggagattgtgacgccactctccacggagatcttggtagccgtggagtgcctcaaggcgggccagaaggcatgtgcggcagacagcgacggcaacattgggtctgacaacaagggcaaaaacaactttggcaccaagaacaatggggatgacaacattggtgagcaaagaatggggtgcacactgagtacagacaattctgcagctgctgcaagcatggccagaaaagactaa

SEQ ID NO: 139 - DNA, 2211 bp, Chlorella protothecoides
  modified_base (542)..(551): a, c, t, g, unknown or other
  modified_base (1098)..(1107): a, c, t, g, unknown or other
cgccggcggcgcgcggggcgcctccgccgtcgccgacctgtcctacgcggggctgggcgggggcttgttccacggcgcgggcctgtcgccctacgccctgcccctgctgggcggcgggctgggcgacgccggcgcgcacgcgctccaccagcagcagcagcagcagctccagcagcagcaccagcagcagcagggcggcacgccgggcccctacgaccaccatgccgccgcgccacccggcgcgctggccgacctcgacttctcgggcctggcacacgtgggtgcggagtacgcgcaggccgcggggctggtgggcctggactccgtgaccctgggcggcgggggcgccgggttcctgtcgcccatgacgccctcgctgtcggcctcctcctccgcctcgcagctcagccgccagcgcctcttcgtcgttctgcacaaggcaggggtggaggcgttcatggttggcatgcacactgtgtgtcccagggtcaccaggcagaagtgtgggccgcacggacacggcgatggtcccatgcagcacnnnnnnnnnngggggggttcaggcaggggtggaggggttcatggccggcatgcacactgtgtgtgccagggtcaccaggcagaagtgtgggccacacggacacggcgatggtcccatgcagcacgctcgcgccttcctatggggaaacacctcgaattcacccctcttcgggaactccccccccccacaccttcctccacccaccccaaccccagtctgtgggcgacgagacgctggcgtgcctcttccgctccttccctggcatggagtactgcgacctgaagaaggaccgcgccacggggcggtccaagggctacgcctacgtcaagtatgcgacgcatgactcggcggcggctgcgcaggcgcggctcaacggcgccgagttcccccccggctccggctgccgcatgaaggtcatgtttgccgagccggcgctgcaccgcgcgcgctccggctccgccgactcctgcgccgacgcgggcacgcccttcaacctggcgggcctggccggcgggggggcggggccgggcgtggaggagctgcgctacctgtccacnnnnnnnnnnaggcctggccggcggggggggggcggtgggcgtggaggagctgcgctacctgtccacgccgggcggcggccagctgggcgcgcgcggcgagcgcgacggcgagcgctacatgggccgcagccagggcgtggcccagacgcccggagatcgtttctcagcccagacgcccggcgtcgaccactatggcgcgcagacccccggcgtcgaccactttgcgacgcagacccccggcgtcgaccggtacgcggcgcagacccagggcgcagcgctgggctcgccgctgtcctgcgagtccggggtgctgccgcggcgccgcgcctcccccctgcactcccccctgctctcctcctcaaccccagacctgctgtcggccgccgaccacctggccggcctgtgcctggacggcggggggctggaggggctcaagggctacacgaccccaggcggcgcgctgggcgcgctgagcccgggcacgacgctgagcgggtcactgacgtcctcctggcacgacctgtcgcccgagggcggcgccggctccgccaccagcgcgctcggcgctggggccgcgggcgccggccatgcggccgcggccggcctgcggccgcgtggcgacgccgccgaccccgaccccaccgtggtctactcgcgcctggcccgcccgctgccggactatgcgctgagccacgtcttctcgcgctgcggccccgtggatgcggtgcgggtgctgcccgacgtgcgcctggccatggtcaagttccgcgacgcggagtcggccgcgcgcgcggtcgccacgctgcacggcaccgaggtcctgggcgaggtgctcgccgtctgcgccagccccccctcgcagtgaggcgggcagggtccgggcgggacgcgcaggcacccagtgccggcggcgggcgcggccgccctcatgccccgccgacgggccatccaaaggcggcggcgagcggctgcgcgggcccacatgccccggcgccactcgtcgacctgacgcgcgcgtgggagcttgcaggggatatccaggcccgcgggcctgatcagaggaaacccgtgctcgggtgcccgtgcacgcatgcccccaccccgtccccataa

SEQ ID NO: 140 - DNA, 471 bp, Chlorella protothecoides
atgaccggcacgcttgacttttacccggccctgcgcctgcagcgcctggggtctgtggccgttgttcagccggtatgggagtctggagaacccctgcccgccctgacggtggacctggagactggcagcctggcagccagcgagcacccccatgtgacctccgactttgtgccctgctttggcgtgctgggtatgctgcgcctggaaggcggccccgccctcgtcgtcatcaccggcgtgtctgcggtgtgttgggtcctgagcggtatggactgctctgcatgggcatcaggcatcagggtctggcaatctgaccacaaaccacacgcatgtctcatgaagctgtccctgactccgtgtactcccccccgttttccattctcaggctggcatcgtgcgcgagcacctggtgctcaaggtcacctcgaccaaggtgctgtacgacacgagccacaagtggagcaagagtga

SEQ ID NO: 141 - DNA, 2922 bp, Chlorella protothecoides
  modified_base (102)..(111): a, c, t, g, unknown or other
atggaggggaggagatggcctggtgcatgcgtctggattcggtgcatgcttggaagatggatgcgcatgcgtgcgtgggtggaggagtctcacctgcccggnnnnnnnnnngtaggcggagaccaccaggttgccaggggccatcaccgtttcgccgcctggcaggatgtagagttaagggggggggatgttaggggagctcggaaggaatgcgattgtctgggccaggttgactcgtcagtagttgcatgtcacccagatggagggaggagatggcctggtgcatgcggctggattcggtgcatgcttggaacatggatgcgcatgcctgcgtgggtggaggagtctcacctgcccggcgcaggacccacgcattctccccacaaacacacacccaccccccctcccccccgcccccccgattaccaccaccaccagcacggccatggcctcgcgcatggccagcgcggcgtccaccatggccgcgccctctccgcccatcttggccgcgtacatccagttgaccgaggccttgacgtgctccagcgcggtgacgggcgcccagaccaggttggtcagcgcctcgcccaccgccaggcgcgccatggcggcggggtccagcagccccttgagcggcgcctcgccgatggaggtggccgcgccggtgcggccgtacaggctctgcgccacgaccgccacgtcggccagcggcgtgtgcagaggccccaccgcctgctgctgggccaccaggcccgtcacgcagcggtccaccttgttggtcaggaagcgcttggaggcgacggcggggaggcgcagcacgcggtccagcgcgtcagccggcgtggcgcccgcgaggtccagcggcgcggcgggggcgggggaccggctgaaggcgtaggccttgtccggcatgtccccgagcaccagctccaggtccaggtccacgggggtgggcgcgcccgcgggcgcctgccggtcgacgacgcgcacgcggcccgagccgtcgatggtgccgatgacctggacgccgcagcgctcgcgcgcggccagcgcctccagcagcggccggtctttcggtgcgatgagcaggcagtcgttctcctggtactccgcgccccagatctccagcaccgacatggtggcgtcgcccaggtgcaccgcgcgcacgtcgatctccgcgcccagcgggtagatgatctccttgaccacgttgcagttcccgcccgcgccctggtcgtggatggacaggatggggttggccgggcccagctccacgcaggcgcgcaccacgcgccacagcttctggctgacctcggcgtcgccgcgctgcaccgcgtcgtagtccagctccgcggagttggagccggagggcagcgagctggccgcgccgccacccatgccgatgcggtaagcggggcccccgatcttgaccaccagcatgcccaggccggggggggtcttctccaggtgcccgtggtcgatctggcccagcccgccggagaacatgatgggcttgagccactcgcggcgcgagccgtccgccagccgctggccgaaggagcgcgtgtacccggccaccagcggctccccgaacttgttgccatagtccgacgcgccgttggaggcgtcggtcaggatctggcgcgggtgcgccagggagggcggatacgccgcgtcggcctgctcccagggcaggtcgtagccctccagcagcaggttacccacgcagtacccggccgtggcggcgcccatcagcgacccgatgcccgtggcgtgggtgtcacggatgcggccgcccgcccccgtctccgcgccggggtagggcgccaccgcgcaggggaaattgtgcgtctccgcggtcagcagcaggtccaggtcgcgatgcgcgggcgccagcgcggagggcgcgccgggcgtgtcgggcagcagcgtgcgcacgggcccgccgcggatggcggacgagttgtccttgaaggccagcaccgagttgggggcggagcccgccagcgtgctcttcaccacgcccatcagcgactcgggcacgggcgcgccgtccacggtcagcgcggcgcggaagaaccagtggcgcgagtgctccgagttggactgcgcgatgtcgaacagctcgacgttggtggggtcgcggcccatgccgtcgcggaacatgtcggtgtagtagtccaggtcgcggtcgtcaaaggccaggcccatggaggcgttgacgcgctccagcgccgcccgcccctccgacaccacgggcaccgtgaagacgggggcggggaccacgctggaggcgaaggaggtcaggggcgtggggtacacctcctccgtcatgcggtcgtgcacgctggcggcaaaggccgccagctgggccgtggaggcgccgccgcgcaggcggaagcggcggctgacctccacgcgctccaccttgcccaggccgcaggaggcgcagatgctcaccgcgttggcggaccaggccgtgctgaaattcatgcgcgtgacctggaggtgcctccagatagtaacatacagcggtcccgcacccacccagcacagctgaaagccacccacctcgaccacggcatcctggggctccagctggaagctggagtcgggggtgagccgctccggctcaaaggtctcacgcagcaacctgtagcagggaaggaggaagaggtcgacgtccgttgcgacagtggcgcatcacagctggaagccacccacctcgaccacggcatcctgcggctccagctggaagctggagtcgggggtgagccgctccggctcaaaggtctcacgcagcaacctacagcaggaaaggaggaagcggtcgacgtccgttgcgacagcggcgcatgtggcatgcgcgagagtcgggtgcagtcgctgcggctgaatggcgacgacgacacaatgagttga

SEQ ID NO: 142 - DNA, 732 bp, Chlorella protothecoides
  modified_base (585)..(594): a, c, t, g, unknown or other
  modified_base (658)..(667): a, c, t, g, unknown or other
atggtggaggggtggtgggttgggatcatgaatgctggacgaaattgcatgctgtctgggcacccagctgctgcatcgactcacctgcctcgcctcatcactccacagcctgggcaccggcctcgcctccatgctggctgtggctgcggccaaggccgaggacgccaacagcgtcacctcctcgcgcatgtcctactcccgcttcctcgagtacctggacatggggcgtgtgaagaaggtcggtggggcgctgcgggtgggccagtcagtgggcatcgcagggccggtgcaggactccacgacacccacgccccctgccgcatgcaggtcgacctgtacgagggtggcaccatcgccatcgtggaggcggtgagccccgagctgggtaatcgggtgcagcgcgtccgtgtgcagcttcccggcaccccgccagagctgctgaccaagttcagggagaagaaggtggactttgcagcccacacgcagaccgaggacggcggcagccagatcctgggcctgctgggtgagcggggcgagaggtggagttgggtggctcagggcttcagggtgaagagtggttggacnnnnnnnnnncccctgagagagggcatctactgtcaacccattaccacccacccacctctacccaccctgcatnnnnnnnnnntgggtcaggaggtggagttggctgggtcaggggctggagttggatgggtcagggcttcagggtga

SEQ ID NO: 143 - DNA, 2466 bp, Chlorella protothecoides
  modified_base (712)..(721): a, c, t, g, unknown or other
atggcatgtgaggaggtctaccccctgagagagggcacctaccgccaacccatcaccacccacccacctctacccaccctgcatccgctcctcccaggcaacctcgccttccccctgctgctggtgggcggcctgttcctgctttcccgccgccagggcggcggcctgggcggccccggcggcggcaacaaccccatgaactttggcaagtccaaggcgcgcttccagatggagcccaacaccggcatcaactttgccgacgtggccggcgtggacgaggccaagcaggactttgaggaggtggtggagttcctgaagaagccggagcgcttcacggccgtgggcgcccgcatccccaagggcgtgctcctggtcgggcccccaggtgcgtccaggcatgggtttgctggttcactctgtctggctgtgctgttcagtagggaggaggagggtggcggggtggagggatgttgtacagtatcgagggggaggcaagagcggccgtcgactgctcgtccgctggctgtgagtgctgcgacagccatgtatagttttcccgggtttccctcctcctggtcctggcctcccccaggctcggcgcaggagatgcagcagcgtagtgcatggcggggccaaaagcgacattgccgattgcctgaccccccaccactcaagccatcttgcagggacgggcaagacgctgctggccaannnnnnnnnnagaggggaggcaagagcggctatcgactgcccgtcggatggctcagcgtagtgcatggtggggcaagaagcgacactgccaattgcctcacaccccgccactcaagccatcgtgcagggacgggcaagacgctgctggccaaggccatcgccggcgaggccggcgtccccttcttctccattgccgggtctgagtttgtggagatgtttgtgggcgtgggcgcgtcgcgcgtgcgcgacctgttcaagaaggtgagacgattcttgtcggagacggagggatgtggctgctggatggctgtggctgctggatggctggcgggccacccagcaggaaggctggggctgccatgcccccctctccccattgaagccaaggagaacgcgccctgcatcgtgttcatcgacgagatcgacgcggtgggtcggtcgcgcggcaccggcgtgggcggcggcaacgacgagcgcgagcagacgctgaaccagctgctgacggagatggacggctttgagggcaacgccggcgtgatcgtggtggcggccaccaaccgcgccgacatcctggactcggccctcctccgccccggccgcttcgaccgccaggtgtcggtggacgtgcccgaccagcgcgggcgcctggccatcctgggcgtgcatgcgcgcaacaagatcctgggccccgacctggacctgaaggaggtggcgctgcgcacgccgggcttctccggggccgacctggccaacctgctgaacgaggcggccatcctgacggggcggcgcaacaaggaggccatcacccaggccgagatcgacgacagcatcgaccgcatcgtggcggggatggagggcacgcccatgaccgacgggcgcagcaagatgctggtggcctaccacgaggtcggccacgccgtgacagccacgctcaccccgggccacgacccggtgcagaagctgaccctgattcccaggggccaggcccgcggtctgacctggttcatcccaggtgcgctgggttgcgggtggaggtgggggaaaggggttgctggcgagcatccgataggagggggggatggctggaggaagggccgtgcagacacgcgactggcgcgccgccccccgatgcctctccagttcgggatgtctcggaccagggcctgcatccccccaaacacatggactcccaccaaccaacctcacccctttcctcccttccctcccaggcgaggaccccaccctgatcagcaagcagcagatctttgcccgcatcgtgagcgcgctgggcgggcgcgccaccgaggaggtggtctggggctcggccgaggtgaccaccggcgcctcctccgacctgcagcaggtcagcaacatggcgcgcagcatggtgatcaactacggcttcagcgagatcgggccctactcgctgcaggaccaggccgcgcagtcgcccgacatgatcatgcgcatgatggccaagaactccatcagcgagagcctgcagcagcgcatcgacgcggcggtgaaggacatcgcggcgcgcgcgtacgaggaggcgctgcgccacatccgcgacaaccgcgcagccatggacaaggtggtggaggtgctgctggagcgcgagacgatgagcggcgacgagttccgcgccatcctggccgagtacgcggagatccccgacgagaacctggaggcggtgcggcagcagaaggcgcagcccgagcccgtgctcagctgatgagccggcagcagtaa

SEQ ID NO: 144 - DNA, 471 bp, Chlorella protothecoides
atggggttttggctgggcaccctcatattcgccctcctggagctgctgggctttggcatcgtgcaggcatctggggctagacatgggaacaaactgtgcgttggctcgggccaggggccaggggttttcggcgggtggcgagaccaaaagatcggtgctctgaccagtgcgacccacgacctctctcccaggttgaagcacacactcgtgggcacgacggtggcgtgctgctggatgatctgcactttgcctggaggtctttctctattggacccccaaacccctctgcaggtggggcatcgtgtacatcgcccagcttcacccgctcatgaggcctaccctccagggctgaggtgcttccgtgggtggaggatggtcgtacctgcccctctttacgcttgctcacctccgcacagcgcaaggtctcctcacccttcctcacccttgtatcgctgccttttccagttgtaa

SEQ ID NO: 145 - DNA, 1443 bp, Chlorella protothecoides
atgtgtcctgcgagaatcttcacattacaggggccgtaccctgcctctttcaagcctgcactggccacggggtcaggtaccgattgtcgactgtcagtgggagcaacatggcggtcggcaagaacaagcgtgagtggacgtgcctgcgccccgccagccggcagtgcccctccacgggcgtcctcgtcccatcgctttcccaatccccccgttcgcaggcctgtcaaagggcaagaagggcggcaagaagaagatgtgagtaggctggacgcgcggtggctcgccctgctcctgcttggctcccgaagcatgctccctcacacccggtacccctcctctccactgcagtgtcgaccccttcagcaagaaggactggtacgatatccgtgcccccagcaccttccagcagcgcgctgtgggcaagaccctggtgactcgtaccgccggtaccaaggtgtgatggacggacggagcgggaaggggccggggcgcagggcgggagggattgctctggtggagatcgggcgcagtagcggcggacaggcctcgggggggggaggggctggggcgcagggcggcgagggattgctctggtggcgatcgggcgcagcagcggcggacaggcctcgggggggggaaggtctctatccagaccgctgctggggagctggggatggcgagcctggagatggcccagcaccagccgctatatctttacccattggggctaggattttgcccctccagctctggctggcaagggtactcggcgagtatacaatgacaaccccccaccacccccccctccctccctccttccaacagatcgcgtctgatggtctgaagggccgcgtgatcacggtcaacctggctgacctgcagaagaatgaggcggacgcgtaccgcaacatcaagctgcgcgtggaggacgtgcagggtcgccactgcctgaccaacttccacggcatggacctgaccaccgacaagctgcggtcgctggtgcgcaagtggcagacgctgatcgaggcccacgtggacgtgaagaccaccgacggctacacgctgcgcctcttcgccatcgccttcaccaagaagcgcgcggggcaggtgaagaagaccgcgtacgcgcagagctcccagatccgcgccatccggcgcaggatggtggacatcatgacccgcgaggccacctccgtggacctcaaggatctggtggccaagttcatccccgaggccatcggcaaggagatcgagaaggcgtgccagggcatctaccccctgcagaacaccttcgtgcgcaaggtcaaggtcctgcgcagcccaaagttcgacgtgggcaagctcatggaggtgcacggcgacctgcccaccgaggtgtccaccgccgtggaccggcccgaggagggcgtggtcggcgacgccccggaggaggccaccgcctga

SEQ ID NO: 146 - DNA, 1701 bp, Chlorella protothecoides
  modified_base (1605)..(1614): a, c, t, g, unknown or other
atgtcggtccactcacctcggggatggtgtccgctgttgcatgtgcgaggacgccattcggtgttgcaaaccctcaaggcccatgccactccacaagcagtgccgacgctgccaggctcctgccctgcgcgagggggaggtagcaggagcaaaatcatcacaaaagccctcagttcaggagagcagcaaggaagaggagggagggaggtgcggcgttatgggtcagtgatcatttcatctcactggaaaaaacgggaacagaaagcggagaaagactacagaatcgggatcggtggccaaggaatcaaggttgcaggtcagaaagaacgcagcgatgaccctgccaaggtcaacaagcataggcgttccccacacaatggagctcgagctcttccctacctggcaaggtgcccgctgccatcagacctaggcaggtcctccatcccagctgaggggagcccgtgcagggacctgcaccaacgtgcgtcgacggggagtggtggtttaaagagaagtaatcctggtgcaaggaccttgccagttgaggttgcagggaagtgtcgctgtcatgcttgtcggatcggctaccgatgggctggcccgatcaaacaacagcatcgctctcctcggtttgtgttttggggcaagcaggactcatggactggagtccgctgcacggaggatacccgaggctgggagctcgacagtgacgccccatcacgcaggggcatgcggccccacaagtgccctcaggaatgcaagattgtccacaagtatgttcaggtctcaaagattatcattcaacatcttcgggcatggggtacttggtgcgcattagagcctccagcctctgtcaaaagtaccttgaagggcttgccgtcacccgctcactccgctgcgagccatattgactgccatcggactgctctccagggatggagagagtccgatgtcgagcttaatatagaggaggcgggggccaccccggccccgggtcgacccgagattggtccacgtcctcgaagcgcaacattcactcccgctgggacattcacccccgcaacatcgcgcaaggcccgagaaacccacgccctccaaccctgtgtcatcgatcctaggtacaacaccggaggaaatactcctttcattcattgccggcgttggacgggggcagacttgggactggcagtcagtttgcaccatggccgctcgccccgtcgtgaggaaagccctgggccttggcggacatggctccggtctccagcaagcagtggagcacggaaagtccaccctcttcttccgggaggtgcgagcgctgggagaccgggtctggtgtgccgcaccctgccctggatcgtccacaactacaagctcgaggagctgaccaccgtctcccagttgcgacgaaacgtgaaccagctgttcaggcggttcgaggaggtcaagacgcccgaggcggtggacctcctcatctataagggccgcgaggagctcgaggtgagacgcaggattgggtcggctccgagggaaaagctgggcgtgagggacactgctcttaaattgcgagtcgcactgtgctggaggtttgcatgtggggactgggannnnnnnnnnagcagaaaagctgagcgtgagggacactgctcttggattgcgagtcgcaccgtgctggaggtttgcatgtggggactgggatcatga

SEQ ID NO: 147 - DNA, 345 bp, Chlorella protothecoides
atgtatgggatggcgctggccgtactgagcttcgccctcctcgtcgtgacgtcctccggtgcagcctcgcagaggccctggatcgagcaaatttcctggaggccgcgtgcttacttgtaccacaacttcttgagcgaggccgaggcggatcatgtggtcacgctggccaagccgcacatcacgcgctccagtgtcctgaacgacgacgacagtgtctcggatgcgcacgaggtccgcaccagctatggcaccttcctcaggtacctgaagacgtggagaatgggccatatgccaggaacgaaggtgcaccatggcagtgtagtccgagtctgctcgtccggctga

SEQ ID NO: 148 - DNA, 843 bp, Chlorella protothecoides
atggaggacatgcaggtgctcaagtacgtcgacggccagaagtacgacgcgcactgggacgagcgtgcagcggaggacgggatacccgtcggcggtggctcccgccgcatctgcaccgtgctcatgtacctgtccgacgtggagtacggcggcgagaccgccttccccggcggcttctggctggacgccgccgtgcagaaccgcaccgagttcagcgcctgcgcggcaaaagggccggcggccctggcgagaaagggtgacgccattatgttctgggacatgaagcccgacggggaaaggatgggggagggggaaaaaggtgggaccggcgcagttggaacctcactggtggtggccgggggtctgcgggcaatgaaacgcattccccctcatgggctggttggatgtgagcacgcccataccttgcaggatgatccgctgtgccctgccctgggccccatcccctgcccgtcaaaagtctcatgtgccctgcccataagcatccccccttttccctgctttcctgtcaaaggggtaaccctggaccggtacagcctgcacacggggtgcccggtgctggccggagaaaaatggagcagcaccttctggatccacgacaaccccttccggcgcagcccagggtcgctgctggccgacatcgactccgcccccgcccccgcctgcgaggaccagtccaccacctgcgcgacgctgctggcagggagggaaggcgcgccatgctcggaggaccaggcggcacgctgccgccgctcctgcggccggtgctgccaggcgggggacgtgctctgcgagcgccgcgccaagcgcatcgtcgccgactga

SEQ ID NO: 149 - DNA, 1026 bp, Chlorella protothecoides
atggcccccggcaacctggtggtctccgcctatgtgggctgcaccgacatcacgcgcatcaccacccccgacctcaaggccccgggcgccagctccctgctccacgtcgacctgggcgcggggcggcgccgcctgggcggcaccgccctggcccaggtgtactcccagctgggcgacgaggcgcccgacgtcgaccccgcgctcctgggcgccgccttccgcgccacccaggccctgctggccacccccgactcccccgtcctggccgggcacgacgtcagcgacggcggcctggtcgtcgccgcgctggagatggcctttgccggcaactgcggtttggagctggggctggaaggcgcggcgcacgcccgcgacgcggcgcacggcgcactggccccgctcttcgccgaggagctgggcctgctcctcgaggtcgccgcggggcgggagggcgaggtgctggccgcctacgcggccgccggcgtgccctgcgcgcgcgtgggcgccagcctggcggacgacgaggtgcggctggtggtgggcggggagatggtgctggccgggggcgcgcgcgacctgcgcgacgtctgggaggccacctccttcgagctggagaagcggcagaccgctctcgagtgcgtcgagtctgagcgcgccgcgctgcgcagtgcggaggcccccacctgggtcgtgccttacgtccccgcctggacccccgcggacaagctggaggctggaggtgagcgcgtgtggggggaggtgtcgttctttcgagcaagggcccgggggcggctgtcgttgaccgagtgctgcgctgcggcgaggtggggattctgtatccaggatgggggtgccgacggggctcctgcatccctgcctgtgcgtgtggatgcgctgcgacgtgccgttatggagacgtatcgacctcggtgcccggccttgctccgcaatacacacgccttgcaacccccttctcccacccctccccacccaaacaatcgacagacaaggtgcgtgtggcggtga

SEQ ID NO: 150 - DNA, 723 bp, Chlorella protothecoides
atgggtccaaagagatttgccgaacccaggttgcaggtggcattcacacccggacccagccacgctcagcatctcctccctctgcctctcacccttcccaggctgctcaagctgctggcggcgggcgtggaccccaagcagtacggcggcagcctgtacttcagccacgcgggggacatcacgctgaccgcgcagcgtgcagagcgcgtcgcggcagacccgcagacggcggccgcgcgcgcctggcagcgcgccgacctggacgtgacctggaacgcggccctggccaggcccctgctgggtgggtgtgcgatggcgaggttcttgttaggaggctgtttgggggctgccaatgagggcgtgcagagcgggagccagcaagctcagccaccaccctgtttgctggaggttgccgtacatgtagccccatcctccttgtccaccgccattccagatgcggggctggatgcctatgtccctcccgtcttcatgggattcgtggagcagctgaacggcctggacttcctgggcggcgggcgccaggtcagcctgggcgtgaccctgattgcacgcaggtccaggcaccgcccgggcacccggcagtggaggcgtggggcggaccagcagggtacgtcgagggtcaggctgggcgggggaaaggcgtgggcacggggacgggatgctgcgcggggtggctcgcggacggcggctcggtacgtttga

SEQ ID NO: 151 - DNA, 2379 bp, Chlorella protothecoides
atgaatttcagcacggcctggtccgccaacgcggtgagcatctgcgcctcctgcggcctgggcaaggtggagcgcgtggaggtcagccgccgcttccgcctgcgcggcggcgcctccacggcccagctggcggcctttgccgccagcgtgcacgaccgcatgacggaggaggtgtaccccacgcccctgacctccttcgcctccagcgtggtccccgcccccgtcttcacggtgcccgtggtgtcggaggggcgggcggcgctggagcgcgtcaacgcctccatgggcctggcctttgacgaccgcgacctggactactacaccgacatgttccgcgacggcatgggccgcgaccccaccaacgtcgagctgttcgacatcgcgcagtccaactcggagcactcgcgccactggttcttccgcgccgcgctgaccgtggacggcgcgcccgtgcccgagtcgctgatgggcgtggtgaagagcacgctggcgggctccgcccccaactcggtgctggccttcaaggacaactcgtccgccatccgcggcgggcccgtgcgcacgctgctgcccgacacgcccggcgcgccctccgcgctggcgcccgcgcatcgcgacctggacctgctgctgaccgcggagacgcacaatttcccctgcgcggtggcgccctaccccggcgcggagacgggggcgggcggccgcatccgtgacacccacgccacgggcatcgggtcgctgatgggcgccgccacggccgggtactgcgtgggtaacctgctgctggagggctacgacctgccctgggagcaggccgacgcggcgtatccgccctccctggcgcacccgcgccagatcctgaccgacgcctccaacggcgcgtcggactatggcaacaagttcggggagccgctggtggccgggtacacgcgctccttcggccagcggctggcggacggctcgcgccgcgagtggctcaagcccatcatgttctccggcgggctgggccagatcgaccacgggcacctggagaagaccccccccggcctgggcatgctggtggtcaagatcgggggccccgcttaccgcatcggcatgggtggcggcgcggccagctcgctgccctccggctccaactccgcggagctggactacgacgcggtgcagcgcggcgacgccgaggtcagccagaagctgtggcgcgtggtgcgcgcctgcgtggagctgggcccggccaaccccatcctgtccatccacgaccagggcgcgggcgggaactgcaacgtggtcaaggagatcatctacccgctgggcgcggagatcgacgtgcgcgcggtgcacctgggcgacgccaccatgtcggtgctggagatctggggcgcggagtaccaggagaacgactgcctgctcatcgcaccgaaagaccggccgctgctggaggcgctggccgcgcgcgagcgctgcggcgtccaggtcatcggcaccatcgacggctcgggccgcgtgcgcgtcgtcgaccggcaggcgcccgcgggcgcgcccacccccgtggacctggacctggagctggtgctcggggacatgccggacaaggcctacgccttcagccggtcccccgcccccgccgcgccgctggacctcgcgggcgccacgccggctgacgcgctggaccgcgtgctgcgcctccccgccgtcgcctccaagcgcttcctgaccaacaaggtggaccgctgcgtgacgggcctggtggcccagcagcaggcggtggggcctctgcacacgccgctggccgacgtggcggtcgtggcgcagagcctgtacggccgcaccggcgcggccacctccatcggcgaggcgccgctcaaggggctgctggaccccgccgccatggcgcgcctggcggtgggcgaggcgctgaccaacctggtctgggcgcccgtcaccgcgctggagcacgtcaaggcctcggtcaactggatgtacgcggccaagatgggcggagagggcgcggccatggtggacgccgcgctggccatgcgcgaggccatggccgtgctgcgcatcggcgtggacgggggaaaggactcgctgtccatggccgccgccgcgggtgagcgaaccggctgtttacctggtggtggtggtaatcgggggggcgggggggagggggggtgggtgtgtgtttgtggggagaatgcgtgggtcctgcgccgggcaggtgagactcctccacccacgcaggcatgcgcatccatgttccaagcatgcaccgaatccagccgcatgcaccaggccatctcctccctccatctgggtgacatgcaactactgacgagtcaacctggcccagacaatcgcattccttccgagctcccctaa

SEQ ID NO: 152 - DNA, 816 bp, Chlorella protothecoides
atggcggctgcagtgcagatggcgggcatggagccgtgggacgtcaccatgtccgacctgctctccggcgcagccaccctggactccttccaaggtgggtctgtcggaggggtggtggagggggcttggggaccggggtccagcatcatcttccccggcggcttcagctacgccgacgtgctggactctgccaagggctgggcggccaccatccgcttcaactcccgcctgctgggccagttccaggccttctatgcccgccccgacaccttctccctgggcgtctgcaacggctgccagctcatggccctgctgggctgggtgccgggcaccggcgcggggaccggcgcggcggggcccctgctccccgacgcggcacagccccgcttcacgcacaatgcctccggccgcttcgagtgccggtggagcagcgtggcgatcgaccccgacacccccgccgtcatgctgcgcggcatgggcggcgcgcgcctgggcgtctgggtggcccacggcgagggccaggccctgtttccggacgaggccgtgcgccgcgacgtgctggaccgccacctggcgcccatccgggagacgcaggagtacccctacaaccccaatggctccagcgacgccgtggccgcgctgtgctcgccctgcgggcgccacctggcgctgatgccgcacccagagcgctgcctgcagatgtggcaaaacccgtggtggcccgcagatacggggctcaagccaaccgaccccagcccctggctcaagctcttccagaacgcggccgagtgggcggcgtccgtgcgcagggcttga

SEQ ID NO: 153 - DNA, 987 bp, Chlorella protothecoides
atggagggaagttcaggacgttttgacagcaccggcggccattcggcgacgatcccttgtgactggtatggcaggcaccctggcgctgccctgtgcgggtgccagctctcccacgtggccaactacgtggagacggagcagatcgtgtccgacggggagggcgcgctgctgtcctccttcgtccaggcgcggggctctctgcccctgctctggtcccagacgccctgcctgaagtacaagatcccgctgcgcctggcgccgccctcggcctcggcccccgtctttgccgggcatgcggaccggatggtggaggtgcacggcgctgtgacggccatcaacctggcaaaccagggcgggcgggagggggtgctgagcgccgcgtacgtggcggcggccgacgcctacgccgcctcgcgctccggcttccgcctggtcccctttgacttccatgccatgtgcggcgcgaccaactacgcgcgcctgtcggtgctctgggacgagctggcccccgactttgagcgctacggcgccttcacacgcgacagcgcgtcgggggccgtggcggggcggcagcgcggcgtgttccgcaccaactgcgtggacaccctggaccgcaccaacgtggtgcagggcctgctggggcgcaaggcgctggaggccacgctgcgcgcgctgggcgtgctggcgcccggcgcggcgctggccgccgcgtacccggaggcggagcgccgcttccgcgtggcctgggccgaccacggcgacgaggtgtcgcgccagtacgcggggacgggtgccatgaagtccgccttcacacgcacgggcaagcgcgacgtctgggggctgctggacgacggcgccaagtcgctgacgcgctactacctgaacaacttccaggatggcgctaagcaggacgccattgacctcgtcacgggggcgtttgtcgtcaagacgggtgggtgggttgagtggtcaaggttgggtgtgtga

SEQ ID NO: 154 - DNA, 264 bp, Chlorella protothecoides
atggcccaggagagcgtgcgtgcgctggagggcaggcgggtgctgatcgtgaacgcccatgtcggcatgggggccgacgtcgccgagaccttcgccagggagggggccaccctggtgctcaccgcaccgcagaccctggcgctgcatgaggtcgcatcccggtgtggaggaatgggtggctttgacacactggcgccctgcgaaaccctggaactcgatctcacgagtgcggagcaggtgggcggcggttgcaggaccaggtga

SEQ ID NO: 155 - DNA, 330 bp, Chlorella protothecoides
atgcaccggttggcgcctgcaacaccccggcctacctgcgatgcccgctggatctccaacccaacacaccccttccatcacacgcacacacaggcctcgcctgcatctcctgccgccgccgcggtgctgcagaagctgactgccgcggggccgggcgtcctgcagctgtaccgcagccccggcctgtcggcctccaaggcggccacgctgctgaagcaggcccaggccaagaccctgcccgaggtcacggggatggacaccgagttgtgctacaacatctccctgtcccagcctctgaccgcggccgaggccgagaccctggcctggtga

SEQ ID NO: 156 - DNA, 231 bp, Chlorella protothecoides
atgctggtctgggagcgcggcgcgggcatcacgctggcctgcggcacgggggcctgcgccacggtggtggcgggggtgctggagggccggctcgaccgctcctgccgcgtggacctacctggcggtccgctggagattgagtggcgccaggcggacaaccgcatctacatgaccggccctgcggagctggtgttcgaaggcaccacctccctgaccggcgacgaggcctga

SEQ ID NO: 157 - DNA, 2397 bp, Chlorella protothecoides
  modified_base (1487)..(1496): a, c, t, g, unknown or other
  modified_base (1762)..(1771): a, c, t, g, unknown or other
atgggcagtctgcggtacctggttgctatcaccgcgttccttgttgttcctgccacatccgtgctccttggcatcaccctgcccgctggattcgcggtaacgccatactacgatgccggtgtcccaggggcccgcagcctcacgctgagcacggcgccaccgccggcggggcagggacccatcgtctacgtggctaacaacaaggatggcaagatctatgcgctcctggacgacgacaatgacggattcgccgagcgcctggtcaccctggcctcgggtctgacaaccagcaatggcgtggcctggcacgacggggacctgtacgtctccgagctcgagcgcctgtggcgcttccctggtatcgacgctgtggctcgccgcggctcgggagagtaccccgcggacaaggcagagctgctcatcgactccctgcccagcgccagccagcatggcgccaagtacattgccgtctcccctgccggccagctgtacatgaatatcggggcgccctgcaacgtctgtgagccagggagctaccagaagaacgcctccactcccgtgttccagtacggcagcatcgtgaggttcaacctcaaagactggaccacccccgagacggtggcgtacggcaccaggaacagcgtgggcttcgactggcacccggagacgggagacttttacttcacggacaacggccgcgacgatgtggggggcagcaacgcgacagtcaccgacgccagcccggacgacgagctgaatgtggtcagggcggcgggcgggttctatgggttcccctactgccacaccggggcccggggcggcatcacagaggcgccctgcgcccggctgtctggcattgggaccccggtcatcgacccccagaccaatgccggccaaaagactctgagctgcgacggtgagggatgcatccagttgggggagatgcacggtgccgcgccggcgtggggtttgtggatgcgattgatgtcacaccgtcccctcattgcctccctcgcccctccatgcagcgagcgagggtggctacatcccagcggtgcaggcgctgggaccacacatggccgcgctgggcatcacattctacaggtgtgcgaggatcagtgtgttgttgttcccgtgttcctgggaacacacttcggcggctcggtggggcgcctcgcaggggcagggggcatgctgcccagggggacccagaatcacactcagtccccccccctactcccatcctttgcactccacaggcgcaatgcgagcgcgtcctacgcgttcccggaggagtttgaccgtgccgccttcatagcccagcgcggatcctggaacagggccaacttcatgatggggaatcatgcacccgccactctgcaggcggaccctggccgggtaccgcgtggtgaccgtggcgctgcgcggcgacggcacggcggagggcgtgcgccccttcatgtcggggctgctggagggagacactnnnnnnnnnngaccgtggcgctgcgcggcgacggcacggcagagggcgtgcgcccctttatgtcggggctgctggagggggacacaggcctgcccgcctgccccgccacgcccaagtccaaccaggctgctgtgcgaggtgggggccgcgtgtgggtgtgggcggggttggaggttctgcatggggcgccggaggaaaggggagcgggagagggggcaatggtgcgtgtattgagaaaggcatcgggtgagacgctgcctggccgattgcggcacnnnnnnnnnnctgccccgccacgcccaagtccaaccaggccgctgtgcgaggtggggtccgcgtgtgggtgtgggcggggtggtagtttctgcatggggcgccggaggaaaggggagcgggagagggggcgatgggacgccaggggagttgtgagggtgagacgctgcccggccgattgtggcaccctggcccctcgttgcctaggcccccccccccaagcgcgcaggccggcccgtggacgtgctccagctcccagacggctccctcctggtctcagacgacaccggcaatgcggtgtacaaggtggcctaccaggggcgcatccccgtcctgggcctggccggctgaccggctcggcacagggatatcaaagccgagctgtgtggcgtgtttccttgacgagccgcgtgctccggcctggacccgtgtggcgcggagccagcacgaccaccctgcactttcctgtctgccgactttctggcacctgtgaatggcgggcgcgccctttgtacctctacccagacaaccccaccttccttggggtcatgttagcacctctgattccccggctctgttccccggctctgtacctgtccctttcctgccttccctcgtgcccctcctccgcaggatga

SEQ ID NO: 158 - DNA, 1455 bp, Chlorella protothecoides
  modified_base (33)..(42): a, c, t, g, unknown or other
  modified_base (476)..(546): a, c, t, g, unknown or other
atgcgctgcccctgcccagacatcgaagtagcnnnnnnnnnnaggacgcttgcaggtctcggcacgcacgtccaagcgctgcccctgcccagacatcgaagtagcagcagcagggtgctcctgaactggcgaagccagagtgccatgcttgcgttgcagattctgctgtcctgggcaccccggccatacatacggcctggggccccaggcagcggagaccctgcctcaacagaggccagagtctacccggtgctccggggtgtacagaggctcaatcgacctgctccactccgagtcgtacagctgcagcagccggtcggcccgcgtgacgccgctctctgcacgtgcatgaagaggggggatgagactcgtgttggcctttttggatgggtccgcggaggaccacggccaggttgctacattcaccgaagggcgcccatccccctcttcatgccggcacaggggcctcaggaccnnnnnnnnnnnnnnnnnnnnnnnnnnnnnnnnnnnnnnnnnnnnnnnnnnnnnnnnnnnnnnnnnnnnnnnaaagcagcccccacactacgcacccgccaccgcgtccaggacgtcgaggtagcgctcctcgcccagaccgcgcgcctccaagccccgccgcgcgatgttcagcatgcgcagcgcgacgtcttgcaccgtcccgtcgcggaagggggcctgcagcgccaggcgcggcacgtcggcctgcagcgcttccagctcggcgggcgtccagtctgcgaccagggcggcggcctgcgcctgcgcccccgcgtcgtacagcaggcccacccacagcgcgggcagcgcggtgatgaactcccaggagccgccgtcggcgccgcgcatctccaggaactgcttcaaccgcacgtccgggaacacggtggtcaggtgcaggtcccagtcggcggcggtggggaagaggcccgggtgcccctccagccggccctcgaagaaggcgcggaagggctgcccgcccacgtcggtgtactggccgtcgcggtacaggaagtacatgggcacgtccagcgcccactccgcgtaggcggcgaaggagaagccggggtcaaacacgaagggcaggcggccgcagcggtgcgggtccacgtcggtccagacgtgcaggcgccaagacttgtatccggagggcgcgccgttgcggaagggggagtttgcgaacagcgcgcccgccacgttctgcagggccagcccgatccggaacttctgcaccatatcctcctccgactcgaagtccaggttcacttggatggtgcaggaccggaacatcatgtcgtgccccaacgtgcccaccttgggcatgtactcgcgcatgtagcggtacctgggcgggggtggaaagtgtgggttggggggggttgggggggaggggggtccgtgatgacgagtgccacgcgtgtaccacccacagtgagctag

SEQ ID NO: 159 - DNA, 1209 bp, Chlorella protothecoides
  modified_base (812)..(962): a, c, t, g, unknown or other
atgagccaggcggagcgcgaaaaggtcctgcgcgccttccgccgcggcggcatctccgtgctggtggccaccgacgtggcggcgcgcgggctggacatccccgacgtggacctggtggtacactacgagctgccccaggatgcggagtccttcctgcaccgctcggggcgcacggggcgcgccgggaaggacggcgtggccatcgccatgttcacgcggcgcgaggcggggtggatgaagcgcatcctgcgcgagacggggacggcgggggtcacgctgatcaccgcgcccaccgcggtgcaggtgatggaggcggcggcgcgccaggtcatgacgcgcctggacggcgtggaggaggaggtgcgcgccttcttccggcccgtggcgcggcgcatcctggcctcgcgcgagcccgccgaggcgctggaggcggcgctggccgcgctgtcgggcatcaaggaggtgcccgagccgcgcagcctgctgacgcaggaggagggcctggtcacgctgcgcctgagcggccggcgtggccgcatctcccgccccgcccaggtctcggccgtggtcggtggcctggccgacgccgccgcgcccggtggcgcgcgcgtcgccctgggccgcatccgcatgctgccagcgctgagcgcggaggagcgcgaggagggcgccgccttcgacgtgcccgccgccgccgcgccggcgctgctggccgcggccgaggcctccaccgacctggcgggccaggggctgacgctggacatgccggacactctgcccccggaggaggacctgtatggccgcgacagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgctcgtccagcggcagcggcggcgggtacgggcgccgccctgcgtccggcggctccgggtcgggctaccgcagcggcggcgatcgctggagcggcaatggcgggaacaagtgggagggcggcggtggcgaccgtaacaggcggcccagctcgggcggcgcgcgccggtcgtcctcttcctggggagacgcccagaagtttgggggcgattggtgaggcggactgtgaggtgctcaggaggtga

SEQ ID NO: 160 - DNA, 1038 bp, Chlorella protothecoides
atggagggcaaggcaaagatcgggctggcccacgacggccagaccgtgaccctggagccgggcggccagacggagctgagcggcgcgcccctccccgatctgcacgctgtggcccgcgagacgcgagagcacctgctggaggtgcggaaagcttgcgatgcggtgggcatcgactacatgaacatcggcttcgaccccaagtgggactttgaggacgtgccgcgcatgcccaagacacggtaccgctacatgcgcgagtacatgcccaaggtgggcacgttggggcacgacatgatgttccggtcctgcaccatccaagtgaacctggacttcgagtcggaggaggatatggtgcagaagttccggatcgggctggccctgcagaacgtggcgggcgcgctgttcgcaaactcccccttccgcaacggcgcgccctccggatacaagtcttggcgcctgcacgtctggaccgacgtggacccgcaccgctgcggccgcctgcccttcgtgtttgaccccggcttctccttcgccgcctacgcggagtgggcgctggacgtgcccatgtacttcctgtaccgcgacggccagtacaccgacgtgggcgggcagcccttccgcgccttcttcgagggccggctggaggggcacccgggcctcttccccaccgccgccgactgggacctgcacctgaccaccgtgttcccggacgtgcggttgaagcagttcctggagatgcgcggcgccgacggcggctcctgggagttcatcaccgcgctgcccgcgctgtgggtgggcctgctgtacgacgcgggggcgcaggcgcaggccgccgccctggtcgcagactggacgcccgccgagctggaagcgctgcaggccgacgtgccgcgcctggcgctgcaggcccccttccgcgacgggacggtgcaagacgtcgcgctgcgcatgctgaacatcgcgcggcggggcttggaggcgcgcggtctgggcgaggagcgctacctcgacgtcctggacgcggtggcgggtgcgtag

SEQ ID NO: 161 - DNA, 1161 bp, Chlorella protothecoides
atggccgggcatgagcatggcgcggggcaggcaagcgctctggtctgccggcagcgtgcggcgctcgggcggtcactgccacacaggggtcggagcccggatcacctcctgagcacctcacagtccgcctcaccaatcgcccccaaacttctgggcgtctccccaggaagaggacgaccggcgcgcgccgcccgagctgggccgcctgttacggtcgccaccgccgccctcccacttgttcccgccattgccgctccagcgatcgccgccgctgcggtagcccgacccggagccgccggacgcagggcggcgcccgtcctcctccgggggcagagtgtccggcatgtccagcgtcagcccctggcccgccaggtcggtggaggcctcggccgcggccagcagcgccggcgcggcggcggcgggcacgtcgaaggcggcgccctcctcgcgctcctccgcgctcagcgctggcagcatgcggatgcggcccagggcgacgcgcgcgccaccgggcgcggcggcgtcggccaggccaccgaccacggccgagacctgggcggggcgggagatgcggccacgccggccgctcaggcgcagcgtgaccaggccctcctcctgcgtcagcaggctgcgcggctcgggcacctccttgatgcccgacagcgcggccagcgccgcctccagcgcctcggcgggctcgcgcgaggccaggatgcgccgcgccacgggccggaagaaggcgcgcacctcctcctccacgccgtccaggcgcgtcatgacctggcgcgccgccgcctccatcacctgcaccgcggtgggcgcggtgatcagcgtgacccccgccgtccccgtctcgcgcaggatgcgcttcatccaccccgcctcgcgccgcgtgaacatggcgatggccacgccgtccttcccggcgcgccccgtgcgccccgagcggtgcaggaaggactccgcatcctggggcagctcgtagtgtaccaccaggtccacgtcggggatgtccagcccgcgcgccgccacgtcggtggccaccagcacggagatgccgccgcggcggaaggcgcgcaggaccttttcgcgctccgcctggctcatgtcgccgtgcagcgcctgtggtttttttttgtatgggggtgtaggtggtggtga

SEQ ID NO: 162 - DNA, 1404 bp, Chlorella protothecoides
atgacttcccagcagcggcagctgcggcggggacctgttgaaatggtacgcggaagttgcgccgaggcaggaaagggcagtgctcagatcggaaatgtacccccaaggcgtagggagtggcaaaacaggccagtgccaacatcccttacctggctgtcggtcatggggcgggccgcgatcctgttcagcctgcagaatatgctgggacgcctacctgtccgagagtatctagacaagaagagagacttgttgcacactctctctccaaaggtaaccggcgcgctaggtgacgcagtacacgtgtttggcacaggcgactggcagcgagcatacacaactacctcgctacggttgcggcagtgcccctggcgtcgcgatcactcagagtgctccccaggaaatgaatactcgtgtatcaataacccctgcgccaggttttcaggggcctgcaatcatgtcgtccgctgtttgctaagcgttggaattattcagcctcgggggtccgtgtggcgcgtgctgctggaaaggagttgtttcaaactggcactcgaatgggatagggccatccctgccagtttcagtccgtacggcatactctgtggccgggccatgaggcacacctcggtcgtgcagctgaccggtgcgaaacccgctctcggcagcatcgagccagcctccctcctcacctatgagactatggtccctgccagactactcagacggtacaagcgctttctgggcgatgtagaggtgcgcgaggagcacagcccaatcctccaattcctgccgcagctaagagtcgatgctcaagatgaagatgcggcgccatccacgacacaagccgtcatacatgtacccaacacgggccccatgactgggttgctggatgagctaccctcccgcgtcgccctgtccctctccgctaaccttaagcgcaaatacgcacactccctggaatggatccacctgcagaaggaggtgcgatggccccagcttggacgaccacatcttgtttcgatttcatcaccctgcactttggtcggattattcaatcattgccaacacaagaggcaggcgcccagtgcatctcatcactctcccacctcccaggcggtatgggtgggagtccacagcgcccgagccaacgccatggccaaggagctcctctccacccactgcctgactggcttgccggactatgacaacatcacgccaggtcagagatgcgactgggaggggttgacccgggtggaattcaatggatggtcaaacagcagcctgcctcctctgtggcactcgtgtgcaacctatgatgcagagggacgagaggggggctgcaaacagtgcggcaacgcctctagtggtcctccttcctcagcctgcaagatccacatgtctgtataa

SEQ ID NO: 163 - DNA, 924 bp, Chlorella protothecoides
atgtggggacggggcgaggtgatgccgcccatcccgggcctgcccctggagctgcacccctcccctcatggccatgcgggaagctgtgcatgggaagggatgccttgtctgtacgggaaggggctgagtcgccctgatggcatgcagccacaaacacccacgccagggcatgcacgtcgaccatgcacagcaggaaggttccccgccggtcctccactgacactccccccaccccaccccacgctgacttccaggcctgatcgactgcctgatcacgggaggcatacccccgcgcatcgacaccccctgcgccgccgaggcggtgtaccgggcgtgcgcgctccgggtcctgctccagaatcgcaagtactattcacgctttcccatggacgtcgcgcgcattggggcggtggtgcgcttcctggcggccgccccgggagggggggtgagtacacccgccgggaacctgctcacccccaggtgagagggctaggggtggcccgtggtctcagtacagggatgggggcgggtgatgcacgaatggctctcccttgctcgaatctacctttacccattccttcacctccacccctcaggagcctgcagctgctgggcctgcacagcatgggcttcagcaccggcttcgagcgcctgcactacctctttgaaggcagttttgatgggccagagctcagccgcaagttcctcaaggtctggggggttggggtggttcgacccgggaatgggcttgcaagaacctggtgtgacgaatgtggtggagccaccatggctttacaagcgcccgttgggctggagcatacaggcagagtcttgggtatcgatcccccctctgctatctccccacctggccacctggcaccatggccccccctcctgtgcgccaggattttgatgtgtggatga

SEQ ID NO: 164 - DNA, 1191 bp, Chlorella protothecoides
  modified_base (284)..(293): a, c, t, g, unknown or other
atgcgaagcatctgccagcgatcattcacgtccatctcgagactgacacgcgccagagccggtgcatcgtcgcctgcgccccacccccagcccatgacagggtcggttgtgaagcgggcccgcaccgctggctgccaccagcacaaggtgggccccaccttctcggtgccaggactgtgcatcacagagcacacattcacccttcccctggactactctggtgagggggcctgtgaggttgccagtggctgccacatgctcgtgcccacacctgcttgtgccgnnnnnnnnnnacccttcccctggactactctggtgaggggccctgtgaggctgccagtggctgccacatgctcctgcccacaccggcttgtgccatgtgccggcctcatctccggcccccagcgtcatgccagccccctacccatgccctctaggtctccaccctggcaatgtggatgtcttctgcagggtactggtgcacaggaacaaggtcagcgaccacaacctgccgtacctgctgtacctgcaaggtgcgcccctctgtctggccagggagggttcagggacgtgaaaaaatggtgcacagcagcaggcatccatgggaggaccagggttcgaagctccacgacccctggacaacaccgggtggatcaagcatgcctgcaactacttccgcatcgtgctcatggtgggctctggtgctctgcaacgggcgtgcttgttcctcccctcgcgcgacgcagcccctgcgatccatggcacccaccgccatgtctcatgcgctcggccccacatgtctttccctccaaacatgcaggaccagcgtggcacaggcctgtcgagccccatcacccctggcaatatcgagaggctcggggacgcgggagcgcaggccctgcacctgacgcacttcaggtgggcgtggtgaccagggcgctgaggtggcggtgcgggccacactgtacctccggcggcgctgccatgcctgcatgccagtggcgccatcccatcacttgcctggcgtgcagggcggacagcatcgtggccgacgcggaggtcatccgcatggtgctggtgccgggaacaaaccacgacggccgctggacggtcctgggccagagctttggcgggttctgctgcgtcacctacctctctctcgccccagagagtgagcctggtcccgtgtga

SEQ ID NO: 165 - DNA, 1077 bp, Chlorella protothecoides
atggggtgggggcgtttcggcaggggaccatcctttggatggatgacacagggtgtggatgcgggatatcctcacggtcgcgccaccaaagaccttgttcggcgcggacgtgaagctgctgttgatagtgggggcacagcccttatgccccatgggcagcttttgcgagatgcaccttcgaccccctccaacacaccacacatctcccctcccccccgacaggcgtctgccaagctggccgccgccccgccagccccgagcgcgcccgcccccgccgcccccggcgccgtcatcaggcccctccgcctggacgcgcaggaggccgcccgacgtcacgagcgcagagcccgcttccaggaggagctggcggtcggcgcgcgggcagccggcgtgggccagcgggagacgctggtgcaggcgcggcgcgcgggcgccgcggcggagggtcgtagcaccgccctggagcgagagttcctgcgcctgaccgcgctgcccgcactggaggacgtgcggccgccggggttgctggccgagtccctggcgctggtgaaggcgcgctgggtgcagcgaggccgtcgctgggggacggcagcacgtccatcgcaccctgtggccagccgtccctttcccaggcctgcccgtggctcggggtcaggcagggagccggcctcccaccacggaccacctccacaccccacccatccacctgccatccgacccgcaccctacgcaagcacaggaccacgactatgcctacgcgtgcgcgcagctcaagtccatccgccaggacctgaccgtgcagcacgtcacctccccgctggcggtgggcgtttacgagacgcacgcgcgcgtggcgctggaggcgggcgactgggccgagttcaggcagtgccacgcgggcctgctgcgcctctgggccgacggcgcggaggaggtcgtgccggtgagcagcgtgcggtgcccggggcgtgtggagtgatgcggggagggttggaggtcgcacgtgggtggggtgtgctggcagaggggctggaaaacgtccacatcattccgatccgctggtgcctcggagcacac

SEQ ID NO: 166 - DNA, 402 bp, Chlorella protothecoides
atgtggcaattcacagacatcctggcgagcaaggaggactggccaactctgtacgatgtggatgtcctggaggagaacaccgtgcccacagccggcgtgctctactacgaggacatgtttgtcaattttggactcgcccaggtggggcagccgggcgacagggacccggggacgcaggggggtgggccccctgggggtggcccccctgtgggcctcgctgcgctgcaaggcattccccaacctcccaccacccttgcgtcctcgcaggagaccgccaatcgcatcaatggcatgcaccagtgggtgaccaacgagtatctccactgtggcattcgagaagcagggggccctgtcttcgagcgcctgctcaacctgtgtcgggggggcatcctgccccgatag

SEQ ID NO: 167 - DNA, 1134 bp, Chlorella protothecoides
  modified_base (607)..(616): a, c, t, g, unknown or other
atgggcgcatcaaggacatcggtgagctcgcctgccagctcaaacccacccgcctctcacccgcaggtggtgttgcttctgcttgcactcagcctcacagcgaccgcgcacacgaccccccgtcgcctccagtcgtcctgcgcggcagaggctgggtgcttggccacatcgtgctccgatgccttcgataccacaaacctaccctacaccgccttctacacaaccagcgccagcgcagacagcacaacgttcaccattctggcctgctcggaggggtgctcccaatcctcctccgggtgcgctccactccagaccttgagcatcaggctggccgactccctcctcgccaaccccggtgcgattgtcgcccagcccactggcactgcggcaagccgctgcagtgatgcgggcaaaggataccggtggactggcgctgccctaggcaagctgcacaccctaacccctttggaggtgagtgggacagggtctggtcttgatgctgtacatgccttcacaccagacaaacctgcaatacatgtatcagggcaatggaactctagcacaccatacccacccagctcacaaaccttgcaatgtacgctgaaannnnnnnnnngtgctgtacatgctttcacaccagatacagctgcaatacatgtaccaggccaatggaactctagcacaccatacccaccaagctcacaaaccttgcaatgtacgctgaaacccctcatcaccaccctctgtaagcaggcggctttctgtgccagcttccaactaaccatagccaacacggtgactggcacgccactcggtctcgctgacatttgtcaggcaaatttgaacgtactggccaacaccgggacactcctgtttaacagtacagccaatccaggaacatgcctgatgaatctcgcaaccaccagcggggcggcggggtacatcttgctcacagatgccgagggcccacaagcctcacccccagcgggccccagccctcctttgagtccgtcaacatcgccccagccatactccccaaggacaccgccgtctagtgtgccaccaccctccccctatagcccctcacctttaccatcgcccagagccagcccctcccccaagacgccgccctcc

SEQ ID NO: 168 - DNA, 1554 bp, Chlorella protothecoides
atgaatgtaggagatgaggctgtgcagaccggggttgcagtggggtactccccgtcccgtccgtgtctagcaaggcctggcgatgaattgctatgtacgccattcggatgggagcgggacttaaatctgatcgggggcgcagtccctcaccaattcgacgtgccctccccgaaggaaccttgcggctggaccggtcaccaccgccatcgccctcgacaccgagttcgccaatcgaaagatctggctggtcaaggtacagggaggtgggggtccaccgagcgggtgtcgaaacaaggtgcccgccagtcactccaacccctatccaccccaacccccctcaaggtcccaaactttgtggcggagcggtggagggccgtgtgccagaccaatgcccatgactgtggggaccccgtcggccccgagctgggccagatatcggtggacaagcctgctgccggtgccaaggaggccagcatgcacctgagcctcacccactccgacacggagggcctcccaaagaccttcctcatgaacgtcgccactcaaaacatggccagcatggctgcctttgcccagaccgggccctgcagcgtctccgccgtgggcagggtgtttcagaagtttgacgtggtcgtggagcggggcgccgcgggggcttccacctccggagcggacggggtgatagacccagagtaccgccagttgtcacgcatgcgcgccaaggctgcggccacaaagtcgcgaacgacgcagctcatcagccagccgcagtttaccaatcttcggcaccccatgcacatcggaaccacaaagaagagggtgcgcagggttgatgttattgttggctgggtcatgattggagggaggcctgctcggtggcgaggttctgctgcagggtactggctgcaaggaggctggctctgccatatgatggcgttagcacagacacccttcaatgggccctgggcaacactggacccgacggagaagcgactggccaagccggcagaggagctgactgccgacctcttccggctctttgaacggcaaccgcactggatattcgcccagctacagcgccagacagagcagccgacgcagcacctcaaggtgtgcggggggagcgtatgggtgaaggggcgggccatggggtcacaacgctggcaggcttgcacagaaaatgccgctgcgcaccgattccatcgcgctcaaggttgcagaggggcgtacacaagatgcaatacccactgcatctcacattgtgccctgcaggctgttctcctggagattgctgtgcagaacaagaggggaccctacaaggacatgtgggagttgaagaaggggtatcgactcaccggtgatgcggttgtgccgagaatcggggcaggcgcatttgccggtatacgagagcggctgggtccacgtggtaaacccacggcggtagagcgcgaatacgtcgcacatctctgctacaagtcccacgctgtgtgcggtctgggcatcactcacatcgcccttccccgtccgcccatagaccaaggtgcgaaaccttga

SEQ ID NO: 169 - DNA, 3015 bp, Chlorella protothecoides
  modified_base (1934)..(1943): a, c, t, g, unknown or other
atgtctgggacccccccacacccctcgccccccggcgtggtgcgcacccgggcgaccctggacccgggtgggggccatgaggggttcaatccccgcgccatctccatcggggccagcgtggagtccctgtcctacagcgtggacctcaaccgcgtgggcctgcgggcgatgcggcgcgacgccggcgcgccgcgccacctctacggctactcgggccggaccctgatcaagctgctcaccaccgtcacctcgggcgtgctcatcggcctcaccgccgtcgcgctgggcgagtccatcgagagcctggtcctgctccgcaacggtgcgctgaaagcgctgctgccggagcacggcgcccggggcgccggcgccttgcgcgccgtgctcccggccctgggcctgcagctggtcgtgtccgtcgccgcggcggtaggcgccgcggccctggtgcagctggtggcccccaaggccgccggcgcgggggtcacgctggtcatggcccacctgaacggcaatgacatccccgacgccctcaccgcccgcacctacgtcgtcaagttcctgggcaacgtggccgcacgcgtggcgggcctggccctggggccggaggggcccatgatccacctgggcgcctgcgtcgcctcctgcctctgcgccgctgaagaccgtacgctgagggggggagcgggctgggatccacgaagtaggatggtgctgttcccagcaatgctcctccagacctggccggaagtcattgttggagcagtctggccgcttctggacgcacgcgtcgcgcccctccgtcacccgctcccgagccgggagcctggccctggaggcccccgcgtcgcccggggaccgcggcggcgggcagagctcgcaggagggcattggcgtgccgagcggcgcgcccgggccaaacgggtacgagcccctgccggccgaggccaccccgcggcgctcctcgccgctgcccccgcccccccgcgctggggtcgagggaagcgtcagctgcgacccgagcgcacacggcagcgccggcacgcagtccaccccccgcgccgccagcctgccgcgcctgtcctcgctgctggcacagcgccgccgcccgcacggcgtgcccttcttcagcaacgcggaccaccgcgagatggtgtccgccggcgcggcggcggggctggcggcggccttcggcgcgcccatcggcggcgtgctcttctcgctggaggaggcctgctcccactggtcacgcaacatcggctggcgctgcttcctggccgccacggtggcctccttcaccctctcccagctccacccccgtggccgctccggcatcctgggcttcggctccatctccgcgccggacaaccgccagtggctgctccagctccccttcatcatcctcgtctcggccctgggcgggctcatgggcgcactgttcaacaccgcgcgtggctggctggcggggtcgcggctcaaggccccgcgcggcgctacgccggagcgcttgctggaggcgggcctggtggcggccgccaccacgctcgccacctttgcagtcagcagcctgtggggcacgggggggagggggagcgctggggtccagggtcgttttgtgtgtgtaccccggggagggggggggagggggagggggcaatcgtcccaaagcaggcttgtgaggccggtctggcgatgcagccgcccactccagatctcgatgccctgccacacgccccgggacccattgtcatcctctgggctcttccaatcctcttcccgccacaaccctcgagcaggattctcaccatcacaagtcttactgccccctcccccctcttgcgagaccactcagtggacaccctccccgcaataccccctccgtccactacccaggtgcctgaccgtgcccaaggagtgggacggcgcgctgctcnnnnnnnnnnccatcctctgggctcttccttccctcttcccgccaaacccctccagcatgattctcgccatcacaagtctttctgccccctccccccctcttgcgagaccactcaatcgacaccctccccgcaataccccctccgtctatcccccaggtgcctgacggtgcccaaggagtgggacggcgcgctgctcatgcagtacacctgccccgccgggcagtacaacgacctggccaccatcctgctgtccaccagcgtctacgtcatccgcaacctgctgggcatgggctcccgctcgcaccccgtccccgccgcctgcggcctggaccgtccctgctacttctccctggccagcttgtgcattgcctcggcgctctacctggtcctcatggtggccgccgcctccaccgcctcccccggtggccttttcatgccctccatcatggtgggcgccacgctgggcggcgccgcggggctggccctgcacgccctgctccccgccgacttcggcatcaagcccggcatcttcgccatcgtctgcgccaccgccacgctgggcggcgtcttccgctcctccatctccctcgtggtcattgtggtggagggcacgcagggcatcgagttcatgtttggcatcatcgtggctgtggtcatctccaacgccatctcccagctgctgaaccgcgacgggctgtacgagggtgacctggagcgggacggcacggtgttttacctacgccacgagccgccgcacccgctgcgctacaagaccgccgccgacgtgatggccagcccggtgctgggcttcaacgcggtggagtcggtggcgcgggtgctgcaggtgctccagcgcagcacgcacagcgggtttgcggtgtacgatgacagcagcggcaggtggggggtggttctgtggtggggagttttgtggggcagaccccaggcctggggacagccgtgcatgatgcgctgcacgccctgctcccccaacacacccacaccgttgaggagtggacaacaaaacccacaaaaacccacagggacccgatgctgggctcggggcggctggcgggcctga

SEQ ID NO: 170 - DNA, 1410 bp, Chlorella protothecoides
  modified_base (586)..(595): a, c, t, g, unknown or other
atggtgctgaaggtgggcatcctagggggcgctaacatcgccaacaaaataagccgggccatcaactccatacccgacgtcgcgcaagtaattgtggttggcagccgtgaggcctccaaggccgctgccttcatcgagcgcaacaagctggtccatgcctcccccgtggctggctacgatgccgtgctggacttcccgggcgtggaggccgtgtacatccccctgcccaccgccctgcacgtggaatgggtgcagaaggccgccagcaaaggcttgcacatagtgctggagaagcccatcgccatcgaggacgagcatgtggatgccatcgtcaaggcggcggccgacgccaacgtggtgctcttcgacggcaccatgtggatgcaccatccgcgcaccgcagccatggaggctgccctgcaggagatcgggccggtgtgggatgtggattccgccttcaccttcaaggaggggctggggatgacgcagtgtgctgacggcatgctttgtgcggcctccagggagcactggcaattgacagtccggctcctaagcttgcggctgcaaagagtatttctgagcaatnnnnnnnnnnttgacagtccggctcctaagcttgcggctggaaagagtatgtgcaagcaaccttttgcaccacccatgcagggagcgctgacttcctggagaacaatgtgcgggtcaaggccgacggcgaccccctgggcgcactgggcgacgtgggctggtgggtattgcaggagggagggacggggtgtgcacagactcgaccctcagtactcgaccctcagtgcccaatcttgcggatgtcacgcagctcggagctcgattccgccgccggctgcggggccttcgtattacgaactggctcagtactgcgtgcgcgccatcctgtgggcgtacgacttcacgccgcccacccatgtggccgcccaccacggcgcactgttcaacgaggcgggcgtgccgctgaacatcgcggcgacgctgctcttccccggcgggcgcaaggcccgcttcctggcggccttcgacaccgtcttcacctccaagctggaggtgtacggcgaccgggggtcgctgcgcctgcgggactttgtcatccccaccgccgagcacgaggcctcctttgtcatggccaccgccaacggcctggccgacggcgacacccgtatcgccacggtggaggagacgcggacggtgaggaacgcagtgacgcaggaggcagcgctctggcagcgcttcgcgcgcgagatcgaggtcgtgcgtgccggcggccgcgcaccggagtattggccgcgcatcgcggcgctgacggagcgggtgctgagcgcggtgctggcgtccgccaggcagggctgcgccctgctcccctttgagcaccgcgcgtga

SEQ ID NO: 171 - DNA, 870 bp, Chlorella protothecoides
  modified_base (441)..(450): a, c, t, g, unknown or other
atggccgtgcacgccgcagcacctgcgaggcagatgggcctcgccctgctgacgcagctccagtcgctgggggcggtggggctgggcgtggagcccctgttcctggaggtcggctcgcaggaagccgccgcgcccatcgggtccccttccggcatgtgcgcgccgggcagcggcgctcaggcccgcatccacggccagccgggcactgccctggaccgggagctgtcgttcaaaaaggtggcggtggggggcacctttgaccggctccacgccgggcaccgcctgctgctggccgccaccgctgcggtcgcgagcgcggagatcttcgtgggcatcactgccagccatctgatcccgctgtggtggcgcttgggccgtggagcccaggcctatccctggcatccaccaccgtcccgctcacccccaccttctgccgtcccnnnnnnnnnntggtggcgcttgggccgtggagcccaggcccatccctggcatccaccgcgtcccctcacccccaccttctgccgccctgcagcggaccgcctgctggtgaacaagcaggggagggagtggctggaggcgtacgaagtcaggagcggcgcggccgtgggctacatggaggcaacccaccctggggtccgggtgactgcgggccccctgctggacccgaaggaacctccgctggccaccactgaccccagcttcgaagccatcgtggtgtcggaggaaacgatacacggcgctgaggccatcaacgccgggcgggcggagcgcgggtttgccccgctggtggtggtggtggtgggtctggtgaggggccagcatagctcaagcgggaagctgagctccaccgacctgcgtctggatcgctga

SEQ ID NO: 172 - DNA, 1803 bp, Chlorella protothecoides
  modified_base (1193)..(1202): a, c, t, g, unknown or other
atgtcctcggagggcgcgaccgacctccagaggctcgacgacgcgcccgtcgcctttgccctggcagccccggcgcgacagtcggaggcccgggcccaggcgcaacccttgcccctcgccttcggcgaggacgcgacagggcggggcccacgcgcggatgggagcagggcggctgccccgccccagaaacgtagcaagctggaggagctcatggcaaagcggctctctggaccggggccctggttggaggttcctgggcagcccactgccatgagaggcctgccggcgttgcagcaccaggacccggcactctccctgcgccagctgttgtcccagactccctggcgctcaccctgcctttcctcgctgccccaggacaagctggccaaggctcatggtgccccgtcgcgcctggggggcacggggtccgcagggcagcccccgccccgtggtcaaggccccgccgcccccccgccgcgcaagacggaggcctggctggtggaggggctcacggtcaaggtcatgagccccggcctgaaggcgcatgggtactacaaggagaaggggctggtgctgcgagtgctggacaagtacatcggcgaggtggagctctttagcagcggtgcgggtgctcgagggagggggggttgggggactggggggaggaggcgacatcgtgcgtgtggaccaggaggagctggaaagcgtgatccccacgccaggcggcagcgtgctggtcgtgcggggccggctcgcggggcggcgggggctgctggtccgcatcgacacctcggccttccaggccgaggtcgagctggagggggaggggcgggaggttcgggagcaagtgagggggcactgggtggaaggggtgtgcccgacccgatgggggaggacgcagcgcctggtgttcacccttggcgcttggtgtcctctgcgtcaggctgtctgcccgctgcagcagtgcatcggcaagactccatgggaatggcaacacagggaccgccgtcaggccagcgtcgagcctcgccgctgcgccacactcgcgatggcatccagccgcgcctcgacggcctgctccacggccgcagccttggcctcggcggacccctcctctaccggtacagatggggtttctggcctcccaccgacgccaagccctgcgtctcgccgccgccgcttctgcaggacannnnnnnnnnatccagccgcgcctcgacggcctgctccaccgccgcagccttggcctcggcggacccttcctctacgggtacgcatgggtttcctggcctcccaccgacgccaggccctgcgtctcgccgccgccgcttgtgcaggatgaagccggactccgtttcctgcgtgaccttgcctgcggcggagggtggcggggagcaattacagcagaccaaagccggttctttgagatgtccaggttgctcacaggagcctcacctttcgagccggtctcggccgcagagatggcggtcgacagtttctgccggatggcttgctgcatggctcggtctgccccgtcttgccccttggcatcacgcaggaactcgtagagcagcacctcccagacccgctgcgcctgctgcttgcagaggcacagctcctgacgcgcgcgcttggttatgtcggcggggatggtggtgtggaaggctgcctgcccttcgccgacttcacccttgccttccaaggctgttgtggccccaggtgcgagaccagacacctgttgtggcagaggcaggaagtcagagcgtgcaattcgatctcacgcacatgggtcagaaacgttga

SEQ ID NO: 173 - DNA, 609 bp, Chlorella protothecoides
atgtgcggcaagtcctgcagggatgagaacggcttcaagtgccacctcacctcggacgctcaccggcgccagatggagatatttgggcagaacccggaccgggtgatcgaggggtactcggaggagttcgaggagtcttttctggaacacctacgccgcgcccaccccttcagccgggtgcaggccaccgtggtgtacaacgagttcatcgcggaccggcatcacgtgcacatgaactccaccaagtggctgaccctgacggagttcgtcaagtacctggggaagaagggcatctgccggcctgctctcaaatcgtcaactccttccggtgctccgagaatggcacaggaactgttggagaagaagcgcctgaagcgtgaaagggccgagctggaagagtcggagcgccacaacaaagccctcgaggcccaggtggcccgagccagggccagtcagccaggtgagaggcgcggcagggcgtgttccatggtttgcgcagcagtgatgggcgcttggagttggccaggctcagcactcttgagagcttgtcatcgcagagctggctttgaacgtgcactccgcgccataggctgggcggccgctctctga

SEQ ID NO: 174 - DNA, 2496 bp, Chlorella protothecoides
  modified_base (274)..(283): a, c, t, g, unknown or other
  modified_base (743)..(752): a, c, t, g, unknown or other
  modified_base (1867)..(1876): a, c, t, g, unknown or other
  modified_base (2084)..(2093): a, c, t, g, unknown or other
atgatagtgtgcttcatcctgggctcgtcgagggtcgcggctcagggctgcaatgagctgcaccccgtgaccagccccttcaacgagagcgcctggctgtcatgcatcgatggcgtggagcccgtggtctcggcctccacccctgatgccttgtatgacctcctctccaacctgggcgctgcggatgtgaccgtcgtcatcacgggtatgcacgcgatggcggtggtggtgatgggtccatgtttgctgggggctgcatccctgccaggcgccnnnnnnnnnnatggtggtggtgggtccatgcttgctgggtgctgcatccctgccaggcgccccaccgcgctcggccccgcgatgcccggccgccgctccatcgcccccactcctcccgcaccctcctcagctgacatgagcctctcggactgggccctcaaggccacccccgtcgtcgtgtcccagaaccagatcgtggtcctgcgcgccgagctgacctcgctgcccgacgtcacgcagggcctccccgccctcctggcggcgggtgcccgcaatctcagcctggcccggctccccggcttgttcgaggtgcagaccggcggcaccctggccttggtcggcctggtgctcacccacccgcccagcgccgcggcctacaccgccgccttcccggcaggcaccatccgtcccgccggcctcgacctctacccagcagtcctggccgacgaccgcgccgtggtggccacctnnnnnnnnnngggcaccattcgccccgccggcctcgacctctacccagcggtcttggccgacgaccgcgccgtggtggccacctcctacaccagcgtggactttgaggacgccgactgctcccaggctctgatcaacagcctgaccttcctgcgcggctccgcgctggcctccgcagacgcggtgggcgaggtgccgggcgcgcccacgccggcatactacaccgacgaggtgggcgcgcttaccctggccatggtcaactcaagcagcctcctgcgcctgcccgggcaattcatggtccaggtgctggggccctccctcgagtactgcatgatcactgcggacggcggcggcggcgacaacggcggcggagggggcggtggcgggggcctccccgcatgggccatcgcgctgatcgtcgtgggcgccgtggcggccgcgtcgctggccgcccttgcggccctcatcctcctgcgccggcggcggcgccggcggctggccaagcactgcgggcccgtgagtgccggggtggccgccagcgccggggtgcctctgggcgggaggttgcggggtggcacatcgtcgcgcgcccccccccctcgcccagtgcgcctggccgcgcccgacggtgggtgcgcgccatcggccgcgccaatcgccgccgggcttgccgcggagccctggccgggcctggggttccgagacggcgtcgaagagccggccccggtccccggcctggcctccctcgacgcccagacctgtgacgtagacctggacgcagacctgacacgcctggcggccctgcagtccacgtggcgcggggcggtggcctcctccctggacctggagttcctggagacgctggcgcacaaccgtggcgccacggtgtggcgcgggcgctggcgcggctcccccgtcgccatcaaggtggtggaggacccggcacgcgccgcggcgctggcggccgagggcgacctcatccagtcgctgagccaccccaacgtcgtcagcgtttacatggtctgcgccgcgcgggggttcgacctgggggccggagcggaggagggaggccgccccgaggcccgcgcagcagcaagggtcatcgtcatggagctctgcgaccggnnnnnnnnnnggcggaggagggaggccgccccgagccccgtgcagcagcgagggtcatcgtcatggagctctgcgaccggggttccctccaggactgcgtgcgggtggggggctgcggactctggggcgccgacgccgcacagccgaacgaggtcagtttgtgtatggaggggtagagaggatgccgagtgcctgcaagaggcactccccatcggcgnnnnnnnnnngtggaggggtagagaggatgccgaggtagagtgctgccatggtacaaggggggttggggagggggggggtgttcagagggtgggcgcacgtcggtccaaggatgttacgaatgtagtgcctgcaagaggcactccccatcggcggccagtacgatcccctcgaccccgaccccccacatctcccgcccgcacaggaggcgctgctgcgactcttcatcgatgtggcgacggccctcgactacctgcactccagcgggcccatgaatcgatgtccatggtgtgggcgtggggatcagaaaaaccttcagaatgcgtcttgactgtctgtcgtcttgacatggttcggcccgggggttggaagctgctggcccgaccctcgcaggacccaccagcggcaccatga

SEQ ID NO: 175 - DNA, 1206 bp, Chlorella protothecoides
atgttgagtaattgccctggtacacacattggctcatcatccagcgcgtcgggttttccctttcttgactctgctacccccctctccccgacaaacaccgcaggcctgaagacgtaccccacctacgccatgggcggcggctacgtgctgagcggcgaggtggcgcgcctgctggtggacacccacgagcgcatgtccctcaagttcacgcccatcgaggacgcgacggttgggttctgggtgtcggccatggacctgcgccagatcgaccacccgcgcttctacacctgggcagcgccctgctgcttcaaggcccccgtgcgaaaggccgggcggcgcgtggtcacccgctttgcgctggacccggagtttgagcgcggcctctgctccgacgacccctggctcatcctgcacaagatcgactcgcccaccaagatgcggcacgtgggggcgcgcgctgccaactgcacgcgccccgtggacggcctggcggcctccatcaaggagcactacccccccgcggcgcagggtgagggcttgggggatggatggaggggaggttgcagggaaggaggaggaactgcaatggggggggtgacagggaggaagagaggccgaccgagacacccctccccgcatctcttcgccgcagaggagatcgagaggaggcagagggccgcgcagcagattgccgctctggagggcagcatcgaggacgaggcggtggaggacagcgccgatgtcgggcaggcggacggggagggggggcgggaggccgcgctgaggcacctgcgagagaggagcgcgcgacggcagcgcgagtcgcgggacgacgcgcagtcagagcgtgaccgcgccagagccagcggcgtggaggcggtcgccaggatggtggcggcgcgcagggccgcggaaggtgccgggcaggtggtcggcggagcagcaggcgaggcggagggcgccggtgccacggacgagcaggcggcgggcggcatcggggtcaacctggctgccgccggcgggggcgggggagccaccgtcgacgaggtggcggccgaggacgccagcgccgccgacgccgtggcggcggatgccggcaagggcaaaggcgcgggcgtggcagtgcagctggtcggggggggcgagggccatgcggccgtcaacggccaaggtggcgacgcgtcgcagggcatggcggcagcgtaa

SEQ ID NO: 176 - DNA, 1560 bp, Chlorella protothecoides
atgcctcgaggaccatcttacaatgatgtgcaccccccaaagcctcagtgcaccttcactcccacccctttccccttctccccctctcgccaggcgaggcaggagccgtctggcggtcccaccgcctccgcaccctggagtctcgcctgcagggcctggacctcggggatgagcaggcagccgaggtggtcgccctgctgcagcgtgttcgggaggaaaccgcagtgctggacgccatgtggcaagcccagcgcgcgccagactaccagccccgctggtggcaggatggcgagctggaccgggagcgtgccgacaggtgctgccgcgtttggtcccggcaggacatggacgggctgtgcgctgagcgtgtgcgctgatggcttgtgccaccaaggtgcagccctgcacaacgacgccggcacggccgccctcgccgccggaaacccgggccccgccttcgaggagttcacgcaggcaatacgcctctggccctcgtcccccgcctaccactccaaccgggcggcagccgccctgaagctggccaggtttggggtggcggccgaggacgcccgggacgcgctgaggctcgaccccggcagcgcgcgcgccgcgctgcgcctggcaaaggcccaagcaggatcacgggacccggccgcggcggtggaggcttactcgctggccctgcagctggcggagatggggagccccgaggggtcgaccgcccgcgcggcgaggcggggcctggccgccgcacgggcggccctggaaagcgcggacgcggggcgggtcagggaccgcgcggaggcgcggcgtggcctgcgcgccggcatcccccgccggccgctcgaccctgaggcggccgccgcggcgctggagtcagcgcgggccgtggtgggggcgaatcccggctcccacgctgcgcacgctgcgctggccgaggcggccatcgcctgcggccgttgggaggacgccggggcggccgtcgccggcatgcacccggggctggacgccgactacctgcaggctgaggtggcgtggcggcgcggggatgtggcctctgccctgaccctgttgggccagggcggccagagtgggacggcggcagtgccggatgacgcgagtgatgggtcgaggagggccgcagggcacgaggccatggcagaaggctccagatctgcagcggagcgagggagcgtgatcgacggtcaagatgtcacggagcctgggagccctgagcagccggcacgcacgcccgggcccccgcccctcccggataaaatgaaggacctggcggcgttcctggcccccatctcagtcctgctggcagccgcagacgcggccgaggaggaggaaatccaggaggacgttgcggacgcatgcggcgccgcgctcgaccacttgctggcatgcgcgggggacgggttgcgcgcggtgctgcatgcccggcgcggcgcggcgcgcgcggcgcgcaactcgttggattccgccctggaggacgcccgggccgcgctccggctagcccccgggctggcgccggcgctggcgctgcaggcccggctg

SEQ ID NO: 177 - DNA, 222 bp, Chlorella protothecoides
atgcccgccctgcagatcatggccggcgtggcacatgaaggcacgcgcccgccgctccccgccgacatgcccccggccctctcgtccctggtctgggactgctgggtcgcggaccctgccgcccgccccgactccctccagatcctgcgacggctcagggcccagctggcctcgctcggcgcggacctgggccgcccccgacactccctgccccacgtgtga

SEQ ID NO: 178 - DNA, 816 bp, Chlorella protothecoides
atgaagccgaggcgaaacggctccccgcgacccggctggcaccggtatggcctcgcagcctggttgcccaccatcttcatggcgctgaccatgctcgtcatgttccacaggagccggatggtgggcatgggccaatggcagccaacggacccctcgcccagggggacgctggaggtcctgtcctccacgctgccattcggggagccggagccggatcgtgagccaacggacccctcggccagagggacgctggaggtcccgtcctccacgctgcccttcgaagagccggagccggatcgtgaggtggaggttgtcgagggggagacccctcggcccagcgtggcggagcccctcttcctcttcatcggcatcctgtcggggcgggggtaccggcatcgacgcctggcggtgcgggatgcctggtccagtaatgccaccaggcacggcgcggtggtggccaaattcgtgctgtcggaggacgagcgcacaccccaggtggagaaggaggtggacagcttccaggacatcatctttgtggggcaacgcacgaactacaagagcatcctctacaagacctaccacgtgctggagtatgccgtgcgacactacgacgttaagtttgtgctgaagacggacgatgatgcgttcatctatgtggcgcccctggtggcgcagctgcgggccctctgcgagcaccccgactgcgagggcgagcgcatctacatgggccgcatggcgcaccactcggaggtcctgctgcagcaggggcacaagtggaataacgacatcttttacaaccacaccggtgggtggtag

SEQ ID NO: 179 - DNA, 198 bp, Chlorella protothecoides
atgcggatggtcgtcaacgtcacgccacgctatgcaaagatgtttgcccccggctccaaaaaggacgtgattgggtgggagaacatcgagctcatctccgacaggcccttcgagaccatgctggaggagtttaagcgactaaaggccgagttcccagacaggtcggggctgaattttgttccttgggtggtggcatga

SEQ ID NO: 180 - DNA, 234 bp, Chlorella protothecoides
atgtggccagcaaagctcctcgtcctgtctacgcttggcccccacagggtgctcatcgccagcatcatggaggaggtcaaccgtgcctcctgggaggagatcgtggagcggtgccaggaggcgggtgccgacgcattcgagatcaacttcaggtgcggggggggatgggatggtgcactgtgccgcatcaggaaccgtgaaggtggcgactcgagttttgacatctccgcttag

SEQ ID NO: 181 - DNA, 1122 bp, Chlorella protothecoides
atgatccccccttcaaaacatatgcactcgcaggccctgcacgcccgcctgcagcccctgctgctcttctacatcgacgccgccagcatgatcgatcaggaggacgacagctgggacctgatcctggccctcgccgagaccccgggcggccagcgcgtggtgagacgcggcggggtttgcaacgctctactccttctttggctggccggacagcaaacgcatgcgcctgagccaggtgttcgtgatccctgctttccagaagcgaggggtggggcgggccctgctggccgccgccacggtccacgcccaggcggccggagcgctggacatgacggtgcggctggtctcgtggtaccccctggcatgctcgtccggctgggactgggctctgacgccgaggggtggcaaggggagctgcaagtcccgataccctgcattctgtttgcccgacatgttggccgcagcgatgaggcccatggttctgtgccaggctgctgcctgcagcgagttcctgtgttcagctgcgtcccgtggctgggatcccttcaacgcacattccatgcccatcatcctcccacctcacagtgcgaggacccgaccgaggacctgcagcgcctgcgtgaccggttggacgtgcagcgtgcacggcatgcaccgtggctgctggaagcggccaggagggtgtctggtctcgcacctggggccacaacagccttggaaggcaagggtgaagtcggcgaagggcaggcagccttccacaccaccatccccgccgacataaccaagcgcgcgcgtcaggagctgtgcctctgcaagcagcaggcgcagcgggtctgggaggtgctgctctacgagttcctgcgtgatgccaaggggcaagacggggcagaccgagccatgcagcaagccatccggcagaaactgtcgaccgccatctctgcggccgagaccggctcgaaaggtgaggctcctagctgtgccacacacattgctccccgccaccctccgccgcaggcaaggtcacgcaggaaacggagtccggcttcatcctgcacaagcggcggcggcgagacgcagggcctggcgtcggtgggaggccaggaaacccatgcgtacccgtag

SEQ ID NO: 182 - DNA, 504 bp, Chlorella protothecoides
atgcccgagcgccgcatgggcatggctatgggccaggacccggacctcctctccgaggtctgctcctgggttaacgccaaggccacggtgccagtctgggccaagatgacgcccaatatcaccgacatcgcggtacccgcggccgccgccctgcgtgcggggtgcgagggagtgtccgccatcaacaccatcaccagcgtcatgggcgtggacctggccacgctgcgcccgcagcccagcgtgcagggccacacgacgccgggcggctattcctacaccgccgtcaagcccatcgccctggccaaggggttgggcaaacgtccgtccagcacggcctctgtggacgccgcggagctgggtcccttcgagagggtaacgtttcgaccgcctgtacgtcccgtcccaccccctctgctcataggtcatgtccatcgccaaggccatcgcggcggaccacccgggcgcctcgctgtcgggcctgggcggggtggccacgggaagtga

SEQ ID NO: 183 - DNA, 627 bp, Chlorella protothecoides
  modified_base (20)..(29): a, c, t, g, unknown or other
atgtgggtcgacatgctttnnnnnnnnnnctcgcgcgccgtgctcagcggcatcccctacggtgagcttcctgctgttgtggagcggggctgggaggccgtcggttctgcgacgggggatgcctggctgagagtgtggcgaaccgacgctggggctgcgtcgtatcttggcgcccgcgttccgcttgaatcggtggtggcgaggcgcggggccgccgccgttcgccgtgaattgctggtgggcttggaccccgtagcggcctttgtccggcggctacaggcgcgcctggaccccgtggccgtggtcctggccgatttgacaccgggggcgggcgtggtggggctcaaatggcgcgccccggccctgcaggccgccgcctgccccgtggcagcggcgcaggaggcgggcgaggccgcgtccggcgggcgggacgcggaggcccgcgcgctgggcgcgctgtgcgacgcgctgttcctgggcgccggcctcgtgcggcgggtggaggtcgtggagcgcgtcctggtggtgacgggcggtgagaatggggtaaactgccgcaccctagaggaggcgcagggagccccgatcgccaaacggcccaagaccacgaacgggcacagggactag

SEQ ID NO: 184 - DNA, 1182 bp, Chlorella protothecoides
  modified_base (273)..(282): a, c, t, g, unknown or other
  modified_base (587)..(596): a, c, t, g, unknown or other
atgcgtgaggcggagcgcgcggagcgtggcgccgcacaccagggcgccgaggaggagagcgcggaggaggaccccgaccaggcgctgctcgtctcgcaccagggcttcgtgggcgggctggccgcggagcacccggccttcacgcccgccgtgcgcctggccaaggcctgggtggcacggcacctgctcagcaaccacctgggcgaggaggcggtggagctgctggtggccgcggccttcgtcggccccatgcgtcccatggaaggtaggctnnnnnnnnnntgctggtggccgcggccttcgtcggccccacgcgccccatggaaggatgcatggtgggcagcctctggcacgggatccctgtcgtcagcctctcccctggtgacccgggactggtacctgccagactcgtctgcaccctccctgcggactgcactcgctgactcgagcgtccgcgcccccctcccctcattccaggcacgcccgcctcccggctgtccggcttcctctccttcctgcacatcctgtcggagcacccgtggggtgtcgccccgctggcggtggtggcgctggggcccgggggacgnnnnnnnnnncctctccttcctgcacatcctgtcggagcatccgtggagcgtcgccccgctggcggtggtagcgctggggccagggggacacctccccgccgcctgccgctcgccggcgcacccgctcagcctgctggtgctcgatggggaagcggccgtgcacagcccttggaccgcgcaccggcccagtgcccccgtggtgcggcggctgggcgtgctggcgcggcgcgcgcgcgccgcgctgcacgcctccctggtgcgcggcgaggcgggcgtcgacgcctgcgccgccgtcttctcgcgcgagctgcacgagtgcgacgccctgctgcgcctgcgccccgacgcgctgcccgcgccaggtggcggcctggagggggcggaggagcgggagagcccggccgggtctgcaaccacccgcaccgtcctggaggctgagtgcgcggcgttgaggacgcgcgcctcgcgcgccgtgctcagcggcatcccctatggtgagcttcctgctgttgtggggcggtgctgggaggccgtcggttctgtgacgggggatacttggcagagagtgtggcgaaccgacgctggggctgcgtag

SEQ ID NO: 185 - DNA, 1479 bp, Chlorella protothecoides
atgccctccaaactctgcatgatacgctcaccaataagcgccaccagcgcaactggaacacggcgctggagcaggtgtggcccgagaagggtggctccgggtcgggccaccggtcttctgatgtgggaagccctctgtgtggctggcttttcagcatctcatgaagggctgggatattatgttgagactccgtcgtctaatgcaccccgccgatgttggaactcccagctttggtgttcattctggggatgccttccaaggtctcaccaccgcccccctccttcaacccctccccatcatcaggtcatgctcaagcacatcgacctgtgcgtggagaccaagtcggggcgcaagtgcaaggatgcgctgatcaactaccgcaacacggtgcagggcatgaacgtggggtccctggagctggtcatcgaccacctcatcaccaccgccagcgcccgggctgaacaggcacagcaggccgcacaggtgagggcctgtgtggggtggggtggggggcaggggggtagcggtggggtcgatgtgtggaagcgggggactgcaatgccgagtgcaagcaaccctttccataaaggcacctacccctcccccccattcccaggccaagctggaggacattgccgacctggaggcggatgcctcgcccgaggagatgatgctgagctacgtgtcgggcgagaagtcggcggaccgcacggaccgcgaactggtcacgccctggttcaagttcctgtgggagacctaccgcaacgtgctggacgtgctgcgcaacaactcgcggctggaggcgctctacgcctcgggcgcggaccgcgcctttgccttctgcctggcacacaagcgctccaccgagttccggcgcctgtgcgacatcctgcgcaaccacctgtccaacctgctcaagtgagacagagtgggggtgcttgggggtggggggtgggggaagagtttggggaacgtaagcgttgggaatggggcgcagagcgtgccccgccggggcctgatgttgtgtgccagcgcctgcctgataccaacctcccccatggccagcagcaccgcaccgacctgtccaattccacttcctgggagctgtacatggacatgcgtttcgagcagctgcgcgccgcctgcgagctggagctgtgggccgaggccttccgcagcgtggaggacatccagggcctgctggcgctggcacccaagggcgcggcccgcccccgcgccgcgcgcatggccacctactacgcgcgcctgacccagatcttcacccgctccggcgcgcgactgtacaacgctgcggcctgggcgcgcctggccgccttctcgcgcgcgcacgggcgcctggcggcgcccgaggacgccgccgcgctggctgccaacgtcgtgctctccgcgctggcggtcatgccctacgacgaggccggggccggcgtgtccggtgcgggagccatggcctcccccgac

SEQ ID NO: 186 - DNA, 1242 bp, Chlorella protothecoides
  modified_base (293)..(302): a, c, t, g, unknown or other
atgcatcgcttgcttggcatcgtgccatgctgtgcatgtgttgcctgggtttgcaacgactccacagtgatgcacagccagggtgcctgtctcaagggagggaggctggtcaaggcgcgccacacctgcccccttgcagcactttttcgtggatgtggacatgaaggaggtccttgtccccgtgccggagtccgacctgcacgcgggggtgggcaccaaagccgtgtctacgccacacacttgcccatctccaattcccctggcacatgccacccctgcagtggtggtgacgnnnnnnnnnntggtcgaccctggcgcaggccggggcttgaggcagtctgggtgctattgattcttgcagtgcttttggcagtcaagtttacgccacacacttgcccatcttcaattccccttgcacatgccacccctgcagtggtggtgacgctcggtccatcctgccagtcggtggacgtcctcgtcgagctgctggcagccggcatgacctgcgcgcgtgtcgacctcaccgtgcgtccatgtgttggtggcttggcttttcctgctgccctactcctccgtcccgtgttggcgccgtgggaggagctgcatcgtcctccccaggcttggggacccgccaccttccaccaggtgtccctggagaatctagcaaaggccatgcatgtcaccggccgcctgtgctgcgtgtggctcgacaccacgggaagggagatcaccgtgcggcgccccgccgagaccactgaggacgggtggctgcaccacggcacccccatcgagatcaagaagggccaggtgggcagtggggatgcaggacgggttggtgggggcgctgctcagcttctgaacgccggtgcctttcgaatatggaggcatggagaggggccgtgcgcgatgcttcactcccgaagacctcgtccctcttcttcccgttcacgaccctctacgcccgccgcgtcctgcctccccatagagcgtcacgctgacacccaaggacgtaccggcgagcgagaccatgctgcccataacgtaccctggctttgcagacgccctggacattgggcagactgtggtggtgggttggaaggagtcggagcatgggtgcagggggggggcgtggtgggaatggaccattcggttggctgcaagagtgggcaccaggcacccatgatgggggcgatgcaggcagcgtccccttcccaacaccaccataggtggggcgttacctga

SEQ ID NO: 187 - DNA, 435 bp, Chlorella protothecoides
atggttgttggagcctcagcattcagacgaccgggctgtttggccggctggattggcggtagtaaacgtccgtgcatctcccacttcacgccgtcccccacatccaaatcaatccaaaatccacctcccctgtcccttgcccaggtgacagagaagcaggacctggacatcgtgaccatcgcccagaccgacgccagcctggacggcctgctgacggtgatggccgcccaccccaacgaggccaacgacgccgcctttgacatggccatccccatcatgacccagcatgacgcaaactgcatcaagaagtttggcaaggtgggtggggaccgtgagggactgcagggccagagagcggatgaggtgtggaaccctgtaggccatctcggattgggagggctcatccttcagcctggcctgacaaggcagttgtga

SEQ ID NO: 188 - DNA, 1728 bp, Chlorella protothecoides
atgccctgcaaacagagactgagtgggatccacaggtatcaaagtgtatttgccccacctgctcggtgttcggcacgtgagtgtttcttggatttgctccatgcttataaaccccttccaactcaggagtatgagatcgactacatctcgctgtcctactgctcatctgtggaggatctgacagagtgccgcgcttttctggatgcgctgggcatgttccagaccaagatcattgctaaggtgggaatcaagggggaacaaggatcaggggtaaatgcttcgggttgtggtttcactggcagcacatccatgccgacttggacggacagcacacttagcctggtgctggatctgtcgtccagcccccaggaccaaccccttatttccacaccagtcaagctcacgctcaccctttctccaaaccctacccgggcccaggtggagcgcaagcccgcggttcgaaactttgatgccatctgcctggccgcagacggcgtgctgatctcccgcggcaacctgggtctcgactatgacgcagaggtattgcccggcatagcttttacgaggaacgactcccgcatgagcaggcttgtgccacacatccatccaccccgcgcgcgcatggcacggaccctccatgtctcccttcgtccccctccccgccccgcagctgatgtccctgctccagaagcggctggtggggcgctgcaacctgctgggcaagcccgtcatcgtgacccgcttcgtggacaccatggtcaacacgccgcgccccacccgcgcggaggccacggatgttgccaacgcggtgctggacggtgtggatggcgtgctcctgggcgccgagacactgcggggccagtaccccgtgctgacggtgcagacagtgggagtgagtttatagaagagcagctgagggcacagctgggttggggggccccgccctcctcccctacccttcccaatccggggaatgttgccaagcacccttgaggggctgtcgctgagccacccgtcggcctcggaggccgacatcccggggtcgtacgccggcctgccctcctccgcctccctgctgggcatgtccgagccggtggtcagcgtcggctccgtcgggcagcccaccgcccgcgccgggtctcgcccgggccgtgcgcggctgactgcgcagccgtcgagcctgacgctggccacaggggtctcacaggctcccaccggcgccggcccgatgtgggcggacggcggctcgccgccgcacccggcgtcggggctgggcggctcgcccacggcgcacaccgtgtccgcctttggcagcgtgccgtcacgcatcgtgcagcggggtccgcgccccggccgcgatgcggcctacctgcaaaagctggagagcgtggccagcaacgccacgcgcaccgcggagaagatcgcggcggggctgatcgtggtgctgacggcctcggggcggaccatcagcctggtggccaagttccggccgcccatgccggtgatggcggtggtggtgcccaccctgaagtcggacaggctgcgctggaggctggagggcaagttcctggcgcggcagtgcctcaccatgcgaggtggggcagttggggatttgggtttggggggaggcatagggaaggagtggtgtttggggggggggagggattcttggaggatttgcaacgaggaatggcaggggggattggaatgctggagaggcggaaataa

SEQ ID NO: 189 - DNA, 210 bp, Chlorella protothecoides
atgcttgcggcgcccatgagctccggctcggacgatctgctgtctgaggccatcggcctggccgctgaaaacggtctctgcaagcccctggactatgtggtcgtcatcaccacagagcggggggccctggtggtcaagatcgtgcgggtggggcaggggccgtggtgtgggggacaggagcttggagaaaaagtggacgcactgttatga

SEQ ID NO: 190 - DNA, 1362 bp, Chlorella protothecoides
atgcagaccacatcccctcgtgccaaggcccggcctagcaaagcctgtcatgcctggacatgcaactcttccagcgtgcagcccctcaacgccagtaacttgcctggcatggacatgcccatgttgatgctgatgggccgggtgggcgctgtagggaagaccatcttgatgtgtggcaggtgtggtggtgcaaagcagagcactcgcacccagtggtgcatgtcagtcctccaagggcgctgggtccacagagctctgtcgccttccacgaacccacttgggccgccccctccccattacaccaccctcgccatcccctcacctgtatctcccagtccatgcagcatgatcagggtcgccgagtggcgaccagccgcaggctgcgtgatcaagggtccgaacacgcgcgctgccatgtcggcagggtttttgaggctggggctgatgaggaaagcagcaaagtgtgtgaagacaggaaataatagaagtacgacgcacgggaagagtagattcggtctcacaaacggcatgccaatacactcttccagggtcagggcatgtactgtgatggaccccatcatgagtgccttaacgcatgccaaagacgagcatgctgtgagctaccggatattggaaggtcttgataagatctgccctttgtgctgcttgattgacgcgtggagagtaagaaagcacgcgggcgttaagcatgcggaagccaccggacacccgggtccgatgccggtgtcggtggacctcatgaggccgccctccgatgcgtgtcggaacacagtctctgaataccaagtcaatccaggtttctctacaatgtcttcgtcaccctttgaggctgcggccagccccgggggtcgtgtcgtgatccccgccccggcggtgacccctccccccttcccctcggaggtgcgcgagcccctgctcaccccccgcatcagctcctaccgctcccagtccatgcagcctcccagctcatgggaggcggggacgcacatggtgaaatccatcctgggggtggcgctgctggccttgccccgcgtgttctccatgctggggatcggggcgggctccatctgcctggcggcagtcgccctgctggcctacgcctccctgcacgccctggcgaaggcgtcggcccgcacgggggtcatgaacatgtcggttctggccagggaggagctgggggtgaccggccaggcggtgctggacatggcactcatcttcaactgctttggtgcgtggggccgagcaaggaggggggccaagggtgagcagtctgctctgcatgcgtcctcctcctgcctggattgttgttgcccatggatgcactcgagaaaagaggtctga

SEQ ID NO: 191 - DNA, 777 bp, Chlorella protothecoides
  modified_base (274)..(283): a, c, t, g, unknown or other
atggaccatgcatggcctggtccctccattctcatccactcttcccccaccccgcaggtggcccaaggggcatgcgctgatcgggcacggcttcaagtctgcggtggagctgacctccctgctctccatcatgctggtcgcctacacttgccactggaccctgcagcactccgtgcgtgtttgggggccgaggtggtgggatgcaacaacaccctctcaatgcctgctgagcagcgactacttgaggtggtcaacgcccacggctggtactgtnnnnnnnnnngccgaggtggcgggatccaacaacaccctctcaatgcctgccgagcagcgactactcgaggtggtcaacgcccacggctggtactgttggtatcccctcgtcgctctgtgcacaccagttcaaccgttaacactccacccttccccttgtcacagatgcagagcgcaagctccgtgagggagcgccaggcacagggcgtgtcggccggcgccatcgcggccagcacggccaccttcctcctcatctccatctgctcctacggcgtctttggcaacgccacatccgctgatgtcatcaacaactactcggtggagacgctgtccaagctgctcatccctgagctggctcaagcaggtagacagagaggtccatgctgccagcattttgggggtccgaggctgttggatgagaatcgtctgaccgctggtgtggcgtcgaggagtactcaggttcatgagactgtaaatccacacaacctcgtgagacctttgtaa

SEQ ID NO: 192 - DNA, 207 bp, Chlorella protothecoides
atgcagcacagcagctgccccgaggagatgtcggactttgccgccttcctgaaacgcgtggtcccggatgcgcctccctcgctgtctgatctgcagggcttctctgtgaagcagctcaagcagctgctgagctcccagggcatctcgattaagggcatgtttgagaagcaggaattgctggaggcggcgtccaggctcgcaaagtga

SEQ ID NO: 193 - DNA, 306 bp, Chlorella protothecoides
atgggaggcaaggcactagacccggagggcatcgcagagtccatcaagtatgtggatgacctgattgcggccgaggtggcagcaggcacccccaccgaccgcattgttctcggcggctttagccagggcgggcacatcgccctcaaggccttcctgcggcacgagccagcgctggccggctgcgcggcgctttccacctggctggagccctccaagatgccggtggggagagaggtggggggggagaggatatggcacagccaagggtttcctgtgtttaggaatggggtcccatgcgcctactag

SEQ ID NO: 194 - DNA, 729 bp, Chlorella protothecoides
accccccctccccctccaccaccaccacgccgacagggtcacgtcgtggcaatgaccggagacggggttaacgatgcccctgcgctgcggcgggccgacattgggatcgccatgggctccggcaccgccgtcgccaagcacgcagccgacatggtgagggcagaggggggccacatggcagtagtgccctccagggttggcgtcacaaaggcaggtcgctgcctcctcgtcctggcagacgacaactttgccaccatcgtgtcggcagtggcggcggggcgggccatctttgccaacaccaagcagttcatccggtacatgatctcctccaatatcggggaggtggtggccatcttctcggccgccctggtcggcatcccggagtgcctcaatccggtccaggtgcatgttggggggggcaggcaaattaacatgactcacaggaaggctatttgcgcagaatacacctgcacccagggctgttggatggggatttcgcatgaggctctgacactgcgtggaagctccccggaatatgcaagccaggtgcatccactctgtctcccgctcacaagcgcactcagacctctctcatatctccctcacccgccagctgctctgggtgaacctggtgacagatggactgccggccacggccattggcttcaacaagccagacccactgatcatgcagcagcgacccagaagggccagccaagggatcgttga

SEQ ID NO: 195 - DNA, 486 bp, Chlorella protothecoides
atggacctgagggtgctgcacacagctgctcacctctccacctggtacgggcagtttggctttgactttgggcgtggggcctacaacatcaccagggaacaggtgcgaatattttgggctgggttgggagcagcaaggctgagcatctgtcatgtgggcgtagggcttcaccgtccaatcctcacagtgggcctatgcttttcaaccctggtcgagaccttactgccatggggaacttggtacttgctgccaggatcatgcggcgtggtatggcgctcaacttcctcacacctctgtgatggcttgcagtgggcagaggcagcgcgtgctgtgcacgctgccccgctccgctctctggtagatgactttcacggcgtggacgacgcagtcgtgggtatcgtccagcgatatggggtaagacagaagggagaagatggggtccggcagatggggcccctacccagccgatgtccatggcacaagtag

SEQ ID NO: 196 - DNA, 1107 bp, Chlorella protothecoides
atggcgggggcagtgagcccaccggagaccctcgcaggcttcgaggccactgtcacgcaatggctgaagcagaacgggtcgcccgtgaccctgaccaagatgaagggcgtgtcaggatggctgttggccctgcccgagggtcccaccctgcaggtcttccgagaggaagtgactcccagcacgcccgcctgcgaccagtgccgcatcttgggtgagccctggagtcggtgtagatgtgatggtgccaccgtataccgtttcaaattgaggagcagggatgggagggctgttaccctgcctgcgcccatctgcgatgagctgaaacctgctcaggggccctcttgcatcccctgcaccaggctggggtggtcacccagtgagtcccgcacgctaccacttcatcataccagcagaggtgggatggtgggggtccaagggtgtgcagaatgggaggggacccagaccgggcctggatcactggcagaccccacctccctggcggccatcgcggcagccagcgctcgcggccgtgcgctggccctggctcagacggcgctggcctccccgccgcccgatgatcccgccgcgcagagctacacggcccctgcctcggtgtttgagtgcccccgccacgtactgcatggtatgcgggaagggagcgaatgctgctttgcatgcttgatgggatgggatgggggctctggagctaccgctcaggcagcaggcgggcaggcctcgggctgcctgtatggtgcatgggaatgggtacggtcacctcctgcgggtcaatggcgtggaggggcagggaggggcggccggctctgggccccggatctctgggaggacggtcatgctgctctggacgcagctgtgcgcccgcctcgcagccaccgccatttccacagaggacgtctccaacaaggtgcgttgcctgctgcgggaactgcgggagaaagcagggccggtgtctgcgccagctggcccggcacctggcataggagatcgaggccagggcacggggtctgcatgtctggtggatacagtgggtgcaagcaccacacctgccgcacccgactctgcaccgttaaggagaggtttaggtgttaa

SEQ ID NO: 197 - DNA, 1071 bp, Chlorella protothecoides
ctgggccacgcctggtccggcgccagcgacggccccaacctggacgtggactacgcggcggaggtggagccgcacctgggccgctgtctgggcacgggcgggttcggggtggtgcacgaggcggtgtggcgcgggcggcgcgtggcggtgaagaagctgccgcctgtgggcgccgacgcggtggcggggacggcgctgcacgccgcgctgcgccgcgaggtggagctggcctccaagttcgacagcgagcgcctcgtgcgcgtgctgggcgcgtccaccgcccgcccggagtcgctgtgcctgatcatggagctgatggagggcgggaacctggcgcagcgcatccacgaccgccacaagcggcgcctggggtacctggagatcctgcaggtcgcgcacgacgtcgcctgcggcctcgcctacctccaccccgccgtggtgcaccgcgacctcaagccccagaacatcctgctggacgccgacggccgcgccaagctggccgactttggcatctcccgcgtcaaggaccccaccaagtcctacctgtcccaggtgaccaacgacaacggcacgcccatctacatggcaccggagcagctcaactctgacgccatcaacgagaaggtggacgtgtacgcgctgggggtcatcctgaacgagtgctacaccaggcgacagccttggcgcgagacatccaacctcttccagatcatcgtccgcgtcgccatcaacaaggagcgccccgccctggacccgggatgcccggagcccctgcgctggctcatcacaaagtgctggcagcaggagcccacgctgcggccctcctgtgccgagctggcccgcatcaccgaactcatgttgcaggtgtgggggggggctggggggggctcatggacagggagggctgagatggggggaggacgggaggggaaagcaagcgtgtgcgggagggggcgccagagcacgcaggccctgctgccgccatggcctggcgccgtgaagggtgtgggacaaaactggatgattactgcaaggggaagcctgtcgcaatggcaagcagtgcatcaatga

SEQ ID NO: 198 - DNA, 1323 bp, Chlorella protothecoides
  modified_base (211)..(220): a, c, t, g, unknown or other
  modified_base (1114)..(1123): a, c, t, g, unknown or other
atgcaggtgccgctagggttaatcggcacttgcaggttcgcggatcacacacacgtgccccttcctttcggaaacttcacaggctccgcactctcagcagatccgggccccttcacagcgtcgaggaagacagtgaccacaccttttgaaagcctcgacctgagacgatgcccttgggcagctgtccaacaacatcatgtctccacgggtnnnnnnnnnnaggtgccgctagggttaatcggcacttgcaagttcgcggatcacacacgtgtgccccttcctttcggaaacttcacaggccccgcactctcagcagatccaggccccttcacagcgtcgaggaagacagtgaccacacctttcgaaagcctcgacctgagacgatgcccctgggcagctgcccaacaacaacatgtctccacgagagtggacacaggagcggcaccctgccctggccatgcatcaacggcctgcacctcacggcatgggaaggagccccccggcaccctccactcccctgccacactggccgccgatgccctccgacgctggcaaggacggcagtggacggtgtatcgcggccaggcgtacgacctggcaccctggttcggccgtcacccgggcggcggctggctggcgaggctggccgtccacagggactgcaccgccctgctagagtccaaccacgtccgcgtggacagggcggcggcggccctggggtccctgccccgcctgcccgacttcccggcctgggccgtgccggtgacgccccgcccgcttgattccccctttctttccgccgtgcgggctcgtgtgcggtgcgaggtgcttcagcccctcggggcagaggcggcggggggcggcccgggcccaggccggtccctctttcttcccggggcggaagagagcctcgtggcagcgggtgcggcgctgctggccgcggccggcgcctacgcctggcactgccgcgcctgctcgctggcctccggctgcctgctgggcatggcgggggcctgggtgggcacggcggtgcagcacggcggcaaccacggctccatgagccaacgtcccgggatcaacctggcggcgggggcggcggcagacctcatcggcnnnnnnnnnntgctgggcatggcgggggcctgggtgggcatggcggtgcagcacggcgggaaccacggctccatgagccgacgccccgggatcaacctggccgcgggggcggcggcagacctcatcggtggcgcctccgtcgcctggaggtccgtcgagggtggcggcctggccctgccctgcgggccaggcatggggcggcgtggatga

SEQ ID NO: 199 - DNA, 1905 bp, Chlorella protothecoides
atggtgattgtggtggacgtgacccaggcctggaacgacgcgtgggtggaggccggggacgaggatgagacctggctgtacggcctgctggccgccacgctgggcgcgctgggtggctgcgtagccctggccgccctctgcttccacttcttcgcccccgccagccaggactgctccctgaacctgaccctgatcagcctgaccctggtcctggtggtggtcatggcgctgaccagcttccaccccgcggtggaggcgggcagcctcttccccgccgccgccgtcggcctgtacgtgtcctacatgggctacagcgcgctgcagtcggagccgcgcgactacgcctgcaacggcctgggcgcgcgcctgggtgcggcgagcggcgccacgctggcggggggcatgctgctcacgctcctctccgtcgtctactccgccttccgcgccgggtccaacacgcagacctttgcaggggcctgggccgggggaaacggcgcgggcgccgagccgctgctcgccggcgatgccgagctcacctccgcgggcctcgatggcgtggcgccggccgccccgcgcggcatggaccgcggcggcgccggggagggcgcggcgctgccggcccgcgcgcaggaggaggacgcgccggtgccctactgctacgcccagttctatgccgtctttgcgctggcctccatgtacatcgctatgctcatgacgggctggggcgcgaccggccagcccaaggcgagtgatgcggcggctgggtgttcagtggggtcggggggtggcggattggtgtggctgttcgtgggtgatgggagtggaatggcggtgatgggagggtgggaggtcaggagaatcggggatgaattcgtgctcagtgcgagaaggcatcgtgccggcctcgcggtgggttcagccaggctctgctgggggcctgtgatgtgcgaggttggacgagacagaaactgcgatgtctccagccggcccgcgccttcctcagccttcctccgcccgcatgccgctgaccccgctgctgctgtctcttgggctccttcaccccagccaccactatcctgggtcccctttcccttgcaaaccccgctttcaaacgtatgccatgatcacgactcacactcatgctccccccccactcacaggatgccgtggacgtgggctggacatcggtgtgggtcaagatcgtcacgcagtgggtggcggcagcgctctactgctggacgctcctggccccctccctctttccagaccgggtctttggctgatgctgaacgtgtggcatgccttgggaagcggcgccgaggcatgtcccggtctgcttgtggctggtggaaaggcccccccattactcccccaattcttggctgtacctcccctcgtcgcagcgcatcagaggggggccggtgtgtgtctgtgtcgcccaaggacccagagggcatgaccaaaaggccagcctgcactcacgcgcccagccatggaggcaaggaaggacaccgccgctgcgactcagctgcactgccagtccgctcagaagcggtcctggcccgcgccgtagctctcctcgaagttaatctccccgcccacgcccctgcccgacagcgcggggggcgtgtagcctgtgtcggcggtgcacagcgctcgagtgagagtgtgcgccggcgcgggggagggccctggcatcctcaagccacagcgatggggcgccctgtgagattcaggacacacggccaccgcccagccataccttacggttgcattcattgtcccgcccatgatctcatccctgggtggtgcccttccccccccccctccccccccaccccttaccccgcacactcacccgagtacccgtcggtcctggggccgccgaagccgccacccccctgg

SEQ ID NO: 200 - DNA, 1533 bp, Chlorella protothecoides
atgggagacgggtggtcctcgcagagcgagactgccagggtgcaggttgacagtgcaatgagccgtggtggagctgggtgtcgcgccgatcgctcgtgcgcttcacccccatcatcaccagcgccaggctgccgaagaggagctggaagggaggagcagggtgaggaggcattgtcagacgtattttataaccgttacactggctcaaaagtatccctgacggtagcaaggggctggtgcaccgcaagtggcgccaaggagactaggaatttcctcaccaggttccccaggctgatgcggtacacggcctgggccccgaaccactcatccgaaggcatggagcccttgttgaaggacttgacgatccctgcgagcggtgggggcatgggggtgctcagggattgggaccttgccccccttgggctttgccacgcgcagctcctgcaccaccctcccctcaacgcttctccccatcgttctcctcgtacatgggatcttcatgagcaggggcttggcaaagtcgcgcaggatccatgccaggatcatggacagcgtgaagaggaagctccaggccagcctcgcgctccgcaccatggcctccctcgacgcgcaggtgcacaccgtgcaagcgcatgccgcggcagtgctggctacgcaggagctcagcgatccgatgaggaacatgaggcgcagagtcccgttccgcgacgcctgcagaggcgacccctcgagaccaagggaggggagggactctccgctttgactaccgaggaatcggcgggtgtggcacaggcggcacaggctgcacagccccagcatcaaaagattgcgctactaaaaatcgaaggcgagcgggggggggggttctcttctcgcgcccatcccagatcagggggtaaacttcgtggcgaaggcccaggcgttgtttgcgccggggtcggcaaggtggtcgttcaggttctggatggggcccttccccgttacgatggcctggatgaagaagccaaacatggagaacatggccagccgcccaccctcgccagcgggcccgccgttcacgcggtagccctccaccgcgcccatgagcagcacctggaccgccagggtggcgatgatggaccgggcgttgatcaggccggggacgcccaggtactggaggccgtcgggggagaagatctgggcgccggccttgaaccaggggacgtggttggtgccgtccaggagctcggggacgacgcagcccagcgcgcccagcagggcccagcgggcgtggatcacctcgatctcgcggtagcgggcaaaggtctcggggtcggcggacagacctgccgtatcccagccgtagtcgcctgcggcgtgtgcgtgtgtgtgtgtgggggggggtggagggtcacaggtctggaagacgggcgactggtgcaggggcccatggtgttgatcaggtctgaggacagggtgcagggtggattgagcgctggcatgacgcccaagggaaaccaaaacacatgtcatcccggcactcggtatgcatga

SEQ ID NO: 201 - DNA, 1056 bp, Chlorella protothecoides
atgggcggctccgccggtggcgggctgcacgccatgctggcgcaggccgcctaccaggcacgcctggccggctccgcaagcttcgggtcgctggagggcggtgcgggcgcaggacccggtggcggcctgctgcgcgtccccagcgggcaggcgctgggcgcgcagtaccaccaggcggggccgggcgacgccggcgcgaggtaccaccaccaggccggcgccggtggtgacgcctttggctcctacggccacgggttggacgcgctgggcggtggcgcatacgcgcccgggtactcccaggacctggcacgcaccgcctccgacgcactggccagcagctggatgggcggcggcggcggctccctgcacggcggcggctccctgcagtacggcagcgggctcttgcacggcggcggcggtggctccatgcatggcggcgccggcggctccttgcacggcggcggctcggtgcatggcggcaccagcgtgcacgccggcggctccatgcacggcggctcctccatgcagcacggcggcggggggtcgatgcatggccccgcgtcggcgcgggccggcccgcgcatcttcgtgggcaagctgaacaaggacacgagcgaggcggacgtgaaagactactttggcacctttggcttcgtcatggacgtctacctgccgcgcgaccgtgccaacaagcgcgaacatcgcggcttcggcttcgtcacctttgagactgaggccagcatccagcgcgtcgtggcacatggcgcgcaccagatcaggggggcctttgtcgccatcgacgcggccgtgcccagacaggtgtttgtgtgtgagggtgttgggggatgcagggctctgctgctagtagtcgctgtcgttgctattttatgggagggtgacgagggcgggcagggtggacgccctccagacgaggacccactgcctccgcgccaaagttcctgcatggagttgctcgccccccccaaccccccccctcccgcacacccgcacaggaggagatcctgtcgccgggcgcgcgcccggcaggcagcctga

SEQ ID NO: 202 - DNA, 645 bp, Chlorella protothecoides
atgcctgagcatgcgttaccaccccctcaccccaccccccctctcctgaccccccgcttcactgcccaccaccccaccgcgcgccagctgacggaggaggagacggagtacaaggtggatgcggtggcccacgtgctggccgaccgcgtggtgctggccttcaccgtggtcaacaccgtggcggagcaggtgctggagggtgtgagcgtggacctgggcctggaggagggctggcagctggaggccagcctgcccctggcctccgcgccgcacgacgtgccgggcaccgcttacgcggtgctgcgccggccgcccggcgcggcgctgcccgccacgcgcctgggctgcaccctgcgcttcgtggtcaaggagatcgacccggggctgggggagccggaggaggaggggtacgaggacgagtacagcctggaggacctggagctgggcctgggctgcttcgtggccggcgcgcccgcgcccgccggcttccgcgcgctctgggactcgctgccggaggacagcgagcgcgtggacgactacgcgctgggcgcgcgcgagtcgctggccgacgccgcgcgcgcgctaggcgagctcttcaacggcttcgcgcccgtcgacggctccgacgccgtgcccccgggcgcg

SEQ ID NO: 203 - DNA, 1482 bp, Chlorella protothecoides
  modified_base (718)..(863): a, c, t, g, unknown or other
  modified_base (994)..(1003): a, c, t, g, unknown or other
  modified_base (1324)..(1333): a, c, t, g, unknown or other
atgcggtcgccgctgcctgctgcccgctcgaacgacccctctcgaccccaccgtgttcaccctttccaatcttcccccccctgccagctgtcggagatcgcgcgcgaggtggagggcgcgcccgaggagctgcgcgagacgctgacggggatggacagcgcggcggcggtgcgccagcgccaccgcctggcggcacgcgaggcggtggaagaggacctgatgctgcgcgtcccactgagccgggaggagggcaaggcgcagcgcgcagcgcgccgcgcgggcctcgccggcgctgcgctgctggacgacttccgcgaggatgtggcgtcggtgctggagggcgggctgggcggcgacttccagcgccaccgcacggggcagcgctggggcggggacgcctcggccgccggcgcggcacggccgcggtcgggcgacgccgacctgccggcacgggagccgctggccaagcgccgcgccgccttcgacagcgtcgcggccaaaaaggcgcagcgcacgagcggcgagaagtcggccggcggcgagctggcgcgcacggaggacgagttctacgcctccgtcaaggcttccaagggtgagggggtgagggagcttgttctgggggtcccgggttgcaagcactgcacaggggccataatattgggcaggagggaggttgcatttgccactggggatggtttggtttgcactccaggagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggcacgagaggctgtttggcatttgccagcggcatggattgtgatggttgagaggcttggcgatcgatggacgagtgccaagcctgtgcatgccagctcgggtgtgcggctgtttggtcagtctctcnnnnnnnnnnaggggcacgagaggctgtttggcatttgcccgctgcatggattgtggtggttgagaggcttggcgatcggtggacaggagtgccaagcctgtgcatgccagttcgggtgtgcggctgcttggtcagtcccacagaatttgatcgccctgtgccacccctttgccccgtgcagccatcgagaagaatcgcgggttcaccccgcaccggcgtcgggatctcaagaacccgcgcaagaagaacaggtgtggggcccagtggcgaagcggccaccagtggcacactggatcaagttcaacgaagccactgtgcggcggaagggcnnnnnnnnnnggcaaatgccaaacagcctctcgtgcccctcaccggtggtgatcccgcgggcacccggggcctggggttcctccagcggcacttgggtgtctgggtacttgtatgcttcctttgccacacgccgtgcctccgctgcgagtcagaggtga

SEQ ID NO: 204 - DNA, 1908 bp, Chlorella protothecoides
atgacccttttggatgtcacaaaggaggagcttgattccaagagactgccgtccgactggctgcccgatgtcactccagagaggtgggcttccgactactgcgaggttcggctccacgccacccgacacagaatgagaggagtcggtcagtcaaggaaagggaaggccaatcagcaggaagtctccaggctgagtttcatgagcctgtttgtacaccagtcaacgcgagaggagaatgtgctggctttggccgagtgccggggcatctgcgtcgtggatgcgctgccgagccaaaatgccgagccgagcatgccacagcaggcggccaggaacccaccatgcaggatggtcttccacatggcgcgcgctccacccaagaggggcaagtctgcccctcgtaagggacgcgcacctcaagctgagccgccgaaggactcagatggcagcgaaagtgaagagctggcgatgcacggagaggaggatgaggtgtcggacgtggaatccatcgaggatgccgtcttcgacattgatgccgccagcgacgacgactccgaggacgaggagtttgccgccgatgagcgctacgccgcactcgcccggcaagcaaagactctggaggccaagcttcgcatcgcgcgtggcgagaaggatgagggcgagagcgggagcgatgaggaggaggaggagggtaagcacggcgaggggcgatggggcaacaagcgggcatactacgacgccgacaacattgatctggaggtgcgagccggggtggtcgttgcatggggagcgagcagcaggcgatttactctgcggaggctccttgagccgtgcatgatgctgggaggaacagtctgggatactggcgtgcaattcaaggatgccgtctgtgtggccacgagattggctgtgcaccgctgctctgcccccaacaccccccaacctgcccccctaacacgcctactgctgccaaaggggtccgaggaggaggacgcactgcaggaggaggaggaggaggcccgtcgcctgcagagcgccgcggtgtcgggcctggaccccgaggactacggcgtggcggagggaggagactctccctcctccagcgaggacggcagcgagggggagggcgccggggacgtggagttcgtcccgcgcgacatcgcgggcctgacagaggcggagcgcgccgccgcggccgcgcaggccgcgcccgagctggcgggcctcctggcggatctgcgcgggtcgctggcggaggtgcgccaccgcgtgggcccgctgctgaaggaggtgcgggagggggagctggccacggcggaaggcctgtcctacctggaggccaagcacctgctcctgcttcagtactgcattggcattgtggtgtacctgctgctgaaggcggaggggcgccaggtggcgggtcaccctgtcatcgcccgcctggtggagatcaaggcctacctggagagggtgcggcccatcgacaagcgcctgcggcaccaaatggacaagctactggccgccgccggcgctgtggccggcgcgggcccggggtcgctggcccacggcccccgccccgaggcgctgctggcggagggagacgctcccgccgccgccgccagcgagggcggcgaggagctgctggccgccgcggaggaggaggccgcggagcaggcgcgggtgggcgggacggggctgtaccgcccgccccgcctcaaccctgtgtccatggagatggaggaggggcgcgccacggagcggcaggagcggcacctggtgcacaaggcgcgtcgcgccggccgcagcacgctggtgagcagggggaaggagggctggatgtgtgatggggaggggggtgtttacgggagggtttggagctttgtggtggtttggggcgcggacgtggaatga

SEQ ID NO: 205 - DNA, 726 bp, Chlorella protothecoides
atgtccctcaaccccttcgccagcgactggacgccaggtcgaggcaaatacagtgctcccacccagtccagggacataaggagtcgttcaaagatcgatgcgaacgctgggaagcctgcagacccgtcgccgttcaccaacaccactgcatcacccatcccgatgccttcccccacgcttggccggagtcagccgtccctggatagagaaggcgagctggactttgatgtgggctttgactctatcccagaggccacaagcggacccagcaccccctctggcagccatgaggctgatgctgggggcattctgtctgttctgtcaaacacaagtggacctcaaccgcgccctcggttcccctctctcgtacagctcgtgggcccctccgcactgccctcccgctgcacgtcggtggagcccagccccggaaaggccatcagcctgctgagggccaccgaggatgtcctgcccccagagccggtggtggaaagcaccgcctatgtgtctgaagccacgactcatgccgagacgaggacctctgcccaggcatcaacatcgggcaggaagctgggaccagctgatttcgagctgctgcgagtggtgggccaaggtgcctttggcaaggtgttccaagtccggaagcgtgacacgcaggagatctttgccatgaaggtgagcactgcatgggggtgctgcctgcccgctgcagtgcccagcagtgtgtga

SEQ ID NO: 206 - DNA, 3522 bp, Chlorella protothecoides
  modified_base (813)..(822): a, c, t, g, unknown or other
  modified_base (2018)..(2027): a, c, t, g, unknown or other
  modified_base (2811)..(2820): a, c, t, g, unknown or other
  modified_base (2890)..(2899): a, c, t, g, unknown or other
  modified_base (2977)..(2986): a, c, t, g, unknown or other
atggataaactgagggagctgttggccagcaagaagaaagcagccgaagcagaatttggtggcaaaaaatacctcaagcggtctgagctcgaagagctgcgactgcggaagctgcgagaagaggaagaggcggagcgagcccgcaaggtgcgtcgtattgagcactggctgggatgggcaattgcttcttacgatacttgcggactggaattgaaatgtgatgggatcccatgcgggctgcgggcacccaatgactcccaggaggacgcctcacccgcttcggtccctgcagatgcagcaggcaaggacggcgaggcgaccgccagcacgtccaagccgaggccctcgagtcgccaggacaaggcggcagccgcaggctcccgcacaggcttacagacagacacaccccagctgacccgggaggaggtcattcgcaggctccggcgcctcaaagagccggcgaccctctttggtgagagcgacgaggctcgcgccgagcggctggctgaggcgcagcgaactttgacggtggatgacgagacggagggtggtcagcaggctaacttcaacatcgagtttgcgaggcagcaacgcgccgcgaagaaggctcggcggacgggggagggcgggactgcaggacccgaggaggccgccgcccccgccggcgccgaactcgacccagagcagcaggacccaccccttctcggcccatgtcctggtgcctctggtccctcccttgcagcgtctgctgcagcccatggtttccctactggccactgcaacccacaagtccacccattgacccctcttccnnnnnnnnnngtcctggtgcctctggccctgatggcctccttccgtgccgcggcagactcgcttgcggctaccaacctgccgctggaggaccggctggcgcgccggctgcgcagctggtgcgctgactgggaggcggacctggaggctcggtccgaggaggaccaggccagccccgccggctatcaggccacgctccggtaccgcgagaccgtgcagtacctgcgccccctgtttgcgcgcctgcgcaaccgcagcctggagccggagatgctggcggggctgaagatgatcgtggaggccatggcggagcgcaactacctgcatgcctacaagatttacatgggcctggccatcgggaacagcccctggcccatcggcgtgacccaggtcggcctgcacgagcgctctgcccgcgaaaaaatctccttcaaaagctccatgagcacgacagtgcctatagtaaccgactgcggtatccagtgctggccttttctgcctcgagtgcatggaaaggtggtgtacaggctctttgcaaagctgtcctctggctactttgatgcctcacacagacggtatcctactgatccatctcgatcagtggactttgacggcggcagcagccaagggcgaggagccatgggaggcggcagcgacaaattggctttgttggaggcgctgagcaagggcgagtcagttgcccccgcgcccgcaccgtcagtcatggaaggcaatgcggtgaagatcccaccccgctgggagcaccagatccgagcagcaatgaaggacgtggccaagcaatgcttggagagaggcccaggtgcacgagttcctgacagagcgccacctggcctcggaaagccttcagagtttacacctttaagcgcgctagaagcctgcagcacgctctcacacgacgcctggagtggcatccctgcgcacaacgatgcatgcaccccaagatgcctggtctgccagcttcaggttggccagcaacgagggtgccacataggtgaaacccacaaacagattgtcatcgacgctcagggatccatcacggggagtgacgcacggcgagtcctgggtgcagggcaaagatggaaacttgatgtgagaggaggtgtaggatcgcgagtcaccctttgtagggatagcttgtatgactggaggaaagggaagctgtgttcccattcttgccaagcaccctnnnnnnnnnnacttgatgtctgtccagatgcggtcaaagttctccacactctccacgtggctcacgctgggcaggaagggcgacgccaccttgcgctgctccagcaggccccagttgatggacctgaaaaaggggtgcgccttgatgtccgcgctgccagcggggccatacccgaggcgtttggtggggtccttctggagcagggccttgaccaggttggcggcgggcgtgctcaggtagcctgttccaggatttgggctccaaaagtgagcagatggttcttggctggagactgggagcctgtggtaaacaaccccccctttcccgccgaggcggtgcaggcttcccagcagcctccttcatgcagtcgccttgcgagcacgccacacatgtccccttccactgggccccccccacccccctcgtccctgtcacccactcggcagtttgaacttggcggtggtgatggccttctggagggccggacgcgacttagcgcggaagggcggcaccccgcacagcatctcatgcagcaggatgcccacactccaccagtccacagccttgccatgcccatggcccaggatgacctccggcgccatgtactccatggtgccgatgaaggagttgctgcgctggtgctcctcgtcccccatgccccccttggccagcccaaagtcggtgatacgcaggtggcccgtggagtccagcaacacattctccggcttcaggtccctgggggatgggtgagagggagctccatggtgagaaggaggacgataatgggcaccgcnnnnnnnnnngcttcaggtccctgggggatgggtgagaggcagcttcatggtgagaaggatgacgatgatgggcaccagnnnnnnnnnntgacaggaggacgaggcgcggcgaggcgccggggctcggacgctcctgggccggagcagtcgttggcgttccatttcnnnnnnnnnnagtcaacacaccacccctgtccccctcccaagcacccctaccacacatgcacacctgtgcacaaatccgaggctgtgggcgatggccagcacgatctcggcggtgtacaggcgtgcctgcgcctcgtcaaatgtccccgcgcgatacagctggaagaagaggtgcccgccgttgatgaagtccaggaccaggtacagcttgagcggggtctgaggagggggggaatggagcgagcagcgctgacaggaggacgaggcgcggcgaggcgccagggctcggacgctcctgggccggggcagcctttggcgttccatttgacatgttgggagcagccgtcagggacactgacacctgtgtcatcatacccacaccacttctctgcttcaccaagcagcacaagaggcaccccacctggaaagagtagcggagggtcaacgggcgaagtagagaccgcggtggggcaagctgagggcttactgcacctccagaagctctgtctggtggatttcatcattgctgatggacacagacgctag

SEQ ID NO: 207 - DNA, 1554 bp, Chlorella protothecoides
atgggaaatttcccagatactttggagtcactgcacactaaaatttacgccgaggatgcccgtcagcaatctgccatgaggagcgtcaagattcacatggggcaaaagcttggagctgtggatgcaagtatgagcctcccgtcgccacttcaactcccccgggcgccaggctggcggtcaggcatcccagtttacgtctttcgaaccctgccttgccaagtgatcaataaatcaggtcgatcccgtgcccagccatgcagagcacgtaaaacaggtgagcaatcgcgcattgagtggtggatgacgcccatcgcctgcgctgctctggcacgataccaccgtcatccggcaacagaagggagctttgaagatgtctcagagggtcccccccgtcccccacccctggtgggaggctcatccagcacagctgaaggtcgggagaggagtcatggcgatccaccttcaccgcgtgagtcatcatcctctggcatccagctgccctcctgggtggaccgagacgacctcaacaccgtggcaatagctgtggtggtgtcttatgcgatacgctggtgggtcaaggcgcatgtgattagtatgcatggctggagaattatgcttgcaatgtcactcaggcatgcgggcttgctctccatgctccagcactcccagcagcctcaatccggcctgccctccaccacccgcaggtttgttgcggagccacgattcatcccctccctcagtatgtatcccacctttgaggtgggcgaccgatttgtggctgagaagctgacataccgcttcgcccatcccccgaccgccggagacattgtgatattccggccacccaagggcatcggcggcaatggtggctggctcgacgacaatgtgttcgtcaagagggttgtcgctgtcgctggtacgcggcagagcaagggcctttgcagctgggggccttgcattgcggtaatctgtgctgtccgtgggttggacaggctgcgcacctcgctgcagcgtttttctgggggcagcagtcgtgcctcgcatgcattgcaatcctctcctgcctgctcgcgtggaggcccttggccccctggccacaccattgcaccgtgcatggggtttagatttcttgtgcccatgtcccatcaatcacttccttcaggtgacactgtggaggtcaagaagggcgcgctctttgtcaatggggaggagcgggtggaggagtatctggcagagaggccggcctatgagatggagtccctgaccgtgcctccacgccagcagggttgggcactgatagctagcgttttgccgctatctcagtcaccttccccaccctcctctcccattcccagccatgtctttgtcatgggcgacaaccgcaacaacagctacgactcccacttgtggggtccccttcccctcgagaatgtggtcggacgggcagtatggaaatactggcctcttcaggaattcggacccgtggacagaacttttaccaggagcgggacaggtcttgccggtgaactggcagcacccccgctgaaagggtaa

SEQ ID NO: 208 - DNA, 690 bp, Chlorella protothecoides
  modified_base (670)..(679): a, c, t, g, unknown or other
atgacgctcacaggcgcaccgccccttttccaacagaccatgcagccatgccaaggcgtgaccattcacgacatgggccacaaaatgggctgcaacggcgtggtgagttgggagttgcaaggtgtgggcacacaggttggcacctgtgaggaccagcctgacaggatggcatggggtgggcgggagttggcgccgtcagctgcccagcaagcctcttgccttttcgcgcaacaaatacccccctcccctctctcctcccctccacaggacaatggcaagctgtggttcaacaatgtgcgtgtgccgcgctctgccatgctggacgccttcagccaggtggcgcgggatgggacgctgacctccaagatcccacgagccagggatcggttcctcaaggtggcagaccagctgctcaggtgcggaggccaaggcagggagtgggaagtttgggtgcgcgctgggctcccgctgttggggttgcggtgggacgagagtgtgagggcagggtgtggtgccctgtgtgctgtgtgccgctggttcagtcatggttcatcgctcaggggtgatctccttccttggcgcgccagctcaacccccaaccacccatcccgcccctcgcattgctcaaacagtggccgcatctgcatcgccagcatgatgctgagcgggnnnnnnnnnncttggggttga

SEQ ID NO: 209 - DNA, 1512 bp, Chlorella protothecoides
atgccctgtgtgctgtgtgccgctgactcagtcatggttcatcgctccgggcatgatgctgagcggggcgaaaatggcgctgaccatcggcatgcggtatgcaagcacccgcctggccgtcggacccacgtgagccgcggcgagaggggggtggaaagggagtcgcgaggggtagaggatgtgaaggagtctgggtttaccctcaggcagtgggtgcggaggcgctctcaagatcttgcgggcaggcggggagggtggctgcatcctgaatgcttcacacagcttccacccgtcgtgtcactggaccgactgcctcctggttttgcagtgggaagagcgacacacccattctggagtaccagctgcagcagagggccctggcacccctcctggcctccaccattgccctcaacatcgggctcaactatgccgcagcactcaacccagctccaaaacggacaccttacagtcaaggagcggtggagcgcggcgagtggcttcggagaccgcttgatcccggcggatgaggcccgcgaggtgatcactctggtctgttccatcaagcccctgtgtggctggaacacggaggagacggcgaccacctgccgcgagcgctgtggcgggcaggggcctatcgtctgtcccagactcaatgccacggccgcactgaaccttccctccctctccgcgccaccccaccccttgcgtgacgtctcactcccacccccgcacctccccacctccaaagggctacctgagctgcaaccggtttggctccatcatcggctttgcacacgccggcatcacggcggagggcgacaatcgagtgctcttcacaaaggtcgccaaggagctgaccgccagcctgcacgtgcccgaggtcaaggcacggctggaagccgggaagaagccgccggccgtcaccgtcgccaggtggggtgcagttgtcgggtgcggcgcgcgagcggtgagatgtgccggtgttggcacgcctcccctcatcccaacacttccctccgccaccctcccggcatcacacccaccacccaccctgcccccaactcactgcagcctgtccgaccccgaggccctgctggccctcttcacggcgcgcgacggccggcgtctggccgcgctggccagcgcaatgtcgggcctgggctccagcgcggaggtgttcgacgtgtggatgcgacgcgagtccgacgctgtgcaggccaccgcgaccgcgtacgcggagcgggaggtgctgggcgcgtgcgtgcgtgcgctgcgcgccgcctcgcccgtcgcgcgcccactgctggtgcgctgcgtcacgctgtacgcgctgtgccggctggaggccgacctggcctggctgatgacggagggcatggtgccgctccgcgtgggcgcggcggtgccgggcgcagtgcgcggcctgtgcgccgcgctggcgccggactttggcacgctggtgcaggcgctaggcgtgccggagcacctcatcgccgcgcccatcgcgggtga

SEQ ID NO: 210 - DNA, 696 bp, Chlorella protothecoides
atgtggagattaaaaaggtcaggagagttcaaatgcacggctgctgtgcggtgcagggtgattgctctcaagggatgtgaggggtgggcctatcgcaggctagccctgcaaaagcatccggacaagaaccccgacaaccccaacgccgcctcagagtttgcagctctgcagaaagcatacgaactcctgtgtgatggtgatgcccgcgcagccctcgacaactttctgcgtaatacgatgcacggcgtatggtttgccttccatacctgcattgcgcttgagattatgacactgctgcagctggtgtcgcaatggttttctcgggcctgtgccgcacgcatcgtccgcaccgcgaccaaagacgcgaagcggcagaagatgatggccgacctggaggcgcgggaggcggctggcgagactcaacggagccaggtggaggccgcgcgtgccaggctggccgaggaggtcgccaagctgcgacgccgggccgcggaacgagaggccgccgagcgtgccaggactgtgcgggagcaggagcccgctgcgcaggctggggcggcggaggtggccggcctggatgccgaggacttggcgagcgcctccctccaggagcgcctcgctcgaacagtcaaggcctcctgggcgcgttcggtgcgtgctggaatgggcttgggagaatttcatttggcaacctga

SEQ ID NO: 211 - DNA, 696 bp, Chlorella protothecoides
atggcacaggacggcgagtacagcgcggaggagctccggctcgtgtttggccggcagggcgccgtggaggacgtggtgctgcgtggtgggtccaagaagaagggcagcgcctgggtggtcatggccagccgcgagggtgcggcggctgcggccccctccctcaacggcagcgcctcccggcctctccttgtggtcccactagcccgtatcagagcagatggggtaggcagggctgacgccagaaatggggagagcccctctggagccgtccctggcccatggtctgctatggacgggggcgacgcgggcagggcggggacaggcctgagctcggctcagctttgggcacaattcgatgcaatgctcgcctcggcgacactccccagctccggccctggccggccgctgtttgctgccggtgcagccttccaccagatcccgcagcagagcaccctcttcccggccgccggtggcgcggcgtccgggcgcgcccccagcccccaggtccagtttcccgctttccagagcaggagctacaaggcccaggaccatgacggtgcgcaagctgcagctgccgcggcagggttccctcggcacgaggaggccattctggccaagctccggcaggctgcagagaggaagcggctggcgcaggatctgcagcgacaggagctggaggagcaggaaaagggctga

SEQ ID NO: 212 - DNA, 318 bp, Chlorella protothecoides
atggaacgccaaaggctgccccggcccaggagcgtccgagccctggcgcctcgccgcgcctcgtcctcctgtcagcgctgctcgctccattccccccctcctcagaccccgctcaagctgtacctggtcctggacttcatcaacggcgggcacctcttcttccagctgtatcgcgcggggacatttgacgaggcgcaggcacgcctgtacaccgccgagatcgtgctggccatcgcccacctacacagcctcggatttgtgcacaggtgtgcatgtgtggtaggggtgcttgggagggggacaggggtggtgtgttga

SEQ ID NO: 213 - DNA, 594 bp, Chlorella protothecoides
atgggggacgaggagcaccagcgcagcaactccttcatcggcaccatggagtacatggcgccggaggtcatcctgggccatgggcatggcaaggctgtggactggtggagtgtgggcatcctgctgcatgagatgctgtgcggggtgccgcccttccgcgctaagtcgcgtccggccctccagaaggccatcaccaccgccaagttcaaactgccgagctacctgagcacgcccgccgccaacctggtcaaggccctgctccagaaggaccccaccaaacgcctcgggtatggccccgctggcagcgcggacatcaaggcgcacccctttttcaggtccatcaactggggcctgctggagcagcgcaaggtggcgtcgcccttcctgcccagcgtgagccacgtggagagtgtggagaactttgaccgcatctggacagacctgccgccacaggactcgccgtgcgtcactccccgtgatggatccctgagcgtcgatgacaatctgtttgtgggtttcacctatgtggcaccctcgttgctggccaacctgaagctggcagacctaccgaagaaccccgaatcacgcagttag

SEQ ID NO: 214 - DNA, 234 bp, Chlorella protothecoides
atggaggattccactgcccgtcgcatatctcagctagcccagcacctgggggatcccggtggtgcgggcgcgctcacgagggccctcacctctgctgctggcggtcaggtgcagcatgagatccagatgctcctggagcacgacagccatgccgagcgccagaagatgaaggacctgatgaacaccgacctgttcacgccgtgcgtgactggagttggcgggggccacacgtga

SEQ ID NO: 215 - DNA, 1353 bp, Chlorella protothecoides
  modified_base (448)..(457): a, c, t, g, unknown or other
atggccaccataggatcctcacatatcatctataccccttggcatcgagctacctcccgcctgctcccgccgcagagccgcgccaccgcgctcccggccatggtccggtcgctatggaccctggcggggaaggacagcgccgagggggaagccagtgtccacgccgggcaggagctggcgtctgaccagcacctggagactgcgggtcccaagagcaaagtcgacgagccgctctccgccgccagcggccacgcgcatggcgcggcggaaggcagcgaggcgggcgtcacagtcgtcgccgagcagccgctgcgagggcctgcaggcatcgttcagccagaactgaaggaggcggcaaagtcggggctagaggcggccctcctcggtgtggaaggcatcggaccggcaaccttcaaggaggaaggggccgggcctgcgccgtccgcgnnnnnnnnnngcatcggaccggcaaccttcaaggaggaagaggccggggctgcgccgcccgcagaggccgccgggcaatcgatgcccgacgggaaggaaggtgacccaccggctgacgcccctgcaagcgggggcttgaccagacagccgctgcagcagtcggccccagatgccaagaccgcgagcatcgatccttctcccagctgcgaccttcccgacgccctggcgtcgccggccccgcccccccctggcaccgaggcggctcctggcggccctacacccacggcaggccccttcctcccccctcccccgagcgccccgttccaagtccccgacagcctggcgcaccaccccgagggcctggtgcgtctggcctgggaagtgcgtgacgcgctcgggctgggccgcggccaggctgcacacctccgcacgctgatgcgcacggggctgctggcggggcggtcggtgcgcttccagaccaagaacgggcgcgtgctgctgacggggcgcgtggacggcgcggggcaggtggtctgcggctgccgcgcctgcgccggcgcggcctgcgtctcgccctccgagttcgaggagcacagcggcagccgcgaccgtcgccccgccgacggcatcttcctggacgactttgacgtgtccatcaagaccctgctgggcatcgtgaacagcgccgagctggcggcggcggccgccgacctgcacgccgacgcctgccacgcctgcgccctcggcggcgacctgctctgctgcgacgcctgcacctccgcctggcacctggcctgcgcggagctggacgccgtgccccccggcgactggctctgccgcctctgcgtcgccgacggcgtcgtcctgcccgcgcgcgggggggcgggcggcgggggaggcgcggac

SEQ ID NO: 216 - DNA, 2061 bp, Chlorella protothecoides
  modified_base (1145)..(1154): a, c, t, g, unknown or other
  modified_base (1884)..(1893): a, c, t, g, unknown or other
atgcgcgctctgtcggggggagctgcaaattccccgatgctccgatgcccagggcacctcatcagtcctgtgcaggggcagaacgcgcagctgtctgcgaaggtccagtcgacgactacaccatggtgggcggggacagggcacgggaaagcatctgggttcagggagtgtggtgaacaacttctctcttctgggtgcccggacctccgacgaccagattggcacctctctcaactcccaggcgaggtgcgtgggtactttcggtacggaatgggtccttgcaaggtcaggtccgggatgagtgttcctctcctccgcacatcagcccgagaggccttcgcccgcgcaggtggacaagttctacgcggcatgtcacccagaactggacaatctctgcctgtacggcaacccagacgggagctgggaggcgattccttgccatttttcgccccacaatgcaagcaccgatttgactatgtgaacactgtgtcctacaccaaaccatggagctggcaatgccggaatacccccacccccaccaccccgtcccaggttccaccagagctgcccgagccggctctgggtatcaactttgcaagggatggcatggaccgtcgagactggctgtccctcatagcggtgcattccgactcctggctcatctcaatggcctacttcaatgccgccaggctggatgccgagggcagagatggcaaacagacctctttggagcatgcacgcgttcttgacctgggtcatatggcaaagagagctccttggagcatgcatgcgttcttgacctgggtcgttcgtctgtcgtttcactcgcaagcattcagtcaataccacactccacccctggcccgcaggcggctcctcttcaatgagatcaactccctgcccacatgtcttgaggtggtgacaggcagcgcagcccctggcagcaccacccaggctgccgctcacatctccaagcgccccgcgggagtgccccaggcagaccctgcccccgatacaaaacgcccggccttccaccctgccgtgagtctggctgtggcgctgggccagaccgtgtgcggcgctgcttgtctgctgcactcgttgctccagccggtggcactggctcccactctgtacccccgccnnnnnnnnnnttggtgctgggccaaaccgtgtgcggcgctgcttgtgtgctgcactcgttgctccggtcgctggcactggctcccactctgtacccccgcctgctccgagaatgtcttcgcccttcctccccaggccaaccaggggcggccgcgacaagggcctcccccttcatcggccgccgaggagtcctcggggtcggaggatgcagaggaagcggagtacgagccctgccccaactgcggccgagagttcaagtggagctgcagtggcatgggcctgtcgccttgcacaacatggcggcaacctaacggcggctccaaatgcatacgaaaccagggacggcgacttctggatcttctgcgactactgccggcgctggttcgacgggaggtgtgtgggcatgacggcgcagcgtgccgaggcctccaagacgtggaagtgccccttctgtaccaaggaggcatagcgaagcacggttggctcgacggcgcggccccggccgccgccgcgggcccgcccgctgagcagacggaattgtgtacgtgggtgtgcagggcagccagccggcagaggccctcgctctcgagctcagtgcgcggcgaccggcggccgctgctgcgcggcggcggccgcgccccgccggccccccagcagcatgtcgggggagtagctcgacgccacgtcgatgagacagcagggggggggaagggtggttgcactgcctgcctagtggccagnnnnnnnnnnccaccgattccaggcaagacccgattcagccaggccaggggttctccaccccgctgcagcgcaccgttcatgatctgcagcacggtcaccgcctcgttgaagggcaggcccggcagcagcttgggggtgaggaggaagcactggggcgttcctggcctgagaatgtaa

SEQ ID NO: 217 - DNA, 708 bp, Chlorella protothecoides
  modified_base (409)..(418): a, c, t, g, unknown or other
atgcacctgaccccacgcactcaggtgggctgcgcgggggaggtggtcctgcgcgagacggagcaggactttgaggggtacgccgtcgagatcagggtcaagttccgggagtcgcagcagctggagaccctggatgcgcaccgccagtccggcggggagcggtccgtctccaccatcctctacctcatcgcgctccaggtgtgtgcaggtgggggcctgacctgcctccctgggcggctccctcggtggaaccgatggccatgccttgccgcgggcggggccggcccggaccagggcccgagcctcgtcctggggcatcggcgctcgtggcacccagccgcgactgccagcccagagcctgggagtccatcaaacccatcccccctcatcattccccacgctgcacatnnnnnnnnnnggcgctcgtggcacccagccgcgactgccactccagagcctgggagtccatcaaaaccatcctccctcatcattccccacgctgcacacgcctgcccagggaatcacggtggcccccttccgcgtagtggacgagatcaaccagggcatggatcctatcaacgagcgcaaggtgtacacgcagctcgtggaggcggcaagcaggtgcgctggccattgttctggttttggatgcgactttggtgggtggaaggagggtctgcttcgttgcagctcaggcctggccactag

SEQ ID NO: 218 - DNA, 2082 bp, Chlorella protothecoides
  modified_base (933)..(983): a, c, t, g, unknown or other
  modified_base (2049)..(2058): a, c, t, g, unknown or other
atgaggggctgcagaggcgccagcacgtactggactgcagggtactgcacgaagatgaacttgcctgcaagtgccgaggaggggcgtaaggctgtccctcagggggggcatggccatgcagatgaggatggggacacctcagagccatggaggctccaaaacctgcacaataagcttaccatatcgcaggccatcaaacagggggataagcgctttgatttctggcagcgtgatggaccatgggagaggatggaacaattcccaaagtatagtaatgcgaggccatccgcccttgaacatgccgtgacccggcaaatgacccgcaagaaatgcaatgttgtgaaggggtggtcggtgatgcgcggtggtcagtctcccatttggacgagatcggctgtttcagcgcgcggggggatccaactacgtacggccatccatttcgagttcccgtcagcatcaccaatgaccatagtacacgatgtattaccggtggctgtcgacaagcacgaccttataattcagctcaggtgtctgggacctacaggcgcgaggggtgcatacagcacttgctggtgtagtagtgacgcccaactcgccatgggggcaggcatgactctcaacgaagttcagaaacaaaagagatcaccctcgcagcttggactgaatgggtatatggaatccgacctccagccttggcatctcacaaccatatgcctacgccgacgttccagtgaggttgtatcttgtgtggttgctggatggaaaatgagtatgcatcgctctaagagccctgagtctcgtcagattacaaggtctgccgatcttgcgccttattcatcagaggctgcaccgcagggggtcgagatgggggaggagcctgcgcactccaggtatgcacagcacatcacagaggtttacatgttcgcatttctnnnnnnnnnnnnnnnnnnnnnnnnnnnnnnnnnnnnnnnnnnnnnnnnnnnccagggccgccgtgcgtggtgccgtcttgaaggtggaactcaaggacttcatggtaggaaggggtgggggggatggcatagggatctggctccccagcctgacaacggtctggcagcgtcctcaccatgcgcttcgcagacgtacaagcatgccgtcttcaacccaggcccccagcttaatctggtgctgggccccaacggtaggtctgtaacccagaccctgatggcatgcacaccacaggaactgggaaaagctccctggtgtgcgctctgtgcgtcggcctcggcggaaagacaggggtgggtgccggtttgcaaacctgacccggcttggtgcttgggagtgcaaggcatgccagcccaccccaaccaatgcgctagacgcaaacctctctcacatcaatctgcgaacctaatccccccaatctcgccaaacccacagctgctgggcagggccgacgaagtgtcaaactacgtacgccgaggagctgacaagggttgggtgaagatcacgctggctggtggccctgagggccgcgagactctcatccagcgaatcatgtattccagcaagaactcctcggattggagcatcaatggtgcgggggttgttggaggcagaaaaactatgcaaggagtgcctgaaccgggatgtgcaggcaagggtggcctcgctcaacatccacctggacaacttgtgccaggtgatgtatgggggggttggggggaagtgttgaggatcggacacagcggcccccgtccctcgtcccctcgagaaatgcacgctgcggccatgtgctcgccagaacctgcgagcgccagccacaagcgcctccacacgagcgatgacctcccctctgcgcccccgcagttcctgccccaggacaaggtcgtggagtttgcgaggctgaacccacaggccctgctgcgggcaacgcaggcctccatcggggaggactcgctcaccacagcgcacgacaggctgatccagggcaggaaggacgcggcgcggctcgagagcgtgagtggtggcgctgcccctggcctgaatccttcaaccccaacnnnnnnnnnnacgcggcgcggctcgagagcgtga

SEQ ID NO: 219 - DNA, 2310 bp, Chlorella protothecoides
  modified_base (50)..(59): a, c, t, g, unknown or other
  modified_base (795)..(804): a, c, t, g, unknown or other
  modified_base (1854)..(1863): a, c, t, g, unknown or other
atgcagatgggcagctgccaagcgcggccacacccttcaactcaccggannnnnnnnnnaagcggggcagcaggcgggcggccaggcgtctggcgggcgccgacccggctgcgattcgagcagatgtgtgtttgggtgaggagggaagttgatgatgggcagcgaatgatctctagggcagggattctgggggtggcgccatggagatgggcagccgcccagcgcggccacacccttcaactcactggcgcctgcagagacgagcgtctgcacgtagggctccgggtccgcgggagacgacagcagggcgtcatatgcgctgtacacatcgagtatctcccgccggatgaggtcggggctggtggcctgccgcttcttcttcttggccgggggcggggctgcagaggcgggcagtgcagccaccctctttgggtggaggcttgcctccgtcccgtctgtcatcgtggcaagctgatctggggaaaagccagggctcgcatggcggtggaacccctcggaacagaggggagcacccctcacaggaggagaggagcgacggagcagcgatacgcagggctcgcatggcggtgtaacccctcggaaaagaggggaacacccctcacaggagaggaggagcgacaaggcagcgatacgcaggtatgccgaggtgcaggatgcaattatcggcgaaaggaatggcgaatgtcctccgagtgtcccatgctgatcgagccatccactgttggcgttaatttattgatgttacttacgcaccacgcccaagtcagcgtgttnnnnnnnnnnagccctggagcgcccatggcgatcggaacttcaacccgggtgacgacgtggcatgcgttggtgttggggcgccagacactcactgccgtcgaacttgagttccagctcgatcgcatctcaccttgcgcgcagcgttctccaaatagcgatagacgggacaagccgctcctcaatctagggaggcaggagcatcctccacttactctctccaacatggcggcaccaatggtggagattcagacgtcaatgggatccttcacggtggaactatacgaacgccaggcaccccgcacagttcagaacttcattgggctagcaatcaaggggtattacgacggcactgtggtatccaatgagggtcgccacgtttctgggcatgcagattgccatgcatgttgttttcatcgattgctgtcctggctgtctgtacccacatgtcttcacggtggcacaccaggtggcgaccccaccggcaccgggaggggcggtacgtctgtctttggcgggaagttcgaggatgaggtgacaagagagctgaagcacactggggcaggcattctgtcgatggcaaactcgggtccaaacaccaatggcagtcaggcagccgttgcttgttgtgcgcatgaggacatttggcatcatgcagcagagtcctccatgcaagcagaggtagcgcgagaggtgattcatcacgtccctcaccgcccaacattcactttacctgttcaacccccagttcttcatcacactagccccaacaccgcatctggacggcaagcacaccatctttggccgtgtgagcagtgggatggaggtgatcaagcggttgggcaatgtgcagacagatgccggcgaccgcccattgggcgaggtgcggatcatcaaggcccggcttctctgaaacttaagggcccggcttctctgaaagttaagggcgagatgtctctcagtctgtttttacgtgagcttgaacttcgtcttgggacggtgggctcggcgttcaaggaacgatggagctctatcaaccacatccgacaagccagctcagtnnnnnnnnnnagagtcgatggagggaccacgtcctcctcgctggcctccacatccgaggcagccgcccagatggctcctggaggagaacgcacgctggcacaggctcagcgagagggtgctgccattggtgagcatgcatgcagtgggacggtcgctgcaatttgggctcggcgtttaaggaacgatggagcgctatcaaccacatccaacaagccagctcagcttcgttgcccagacgttgcctccatgcccatggatgagcctgctggcctacaacaacctgccaaggttctggaagaccaaggaaccacccaaggtggacgaggacaaggaggcgcggaagctggagaggacacggctcatcctggcagggcagagcgtgctggatggggaggagttcgacggtctggagccggaggcaagtcccagcttcttctgtggggtccagctggttga

SEQ ID NO: 220 - DNA, 516 bp, Chlorella protothecoides
atgatcgtgacattacagggcgagctacctgcgaggtgccttgtccaagtctccagtcgggttgtgtttctgggcgcacaagcatctcacctgcgtgcccgcccttgtttccccaggggacgcattcgccagatggacggcctgaagcaggaggctggggagaagatacgcagggtcatgcagctgactcgagagctggaggctgtgcgtcagatgttccacgaagcctacaagaccggagacgacgcgctctttgcccaattccctgacgatctcctggaactcacggagcaccagcagaccctggaaaccgagctggctgggctggtgatcacgaatcctggagcatgggaggagtaccagctcagggaggaccagattgcctcccaggagcgtgagctcgagggcatgcaggcgcagctgagtgcctgcgacgcagagctgcagtccgtccaggtgaggggtgtgcttgctgggggttcgtggcccgcccatgcactctcaaattccctctga

SEQ ID NO: 221 - DNA, 1227 bp, Chlorella protothecoides
atggacgacacgcgcaaggagcatagccttcaggcccttcaggacgtccatcttcagcgcgccgtcttccgcaagagaaaggcagccttgctccgcagagtcgtggagctttcgattctctgcgagtgcgaggtggcattgctacttttcaccaaggatgatgagctggtgcaatactcctcctgtggcatggagcacatgctgaggaagttcggaaaggcctgcactaccccgcatgaggtcctcaccactgaaaacgtgagcatcagcttctgggtgggtccaggctcgtcacatgaaccatttaagggcaaggaagcggagacgtgcatctgtcagtcccccccttgccaacctctcagtggcatccccccgtacgcggcagaggtgaggtttaactattccttgtggagacaagaggggattactattggggcgcccggcacagcatgtcacggaaacattaatgagtcccctcgtacccttaaggcttatggccagatctaccgagagtttgacattttgattcagggacatccaccctccacccagccgctaccattgttggcagccgctgccacatctcgtgatgtggctgctgggtcagggagcgatcctgtgccggactctgcagtggacagccttgcccacgacgatgaggtgcccatcagcaaggacaattcaagaatcagtccaacaccctcttcttaccaagaccagtccgtccccaacgctccaggcatgcagctcgaggagcgcagtgccagtgcagcgcgcggcttggatggtattaagcccgatgaacagccggaacaagaactacactgcatcagggatgccaaggccaaggccagctccgctgcaggacagtgtgtgtatcctgtcgaggcatgcggctctgtggagaccttgcaacatggcgctgcccaagatccggcggtcccctcttgcaagcgccgcgactggcctacatctattgaacaagggcccccccttcgggaggtggccccgtccctgagcacgccgaccatcggtccaggcctttctgcccagctgggctcttctgaagggctgtgtttaccgatagctatgccttggcggtgcttgagacgcaaccgtgatcgctctgacgcgtctgctcaacgagcagcgtttgacgaggccaattctggacgttatgtctccatcctgcccgcgatcctcccggcgatagaatgcgacctgtga

SEQ ID NO: 222 - DNA, 1245 bp, Chlorella protothecoides
  modified_base (286)..(295): a, c, t, g, unknown or other
atggcaagcggacatcgcccacctgaaggcccgggagaggcctcccatggctggggcgctctctttctgggcatggtccacttcgaggtcctcgtcttgtccctcctcatcagcctctacttcctcgcgaatgatgtgcaggacacgccgtgcaatgttcccgatgaccagctctgcggatggggtgatccgtgcaatgtgagggttggtgtgcgaggctgctgggacctcctccgaggcagacacttgtccgtctcgatgaaccgagccgtacctgttggctgcnnnnnnnnnnaggctgctgggacctcctccgaggcagacaagtgtccgtctcgacgaaccgagccgtacctgttggctgtgcggcctgcaggccgttcccttggcggcatccagactggtttcgaccttcctttgccgcagtcgtgtggcgaagtcctgcaccctgtcatagtatccttgcgtggccatgcgctatatagacgagtacaagcctattctctcgggtctgagagatgggctgtggatgccaggccagccccctaccgagaagatgccagcactcctacgctaccttgtctgcaaagtaatcctgatgcgatcacacactcaatcaagttgatacagaagaacgtcattcgttcctgccttgagactccacccttggctctggtgttaccgatgcgaagctgcgcgcgtgtggtcgtagcgcgatgtgtcggtgctgcaagccagccaatcaagtcgatttgcacagacatccatactcttacggggcagccagctcataaggccgcccagcgttcggtccaacgacgcgacatgcgaagggatgacttgagggacaccgggtatttgcaacgccacttctccagctctgcaatgctcaacgaggacagtggcagcgatggagggctgcagctgacggacaacgctgttcaacgcctgcaggaactgcagcgtgaatctccagaggggcctctgttcctccgactcactgtggagggggggggatgctctggcttccagtatgagttcagcttggggtcctccttgaaaccagaggacagaatttttgagcgcaatggagtccaggttgttagcgacgacatctccctcgatttcctgaagggcgccgtggtagactttgaaacagacctcatgcgatcagggtttgtggtggctggcaaccccaatgctgcgtccagctgcggctgtggatcgtcttttgttgccaagtga

SEQ ID NO: 223 - DNA, 2010 bp, Chlorella protothecoides
  modified_base (80)..(89): a, c, t, g, unknown or other
  modified_base (1358)..(1367): a, c, t, g, unknown or other
  modified_base (1661)..(1670): a, c, t, g, unknown or other
atggcaactacatccctcgccacacaggtctccacttggcgtcggcaaccgcacgctctctctgcacaccctgctcgacnnnnnnnnnngcacaggtctccactcggggtcggcaatcgcacgctctctctgcacaccctgctcgaccatgatgcagtggaggagccattgcgtcagctcagactctcaggtggacatgggcctgccacaaaacttgatgcctcccgtcaccaggactcgcccaaaaagaagagccagccagtcaccttctgggcacggaaacaggaggttatagatggtgtcaatgatctgatagaggaactcaaagacattgactcatccattgccaaccaggtgacggcgtgggatgaggccagatgcttccttgatctagcctggacattcatgggacggtggcttggcaatctggtacctgacagtcttaggtcgggagtcaccctcccccaagttgttactttatactctgtcgcaacgcaggcagtggagcatatccatgcaaatgaggtcatcttgacctttggatactcaaggactgtgttgcagtttctgaaacgcgctcgtgagaagcgtttcttccaggctgtcgttgcagaggctgctcctacatacgagggtcagcgaatggcgcgagagctggcagcattagggatccagaccactgccatctcagattcagcaatctatgccatgatggctcgtgtgaacaagccgccggggcgccacagacaatattcgccccatggcacccaacaggtggtcgtgactgctcatgctttgctggctgatgggggcatcatggcgccaattggcatgcacctggtggcaatggcggccaagcaccatgccgtccccttcgtggttctggtggggatttacaagctgacacccctgtttgcacatgagcccggactcaatttcaacgagctgaagtctcctgcgagcattctaccttacaacgatgaggcgttgcttgcagcaggtacagccttattgtggacgctggagcacattgctcaccacaacaggtcacatcgtgtgcaatgctcgacgtgctcaaggtgtgactcctctttcacgcgcgcagatagtagctcctgcctggatgctgaatctgggcttgagtttgatgtggacgactcggtgagcacatcgcatccataccttcaagttcacaacccctccttcgactacgttccgcctgcgctgatctccttgttcatcactggtgaggtcgacagaagggacctgcacatagttttctggggaaccgtgacgcctgcaaatgcaatggggagaggcaaccatatcgatcagattccatgcacgtcccatcccannnnnnnnnngtttctggggaaccgtcacgcctgcaaatgcaatggggagaggcaaaccatgtcgatcagattccatgcacgtcccatcccattgctcagatcaaggacacggcttcatgccaagctatgtgtacagacagctgtacgagtgggggagtcctcctcagaagcatttctcagggtcgcaacacgtggctcacagattcgcaagagctcactccagcacaatacggaccatcggttgaacaagaactcagaggaatacagcacaattgtgccagcagccgttgtttgtgcgctaannnnnnnnnntgagcaagcgatagcctgtggtgtgggatcaacctcgcactctaaagcacagcacttgatccatggaacaaaacgagccagagggcctttcaaaagctctacactggcgatgctcaaagctgcgcacgccgcagcttcactgtacagaatctcgccgcaagcccagagaaagaatcgtgcacttccaatcatcatgagctctcacggaatgtcgagctgtaaaagccttgcatcaggcatcagaacggtaactcaaggtcccaaggtgcaaacgctgatgagaattgtagggcaacaatctatagcagaaggtgacgataaagcggctcatatttggtaa

SEQ ID NO: 224 - DNA, 399 bp, Chlorella protothecoides
atgcacctcaattgcagtggagcatgtgaagctgcctttgcactgaagaggagcggcggagccatcaggagggctctcttccgacttgagaggggagtctgcaccaatcctcagtgcaagctggactgccatgccttggtgacacggctgcagatcattgagaaggggagtgcgggcaaagcagaagcaattgctgttcacatccagcctcccctccgtatcagcaggtgggagcagcgtagaagggaagtgctgcagagactggctcccagtttccttcatcacggaaacaagacgctcttggatagtctcattcgctcagcagtggaggggaatgcttggcatgctgaccatgtcatccctgtataccaggtgaggcagcaaggggttgccgtgtga

SEQ ID NO: 225 - DNA, 297 bp, Chlorella protothecoides
atgaagtcagacgccaagccctttcgatcatttgaggtggacgagggccaccccatcgtatcgttgagctggtcgccgagtggggatgcatttctggcggtcactggatcgccccagcccaaggtctacaaccgggaagggaaggagcagggacagtttgtacgtggcgacatgtacattggggatcagaagaacaccaaggggcatgtggctggctgcacgggcggacagtggcatcctgtagacaagctacccctcatgtgtgctcatcgcagctcctgctggctggccgcttag

SEQ ID NO: 226 - DNA, 198 bp, Chlorella protothecoides
atgacatgctccagcgacggcaccgtcagagtctgggacatggaccagcttgtccagaagacggtgatcaagccccagctggccaaaccaggccgggtgcaggtcacggcagcctgttatggaagcacgggccatgtggtggctgccggcctcatggatggcaccatccagctctgggatgtcagaggtgggtggtga

SEQ ID NO: 227 - DNA, 1254 bp, Chlorella protothecoides
atgctgcgaagcctgttgctgacccgcaaggccgcgggcggactggcagcctgcaggcccggggtgcctctcctctccatccgtggcttcgccagtagcgaggagcaggccttgctgcattcgtcacacatgttccacgaggcccagcacacctttgcccaccatgggatcaaggtgtctggccttgaggttgacgtcgcccagatgatggctcagaagggggcggcgagcaaagcagtgtggccgaccctgcgcacatttgcccccggtgcacccccccgtctgcagacaaaggctgtcactgggctgaccaagggcattgagggtctgttcaaaaagaacaaggtgacgtatgtgaagggctggggcagcctgaagtctgggaacgaggtggaggtggcgggggctgacggcgagacctccaccatcaaggccaagaacatcctgattgccacggggtcggaggtcacccccttgcgtggcgtcgagatcgacgaggagaaggtggtgtcgtccactggcatcctagagctgaaggaggtgcccaagaaactcgtggtcgtcgggggtggcatcatcggcctggagatgggctcggtctgggccaggctgggcgcggaggatggcgaggtgcgcaagctgttcgagcggaccctgaagaaggccgggttcaagatcaagctgtccaccaaggtggtgtccgctgacacctctggcgagggcgtgaagctgaccgtggagcctgccaagggcggggaccaggagaccctggaggccgacatcgtgctggtggccactggccgccggcccttcacgaaggggctggggctggagaacgtgggggtggaagtcgacgagcgcggccgcatcaagggcacagcccagcttgcacctgcaccagtcccgacacgccgcggctccctgccccccgctgtgcaggtggatgaccacttccggtccaacgtgagctctgtgctggccatcggggacgtcatccccgggcccatgctggcacacaaggccgaggaggatggcgtggccgccgccgagatcctggcgggcaagaatgggcatgtcaactacgccaacgtgccctccgtcatgtacacgtggccggaggtcgcatcggtgggcatcaccgaggagcaggcaaaggccgatggcctcgactacaaggaggaagcgatcctcatgctgggggcatgggggcacgcacgtggaaactgggcacccagctaccaacacggggcctga

SEQ ID NO: 228 - DNA, 687 bp, Chlorella protothecoides
atgaaccagcaggtgggcaccactgaccgcaaccgtgacgcgcatggcctcgcgtcagtgaccagcgagcgtggtggtgggcccaagatcctggtgttcgtgcaccataaagccgtcatggcgggccttgcggacgcgatggagggggccggcggcgccgaaagtgtaccctacgttcgcatcgatggcgacactgatgctgaggacaggcgtcaagccgcagcgcaatttcagcggaacccacgcattcgagttgccctgctgtcgctgcttgcggcaggggtgtactggtgttgcgtaggccgggtgctctcttcaaggtcggggtgtggcttggaacagcacctgactctgcctcagtgctcctcttaccctgccaattccgcagagctcccagacgaggtgggtatcctctggcaggccgaggctcgagcgcatcgccagggcctctgctggcccggctccagcgacgagcagcggtggcagcgcctgcaccgcagccttgcacgggtgaatgcagtgcacgacggcgtggagcagatcacgccccctcccggtgctgggacaggggtccatgcatgggatggagatccactgcagcccaccccgggcccctcccatgcaagcactgacgaggccagcggggtcccaccaccaggtgatgacagggtcaagatgatgggctga

SEQ ID NO: 229 - DNA, 540 bp, Chlorella protothecoides
atggagctccttttgccagcaggagacggtggtccctccccttcggcactcctttgggagcgtctgaagatctactgtgcacaagcggggtggtgcgagaaacggcgtgatgtcgcaacaccggtgcagtcaagctctgcccaaaccgtggtgctgcccggcatcggccttgttgcgctgcagccttgggtgacgccgggcatcctcaaggccgctctggcaggagcccaggcgtttgtggcagaatggagggagctgcgggcggtgcatgccgcacggctggccgatgccatcctgggactgcccctgtcagaggctgtggcgggactcgaggccagtttcctgacgacgggcatgtacgggttggggacgtcgagatacctggatgcgcagaagggtgaagctcccccagctggctcagagtggaggaccgtgaccgtcgtacacagacagtgcgcggagaaggtggaaatggatgctttgtgcttgtgtcctgcccccagactttctgggctggactccgagctaccaaggctttga

SEQ ID NO: 230 - DNA, 345 bp, Chlorella protothecoides
atgtaccgggagcccatgccagggcagcggaaacgtaagacggccgagtcagatgccgcggagaacaagcagaagcacaagccggacctgggctctgctgcacccggaatgggggctggggggaagctggggtccacaggaggcacgctcctcacgcagtacgtgctcaagacccatggcctgctcaagaacccactggatgaggatgtgcgtgcctcgattctacgacatgcagacaaggccgacgaatactccttattcactgctgcctacaaatcaactcaacccgacaagatttatgccgaagaggagaaggatgaggaggacgaggaggagcagaagtga

SEQ ID NO: 231 - DNA, 405 bp, Chlorella protothecoides
atgtgcactcaggtggatgctctccgcccggggatgctcggggacacaaggcagcagtacgctggcctctactgcgccaggcgcatcgtgcgtagtaggactcgcggtggcgaggaaaccacgcatgtggacaactcgggcttgcggcgcgcggaggagctgcaccgcctgctgcgctacgccgtcatgctacggaggctgaagcgggaggtgctagcccagctccctcccaagcgacggcaggtggtgagactgccacgtctcagagccaagccaggccgggcgggggaaggagcaggggacgacgagggctgccaagcaagatctgccgcgcaggcaacgggtgcggggtgtggcacggtgtctgtgtgccagacaaggtggctccaaggtctgtgggtctga

SEQ ID NO: 232 - DNA, 303 bp, Chlorella protothecoides
atgccttctatcctcccacacactcaggtgggcaagttccccttcatggccaatagccgtgccaagaccatcgaggacaccgatggcatggtgaagttcatctctgatgccaagacagacaagatcctgggagcgcatatcatgggccccaatgctggggagctgatccaggagtgcgtgctggctctggagtatggcgcgtccaccgaggacatcggccgcacctgccacgcccaccccacaatgtctgaggcgatcaaggaggcagccatggctacctatggcaagcccatccatatgtga

SEQ ID NO: 233 - DNA, 882 bp, Chlorella protothecoides
atgggtctagcgtgggccatctctgagcacctcatgaacgccattggctgccccaccctgtttgccacccacttccacgagctgacggcgctgcggggggctggcggcgtgaagaacctgcacgtcggcgcggccatcgaccacgcctcgggcgcgctcaccatgctgtaccaggtggaggaggggtcctgcgacaagtctttcggcatccacgtcgcggaattcgccaggttcccccctgccatcgtggaggcggccaggaaggcggcggcggctgccgcgtccgataagcaccaggtgtggggggatactgagatctcggtacaattgtgccacatgcagcgctgtggtatgcagcgtgcctggtgtgcgagaccgttgcatgacacatgtgcctctgctgacagtgaggtctcggcgtcaaagcggcagaaggcggggtcggacgcggccctgcaggccgccctgctcgagtttgccgagctgcctctggagggcggtgccgagtcaggccgagcgcgcgaggcgcttaccagctggcagggcagggctgcagccctcctgaaggagctggaggcactgcccggccggggtgaattgggtgagcatgctgtggattttacagagcacttcccatcgcagaggatagggaaagataagcgggaagcgaacgttcccagagcacttggaggtcccatcgcagaggataggacgaggggaaagacaagaaaagcgaacgttcccaggtcggctcgagcgagcgcgcgagcaggcctgcccggcgcggcggagcggccacttcgggacatgatcccctggcccagcggccccgtcaacagtcggcgaaacatcgccatgactcccgctgaaatagagcgctag

SEQ ID NO: 234 - DNA, 1626 bp, Chlorella protothecoides
  modified_base (571)..(580): a, c, t, g, unknown or other
  modified_base (1054)..(1063): a, c, t, g, unknown or other
  modified_base (1329)..(1338): a, c, t, g, unknown or other
atgggagcatctttcgcgtggtcagaggaccttgctggcccccggcttccccttgtgtgggggttgtgcagtgtgcgcacgggtgtgaagggacgagtttcccctaaaactcagaatctgcgcacgggcccggcttccacctctcgcacaccgagcttagaattccagcccagcttcgcgcgttcctgcacccccacccccggccgcaggtggtgtctgtggcggccaccttctgccaggtgtgggagcaggtgcgcagcgtactcgctgagctggacgtcctggtggcgtttgcggacgtcgctgtcaccgcccccaggccctacgtccggccctccatgctgcccgccgacggtgcggagtggggtgtttgggatggctgttgcaccggagctttgctcggcgaggctggggagcggccgctgtgctagtttccatggatcctgcggcactctggctgcttgtatgcacctcggccaagacatgggcgacaatcagtgtgcctggatacctcggccaagtcggggagcatcacaaccctcatcgcttgacccatggtatgctcatacannnnnnnnnntgtatgcacctcggccaagacatgggcgacgatcagtgtgtctggattcctcggccaagcggggggggggggcatcacaaccctcatcgcttgacccctggtatgcgcatacggcccttgccacccccgcatcctggtctgctgccacagttatccacacccaggcgctacgcctcactgcagggggtcgcgtggagctggtcggctgccggcacccctgtgtggagctgcaggagggcgtcgattttattccaaacgactgcgtcatgcagcgcggggagagctggttccagatcatcaccggccccaacatgggtgggaagagcaccttcatccggcaggtgtgtggtcggggaggtgggagtgatccagcgaccttgggtaggggcactgatgcagtgaccagatggatgcaatgtctaggtgacagggccctgggtggtggtatagggagtctccgagcagcagcattannnnnnnnnncagccaccttgggtaggggcactgatgcagcgaccagatggatgcaatgtctaggcgacagggcactgggtggtggtatagggaggctccgagcagcagcattgggaactccatgctctccatggcctgggttggcgtctggccgctccgatgtatcatcctcccccagcccagtgcggcccttgtccttccgcccccagcaacccgcctgtagagttgctgcccctcaggaacccaatcccatactcaagcgccccaccccgcannnnnnnnnnttgtccttccgcccccagcaacccgcctgtcaagttgctgccccccaggaacccactcccagactcaagcgccccacccctcgcgtcatgcaggtcggcatctcggtgctgctggcgcaggtggggtcctgggtgccctgcacccaggccagcatcgccgtgcgggacgccattttcgcgcgcgtgggcgccggggacagccaggcccgcggcgtctccaccttcatggccgagatgctggaaagcgcggccatcctcaaggtgaggggggaaggtggtgggccatga

SEQ ID NO: 235 - DNA, 912 bp, Chlorella protothecoides
atgcagggccgggagcagggattcgaatcgcgaggtgtgatgaattgtgccatgctgcggcgtgcggggattcaagtcccattccacaagggcagtgttcctccagtgctgagggcagcagaatggcatgaaggatgtgccccttggcttgcgaggaccccaatggaccgggtttcggtgaagcggaacgacaaggccgctgcttggcgagacaagctccggagcgagtgtctggcacgggtacgcgagcagcggcagtctattctggacaagttgagagccagcagggaagagacgcctgcgggagggcgagcctccctcaaccttattctacataatgcgctcgattcacgaaaaaatggagacagaagcctggccatggattacaccctccctggaccagagtatgaagagctcatgcagtccctggaggaagccctttggcaagacgccactgctctgggacacaatgaatgcgactaccttgacgacctggaggcagcagagatggaggcaagctggcaagcagctgaggcagagggttccaccccaactccctgcccatgctgtggctatcatgcactgtactgtggtcctggcggcagagtctcgtgcaaggcatgccacctcgatcttcaagttgcttcccttgaggccctgagggagctcctcgctgttgtcctgcaggtttataccagcccacgtgtggaccctgcgacattccccccattcctgacctccaacaggagcactggcagaggggctgcaaccacacaccgtccttccaggcacacaggagccaagcaggagagtccacgcgcctatgggcccgctgtcagggctgcggcatgcgagtgcaagttttgtgatgcacagcatcccatctggccgggtaaactggtgcagagttga

SEQ ID NO: 236 - DNA, 933 bp, Chlorella protothecoides
atgccccctgggggcgaccccccaccgccccctccctcgccctggcaaaaggtactatacaaggagcagccatggcccgacaactacaccagtcccgccttcctggaatcccttgtcgtcaacgaccgtgtgccggtgcggagctacgcacgagttgtgagccaggcttgccctgtccttgagcagctcgccaccgtctgctgggtgggcgcactcacccacaatttatacaccgcaccctggacgtgccacactgcatctcgcctccttcccacaccctccttcactcgacttcctgttcccctccgtctccaccccccctctccgcccaccccatccctcgcagggtcgattgacgagcacgggtctcctgctgcgctgcgccttgttctccaccgccggctgggcactgatccgcaccctcgcccccgcccccgcccccctgcccgccgacccgcgctccgcggcggccgcgatgctacagctggccgccgccacggcgctgatgagccccctgtactccacgctcaccctctccatctcctcggacacggtgctggcctgcgtcctgggcctggccctggcgcacctctacctcgccgactaccgcccggcgtcctccggccccgcggcctccctgcagggctccctcagcctcgccgccatcctggcggcggccatcctggtggcgagcaggtgggcgccgccggcgccggcgcgcgtgccgcgctgacggcgggcatgctggcgggggcgggggcagcggtctggggcgcctcgcgccacgccggcgccctcttcgcgctggttgtagttttcctgggcgtgctgtgcccgctgtggctggggggggcccacaaattcaaggccaagatcaatgggccctgggacgaggccgtgccacggctgggccaggacatgagggaggcgtaa

SEQ ID NO: 237 - DNA, 978 bp, Chlorella protothecoides
atgcaaggagtcgtcaaatcaggcattgagacagcccaacatgtgcatttcatggctgtggctgcaagttacattgatcggtggggtgtcgggacttcctatcgcaggttcaaattggggcgcgcgggcgcgatgattggagttcttcttgctgccttgatgccacagcaaatggaggcaccgtcaagcgcgccggctgcagaaccgcagtttctcgccagcggcaccgggaccgaaccggcccagccctccgcaacaggagacggtccatccacgagcaaagcgcagctgattctcactctgggaagagtgaagaccctgatcaaagaggacgctgatgtcaagtttgtttcctcagaagcttacttcgcgattgccaaggcgacaaggcacagctggggtgatgtacctgctgtctctggcaaacatcagaccgttcccttccctcctggcgcacgctccagtacctcctcttgcccacaccgcctcccaggagctgcttctagaagccatgacggaacgtgctgctcagccaatgctccagtctggacggagccaattggggtatggcgatgtcgcccaggcggtctccagctggcagtcgctggacttcctcggggacgttatcccgcacaagatccccgccggcgtcgtgctacagaagatgctggccgccaaggctgctgccgccgtggcataggcgtctcctctatggagcagagttgggggtggtgccctttccagctttgtgtcccatgggcatgctctcacaagtggatgctccacatactaccagccccaaacgtgatggaactgggaccaagagcctcccaggcttgtccttggcctctcttgaactgccatgactctgcaggcatgcaactgcgtggggcatccctgctctgtatgtgcggactgctcaagtatcatgtcaggcctctgaaggtgcttgagctggagcacatgcccatgccttaa

SEQ ID NO: 238 - DNA, 294 bp, Chlorella protothecoides
atggacgtgctggcgcgcacgggcgccgcccccgcgccgcgcccgcgcgcgtccttctcggcgcgcaacctggaccaggacctgcagcgcctgctgctcccgggaaccctggagcagcaccggcatgtgctggaggggcaccatgcctccgcggccctggccggcgtgctggcctttggcgagctgctggccgacgggtcggggcatggcaagtacggcctggaccggctggacctgggcaagttcatgcgcatggatgccgccgcccaggtgggtgggcggtgtgggtggtga

SEQ ID NO: 239 - DNA, 372 bp, Chlorella protothecoides
atgccacccggcactgccacccccggcttgcatgcaggtctgcgcacggtgggcctggcgtacgtcgaccccggggcacgcgtgctgaggacggtcgagttcaccgacgacgaccacttcaaccacctggagagcgccctggtgcagctgggagtgcgcgagtgcgcggtcatcaaggtgcgcatcgccctgtgggtgggcgctggagggtttgagtcaggcacacccgctgccagattctcccggaggttttctgtactcctcatgcaagcggcagtgcgctgcgcgcaccggcgcctcgcccgcctccccaacatggtgcccaactttcaacccccgccccccaaaaatgcggcaggacacggcgtctga

SEQ ID NO: 240 - DNA, 285 bp, Chlorella protothecoides
atgccggaggaggcgccgctgttggaagtgtctggcgtagaccagtctgcatttgaaaactggtatgcatcgctgccgcaggtgaggaggctcccgccatgtggtgatatggagggaggggcgtggcaagctggtctggtccgcatcttcgaccgcaagtcatgcttgtctgtgcatggcgaggtggcctacgcgcttgccaagcacctgtatcgcagcactgcccaggtgtcccgcagcggtgtggcagacaacggccttccaggtgagcttgaagctgtctga

SEQ ID NO: 241 - DNA, 645 bp, Chlorella protothecoides
  modified_base (399)..(408): a, c, t, g, unknown or other
atggagtatgcacggttcattcaggtctctgcactgactcccccttcatcgctccttgctgtagtcgtataccccccgccccgccttcttgcccagccaccctgcgtccacgtgctggcgcagcagggggcaggggcggtacttgtcgtcccccagcccgctgtgcaggacctgcatgatggacaggcaggtgtccagtccgatgaagtcggccagggccagcggccccataggcacgttggtgcccagccgcatgccacggtcgatgtcgtccgcgctgcccactccctgcgatgtggggtgggagggagtggtgggtggtgccagaagctggaacccatgggcatggctcacgaagctagcgctgggccggaggcactggtgccttgcatgcacagnnnnnnnnnnggtgcccagccgcatgccacggtcgatgtcatccgcgctgcccaccccctgcaatgtggggtggtagggagtggtgggtggtgccagaagctgggacccatgagcatggctcacgaaaccagcgctgggccggagacactggtgccttgcatgcacaaaggcgagtcttcatcatcgcgcctcgccccggattactcgtccagccaccggcctcccaccctgcccaagcggatgtag

SEQ ID NO: 242 - DNA, 438 bp, Chlorella protothecoides
atggaccagaaggaggaaatcctgcgttttgccatcgattcgcgcttgtcacgtgggttcgaccctagcacgaacttgccaattgatccccccaaatttctaatctcagtggacctcgtttcgcagagtactacagtccgtttctgtatcacatctgactgcaaaaataatttacctcttgagtcctggtatctcagtgcccgtgagtactcttgtccgacccttgagcgcatcaccgccatgccgaccgagacaaagatcggcttcatcggcgcgggccagatggccgaagccctggcgcgtggcttcatcaaccagaacatggtggaagccgagcatgtcttctgcacggaccccgtggaggctcgcaaggaggtcttccgctccttcggcaccgttcccgtcgacggcaacatcgcggtgggacggagtgcatga

SEQ ID NO: 243 - DNA, 546 bp, Chlorella protothecoides
  modified_base (68)..(77): a, c, t, g, unknown or other
atgctgccgccgtggcgggggccggggatgacgccgtggcggagcagctggccagccagctggcagcnnnnnnnnnnctgccagtaccaggctgcgcgcgagggcagcggcgcccatgctgccgccgcggcgggggccggggatgatgccgcggcggagcagctggccagccagctggcagccctgcaggccacgccgggtggcggcgacagcgtggcagcggctcatggaggtgcagccgcccccgccgccgacttcgagtggaggggcgcaaagttcccggtgcccgatgccaggacgcgaacggccctccaagcggcccaggagcgggagagggagctggtcgccggccaggcggacgccggcagcctggagaagagggtggccctgtccgaccgcgtcgccgccgcttatggtgacgcgctgtccggggtcaaggccgcgctggccctgggccagtccgggtcggtcgaggagctgcgggcgctggagcgggcggtgcggggccgggtgctggacctgacgctgcggcggtattcgctggta

SEQ ID NO: 244 - DNA, 573 bp, Chlorella protothecoides
atgttgaccccttcccccgctcaaaatccctggcaggaggctgccggccccaaggccaagatcatccgggtgatgcccaacacgccctgcctggtgggcgagaccgcggccgccatgtgcctgggccacggcgcgggcagcgccgacgccgacctcctccagcgcctgttcgagtctgtgggccgcatcttccgggtggacgagaagctgctcagcgcagtgacggggctgagcgggtcgggcccggcctacatcttcctggtcatcgaggctctgtccgacggcggggtgcgggcgggtctgccacgcgatgtggcgcaggccctggccgcccagaccgtgctggggtcggccaagctggtgctggaaaccgggaagcacccgggcgcgctcaaggacatggtcacctcgccggcaggtgggtgggcgggcggtccgcatggcgagggtgccgaggcggccagcgggtcgggcagggcccgggggcggccaggggggcgggcagggcccggggttcccaaacgtgaaggtggtcgcctgcagggctgctgcctccccctaggcggcccgtag

SEQ ID NO: 245 - DNA, 267 bp, Chlorella protothecoides
atgcagccggtcctgcacagcggcgctcgcatatgcatgcgtggagatctgccgggtagagcaacaacccgcctctgctccacgtgcgcccaggtggccgaggccgcggaggtcatcttcatcgccgtcaagccccagtacgtgccggtggttctgcgcgagatcagccccaagcttaccgagaagcacctcatcgtctccatcgccgccggggtcaccctggctgtcctcacggtgaggacaggggagttggatctgggcagctga

SEQ ID NO: 246 - DNA, 702 bp, Chlorella protothecoides
atgcgctcaagggtcggacaagagtactcacgggcactgagataccaggactcaagaggtgaagcccagcctctctgccggcaggcagacagccccactctcgacacactggcgacagcgtcggcgtccacggtatgcccatcctgtggacatgcccactcagaccctgcatcctgggaggactttggcgcctgcgatgcgtgcggccatgttctctcgggctccgactctgccctgttggcggagcttacatggtgtccgagggggcatggaccgctgggccagcacctacggccgggcgaggacggcaccaccgccacgcacatagtcccgccccagcatcgtgtcctcagcagtacaccgggccaggctgcccagaggacgcaggctaaagtcaggaagcggctggcccagctcgcccctctgctgaacctcccatccgccgtgaccatcaccgccgagggactggcggcgcgtgctgccaagctccacatccgcggtctgacctcgggcgccgggctggcagccctggtgtacgctgcctgccgcctggaggctcagccggtctccatcgccaccgtcgccggcgcagccggctccgactccacccgggtgggccactcgttcttggcgctctccagggtgaggcgcctagggatgggggggccggaagaccccctcatgctgcactgtgccgagtga

SEQ ID NO: 247 - DNA, 606 bp, Chlorella protothecoides
  modified_base (145)..(154): a, c, t, g, unknown or other
  modified_base (440)..(449): a, c, t, g, unknown or other
ggcccattcggggaggaggcagccctggctcctcgctcacccgacaatgcgggcacatccggggcggcctctgatgtgcaaggcaggaaccctggccccatcagcgaccccacttccccgtccctgctcaccacccacccctccnnnnnnnnnnccatggcccattcggggaggaggcagccctcgctcctcgcttttccgacaacgcgggcacatctggggcggcctctgatgtgcaaggcaggaacccctggccccatcagtgaccccacttccccgtccctgctcaccatccacccctcatcccccgtggcaggcctggggccgacgctggagttctacgcgctgctggccaaggagctgacggcccctgagctggggttgtggcgcggcgacggcggcggcgacgacagtggcgcggcgcagcccggcggcgcacnnnnnnnnnngcgcggcgacggcggcggcgacgacagtggtgcggcggagcccggcggcgcatctggaaagcggggccagggtgcggccgggggcgacattgcgcggcgggcgggcctgttccccgcgcccctgcccccgcgcgccgcggacgccgaggcgcgctgc

SEQ ID NO: 248 - DNA, 378 bp, Chlorella protothecoides
atgtcgaagcgcgctgcctggtggcttgcgtgcctgttggtggcggggtactggcaacaggctctcggagctgcgcagccacaccagccgttcctgcacgcgacgcgccgatctgctccacatcgccatgttcccgtccacgaggggtgcgccgtaattgccaatggccctgatgccatcgtattcagcgccaccgaatgcaaaggggccgtggcgcatgcctccttccagcgcggcaagcacacccgccacggctggtcccagtttagcgtccataccttcaacaccaccgacgatctgacccagctccgcgccgccggcttcctagagggctacttcaccgcccgcgagatccaggcggtgaggcgctggcgttga

SEQ ID NO: 249 - DNA, 330 bp, Chlorella protothecoides
atgcgtgcgctcttccacagcctggtggagcagcggccggcgcgcgtgggcgacaaggagtcgtgcgacaactgcaaggtcgtggtcctccaggccgtcgccatcatccaggtcggcgcaggggctgtgaatggggcgaaccccaagactcaggcggacatcatcgagtacgccaaggagagctgcagcatgttccccgactggcaggattcctgcgaggcgtacgtcacgctctacggccccatcgccatcaacatgctggtcacctacctccagccccagacggtgtgctcggagctgggctactgccccccactcagcctcgcctga

SEQ ID NO: 250 - DNA, 1494 bp, Chlorella protothecoides
atgctggtgatcaagaccctgcggggccagcggtatgaggtggtttcggaggaggcccccaccattcgtgatgtgaaacgactgctggctgtgcagcatggcgctccctcactgcaattgttttacaagggcatgcgcctgccagacgaccaagccattgccgacctcaagctggggcccctggacactcttgcggggatccccagtcgaggggcaggtcgggtgcaggcggaacccaatcatcttgggaatggccagacagccagcccctgccctgcagtgattcaagtgacgagtgagccagtctgtgagatacctggcgactctgccacagctccggcctcagcctccccgcctgcctcccccacgtcgctagacacattgctgcccgggtacctctcccgccccggcgtttcccccgccaagttgctgcggaggtctgtggggcccggcagcaccgccagcgcgggccatgccgtgagccggtcagcgccttggcctgacgcccgcccttcaatgggagaggaactgcggcgccacgccagtgaggcgggcgaggccaaactccaagcggaggaggggtctggctctggcccccttggcgctaatgcaggggaggatgctgacgtggaggctgtgcgtgctgagttgagggtgcagggcgtcgctttcatgcatggcggtgcggccggcgacgactgccccaaagaggcatccccggaagtagggttcagccgagagaccctgttgcgagaaccgaaccagttgagtgacgacgaggccgctgcgccgctcgccgccgacccgtttgacaacagtggcaaggtcagggatgcggagagcgctgcattgatcgccgccatgatggcattggctgcgaggagcccaggcctcctggaggggatttgctttgatcttggtgcagagggtcgggaggattgcgggagcctgaggatgatgacgtgtgaggatcaggtgggcctggggatcctgagcttgtttcattataaagcacctttgcaccttacgaatcgatcctcacctggtcgcctgcctgttcttccacagccgtcatggcggagggttgcagccggtctagcttccctgcagcttcctggaaacatcacgctggaagatgtccaggccatggctaccatctgcccggatgtgctgtccctgcacacccaccatcggtgggtgggtgctctgaacaggggatggttgcgggaacgggctgggtggcttcaaccgcccagaatcttgctccagcatcaacacccgcctgcccattctcttttgtgctccctgcgtcaggctgagagaacaggatcaggtggacggctggaaagggacgcgcggcagcgaggcgctcaccgccatgcaggagagcctgggcgccgcccgccaggcagaggcagcgtctggcgaggcgggggggtccattccgaaccccatgcaggcatgtggatgcttcagaagacgagggatggatga

SEQ ID NO: 251 - DNA, 321 bp, Chlorella protothecoides
atgactagaggacgagatgacagacccagtcctggaaccccccccaatcccctccccccaggcggcatctatgtcgggggcaaggacatctcgcatgtgacccaggcgtcgttgcgtgccgtcatcggcgtggtgccacaggacaccgtgctcttcaacgatacagtgcgatacaacattgcgtacgcgcgccccgacgccagccaggaggacatcgaggccgccgcgtccgcggcctgcattgacgaggtgatcaagaccaagttccccatggtgcgtacggttaggaaatgggggttgttggatttgggggttgttgga

SEQ ID NO: 252 - DNA, 366 bp, Chlorella protothecoides
atgcagcagctgtacgcgccgctcaacttctttgggacctactaccgagtgatccagcagtccatgatcgacatggtgagggcggcttggaggagaagagatggagcgctgggtggcttgagggcctcgtactccacttcaaccctccaaacccacctgcccgcaccgcaggagaacatgtttgagctgctggccaagcagcccagcatcaatgactcgccaggcgccaccgacctggctgtgactcagcacgacgtcagcttcaaggacgtgtcctttgaggtgggtacggatggagcggcgagatgcgaggcggtctgtgggtgttgcgcagggcggagctgccctccgacgcagcctgggtag

SEQ ID NO: 253 - DNA, 477 bp, Chlorella protothecoides
atggggcccctgcaccctttgccgcccgaagcgagtgctgcgcttgagtgcgacaatccctgcctgctggagagcctcccgaccgccgggacccccttctatgcctggttcgactcacaacagcagtgccaggccagatcgctgctcgccctcgccgcgcagggcggggccgctagggtggtcgcggctttgctggtgctgcccggggcacgggaagcggcccgcttgccctcccccacagacctctgcacccccctgcacgatgcgtgcgccagcccaggacccggtacacaccgtatcatcgcatccctcattgccgcgggggccgacacgcaggcccttaatgctgccgggcagcggcccggggacctcctgacgcaggttcaggtacgggttgccggctttgcaggggcgccgcgggcgcgccagtcatgcggcaacaccatgtcctaccaccagcaaccgattcatccctaa

SEQ ID NO: 254 - DNA, 501 bp, Chlorella protothecoides
atggctgttgcccctttgccggttccagagatggaaattcccgaacccgcttcaaccgagccattcaagtggactgccgggaagatagttttgagcatattcctctttctggttgcatcagtggcagaaatcggtggaggctggctctggtggcagactctgcgggaatcaaagccctggtggctcgcagttctaggttcgggcgtgctcatcctgtacggcgtcataccaacctttcagcccacagacaattttggaaggatctacgccgtgtacggtggattcttcatcatcatgtcatacttgtggggctgggccgtcgacaagcagcgccctgacactggcgattggattgggacggcgattgcgctcgcaggcgtactgtgggtattgcctagcaggccctcctcgtatcactcttgcagtccgcacattgttcatgtgtaccctattctatatgcccggcatcttgtcaatggctttgctcgccctccccagtaa

SEQ ID NO: 255 - DNA, 624 bp, Chlorella protothecoides
atggtgagctcgccccgcctccaagggttgaggggcctgctgccgtgcactgcttcggcacctcacacaaccctgatccccctccctcgcagtcggccgccgcgtacatcgaggagcacaacatccagaaggtcgtcgaggaggtcatcaatgccaccatcaaggccaagccctccaaccccttctccttcatggtgcgctgaacccccggccggtattgacatgactgcggtactgctccccagggcggacaagtccgtgcatgcaatgatcgcgtatgattcattccgagcctcgcacatccgctgggcgcaggctgacgaggtgcgcaagcaggcccctgctgccatcaccgccgtgcacgcccgccagatttacgattcccgcggcaacccgaccgtcgaggcggaggtgaccaccagcctgggagtattccgcgccgcggtgccctccggcgcttccacgggcgtgcacgaggccgtggagatgcgcgatggcgacaagagcaagtacatgggcaagggcgtgctcacggcggtggccaatgtgaatgacaagatcgcccccgccgtcatcgtgagcctagggtttgggggtctgatgatgcacgcgtgggagtggtga

SEQ ID NO: 256 - DNA, 273 bp, Chlorella protothecoides
atggccactccctgcctgccgggcctcgtcattcggcctgcaaccgacaaggacatcgacaccatcgcgcgatatggggctgccatcgcacaggagaccgaggacttgacccttgagaccaaggtcatcaccgcaggggtttctgccgcaattgcagaccccagcaaggcacggtatctcatcgctgaggtgggttacagctcgagggtgtggggtcggggcgggcaaggatggcctgggaatgaccggcactgcttctcttcagccgcgtga

SEQ ID NO: 257 - DNA, 267 bp, Chlorella protothecoides
atgccccaccacatcaatccgtgtgctgcctgcaggcggaatgcagagtactggtggattcacagcgtctatgtggttcatgaccaccgcgggaccggcactttcaaagccatgtacgagtatgtggagaaggaggcgcgggaggctggtgcggcagggctgaagctgtacaccgagaccaccaacgagagggcacagaaggcgtacacgaagatggggatggagaaccacgccttggttttcgagaacgtctggctgaagcactga

SEQ ID NO: 258 - DNA, 1095 bp, Chlorella protothecoides
  modified_base (30)..(39): a, c, t, g, unknown or other
atgctgccgggatcctcgtgcgacgcaccnnnnnnnnnncttcgggttggaaatttgagaggttatcaacgagccttatctgtatctgggagcattcttctaggatttatgctgccgggatcctcgtgcgacgcaccgtgtggaggagcaacgctaccctcaagagtcctttcccatcgctcgcggactgggtcgagcgtaggagcgcgtctgggaataaattgcaaccgttccgctaatggtttgtcgctcggtattttgccccggaagcatgcgagctggcaccgcctcaccggttgttttgaaaccggtctgttgtttgcaatccaaacatcgaccgcgcgcgcgcccaggcccctgaccgtcgccgtgtctctgctgtgtcggaggtctgtggtcgcagcaacgcagtccctctccctgggaccagcgcccagtctggcgcacttcctccatagatacagcacagagacgaatgtgccatctacctccagcagcgacgtgtacgtttacacatcgccgtacggccccacggttcggaatgtgaaggtatgcatggctgagttgttgagcaggtcttggggccggggacctcgggcattcgaggtggaggactacacgcgggaccctggcacccagggtcccatcttgaggctgagccttttcagctgcgcctgcgccctgggggccggtcccatcatcctcggcctggacagcggcatgaccctggcagccaagggaagcatcgccgccacgctgggcagctttggcgccttcaccaccggcctcttgcactggttcgtgtccccctacgtccagcggctggaggttgaccgtcgtaccggcggcgtgcgcgccgagacgctgacgctgtggggtacggaccggtgccatgccttccacctcagcgacgtgagcgccgtgtcgggggggcacccgctcacctccttccaggccctgggcaagacgttctacgtcgacccgtcccactttggcgacaaggagctgctggcgcgcctcgcgccggaggccgccgccgtggccaccggggcggcggccaaggaggagatcgagcacgtcaatgggatgcgatga

SEQ ID NO: 259 - DNA, 666 bp, Chlorella protothecoides
  modified_base (622)..(631): a, c, t, g, unknown or other
atgaaggtcgcatgcatgcgagggatcagcgatccaaccccccaatcgggtgcacctcattattttgctcatgcaggtttgaatagggccgctgggcagcatgggggaggcagtggtgcccgccccaggccctgccagcccctcctcgctgctgctgtgcccttctcggccggtgccacggcagccaggcccctgcagccgccccgcatctgcatccttggtggagggtttggcggactgaacaccgcagtgaagctggacggtctcgtgtggcctgagggcaccaagccccaggtgaagcctggcacatgtggctggcatctggatgggatgcagatcaccctggtcgacgccaatgagcgctttgtgttcaagcccctgctgtacgagctgctgtcaggggcggcgggggaggaggaggttgcccccacctttgagaagatcctgcgccccacctccgtctccttcgtgcgtggccaggtggagagcgtgaacgacggccctgccaccggtccagagagcaagttgcctgaggtgttatatgctcgcctcagccgtcacccctgtgcttttatcacccccaccgactattgtacctcatgtctccctccccaaccgcccnnnnnnnnnnctgctgggatgagtggtagtatggcatggttgtga

SEQ ID NO: 260 - DNA, 1290 bp, Chlorella protothecoides
  modified_base (257)..(266): a, c, t, g, unknown or other
  modified_base (646)..(655): a, c, t, g, unknown or other
atgtcttggagaagaccaggcaccccaaggtcgcatacgtcgggcactcccaggtgtggaggtgtggtaaaaggggagctcaccaggttggcggcgcctcctcaatgctcaagacaaggcgctccccctgactatccactggtaggggtatgcgcagtgcacctgcgcgacagcagagggtcccaggagagacttgaatccgtcatgccagtgtgtgagcttgttcttcccctccccactgtcagggggcaacccannnnnnnnnntcaggagagacttgaatcaggcatggcagtgtgtgagcttgttctttcccctccccactgtcagggggcaacccagatggtagccgcctccagtcgccaccccgagctggcggagagggtcagcctggcggtgctgctggcccctgtcctgagcatgcagcgggttgacagcctgctctggaacttcctggccaagttgaatgtggataggcttctggcgttgtccgggctggcattccgcattgggcagctgccaggtgtattgcgatgctacagaatggcgcgtgtatcccgtccttccatgtcctttctggtccccacatccactctgcctgaccgcagttcctgtccctcgtccacagtccaacctgctgtccagnnnnnnnnnncattgcgatgctacagaatggcgcctgtatctgtcctttcatgccctttctggtctccatatccactctgcctgaccgcaatccctgcccctcgtccacagtccaacctgctgtccaggaccgtgatccagctggcctgtccctctggcgggggcctggagcccatcctctgctcctccatcctcacgctggcctgcggcttcaatgaaaaccagctgaacatgacgcgattcaaggattacgtcaagtacctccctggcggcaccagcatctacaacgcccagcactggctgcagctcctgcgcggagctcgccgcctgggccgcccggtcttccagtcgtacagctggggcgatgactgcccccggcgcccacccttcttctggtgggagccgggaacctgcaacgcctggtgcgtgtctgggagggtggcggctgggatgtggagaaaggaggggctggagtgggggaccctgatggggctgttggaagacagggttttaaagacacggagcctggaactccaggtgcctgaggaatcgcattggcgtaaccagaggaggagtgcagtaaggccgagcgcagtgctggccccttcctggagcatcacatccatctctgctggctgtccgtag

SEQ ID NO: 261 - DNA, 579 bp, Chlorella protothecoides
  modified_base (347)..(356): a, c, t, g, unknown or other
atggacgggcgggaggcgcggcggtacaacttccactacgactggcgcatgtggacggtgccggacgtccgcgagctcctgcgccaggcggggttcagcaccacctacgtctggatacgccccatcaagggaggggcccttaaggtgttgaattctagcagagtccttggggaagatgcagagcagaacttgatgagcaggagagcggcagggcagcaaagggtacagggcgccgccgatgctcaccggcaccacaatctcatcctcatcccccaccatcacaggatgcgtctgccggggacggtgggcgcacgtctgatacctcgggcagccaggaggcctcgggnnnnnnnnnnatctcatcctcatcccccaccatcacaggacgcgtctgccggggacggtgggcgcgcgtctgatacctctggcagccaggaggcctcggccagcgactccgaggagtcagagggcgaggctgactttcagccacatgaggatatagaccctgaggcacggcagcggctgcagcgcggatggtcggcctacatcgtggcagtcttggcgccgcagcctggctga

SEQ ID NO: 262 - DNA, 1017 bp, Chlorella protothecoides
  modified_base (565)..(574): a, c, t, g, unknown or other
  modified_base (648)..(657): a, c, t, g, unknown or other
  modified_base (929)..(938): a, c, t, g, unknown or other
atggcgccccagtctcggaaggcgccacccgccgctgcatcaccaaagtcaccgatcctctcacccccttcaacacgcacaggggcgctgggcggccccgtagaggtcatcctgcacctgaccccggtcatgagcgccaccctaggcgtcgtcagcctggcgcacgagcagctgtggaatacgttgccctccagcccctactttgccggctggggccactgcctgctcaccgccggcatcgtggccacgggtgccgtcatcgccttcctcatggtctgggctgagtttgcactcatcggccacacctccgccctcaccttcatggtggccgggaccttcaaggaggtggtcaccgtggccgccgcggtgctcttcctgggcgagcgcttcacccccgtcaacgccgccggcctcgtggtcctcatcatcggcgtggtgcgcgtgcttgttcgtttttgtgtgtgttggggcccagggaagggaggcagactatcaagggaggggcctgcggcacatcacacccaggaagctgcggcaaaaggggctggtggtggtggtgggcgtnnnnnnnnnncatcggcgtggtgcgcgtgcttgttcgtttgtgtgtgtgttggggcccagggaggggaggcagatcatcaagannnnnnnnnnctggcaaaagtacaggaagctgcggcaaaaagggctggccctggtggtgggggcggaggacgaggagatcggctccctgccaaagggcgcagcactgggcggcggccctgccaccggcgcccgcggcatccccgccctcggctcgccctacggcgacaggtcggaggtggtggacggccaagcgaggcccggcaggcggagagggggcagcatatcgccggtggccacgcacagagcactgaggatggggtccatgtgagctccggaatggnnnnnnnnnnggagagggggcagcatatcgccggtggccatgcacagggatatgtgaggtggaatgaagtacatcaccaccaccactga

SEQ ID NO: 263 - DNA, 498 bp, Chlorella protothecoides
atgctcgcagtgttccccaacggcgtggcgacggggctggacatcggcctgtccaactattcgttggtgttcatcagcttgtcattctacgtcatgtgcaagtccacagttcccctgttcctcctggcctttgccatcatgtggcgcatcgaaaagtgggtttttgggtcgagctgcttgcacgtccacggttcccctcttcctcctggcctttgccatcatgtggcgaatcgaaaagtgggtttctgggtcgagctgcttgcacgggagcgccccggaacgacacccgtccctctcccctctcttatacaggccctcctgggatctggcgggcgtggtgtgcgtcatctccatcgggctcatgctgctggtggcgggggaggtggacttccacctcgtgggcttcctcctggtcatgaccgcctccgctctggccggtctgcgctggaccatcacgcaggtcctcctgcagggcagcaatgccacggggcatggtaa

SEQ ID NO: 264 - DNA, 1140 bp, Chlorella protothecoides
atgatgggctggagctcgacctcatcgaggccctgcccggggccggccttgccattcatggtgcggtgcaagaccgtctcagctcatgcccctcggtcccacatactctcatgcgcggtttgtactggagcggggcagggcagcgtgcaggggtggtgggcagggatctgcccggggctagcaaggcccccaactgctcgagcgcggccagacgcccaaggagtgccgggaggatggtcgccctttcgcgcaggcgtagcgcgctcgaaacttgcctctggttcaccgtgccacacgagttcgtacagcacatcccaccctccccttgtctctgcctttgcacccgtggcagtctcacacacgtctgcaccagcagcctggcactcaggccttgacacggcccagggaccgcgccttctcctccgcggtctggaagcggccgttcccaaacttggaggcggtgtcgatgaacttcagcttgatctcctccagcgcggagcgcttggtctgcgcgaagagcgtcttgcgcagcgtgatcacacgcttcttggtaccgggcaccgcgcccttgatcatgacgtagtcctcgttcaccacgccgtaatgcgggaagccgcccaggggggtgatgtccttctccgtcacgtcgtgctcggtggtggccaggtggctcgcctcgcccttcacgccgatgcggtacaccttcttgttcatctcggtgcggtggttgaagcccagggcacccgcgcgcgccacggtccagcccacacgggccgggtgccaggcgccgatgcaggccaccttgcgcagaccgcgatgggtcttgcgcggcaggcgggatacgccccagcgcgtcaccacgccctccgtgcccttgcccttggtgatggcgatggtgtcgatcatctccgactgggagaaaatggaggagacggggacctcgcgctcgaacaggcccaccgcaaagtccaccttggccgccacgtcaccgccgttgacctggatctccatgacgtgggccttcttctggcccacagacaccttgcggatctgggtgtgggcgatcacgcgaatgacagaggagtgcttcttcagctgcaaggtgtgttgagaaggggggggtttgtggagggggggtga

SEQ ID NO: 265 - DNA, 933 bp, Chlorella protothecoides
  modified_base (776)..(785): a, c, t, g, unknown or other
  modified_base (856)..(865): a, c, t, g, unknown or other
atggcgatggttttctgccttgatggggtctgggttcagggttttttaaaggaggggcaggatatccctggcaggggcccgggcgcgactaaggcgatgggttggagagccaggggcccgggacgaaagcacgacaatccaccgacctcgtgccggccgcccagcacttggtgcgcaggagtgccggcatctgtccttttcacccggacgagcaccatgtcgcacaggaaggtgagcttccaatggacttgtcggggtgccgcctcaaaggggctcgggccgggcgggccccctgggtgtgcggcctcgggccactgcgggagggggcgactgggtcccgtggcgggccgaatcggtgatttcgaggctccccgccacggccacttgggcttcctgcccaagaagcgctgcaagcgcggaaagggcaaggtgaaggccttcccccgggatgacgccaccaagaagccccacctgaccgccttcatggggtacaaggcgggtatgacccacatcgtccgtgacgtggagaagcccggctccaagctgcacaagaaggaggctgccgaggccgtgaccatcatcgagaccccccccatggtggtcgtcggcgtggtcgggtacgtgaagacccccaccggcctacgctccctgggcgccgtctgggctgagcacctgtccgaggaggtgcgccgccgcttctacaagaacttctacaagagcaagaagaaggcgttcaccaagtacgtgcgcaagtacgccgacggcaagaaggagannnnnnnnnncgtggtcgggtacgtgaagacccccaccggtctgcgctccctgggcgccgtctgggccgagcacctgtctnnnnnnnnnntcgaggctgagctggcccaggtacgaggcgtggggtgcggtgggttggcggacggggatggaggttga

SEQ ID NO: 266 - DNA, 918 bp, Chlorella protothecoides
atggaggtcccagcaggtcaagacggcatccagcgcctgcttgcttccgagaaggaggcccaaagcgtggtcgcgaaggcccgcaaaggtacggcccgggcttgcgctctgttcacaaccggtttcatattcatgttgggtgctcgcgcatggacagccctcgacgtgtctccgatcgctccacgcccctcccctcgacgtgtctccgatcgctccgcgcccctcgtagcgcgcaccgatcgcctgaagcaggctaaggacgaggctgacagggaggtacaggcatacaaggcacagcgtgaggaagacttcaagcgccggcagacagaccctaaacctccctccacgcaggactcttcagcctccgaggagtctgcgcgcaagctcattgaggaggcggaggcgactgtccggtctgtgcagcagtctattcaggacaagaaggaggatgttctgaagctgctgctcaagcatgtgaccacagtgcaaggggggttgggtgcaagcgttgcgagcgcacgcgcactggcagggaaggcccagcagctgcgccaccgagatgtcgcgctccgcagccacctgccgcagcgtgcgcatggcacgcaggccctcgatcgcggccttggcgttgttcaggggattgctgccgccaacctgcttgccgaaaccgttcctcacgcccgccagctccaggaccaccctcacggctccccccgcgatcacgccggttccctcggaggccggtcgcaggagcacctgcgtggcggacgagcagttgcgatcgagcagttcaaggttttgggtgtgcactgggcagaagttgtgtttcagcatgcacgtggagtgcagctgaacgaggtcagactgctcgtcaactctggctcatgtatatatagcagggagctctctcatggttga

SEQ ID NO: 267 - DNA, 699 bp, Chlorella protothecoides
atggtcgggggatggtcggattctgcgcagcacagcaggcagagcacgttatcccctgctcacctaccactccttccaggcataggcagttcccacaccagcaccccgtctgtcgccatccctgtagcttgtgacagcatggcgcccgttcttcaagccacgatgtcggtgtgtggactggctcccggccatgcattccgtccccagagtgcgctgccccggcaccctagccatcgcggggtgtgctcgccgatgcgaactcacgatcagcaccactccgtggcgtttcaaagacccatcgtgaccatgcgcgcgggccggggccccgcgcagagccaggacgacaacaacgacgacgacggagagtctggaccctacgtgagggacacggagtacgaggagcgcgtcattcaagtccggcgtgtcaccaaggttgtgaagggcggcaagcagctgagcttccgtgctgtggtggtggtgggcaacaacaacggcacagtgggcgtggcatccgcctcggccaaggaggtggcacaggcagcgcagaaggctgtgctgaaggccaagcggcgtctcatcaccgtgccgctcacccggaacgccctttccgtgccccatgcatttgacagctacttcagcggtgccaaggtgcgaggccttgtttgggagttgtcagcctgtgctctgcctacttgctaa

SEQ ID NO: 268 - DNA, 2457 bp, Chlorella protothecoides
  modified_base (1132)..(1141): a, c, t, g, unknown or other
  modified_base (1819)..(1828): a, c, t, g, unknown or other
  modified_base (2248)..(2257): a, c, t, g, unknown or other
  modified_base (2343)..(2352): a, c, t, g, unknown or other
atgatcaccagtgattctgagtcctgcatcctccagaatggggcggggtgggtccttcctgctgtccctcgtgtcggtggctctgctcggcgtccaggccgcggcactgaaacaggactgctacgaggccgggagcatgtcccggtccggcccacgactctcgtgctacaacgccttccgccaccttccccggccccttccctccctggcccacaggtcaagatttctgccatccacgcccagcaccccgatgaacccgtgctggaggtgtacggctaccccagcgccatcgggcgggccatacccgcctcccccaccggctccatgcacctggagctggcagccccgccccacgcctgcgccgccgtgtccccgcccgcgctccccctctccgccgccctggtgtcccgcggcgagtgcgacttcgtccagaaggccctggccctggccgccgcggggtacagcgccatgatcctggtggactccgcccccggctgcgtgttcatgtcggccaacgacacggccgccgccggcgcgctggagatccaggccgccacgatcacggccgtcgccggacggcgagtgagggacgccctctgcgcttctcccgcgggcctcgacgtcggcctctgggcgcccgccccgtgcggccccgacctcgccggacccctcctctgggccctggcggtggggtgtgtggcgctgggctccgcgctggccgccgccgcgcagcgccgcgccctggacgccccgccgcccaaggacagcgacagcgaggcggagggcccgcgggcgcgggccgaccccggcttcgtcgtctcacgcgtcggcgccggtggcttcgtggtggtcgcctccactttgctcctcctcttctattacctggacgatgactggctggccagcctcctgacgttcgtgttcatggcggcatgctggtcgccgctggcagaggccctggcggctgcggtggagctcgcgctctggcgcgcgccgcgcctccgcgcctcgctgaacgatccggccccgctgcccctgctcggccccgtcgggctgctgcaggcggtgagtgtcgtggcaagtgtgaccacgatcgagatgtggcgggagcatcgtgacgcgggctgggccnnnnnnnnnncttcggccccgtcgggacgccatgggcgccgcgctgctggtgtccctgctgcggaccgtccggctgccggacctggccaccgcatgcatcctgcttcccctggccttcctgtacgatgtgtggtgggtcttcctccagcccctggtcaccggcggcccctcggtcatggtggaggtggccgggggtggcgccggcgggccccgcttccccatggtgctcctggctccgaccccgggactgggggacaaccccgccatggccatcctgggcctgggcgacgtggcgctgccgggcctcctggtcgtgctgacgtggcgctgggatgtgacgcagcgcttcctgggcgtccggccctcccactacggcccctgcgccctggccgggtacgcggtggggctgaccgccacgtacgccgcgctgcgagtcggcctatttggcgacgcggggcagcccgcgctgctgtacctggtgcccagcacgctgggcacgacgtgtgcgctggcggcggcgcgcagcgagctgggccggctctggaccgcggacgtcgacccggagagcctcaggagcggtggggggccggcaggggaggacgtggagcaggggcgggagaccctcctcgccacgtgacccaagccagtgtctctgcgctcgcatgcaccgggccattgccgtgcaccnnnnnnnnnntgcgggggaggacgtggagcaggggcgggaggccctcctcgccacgtgacccaagctctttctctgcactcgcatgcaccgggccattgccgtgcaccgcgtccgcagtatttgtagtagtagaagccccttcccatacagcaactctttcaatccctacttgcccacacactgagtcccttcgtcccccatgctctgctccgtatcttctgctctcgtcccctgccctcgtttcagcacttacagactgcctccaccccccacctccctcccactcaccaaggcctactcctcagcctccaccagccaggcagctgtctccgcctgaatgctggacagcagcccgttcaggcaggagtcaaggggccggccgtccaccagccaggcctcccgccacttctcccagcgcatggccagcannnnnnnnnntgtcctggatcataacagatgacgagcatcttgctgtcaaacaggacccctgctccccccccaaaaaaccatcgtcaccatggctnnnnnnnnnntcccctgtacgggtggagatggggttcaacgacaagcgggaagagcacattggtttccatttctctggacatactgacgatgcagtcctggatcataacagataa

SEQ ID NO: 269 - DNA, 1254 bp, Chlorella protothecoides
atgcgaagcctgtgcacgctcagtgtctcgtctcctggtgtaggccctctcctccctttcccttcacgcaataactcgtggcgggcgacgagctctgtcttcacatggcgtgattcggtgaacgtagccatgaccctccttcgcgtagctcggcaggcggaggttggggaggggcagaaggtcgtcaaggtgagtctcctggaggctacactcgctgccttgtcgttactcgaaagcgttcacagccagcatggtatcggagcctcaattcaaaggcgtgtccctgtgcgggggactgggctctggaagctcaacgcacaaccccgtgccccaatttcttcaggaggctcacggccggaagctcctcctggtccgagtccacggcacggtctactgcacagatgctcactgcttccacatggtgtgtgctcgaggcatggagtggcgaccgatcctccgcacgtaccacatcagttgcctcctataaacagcccattgtccctccctgtagggcacatctctggccggcggggacatagaagacagcggcagccacgcctgcatcgcatgctgtcccagcacaaaacgcaccatgctgctcacaccttgcagatcgagctgtgcagcggcaaaaagatcgatcggaagttggacggcgccgtctgtgctagtgccgaccaaaaacagaggatatacgaagttcacccagaccccgaattcatctggcaagctgggcaatggagcgcagtgcatgctgtcaccacagcttccttggtgaccctgccggactcccccccctcccccctgccaagcgacgtatacaaccaagtggcctacaccccatcccgccccagctacggcctgtttgggagcgcagcgggcatggcacgcccgcccctggccccgcccacccccctccagccctttgcagggtcggccgcccggcccctcgtccactcccccactgatggcgagatgctgcagctcagtcaagagtccacggagggcagctcggtcccatccccagagcctgtgcgtcaacgtctgtttgcagggcgagtagatgcaccacacgtcgcgcgccgaaaagccgcagtggcggccatccgtgccaaggcatacaagccgccaatggcggcgacgcctcacaccgcgcccacacagaaccagacttccaagtcgggcggccagcagacgctcttcgatgcctggcgcgtgacgcctgtgcctgccgtggaggacatggagttttga

SEQ ID NO: 270 - DNA, 1545 bp, Chlorella protothecoides
gcgctggcgcggctgggcgccgtgggcgctgctgctgaccgcgcggcgcgccgcgtgcctgctggcccaggccgccaacgtctgcgcggggctggccacgctgtgcgcgctgccctgggtcatgcaccgtctgggcctactggacgcgggccgtgcgcccctcacccgcctcgtgctgggcctgggcctgggctgcggcgcggcagggcgcgacgccgtggggcggctgggcgggggcaccgcggcctggaccctggtctgggggacctgggtcggcgtgcatgccggcatgcaggcgctgggccggctgcaggcggggagggtcagggagcgcgcacgcgcggcgctggagagggacctggaggtcgcgccgccgggcagcggcctgggcgggcttaccgctgcgctgtgcctgctgcagggggtcctcctgccggccaccatcagctggtttactttttactccctggaaaccagcctggagtggggctggtggtgaaggaatttccgggcaggcaggggactctggtctgcagcaacgtatggtcagctctgaaccgcggagcattgcctgtggcattcaatgattctgcacaaacacatcgcaaggctttcttcctaacaaacccttctgtgacctccgtcccaagttgccggaactccccggtctcatttgctctcagcttcctttctgcgtcctgtccacagaacgcgatgatgagcaccattgccacgccgagggtcatgttggcccggccaaccacctcgcacacccgtgcgccccgtcgggccgtcatccgcgccgcgggcggcaaggacaagaccgaggccatcaccggcgtcgtgttccagccctttgaggaggtcgcccctgtgctgaaggacaccagcaagtctggagcccttaatgacccccgccccgagcacagctttgctcgctactccacctggaccgagaccgtggaggccgcggtcaacgagcagatcaacgtggagtacaacatcagtgagctaggcaactgtcaccatcatcccctaccccatcacccccactcctccaccccaggctacgtgtaccacgccatcagcacctactttgaccgcgacaacgtgtccctgcacggcatcgccgagtacttccgcaacgagtcagaggaggagaagtcccacgcccagtacctgattgacctgcagaacacgcggggcggtcgcgtgaagttcaacgccctggtcccgcccgaggctaactatgaccacccggagaagggtgacgcgctgtacgcctttgagctggcgctggccctggagaagctcaactactccaagctgctggggctgtgggaggtggcggacaagaactctgatgcgcagaccacccagttcattgaggacatgctgcacgagcaggtgaaggacatcaagcaggtgtccgactatgttgcgcagctgcggcgcatcggcaagggccacgccgtctggcactgggaccgcgccctggctgagggcaaggtggatcaccgcgccgtcgagtcccccaaggcctga

SEQ ID NO: 271 - DNA, 627 bp, Chlorella protothecoides
atggagatccaggtcaacggcggtgacgtggcggccaaggtggactttgcggtgggcctgttcgagcgcgaggtccccgtctcctccattttctcccagtcggagatgatcgacaccatcgccatcaccaagggcaagggcacggagggcgtggtgacgcgctggggcgtatcccgcctgccgcgcaagacccatcgcggtctgcgcaaggtggcctgcatcggcgcctggcacccggcccgtgtgggctggaccgtggcgcgcgcgggtgccctgggcttcaaccaccgcaccgagatgaacaagaaggtgtaccgcatcggcgtgaagggcgaggcgagccacctggccaccaccgagcacgacgtgacggagaaggacatcacccccctgggcggcttcccgcattacggcgtggtgaacgaggactacgtcatgatcaagggcgcggtgcccggtaccaagaagcgtgtgatcacgctgcgcaagacgctcttcgcgcagaccaagcgctccgcgctggaggagatcaagctgaagttcatcgacaccgcctccaagtttgggaacggccgcttccagaccgcggaggagaaggcgcggtccctgggccgtgtcaaggcctga

SEQ ID NO: 272 - DNA, 447 bp, Chlorella protothecoides
atgccgccgcaccaatgtccttggcctctatccaaccacccacaggagccccggcacctgcgagaggacttctgcggcactgccctcctggccgccacctggtgccgcggcggcgtctttcgctcagccgtaggcctcgacctggaccggcccaccctggactggggcgctcggcacaacggcgagatgctgggcgggtctgcgcagcaccagctcgcactgctggagggcaatgtgctggacccggcagactcggcgctcctggtgccctttcccgaggccgggccggaggccagcgactcgcagagcagcgcctctgacgagtcagacggggagggaggggcgcccgcgcgccgcggcagcgtgcgctcccgcccgtgcgacatcgtctgcgcgctcaactttggcgtctgcctcctgcatacgaggtatgcgggggtgggatga

SEQ ID NO: 273 - DNA, 339 bp, Chlorella protothecoides
atgctgaaacacaacttctgcccagtgcacacccaaaaccttgaactgctcgatcgcaactgctcgtccgccacgcaggtgctcctgcgaccggcctccgagggaaccggcgtgatcgcggggggagccgtgagggtggtcctggagctggcgggcgtgaggaacggtttcggcaagcaggttggcggcagcaatcccctgaacaacgccaaggccgcgatcgagggcctgcgtgccatgcgcacgctgcggcaggtggctgcggagcgcgacatctcggtggcgcagctgctgggcctgccccccaagaaggagtcgtcagacgctgtgcccgtatag

SEQ ID NO: 274 - DNA, 615 bp, Chlorella protothecoides
gcgacgacccgcgccgcctcttcgtccgggacgccctgccctccaccgccgccggcgcagggcccgggttcgtggcaggcgtgctgccggcgccgcgcacgccccggccggcgcctggcgagggaggggccggtgtgtccccggcggctaagaggggtggcagcggcgccgcggacgaccgtgccgacgtcgccaacggcgacgcgggtgacaacagcgccgccgctgcgtccccgcactccgcccaccgccccgactcggatcccgatgccacgctggcgggcctgctgccgcgcctgacccgccccgactactacacggtgccctcgctggcggagctggcggcggcggcgcgcagcgacccggccgccgccgccgcggtgcccgagtttgtcatcggccgtcgcggcctgggcagcgtggcctggctggagcccgtggacgttcgcgggctggacctggatgacgtgatcaccatctcgcggggcggggtggaggtgtacctggagggcccggccaagccgccggtgggcgcgggcctgaaccgccccgcggaggtgaccatgctcaagatcttcaagacggacaaggccacggggcagccggtgacaaacg

SEQ ID NO: 275 - DNA, 282 bp, Chlorella protothecoides
atgtcgccccactctgatgcccgtctcgactcccccctccgctccctggcccctgcgcagagggtgcggggcctgctgaccgcccaccaggcggggctgcacgccctggcagccagcctgctggagcaggagacgctgacgcagagccagatcaaggaggtggtggggggccgcgcggcgcaggcctggatcgagaaggcgccgggacccggaggcccccggcgcatgcccgcgccggcggcggccaccaccgcgccgcggccggcccagcagacggcatga

SEQ ID NO: 276 - DNA, 663 bp, Chlorella protothecoides
tcggcgggccccgcgcccgagccggggacgagcgccgcgcggcccctgcacgtcaccttcacccccgccgccgaggccccgccctcgggcctggtcaccttcctgcacagcgccctcagcttcggcctcaccctcgccctcctgggcttcatctcggtgctgggcctccgggccacgcagcgcgccgcgggcgtcaactcctcggccgccatgggcgtggcagcgggcggcgcgcccgcgggcatggccccgggtgagggctccgccatgtccgccaaggagtacaacaaggggtgtttggaggagctgggggtgggtacaggtggaaggaggggttcacgaagaaggaacctcctccccacaccatggttgagcgcaccttgcccccctgccggtccttctacgacaactcccacccccgtctcctcacaggaggcgttggcggagacgtcggtcaagtcgttcgaggacgtcaagggctgcgacgaggcgctgacggagctgcaggagatcgtggcctacctcaagaccccggagaagttcacgcgcctgggcgggaagctgcccaagggcgtgctgctgacggggccgccggggacggggaagaccctgctggcgcgggctgtggcgggggaggccggcgtccccttcttctacaagtga

SEQ ID NO: 277 - DNA, 1188 bp, Chlorella protothecoides
atgtttgtgggggtggggtcacgccgggtgcggaatctgtttgcagccgccaaggccaaatcgccctgcatcgtcttcatcgacgaagtggacgccgtcggcggcaagcggaccaactgggaggcgtctggcgggtcgcgcaagaccctgaaccagctgctcaccgagatggacgggttcgaggagaactccggcgtggtggtcatggccgcgaccaacctgcccgagacgctggaccccgcgctcacgcgccccggccgtttcgaccgccaggtggcggtgcccctgccggatgtgcacggtcggcgcgccatcctggacctctacttcaagggcaagccgctggccgctgacgtcgacagcgacagcctggcgcgccggactccaggtggggaccagcactgctgggagctgcagggtgccgtgccactgaagcttcccctcagccggagtcacttcccccattgtttcaccccacacacacgcttcccgcccccgccaggcttctccggcgcgcagctgagcaatttggtgaatgaagcggcgctgctggccgcacgcacggggcgggactgcgtggatgcgggcctgctggacgaggcgcgggacaagatcctgatgggctcgccccgcgcgctgagccagacgctggaggcgcggcggctgaccgcctaccacgagagcgggcacgcgctggtggccctctttaccccgggcgcccggcccatccacaaggccaccatcatcccgcgcggccacgcgctgggcatggtgagccagctccccgaccgcgacgagtactccaccaccaagcagcagctgctggcccagattgacgtgtgcatggggggtaaggcggcggaggagctcatctttggcgaggagtttgtgaccacgggcgccacctcggacctgtcggccgccacacgcaccgcgcggcacatggtggaggactgcggcatgagcgctcgcatcgggccgctgtccctcagcgacaagctgggctccgagacgcgcaaggtggccgacgccgaggtgtccgacatcctcaaggcctcctacgaggccgggagggggaaggtcctgttggggggccccatgggatggtgccatggaccaagcacggactcaaacagggagggtctactacccaatcgggagggctggcgctgggcaagcgacacgtga

SEQ ID NO: 278 - DNA, 462 bp, Chlorella protothecoides
atgctcaccacccttccccaccacccatatgctcccccccaggccccccatccatcagcgtatgccccgagctgtgccccccaccccccttcccctgggctcacccctgctgcacagcaggcgctgctcccaggccgcgtcgtcgttgagggcctgggaggtggtggaaagctctatcctccactccgccgggtccaggaagatgatcctgcggtcgtggcgggggggatggggtgggcatttcaaggcgacgcggggggtattcacggcgtcggaaccacgagggcgtccagctggttcaatcctgtggctgcatccgtgggctgtcaccatgcccatgctccgccgcatgcacctggccgtcaggttgtcgccctgtttcataaagtcgcggcagtccacctcgccgtggctgccggacacgttgccagcttggatggtctggcgtggatccagggatga

SEQ ID NO: 279 - DNA, 720 bp, Chlorella protothecoides
atgcattctgtgcaagggcttgcttgcagtagaggcgatccctgcttttcaagacttgctcctttccacccttccatttcccccgccccctcgatcgcttcacaaagcgcccgacatccccgaccggtgcctctccacgcctggtcggagcaacgcgccttcacttttcaaagaactcatgtgggattctgggatgcactgaattatatacttgattctaagaccaagtgcctcaactcttgcatacctgacgacatgttccgaaacagctaccagtcgggcctcctcagcgtcttgtacagcatagggagcaaaccattgcaactctgggcgcctcacactcagggactgaactccaagcgaccgcgcaagccgggaccccaccctgatgcagtcgaggatgggtctgtgcgccgggtgatggacgaagacatccaaagcagtgtgctggagctgacgggggccaacgtgtccacctcctacatctcctgccccgccgacccatcaaaggcactgggcattaagcaccccttcctggtgctcgtggtcaagaacctgcaccagtacttcaccttcgaggtccaggttctggacgacaagaacgtgaagcgcaggttccgtgcctcaaattaccaggtgggggagagtgatgagaagcaggctgaccccccttgcgttcctgtttggatgtggccggggatcaacgggattgagcgctag

SEQ ID NO: 280 - DNA, 549 bp, Chlorella protothecoides
atggtcgctgtggggcacagcgccacttccacagacatcgtgactcagctccaggatgagctgtgtcacgtcacatccctcctctataactttataggcacaacccagagggatgcggcgccgtccagcatcaaggacgaaggcccagtacaggcgggatgcgcccccgccccaccggtgcgcaggaggggccgcttcaacagtatgcgtacccagctgccatcaagatgtgaattcctgtctgtctccaaatcacgtaagacgcaccatccataccaccagatcgacctcatggcggagcagctgaccggtgccttggctgccctaggaaaggtcatagcagcactccccagcacgctgtcgagtgaggaacagcaaattctggagatcacgggccttcagcacgcaaacgtcatggcatcccaggagctgcaagcgtccctcgagagagcacaagtggtgctcacagagtcttatgcatctcattcaagcttggcagagacgctgttgcaagacgtcgagggagcagcacaaccggccctcctatga

SEQ ID NO: 281 - DNA, 459 bp, Chlorella protothecoides
atgaccctggatgacgactggaaccagatccagttcaacctggccgactttgtcaagagggcatacggtgggtggcagcgtggggctggcagcatgacccagccgccaaatctggaggggacaaagggcggggctgctggtgccggactaaaaccgcacaccctgctcaacaaaggcaccagctatgtggagacgctgcgcctccagatccacgccaactgccgtttgaggcgcgtgtactttgccgacaagctgtaccccggagacctgcccccaaccccctcctgcgcagagtcggagctgcccgccgacttcaagctcttcctccctgtccaacggacggcgacgctcgcctcgggagccggccaccccgtggcagatcccgcgcagatgggcggtggcgctgcggtggacgaggcatgggacgcagaccaatcaccaatgcctcaagaaccgtga

SEQ ID NO: 282 - DNA, 1725 bp, Chlorella protothecoides
  modified_base (1424)..(1494): a, c, t, g, unknown or other
cgagcgcttcggcggcggcggcggcggcgcgcccgcgccgcgcgagcgtgccgacccccccgtcgtcgacttcgtgcacgtgccggagctggaggcgcggggtctggccgccgacggcgcggcggtggcctgcctcctctccgcccccgcccccgccgcgccggagaccgaggggtgagccagcgtctaggggtcatggtgggggggatggggatcccgggcggttgcgtggcggagatgtcaccaggggaggacagtgcctggagtacagcagccagaatgcgctctgctttggcatgtccgctcccggctgggttctcctctgtctgcaccgcgctggcgcgcctcccggcactcccacccgtggcctcaggagatctgtcttccatcgcatgccgcccccccctcccgtcctcccggaaccccccccactcccccccacacacaggctgctgggccccggcgaggtgccggagggcagcaacccgcgggtgaagctggaggtgtcgtacgcgctgctggccgactcgacgcaggcggtggaggtggcgctgagcaactgcctggtctcatggccctactttgacgaccagagcctggtgaacacgttgaccggcctcttcggcgcgccctgggccgagggccgcggcggcgaggctgcagcggcccggccggcgcccgcgtccccctcggcgagcaccaagccggcggctgagccgcggccctggacctacttcaacgctgtgctggcggaggtggaggtgttcctccccgtctacgatgtggagcgggcgcgggagatggcggccgcgctgtgggacgcgggggagcccacctctcgcttccacgccgtgggcgacctggccctggcctcagtgctgctggcctcgctggacgagggcgcggaggccggggcgctgcccctggaggcgcgcggcgtgctgctggcggccggcgcggcgcggctgggccacgccgccggtggcgacggcgagtcctgcctgcgcgccgacctgcgcgacttctccgcgcacgtgcgagacccgtgcgcgcgcgtgcacaccgtgctgctccccttctccggcaccgccacctgcgaccaggtggctccccaggtggcggagcaggaggaggtggaccgcctgcaccgcgccgcggccaccatccaggcgcactggctcgcacaccgggccaggaggcggcgcgacgcgcgcctggccggcgcgttcggctcggggacctccagccccgccgcctcgctgcccacctccttcagcatggagagcgagggcgaggccctgggcttccccccgcctagcccgaggtcgggcgccggcgccggcaaccccgacgccgtcgcggactcgcccgacgccgcggtcacgccctggcacgtggtggacgagctgatcctggacgtggcnnnnnnnnnnnnnnnnnnnnnnnnnnnnnnnnnnnnnnnnnnnnnnnnnnnnnnnnnnnnnnnnnnnnnnntacaagcgcgccagcgcggagcacaaggagatggtgtacctgcagcgcctgcgcaccaccacgctgacggcggtgagcgtggaggcgggcgcgctcaccgtgcgcgccgccttctcccacatccccttctggcgcgccgccgccgccgcgctgcgcctggtcgcgggcggcgcaggcgccgggccgggctccccgggggcaccgtcctcgctggacgcggcgcaggcgagc

SEQ ID NO: 283 - DNA, 384 bp, Chlorella protothecoides
ggcacggccgcgccagcgtcgccgcgccggcctcgcccgaggccgaggcgctgcgcgcggagtgggcgcggcatgaggccaccatgcgcgccatcgccgacccgtccgcgcccgaggcgctgatcgcgcgcaacgcggtggaccgcgtgtccgccatggcgctggagctggggctgggccccggcgtggtggagatcgggcaccaggccgcggagatcctgctcatgatgcggccgccggacgaggcgccctccgacttccaggagtacacgctggtggccatcctggccgtggccgctcacctcagccagcaccacctgggcgagcgctacgggctggaggccctggccgcgcgttacggccaggaccccgacgccctggagc

SEQ ID NO: 284 - DNA, 1098 bp, Chlorella protothecoides
  modified_base (49)..(58): a, c, t, g, unknown or other
  modified_base (220)..(229): a, c, t, g, unknown or other
  modified_base (340)..(349): a, c, t, g, unknown or other
  modified_base (871)..(880): a, c, t, g, unknown or other
atggagggagcctgggtctctttggccgtgccgtgtgatcttggtgtgnnnnnnnnnnctcaactccaaggtgcggcggggcggtggtatggttgtgttcacgtatggagggagcctgggtctgtttggccgtgccgtgtgaactttgtgtacctgttgagggatccttatgctatcacctggaggaggatggcatggattcctctgcaaatgggtttcnnnnnnnnnncccccccctcccccccactcggggccttagtcctcttcctgcttgagtctccacctccagacccctctactccacccttactcctcgcacatcaggcgttcctggtggaannnnnnnnnncctccgactacccattcggggcctcagtcctcttcctgcttgagtctcctcctccggacccctccacctcacccttcctcctcgcacatcaggcgttcctggtggagggcgagcacggcggcgtggatttcgtgggcaaccgcacggagtgcgcgctgctcatgctggcgcgcggctgggagcgcgactaccgcgacgtgcgcgccgcgctgagcgacgacgtggccatggtcttcaatttctcctcggagcgcaagatgtcgagcgtgctggtccgcggcggcgcgggcggcggcctgcgtctgctgtgcaagggcgcagcggaggtggtgctcggccgctgcagccgcgtggcgggcggcgcagggggcgcggggccgctgggcgccgacctccggcgtgagctggaggagtgtgtgacagcgatggcgactcgggggctgaggaccctgtgcctggccatggcaggcaagtgtgcgcaaggggaaggagggattacccccggaattgggaggggctggnnnnnnnnnncctgtgcctggccatggcaggcaagtgtgcacaaggggaaggaggggttactcccggaattgggaggggctgccgggttgaggggtgggatcctagacatgtgggtgctccattgtgcacctatgtcccagtcacagccctttaccagcctgacattgacgtcagggtgtaccctgggagtcaaatggtgttgtctgattgaaccaggctcctcctga

SEQ ID NO: 285 - DNA, 1722 bp, Chlorella protothecoides
  modified_base (94)..(103): a, c, t, g, unknown or other
  modified_base (207)..(216): a, c, t, g, unknown or other
  modified_base (536)..(545): a, c, t, g, unknown or other
  modified_base (1129)..(1138): a, c, t, g, unknown or other
  modified_base (1369)..(1378): a, c, t, g, unknown or other
atgtgctggccaaaagtcttgtcgaggctgagaggaaggaatgcttcaggtctcgcagaagcagagtgcgtgtacaaccatgaaccaactctcnnnnnnnnnntgcgacatgtctacacgctggcctggtatttccctggcctgagcggcacaacgacgctttgggtcaaccttgatgccttgcctgcgcaaaccctttgcctgcannnnnnnnnncccacccttctggctgcaggacccgacgctgatcatgctcatggctgcagcgctggtgagtggcagtttgcgacatgtctacacgctggcctggtattcccctggcctgaatggcacaacggcgctctgggtcaatctcgatgccgtgccctgcacgaaccctttgcccgccatctgagtacacacattggccctcagtatccaccatcattggcacggctgtcaaggctgagcgagacgaccaggcgtacaccgagggcattgccatctgggtggctgtccttgtggtgtccctggttggtgagtggagggccattgtnnnnnnnnnnggctgtcaaggctgagcgagacgaccaggcatacaccgagggcatcgccatctgggtggctgttctcgtggtgtccctggtcggtgagtgtggggcgatgggcagagcactctactgggttgatgcgacttggaaggagggttcctgggacagcaccctgcccaagctcttgggctccaaggccattgagctcctatctcctgattccctcctgtgcgccccccttcctcgaccaggggccggcaacgactggcaaaaggaccgccagttccagaagctcaactcccagcgtgacgtgatcgaggtcaaggtcctacgcggcggcgcccaggccacctgcctgaacagcgaggtggttgttggcgacgtgctgtgcctggacaccggggacaagatcgtggcggatggctacatgatcgacgggcatgggctggtggtggacgaggcaagcctgacgggggaggccgagcccatcaagaagggcgagcgcgacccatggatgcggtcggggacgcaggtgggccgctggtcttggcttctcggctggtgtcctactgttttctctggaaggggatgtgggtttnnnnnnnnnntggatgcggtcggggacgcagagcaggaggggaaggcgctgaagggcgggggaggttgggggagtctgcaatcctgtatgcattcagtgtcagaagggaatacaagcaggaagctttgcacaaacgtgcgcttgcctacgtgtgtgtctgcagagctgtgtgcatcaccaggcttgcctaaactcctcgctgcccaagccctgcccccttctccaaccatccccccttccnnnnnnnnnntgcatcaccaggcttgcctaaactcctcgcagcccaaaccctgccccattctccaaccatccccccttctacaacccatcaccgcaggtcaccgagggctccggccgcatgctggttctagcagtcggggagcagtcggactggggtcggacgatgagcatggtgcaggtggagtccccggacacccccctccaggtgcgcgcagaaggatgttggagttgaaaagagggcccttgggtgaacaacgatcaaggcaggcatgtgcatgggggaggcaatgccaagatcatccagcggagagggggggggagcacactgttgacttgcagcacgcctttatgtag

SEQ ID NO: 286 - DNA, 1245 bp, Chlorella protothecoides
  modified_base (73)..(82): a, c, t, g, unknown or other
  modified_base (248)..(257): a, c, t, g, unknown or other
  modified_base (318)..(368): a, c, t, g, unknown or other
  modified_base (1111)..(1120): a, c, t, g, unknown or other
gtgcttcatttccagggcatgcttgtgaaagctaatcacgaacatagcacttgcctctgcacccaagcacatnnnnnnnnnnatgttattatttggtcctgcaaggtgcttcacttccagggcatgcttgtgaaagctaatcacaagcatagcacttgcctctgcacccaagcacattccatttcgccatattttgagcctacgccccagctatgtatgaaggcgccttgccttcttccatcgcaagnnnnnnnnnncttcccaccagcttacgcccaagcaatgtttgaaggcgccttgccttcttccatcgcaagnnnnnnnnnnnnnnnnnnnnnnnnnnnnnnnnnnnnnnnnnnnnnnnnnnncgttcttgaggcccgcggccacctgggatcacctcctccagcccgccctgttcttgaggtcgttcggattcgacctcgcttcagaccgtcaaacatttcgatggcggaaaaggcaaatttcgtcaatgtctcaccttcggagctgaagttcaggttcgagctgaagaagaacacgccggtgacgctgacgctgcagaacccctcaggggaccgggttgccttcaaggtgaagaccaccagccctaagaagtattgtgtccggccaagcaatggcttcgttgagccgaacagcagcaaggacgtgcaggtcatccttcaggcccagcgggagatgcctgccagcctggcagactgcaaggacaagttcttgattcagtgtgtgaagctgcctggatctctaccagagcagaacgagatcaaggagatcacctccgacctcttcgacaccagccgcgtgaaggacatcagccgcgtaaaggacatcaggtgcgagggcgggccaggagggcaagcacgctgcatggacctgtgcgcaaatgcacacatgcacggagagtgtgtggacaccttggagggccgctcctcgctccggtcggtgaattgtgaattcgttattcctggtcgcgtatgtgcccacccttgggcccaggcttcgctcactccagcgggactcccgtcctcaaccgttcaatggaacactcttgtggcgcaccccccgcacaggcaaacaaagctgcgtgtgnnnnnnnnnncgactcctgtcctcaaccgttcaaaggaacactcttgtggcgcatcccccgcacaggcaaacaaagctgcgtgtggtgctggtggcgccgcctcggcccccctccccagtgccagaggggaatga

SEQ ID NO: 287 - DNA, 534 bp, Chlorella protothecoides
  modified_base (128)..(137): a, c, t, g, unknown or other
atgccgccgcactttctccccgcagtggtggacaaggcgaccagcaagtcctggcccggcggcgtcggcttcatcaccaaggtgcacggtggcgggcatgggatcgcggacgtttcccccgcacgcgnnnnnnnnnncgacccgccaccccccaccctccatgccgcgcttctccccacagtggtggacaaggcaaccagcaagtcctggcccggcggcgtcggcttcatcaccaaggtgagcggtggcgggcatgggatcgcggatgtttccccgcacgcacgccctgccagaccctgcttcggtgccctggcacgcacttcaaacccccttgcaccccctcctcccggcccgcaggacatgctgaagcagcacctgccccaccccggccccgacagcctggtgttggtgtgcggccctccgggcatgatgggcgcgctgagcggggacaagctacccgacaagtcccaggggcccctgaccggcctgctcaaggagcttggcttcgacgagagcaacgtgtacaagttctga

SEQ ID NO: 288 - DNA, 2385 bp, Chlorella protothecoides
  modified_base (1371)..(1380): a, c, t, g, unknown or other
  modified_base (1974)..(1983): a, c, t, g, unknown or other
  modified_base (2224)..(2233): a, c, t, g, unknown or other
atgcccacgacctatgcacgtccccataccgtacacacaggccctggcaaagcagtactccgacgccgtgccccgcctgctggtgacggaagcgcgagactgcgttggcggcaacatcatcactcggcgcgacggcgggtaccagtgggaggagggccccaactccttccagccctccgacgccgtgctgcgcgcggcggtggatgccggcgtggcggaccgcctggtgctgggcgaccccaaggccccgcgctacgtgtactggggcgggcgcctgcgcgccacgccctccggcccggacgtcctcaccttcgacctgctcagcctgtggggcaagctgcgcgcggggctgggcgcggctgggttcaaggcccccctgccggagcgggaggagtcggtgaaggagtttgtgactcgcaacctgggggaggaagtgttccagcgcctcatcgagcccttctgctccggggtctacgccggcgatcccgcaaagctctccatgaaggccgcctttggcaaggtctacgacctggagaaggggggcgggtccattgtggggggggtgctggcgctgatgaaggcacgaaagcaaaagccgccggagccccggcccgcagacctgccgcccaagcccaaggtgagcttaagtttgagggcggatgcgcatgtcgatggattgcttgtggtgtggggccaggccagcccctccctgggcaagggagaaagtcaaagctatgcccgcagctggagtctacggtggacgcggagccgtcgggactggccggccaaaccgtgggctcctttgacaagggcttggtcacgctgccgagcgccatcgcagaggagttgggagaccgggtggtgacggggtggaagctggagagcatcgatcgcagcggcgatcgattccagcatgatctcttgttcaatcagcgcaacacctcattaccatgtgcaggctcatggcgatcaccccgtccaaaccccagctgcccccactccccttcttcgcacagactgacgtacgacacgccgcagggcaggaagaaagtgagcacacgcagcgtggcactgaccgtgcccgcatacaccgccgccagcctgctggagtcgcgctttcccaagctaggcaaggcgctgagcagcatctactatccacccgtggcctcggtggcgctttcctaccctgagactgccatcctgcccgagcgcttgggctctgacggccacctcgcaggtatgcataggaaaggggtgcgcctggtagggtgctggtctggagaggccacactcctcggcaccagcatccactcgggagctcgccacatcatcctgcaggtttcgggcagctgcacccccggactcagggcnnnnnnnnnnggccacactcctcggcaccagcatccactcaggagctcgccacatcgtcctgcaggtttcgggcagctgcaccccaggactcagggtgtcaccaccctcggcaccatttatgccagcagcctcttccccgggagggtcccggagggcaaggtcctgctgctcagctactttgggggagccaccaacacccaagtggcgaccatgccgcacgaagagattgtgtcccaggtgaaaaggttggggtttgtgagctggactgccatggagcttcactcgcatcggtctttgatgggccctaccacttctgcaagtcttggggctgaaggcatgcccactcctgctcatgaaaaccacctctcccctccctgccatccaacccccctcccaggtggacaaggatctacggaagatgctgatccgaagcgacgcagagtccccacacactgtgaacgtcactgtgtggcccagggccatcccacagttcaacgtcgggcacacagacttgatccaggtttgcaagagtttgtggcgaaagtggcatgggtcttttccgttgcagaggggggcatcgctccagaggtggcgacactcttnnnnnnnnnntccagaggtgtgagtcctggaggcaaagcacggcctgcactactgcatgccaagagtgatcgtgtactgtggcaaggtgtgtgtgcaccaacagggcgacactctctgcatctgcaggaggccaaggatgacttggcgtcgcaggggtggcagggtctgcaccttggaggaaactacgtcgcaggtgggtcttggttggcttcagttctagctgattcaaggatgctctggcaggcagatnnnnnnnnnncaccttggaggaaactacgtcgcaggtgtcgcacttggcaagtgcatggaggcagggtacaagcaggcggcagagctggcgtcacatgtcaagagccttgctgcttgagcatccatgatgttaaaagatcagtagcgcaatgctgccgttga

SEQ ID NO: 289 - DNA, 468 bp, Chlorella protothecoides
  modified_base (247)..(256): a, c, t, g, unknown or other
atgcgcagggaggggacggtgggccagcacaagtgcgactcggccgctcagtccattgccggcctgaactcccgggtccaagtggagctgcacagggatggcttgaccccggaaaacgccgtcggcatcgtcacccgctacgacgtcgtcgttgacgcgtcagacaacgcccccacccgctacctcatcaggtgcactggggcatgcctggcaagcggctgcgtggaggttgcttggttgcccacannnnnnnnnncatcaggtgcactggggcatgcctggcaagtggctgcgtgggggtgcttggttgcccatggtgggtttctctctcgattgttgctccacttgcatgcgccacacacaactccaacctctatgcaccgcatatcaacgtgcctacatccatccatcccatgccctggcccctcctctgcagcgacgcctgttgcgtggctcgcaagcctttag

SEQ ID NO: 290 - DNA, 591 bp, Chlorella protothecoides
  modified_base (470)..(479): a, c, t, g, unknown or other
atgggagtcccattcgatgatgagcttgaacaactccgcgcagagaatgaggccctgaaggtggaggtccagcgcctgcgccaggcgcagagctcctccctgcccgaacccagatctcagaatgaattagagactccctcaacccactcctgggatggcctggggcatggcctgagccgggacgacatcgccaggtacagccggcagatcatcctccccagctttggcgcccaagccgactctgaacaacccctccctcccacatccccgtctgaacctgcagctcaggggaagctgtgccgaggctcggtgctgatcgtgggggccgggggcctgggatctcccgcagcgctgtacttggcggcagctggcgtgggacgcatcggcctcgtggacaaggacacggtggagctgagcaacatccaccgccagatcatccataggtctggtgacgcggcaggagaccaacnnnnnnnnnnggacacggtggagctgagcaacatccaccgtcagatcatccataggtgggtgcttatggggatgactgtttcgccaggtagtgcgctcgggtgccagtgcgagcctgcgtaa

SEQ ID NO: 291 - DNA, 2631 bp, Chlorella protothecoides
  modified_base (178)..(187): a, c, t, g, unknown or other
  modified_base (398)..(407): a, c, t, g, unknown or other
  modified_base (762)..(771): a, c, t, g, unknown or other
  modified_base (2070)..(2079): a, c, t, g, unknown or other
atgtccgagggattcccatgttgggggacattggagatccttgcatcaagtataggattgtccagcaaaaccatgcttgttttcaaggaccagctgaatgattcgttattgaggtgcaacccttccttactcgggtctcgatgccacgacccccacgggcttgtgccgtctcctaccnnnnnnnnnngtgatcgcgacgaaaaggaccagctgaatgtttcgttagtgaggtgcaacccttccctactcgggtttcgatgccacgacccccacgggctcgtgccgtctcctacgctgtggtgccacgcaagcatgcacatcgcactcgacacggttggacggggtcatcaatgctcgcaccggcaaaccccactcttccacattcgggtgcccaaaannnnnnnnnnctgtttggtgtttcggttgaatcttgtgcggccatggccaccacagcaccggcaaaccccgctgttccacattcgggtgcccaaagggaccaggatacaggcaaaccattcaccttagaccttcctgtcgagttgtgctggaatctcagttcagtcccaccccttgcactcacccagccatgcggccgtgacgtacggcagccctgacgttgcgcgaatggtacgggatgccctcgctgtagatccagaggtatgttcacgtgccagatgtggatgtggggttgtatacggccaggcgtcagtgtgtctaccctggcaccgagcttgcctatatcgctcagctctcctgacactnnnnnnnnnngtatgttcacgtgccagatgtggatgtgggattgtatacggtctggcgtcagtgtgtctaccctggcatcgagcttgcctatatcgctcagctctcgtgacacccatctgtgcagctaagaccggacgttgccacgcgagagctgacggtcgtcgggaacgaccttgtcctgtaggtttagagcagccgtttgttctttgtgaggggtgtgtggtggagtggggcgtactgggatttgcaacagggaggtgcagagattactcttgctgcactgcagctcccgctgctccactcctccaaaaccccggcatccaatccagagattttgcggcagtggacgccaggacgctacgggcctccgtagggacgttctgcgacttgctagccctggccacaaggacagccgaagccttcccaccccttgaaccccgctgcatcgagcctgcagtgcatcaggccttcagtgtgcaggtgggcaccatatataccggcaggtgccagtacctattcctgattcctttccagatgctgccgtctgagccgcgtcgtttacccctgcccaagcggtgcggggcagtacgccaacgcaggccacccctccccaccctggactcgccttgccagctcgagcttgacgacctccccctgcaccatgttgaagaagatgttgtccgggcagaggccgttgaagaaggagtagacgccccccggactcagcagcctaatcagggacgtggggttcaggcgcatgctcaccaaccaggcgaccgcccccggcttcgctgtgaggtttcctcgtttcctccacttggggaaagcctggcccgcggatcagcagcagcccccccacacagcccctccccgggctactcacctcggcaggtgggcgtgaaactccctcatgtcctccgcgtactcgccgtaggtgtcgaagaagacgccgtcaaaggggcccaggtcggcgatcacatcctgccaccgacctgggaccacggacaccccggggcggtgggtccagccccgcgccgccatgtgcgccaggacgtctgggtgggcctcgacgatggtgtgccgggccggcgccagctcggcgatgtagccgtcgatgatgccgaggccaaagcccacgggcagatttggggagtctgggccgcgcttcaagcacaggcgtggggtgtgtgcgctgggcccggcaacggtggtcgtgctgccggcttgaggccctgggagccggctgacagccccgacctccggccctccacactcaactccatccctgcaacacgggcagatccatcnnnnnnnnnnccggctgacagccccgacctccggccctccgcactcgacttcatccctggaacacgggcagatccatgcaaggccgaccttggccgcgcagaggatgcgggcatgctccctcatcagcggcgcctcccacgtcatcatcaccgcctcgccctcggcgtccaccagctggccgtcgcggtatgtcgctctttcctgcaggtacccctgcgggccgggggcgggggcggcgctggcgcggcgcgacgccgcgcccagcaccagctcggcacgcaccgcccagtccagcagctgccgcacgacttccacgtgcccggacccggaggcgtactcccccgcgcagcagccgtcctcgtccagctcgtgccagggcgcgccggcggctgcggcaggcgatgcaggggggaatgtcccgtgagaagcccagctgggaccccggatcttcacgctgagaatgcctccccaccccgaccgtgccactcacacagcagcgcagcgacggactctgcatctccagcggcagcagcggccatcaggggggtctggccgccctga

SEQ ID NO: 292 - DNA, 714 bp, Chlorella protothecoides
atgcgtaatgggtgcagaactcacacatccacactccgtacagccgattcccaagcagagcaatttcttcttgtttttagcacgaacatagagttttttagtgtattcaatcttgccattcagactctagggctgtccctcatcttcaccaaggttacgtgccgcccgtcattttccacttttccgaggtcaggtcgccctggggctcgtcgaggacctccctcccacaccgtcgtcaaactggggctgtttcgacctcttctcggcggggctgggtgggccagcgcccccgacatgccgggggcactggcgactagcctagacgagccagaccggccacagcgttcggtgagcaagacattgaagcgcgccgtgtcttcttactttgttccccgtggccggttcaaaaaactactggagagcgcggagaatgacaacgaggcggatgtctaccggcggaatgtgagtggggtgtgcaatccgtcgcgtcggctgccatccgggaccaggggtgatgtcggtgtcggccgtcctagtgggcacagggtgttcacccatgctgactgggcggtgcacaggaagccatcccgctatgcccggcacctggccctcatcttcgccagccgcatcttcaggtccctcatcccccccatcacggccgtcaccctcatctccacgctggtcggggtgtatgagacgcttctcaaggtgtga

SEQ ID NO: 293 - DNA, 453 bp, Chlorella protothecoides
atgatgcccttcaccctctgggccgcctactcctgggtctccatcctgctgtcaggcctgtttgcctacctcatgttgggcatcgacgagatcggggtgcagatcgaggagcccttcggggtgctgcccctgggcagcttctgcgcaaccatcgagcgcaacctgagggagctgcactacagcaacccggaggcgcgcttcgcggccctgccctggctggtgccggcctcgcccacctgttcccgtgcctcgggcagctgcgacggcgcggacatggccgctggcatggatggtgggcatgtgggagggtgtgcgtgcgtgtgtgtgcagaggtggccggcgatggagacgagtggggagaagttcgcatgcagcgcccggagtctcgatgtcgcacacagcgggccctctggacaggggctccctactacgtcgcactgcaccctttcctga

SEQ ID NO: 294 - DNA, 276 bp, Chlorella protothecoides
atggggagcgtggaggacaccagcacggggtcgtacgcgtaccgtgccagcaaggcgggcgtgaacattgtgtgcaaggccctggccaacgagctggggcccaagggggtcaccgtcaccctgctccacccgggctatgtcatcaccgacatgacggaggggaggggcctgattgacaccgccacctccgtggggggcatgctgtcggtgctggagggcggggacgacatccacggcaagttccttgcatgggacaagaaggtggtgccctggtga

SEQ ID NO: 295 - DNA, 543 bp, Chlorella protothecoides
atgcaggtcgtcatcaacaatgctggcatcgccgacatggagccctttgggagcctgaagggcaagctcttccactccattttccagaccaacgccatcggccccttcctggtggtgcaatcactccacgcccaaggcctgatcggcggcagcggcggccacaccctggtcgccaccgtttccagcacgctatacccttcacctcacctgtccccaccctacatcccccagatggggagcatcagcgagaaccgggcagatggtctgcccatcaccattggcctgaagccggggggggccattccctaccgatccagcaagtcagccgtgaactccatcatgaagagcctgtcccacgacctggcagaccaggacatcaccgtcacactcctgtgccccggctacgtggccacagacatgaatggacacagcggccacatcgacacccagacctctgtcaacggcatgctcaaggtcctggaggagaataaggaccttcagggcagcttccactactacacgggccaatacatcccgtggtga

SEQ ID NO: 296 - DNA, 402 bp, Chlorella protothecoides
atgtccatcatcgaaggcaagacagtggtcgtcaccggcgccaaccggggcctcggacgggagaaaatgaacccagtgcctgcatggagctgtgctgatctcatgctcctcccccgcactctccactcctcctgccagctggtgaaccagcttctggagcggccaggaaacaccatcatcgccggggtgcgcgaccccagccaggcgaaagacctggccagcctgggacccaacgtggtagtgacccagctcgatgtgtccgacgaggcctccatcgaggcatgggcagcctccctgaagaaggatttcgctcacatcgatgtcagttgggggttggttgggaggggtgatgaccgtgcagcggtggtcccggtggctgactgggtcagggaacaatcctga

SEQ ID NO: 297 - DNA, 840 bp, Chlorella protothecoides
atggctctcaattcctctcgccccgccacccctcaccaatctccccagtcgctgcacctggccctgaacgagctggccaggaggagtgcgggcgcgctggcggaggtcctgccgcgcctgacctccctgagggagctggacctgcgtgagaatgagctgggcagccgcggcctggtccaggcagccctggtcggtcttggcaggggctggctggcaaggatcctggggatcgtgagggggatgatccggcctgacctgggaggggtgccggcctgcccaccccagatcacctgccccctgtccgcctcctcactgttcgttaccctcctcgcacagggcatcccccgcctggcaagcctggaaaggctggacctgagcgccaaccagtcgcggcgtagtggggccctggcggtcgccgacgcggtttcctccctcaagtccctgaccttcctggggctggatgaaaacgaattcagcgaagaggccatcgctgagatcgatgtgcggggttggtgggaggggtgcttggggcggcgggcgaggcttgcatggcgggcgggcgtggcgctgaggaccccgcctctcacccatgctgggctgggcgagggacctcctggatcacaacaacggtcgtcacggaccccatccatgcacatggtgcagggcatcctggcgcagcatgagcagtctagggtgctggggaccctggaggaaaatatggagccctcggacgatgaggatgagactgaggaggaggacgaggaggacgaggacgagggcatggcggatggggaggacgatgcgcttgcggcgaatctgggcggcctgggcctaaattga

SEQ ID NO: 298 - DNA, 264 bp, Chlorella protothecoides
atggcgtcaaactggtttgaccggctcaggaccgggctgggcatggaggtggaggagccggagcctcccgaggtgggcaaccagaccctgctgtcgcagctggatgaggccaccacgctcacgcgcacccagagggcggtgggctttgcactctgtgcggggctgggcctcctcctctcattcctggccccgctcttcgtgctccgccccgtcaaattcgcgatggtgtacacccttggaaacctgctcgccattgggaggtaa

SEQ ID NO: 299 - DNA, 1185 bp, Chlorella protothecoides
atggcggaggacacgggtgagggggtcccgggtatggcacggttcgagagcatcaagctttgcacccgagagacgatgtattggagtggaattgggtctcgaaggccactccacctgctcacacgtcccatgactttcccaggggctgccttgctcgctgccgccggaggaggggatgcctcccaggtgcatgccctcctgcaccagggagctgaccctgggcaccagggtcagggcggccagacccccctgatggccgctgctgccgctggagatgcagagtccgtcgctgcgctgctgtgtgagtggcacggtcggggcattctcagcgtgaagatccggggtcccagctgggcttctcacgggacattcccccctgcatcgcctgccgcagccgccggcgcgccctggcacgagctggacgaggacggctgctgcgcgggggagtacgcctccgggtccgggcacgtggaagtcgtgcggcagctgctggactgggcggtgcgtgccgagctggtgctgggcgcggcgtcgcgccgcgccagcgccgcccccgcccccggcccgcaggggtacctgcaggaaagagcgacataccgcgacggccagctggtggacgccgagggcgaggcggtgatgatgacgtgggaggcgccgctgatgagggagcatgcccgcatcctctgcgcggccaaggtcggccttgcatggatctgcccgtgttccagggatgaagtcgagtgcggagggccggagccggctcccagggcctcaagccggcagcacgaccaccgttgccgggcccagcgcacacaccccacgcctgtgcttgaagcgcggcccagactccccaaatctgccccttccagggcacccaaccaccccccaccccccccggcgcagggcagggcggcacgggtgctgaacgtgggctttggcctcggcatcatcgacggctacatcgccgagctggcgccggcccggcacaccatcgtcgaggcccacccagacgtcctggcgcacatggcggcgcggggctggacccaccgccccggggtgtccgtggtcccaggtcggtggcaggatgtgatcgccgacctgggcccctttgacggcgtcttcttcgacacctacggcgagtacgcggaggacatgagggagtttcacgcccacctgccgaggtga

SEQ ID NO: 300 - DNA, 639 bp, Chlorella protothecoides
atgccttgctttgtggcggagcctagtagggactgggtgagggagttcatgccattaccggtgcagtgcgggggaagaggatctgccaccgatcggttccatcacaaggtccgccctctccctgctgcccgcaggtacactcccatcacagcccccgatgccaggggccacttcgacctcgccatcaaggtctacaaacagcccagccccggaaaggtctccaccttcttcgagggcctatctgtgggggacagcgctgacttcaagcctacaggggaccgcgcctgcgccaccgtgccctgccctccactcactggtccccctcccgcttcacagggccccctgcccaagctgagcctgtccgacatcgccaagcgcaaggaggtcggcctggtggctggcggcacaggcctgacacccatgctccaggtggccactgaggcgctgcgccagggcctccccctcaagctgagcttcatcttcgccaacgtgtccgaggacgacattgtcatgcgcaagcacctggacggcctggctgccaagcacgacaacttcagggtgtactatggtgaggcgcaggagcaagagggaggagggtcgccgtgcggggtgcctcggggcggcctcctgcaggcctag

SEQ ID NO: 301 - DNA, 594 bp, Chlorella protothecoides
atgtcgctcggcaattgccctggcctcagaatgcatcacgccgcaagccttcacccccagcgccttccattcgtcgtccttggcaggtctgctggctgtgtggcttgcggcgacgcgcccagcatcacggccgagaccctggcggactatgactatgcggcattcactggccaggctcccaatgatgggccgccgcgcccgctgcgccttttgaacccggagcagcgcatcactgtgcagcagctgcgagacaggttggtgctggagagtttgggagtggcgggaccatccaccgcttcaaccgacccttccgccccccctctagtgatcgacgtgcgcccgcccgagcagtttgccatctgccacctgccgggcgcggagcacatgccctgggcgcgctttgcgcgcttcgagcagcgcctcttggacctggccgccggcgaccggcccatcgtggtcatgtgccggcgtgggaatgactcgcagagggccaccgcccgcatgcttgagctgggcatgcagagtgtggtggatgttgtgggaggagtggaggcctgggcgcgagatgttgaccccgacttcccgttgtactga

SEQ ID NO: 302 - DNA, 201 bp, Chlorella protothecoides
atgcgcctgaaccccacgtccctgattaggctgctgagtccggggggcgtctactccttcttcaacggcctctgcccggacaacatcttcttcaacatggtgcagggggaggtcgtcaagctcgagctggcaaggcgagtccagggtggggaggggtggcctgcgttggcgtactgccccgcaccgcttgggcaggggtaa

SEQ ID NO: 303 - DNA, 1305 bp, Chlorella protothecoides
atgtcgtgttctgtgtcgcgtgacgtccgcggcaaggctgcgtcgggatcccccgccggcaaggagaccggacccccacaggcgcaaaacccagaaagccccttcacccacgccggcctttctttcaccctcatcccgcgccacgcgacgtcctggaccccggcgtgcctcccccgccccacgctctccctgtccctggacgcctgcatcgtgccctcccccgccagccccgacggcgcgcgcctcgccgcctccaacgtcctcgtgctggacgattttgtggacgaggccacgcgtgcggggttattggaggcgatgatcggccccgcggccgccgtcgacctggccgcggggcgcctgagccggccgccggcgggctcgtgggagcggcgtaccaccgacgccgcaggcggggcgcccagctggggcatgcggggcacggcgctgcgcgcgctgcggcgcggcacgctgggcgcgctgcgtgaggtgggcgcgcgcctggccgcgctgtacccggacgcccacgtagcctggctgcccagcgacgccatccagggcgggggcgggggggccctcgtgtctgctgccgcccacggcggcgacgatggcgccacggagacctgctggcccgaggagtgcaaccaggggaacgccagcgctgccaagcgcgccaagatcgggccggaggcggcggatggcgccacgcgctgcccccccgacggcgctaccccccagggtccatatgccaccgacccgtgcgcccccgacagcagtgccggcgaagcccaggcggccaccaccgccccggcagcagactgcgtgccgctgctggccaatgcggcggtggccggcgacgaatttgcctaccaccaggacgccgaccccacctccttccccgaatcctcgccctgggtggcggccctgggcgactacttcaacggcgagccgggccagccgctcctggcctccctggtgctgtacctgaacccggactggcgccgcgactggggcggcgacacgctctgcctcgactccgactccggggtcggcgtgggcgtggccccccggccccgccgcgccctgctgatgcaccaggacgtggtgcaccggctcagcgcgcccagcgccgccgcgggcggcaggccgcgcttctccctggtctggaagctggcgctggtgccgcggcgcgcgggccggggcgtcgacctggcccgcgccgcggcctgggggctgcccacgccctttggctccgcggcgcgcatggcggcggtgaagcgccagctggcgcgcgaggcgagggggtga

SEQ ID NO: 304 - DNA, 297 bp, Chlorella protothecoides
atggacaccccctggagcctgactgcggagcagcgggcggacaccgtggcccgcatccgcgcaaacatggccagcatggcgttctttgccaagacgcccctcaacgatgcggaactgagcgcggaggcagccaagctggaggccaaggcctacgctgtggccggagtgcagggcacggcctacatcagcaagctgagccagctggtgctggagcgactggctttgggcagtgacagctctaccgatgcctcgcaggccgccgcccagcccactggcgtgcgtgggcttgggggttga

SEQ ID NO: 305 - DNA, 882 bp, Chlorella protothecoides
atggtcccgggcatcgaagtgctccccctggaggctggcgacgccggttccctcaacgcctgggccgatgaagtggccaaaaagactccgcacatcgacgtaaatcacctaacccagcgatgcaaggccattcacagctgggtgaccttcctcgtttgctcaacaacgcattctgctattgatccggtagagggagatgtcgatcgcgaacaagacaatcgtcctgacgggcgcgaatcggggcattgggctcgaggtgcgacgctacggtattgtggcttcgacggcgagcaacaggaccgcccattcgctgcacgtgcatgtgtggtccaatggggtgcaatcacggtggcattcacgggcgtcctcattcactccgccatgcagtgggcgaggcagctcctggccagaccagggaataggatcatcgccggtgttcgtcagcccgacaaggccgcagacctcaaggcgctgggcggatctcgagtccagatcctacccctggacgtctccagctccacttccatcgagtcatgggcggacgagatcaaggcctccacggcccacgataccatacgtcatgactctcgacgggagatgcagcctccatctcgacctgaggtcctcctccctctcatgctcgctccctctggcctggctggcatgcaccaggtcgtcatcaacaatgccggggtgtacggagagcgtcaggacctgggcagtgtcacgtccgagaacatggtgagcacctttgtcgcaaacactgtcggccccctcctcatcgtgcaagccctcgcctcccgaggtctcctgggaggctcagcgggcccgacgctggtggccaccgtttccagcaaggtgggaagggtctggtggttgtag

SEQ ID NO: 306 - DNA, 390 bp, Chlorella protothecoides
atgctgcagggaatccgggcacgcttccccaccctgctcgccgcagctggagcgaccgcggctgtcggcggatatgcggtttggacggggagccctgtccgattgggcacctgctcgcccgatctcacggatgctcgaccccacctcccacaggccacccgcccggcgctggccgccacgcctgccagtgctctgagccccgacgagtggcgctccttgaagcttgtgcacaaggagcagctgacgaagaccaccaaccctgtctggctcttccgctttgcactaccagatgagaagcaggtggtggggctgccagtggcctcctgcctcctcacgcgcgcccccatcaccaagaaggacggtcaccccggctgggtcatccgcccgtga

SEQ ID NO: 307 - DNA, 423 bp, Chlorella protothecoides
atgccgccctcacatccacccccccgccaggcgcgtatgttgtggggctccctgaccaaccgcacccgtgacttcgtgcgccagtgcctcgccttcttccccgaagacgccaagcgcttgcgcgaggcggcggtgctctggaccatcgcgctgccgtacgtggtcaaggcccacctgcgggagggcaaccgcctggagtcggagctggagggcatcctgacgcgggacgaggtggatgcgctgacgggcgccacacaccgcccctgcttcgtcctcgccgcgctttcccaggtggtggccgccgcagggctggacccgcagctgcgccagcgcctggacaccaacctcaccgccttcgaggactgcatcggcggctgcgagcgcatcctgcgcacccccatcccccagtcctatacgaggtga

SEQ ID NO: 308 - DNA, 990 bp, Chlorella protothecoides
atgcccgctgtccgcctcttcccacggcaccccgttcccaaatcaatggcgcagatcaagttcagcaccaagagctttggcgccgacgcctcggcggtggcggcgcgggccatcgcccgtgttgccgagacgctgacgcacgctgacatggcggacatcattgccggccggccagccttgcacgccgcaaggatgagcgggcggagcctaccatggcggggtcggcaggcaacgctggctgggggcgcagactcatgtggctggcctccgcgcagacctgcacatcatggacagtgcctcacacgctcccacaccactccaccccccgcagaggaggaggcgctgcgctcgttgcgcaccatcgccgaggcgctgtcccgcgccccgctggtggagctggacctctctgacaacgcactgggagagaagggcatccgggcagccgccgccgcctttgccaaccagaccaccctggagcgcctggcctttggaaacgtgggctgctccgtgcacggctgcgcggcgctggacgagctgctgccggcccccgccgctctgcgcgcgctgcgcctgtacaacaacatgagcggggacgagggagcgcggcacatcgccgcgctgctgcgccgcgcccccgccctgcaggagttctccatggtttcctcccgcgttggcaccgacggcggcgccgcgctgtttgccgcgctggcaggccggggcgacaccctcctgtctttggacctgcacgacaaccccatcacccacgaggccctgccccagctgctgaacctgctggcagccgcgcccaagctgcgcgtgctcaacctcaccgacaccggcctgggcgacgctggcacggccgcggtcctccgcaccctgggcaaggtccagccgccgctggaggtgagtcatcctttttggaggggtctctggggcctgcacatcaagggcggggtggccagcacccaagagacgggggcgggaggatga

SEQ ID NO: 309 - DNA, 1008 bp, Chlorella protothecoides
atgacccacccacccctgcatacattactactgtgcgtcagggatacgaggggcgcttcgttcgggactatgtggacgccacggtccctcagatggcgtttggggagtactgggacacctgctcctacaccgatggcgtgctcaactacaaccaggacgcgcaccgccagcgcaccgtcgactggtgcgctggcgtgctggagggtgcggggttgctgcgttctgacacccacacctgcggccgcatcccgtcccagcagctcccgctcactcccgctcgcctcccctcctgttctcaaggtgcgacgccaccggggcgaccgcggcggccttcgacttcacgctcaagggcatcctgcaggaggccgtcacgcggcgcgagtactggcgccttatcgactcgcgtggacggccgcccggcgtgctgggcatctggccctcccgcgccatcaccttcctggagaaccacgacacggggtccacgctgcagcactggcccttcccctgggagcacgcggcgcaggggtacgcctacctgctgacccactgcggcacgccctgcgtgttctacgaccacatgtactacgacgtcgagctgcgggagcacatcaccaagctcatcgccatccgcaagcgcttccgcatcaacaacaagtcggaggtgtgggggctgccgaagttaggggagcttgggcgggggtgcagcccttcttggccgggggaaagcagcagcccagggcgacgcgcttctctgcatgtaagatactgccgtcgtctccgcggcatcgccctcacacctccccgcccccccattggaaaccatgctggcaggtcaagatccacaaggcgtacggcgacctctactccgccatcatcgacaagaaggtggcgatgaagattgggccgggggattggtcccccacctccgacaaggtggacgtgggccagaaggagtggaagctgctgcattcgggccccaattttgcagtctgggaggccgtgctctga

SEQ ID NO: 310 - DNA, 525 bp, Chlorella protothecoides
atgctggccaccgccagcatggacgagggcgagggccctagcgtggatctggacaacgaggccgcccccggccagacggtgctgcgggtgaccggccggcgggacgccgcctcgctggcgcgcgtggcccaggtgctggcagaccagggcatgtccatccgctccgcggccatcggcagccagggcggcggcgacgtgtaccaccttaccacacgcgccggcggcgcagtggcggccgacgcctggccgccgctgcgcgacgcgctgctgcgtgtgctgctgcacaccacgcgctccagcaagcccagcatccacggcgcggcggtggacgtggacgcgcgcgcgctcaaggccgtggcctccgaggccgatgcggcggcgctggagagcgcggcgcgcgagatggccgccgccgccgaggcgctggtgggcgtggagcgggagatcatcgctgcgggggatgaagtcagcaccaacgacctcctggccaagcaggcggaggtgccgagcctggtcaggggatag

SEQ ID NO: 311 - DNA, 522 bp, Chlorella protothecoides
atggcggccatggaggccatcctgaccagccggcgggagctgctggagcgcgcgctgcagtcctcggtggctgtccccgactttgtcaagccgcagacggtgcagaccacgggccccgctgcgggcaacggatatgagatcatcctgcaggccttcaactgggagtcgtgcaaggaggcgtggtggaagaagatggcggccctggccccccgcgccgccgaggtcgggttcacctccgtctggctgccgccgccctcggacgcggtgtcgccgcagggctacctccctcgcgacctctacgacctcaactccaagtacggcagcgaggcggagctgcgcgactgcattgccgtcgcgcatgaggtggggctgaaagtcatcgccgacatcgtcatcaaccaccgctgcgcacactaccagccggcaccgcacgctggctgcctgttgacaacattgtgtcggctgtgcagggcttcctacggcagtgccagaatcccgcaaaccgctcaaaattccggctga

SEQ ID NO: 312 - DNA, 1737 bp, Chlorella protothecoides
  modified_base (996)..(1005): a, c, t, g, unknown or other
atgtctgtgttcatctgcgtgacctgtgctgcccagtacgaggggcaagaaacaccgtcctgctgccgcatctgcgatgacgaccggcagtatgtcggcgaaaatggctccgggattcaggagtggacaaccgcaggagctgtcgaggactccggccaccgcaacagtatcacccaagtcagggagggcctgcacgtcatcgggttggaacccccgctgggcatcgggcaggtggcccacctgatcacacggccagacggcaacatcctttgggactgcctgtacctgtcacaggcgtctgtgccggagatccaagccctggggggtgtcagctcggtggtcatctcgcacccccacttctacacagcggctgcatcctgggcgcagacctttggctgcaaggtgtgctgctggcgtggggcgcaggtgtgtggggtgcacctcgggactgacctcacagacgctgaccgggagggttctcacacccgacatcagactgtgaggctgcccaacctgcaggggggccatgtgccatcgtgccgcagcacactcagcctcagccaccatgcctgcagcacaggtgtacgtgcatgccgccgatgcggggtgggtgacgcagcccttccccagcctgcggcaatggacgggggacaggatggatctgggtcccgggctcacagtgtaccgtctgggtggccacttcccgggatcaagcgtcctcctgtgggacgagcaggagcgtgcgcccgagggggtgctgttcacaggtatcgcagcgacagcatgtcacctgctcctgggtcaagtctgcgtgggcccatgcagactcgattcggctggggttctggggatccaagcctgggcctgggactgcgatccaaccacatgagcacagggccccagctgccaccctgcgcgcagctggaattcacctgccccctcctccccctcgggcaggcgacacaatcatgcccactccccggggggccaccttcnnnnnnnnnngctcagctggggtcctggggatccaagcctgcgcctgggactgcgatccaaccacgtgagcacagggccccagctgccaccctgcgcacagctggaattcacctgcccccccctcccccccccgggcaggcgacaccatcatgcccactccccggggggccaccttcatctgcgtggcagcttcgcgcacagagtgatcgaggagaacgcgcgagaggtggtgctgcggtctgcggccctctacatcggcctcttggatggaacagaggcacggatctacttttaaggggaatggcaccatctcccatgcagtttctcaggcgccgatgtggcacagcatcaggctgtgaggctctgcaggctctgcgccgcaggcgtgcacgaccgcgactggctggcagaagagggccgggggtcgacagggccgaggcgcctagcggccgtgccgccagcaccacacgtctggtcaggcggagccagagtacagggcgagggggtcggggtcatcaaggtgggctgcagggtggcggcactgtggcagggtacaagatcgtcgggctcaggtgtctgtccaaggccttccaggcgcgtcatctgtttcgagaccgcagggtcctggcagcaagcaggggagattccctggctctgcccgccttggcgccgccggccggggccttcgaggaccttccacctgaggtcctggtcctcctggcagacctggcacgagggtga

SEQ ID NO: 313 - DNA, 237 bp, Chlorella protothecoides
atggctcagcccgaggcactgcgcatcctgcgggagctgcagagcaggccagacaacaaggtttgtgttgactgtgacaccaagaacccgcagtgggcctctgtctcctatggcatcttcatgtgcctggagtgcagcggcaagcaccgcggactgggggtgcacatcagctttgtcaggtgtgcctcctgggaaggggggaaatggggcctggcagtgcagagagactcgtactag

SEQ ID NO: 314 - DNA, 567 bp, Chlorella protothecoides
atggatgcctggaaccccgaccagctcaagcggatgcagctgggcggcaacggcgcctgcaacgcctttctcggcaagtacggcgtgaccaagcacaccgacatccgggaaaagtataactcccaggccgcggagttctaccgcgagaagatcaaggcggagctgaatgggcaggcctacacgccgccctcccctgcggaggcgcgcgccgccgcccccccccgccccccgctcccctcttccgcctcgggcacgctgcggcggggggaggggagcagcggcaacgtggcctcccgggggatgggcgcggggtgggacagctgggacgagccccaggaatcgagcggcactggctctggcggtcgcccgggctccagaggtatgcagagggggatggggaaggggcaaccgggtgacgcccagggcgatttgggggcagaggcccagctctccacgatgtgggcttggaataatctgagaaactgcaaggctctgggtcacatggggcagcactatcgtcctggtggggcaagacggcacaggaagccttgggtgcctggatggtga

SEQ ID NO: 315 - DNA, 741 bp, Chlorella protothecoides
atggccggcggcgccgacccagtgccggagaaccaggcggccgcgctgcgcgcgctgcgcgcctaccgcgcgcccgatgcggccggcgctgccgcgccggggcccgggctgcgggacctgcccgacttcctgctggcttccctggtgtacatcctggcggagcaccccgacctgccgtccgccgccgacctggcggcggcgacggccgcggctgcgggcggcgccctggccgccgccggggacgcagatgacgacgggaatggcggcgcgccctcgaccccgcaggacttgctgcagccctttgtgcacatgctccaggtcgggctttctttcctcttgggcaggggtgatcactgcgtcaggcgccaggaggaagctgctgggtcctgtaaaggaatgtgcaacgccacgatgaccccccaccttggcccatcaccgccacttcaattgaccctggtccttcgcaccccctccgcagtttgcgctggaggtgctggtcaccccgcttgccggcgaggccacccaccccgacaccgtggctcgatgtgctgggccggccagcaagctcctgcacaccctgcgctactgcgccgtgccccacggtgcgttgttgtggtcgggtctcactggccgtgggcaatcagggacttttggcaagtgggagtctgcgagcagcatgggaaggtggaggtaccgctgcagggaccgggttcgacagcacatgcggcccaagcccggtga

SEQ ID NO: 316 - DNA, 687 bp, Chlorella protothecoides
atgcatgcgcctggtaaagagtgcacaaaacaggctgcagctccccaaccattgcagccccctcccatgcacacaggacttcatcaatcaggggcgtgtggagtactactacctgccgcgagtcacgccaataactgtgcctctgatgcaggtgccagattgactggagtttgtgcatctgagaccaagggggcacttcctgcacattgtgtggattgcatgctgaaaaggaggctagccaggggcaacagcgtgtggtgtcctgtcttctgcacgaccaccccttgcatcgtatcgcatcagccctctcctggccatgccaaagcagcaacttaccatcgcccttcttgctgcatgcaatcatacaagctcacacatatcaagctgtatgacttgtgcctgcgccatgcaagcccactccatgccttcatcgccttcatcgatgttgacgagttcctggtgatggcatcggccgagcgcgcaacggggctgccaggcctcctcaaggaatttgagcagcacggtgccctggcggtgaactggaggctgctgggctcgggaggtcggtggctagggtactggatggggacggaggcctgcagaggggggccggtgtgtgctgtgagtgaaggagtcttccctcccaggaaacaacggcctacatgcccagacctgcacagactttga

SEQ ID NO: 317 - DNA, 1416 bp, Chlorella protothecoides
cagctgggccgagccggggtgctggcccaggccggcgtgctggcccaggtacatggggtgcatgttgctgtgctgagtaccgttcaaggtgggggcagggacctgctggcggggccacccgtccgccatcgctccctgggagggtggtttaacgacattgggccagtgctgcttggagcggtggggatgcagggatcgaagggacatgaaacaccgagattttatgcaccctcacctggggctaggcagtcgaagggggtgcgggagtcatgggatacggagaggcgcaaaggagagcttgtgagtcttgtctcgactgcatgtgtccctgcgtccgaggtatggcacttcgcaaaatcgaatcaagtggggcggggagaagtacctttcggttcgccacgcatgttcctgacgctcctcgatggcacaggccccatagcattggcaatttcggcatttatcgccttgacactagggcgttccaatagtctagcttacacgatctatgactggaaggtcattgaggaggctgcaacagtactcctgactgtggattgctggtggcagccgcggccgcagcaaggagcatcaacaccttcaaacaaactctgttcatcacttgacaccgcttcccgtcgccatgtggttgcctcttggacttttcccaggctttaccttcgagcctcagctggcatccttgcccttcatgtagcctgccaatgggaggcatcctcggggcctgctcgattaggaccaaattgcgctgaagcccgctcccttcttgttactgtggacaggcgcatgatctcaaaacagatccacggcgaacaacacacttgtgttcggatggccggggaaaggaaagcggagcttgtccacaccagtcatcgtatggagagtggcgtggacgggcgaccgcagcgatcccggtgcagaattgctgccttgctgttattggccgtcattgcctgctggctcccgatcagccgaggagaaggactggagaagtctgcgactggcggccaagggctagaagccggatcgcgggttgcacaggttcattccctgggagacggccagactctggatgctggctctgacgccaggcagctgccagggaatgcaggctcagctgcagagaaggccaacgcatcggcccatgttaaggaagctaagcaagctcagggcacccctgcgggacaggagtatgtcgccatctgtgccgccacgaaggatgcgggccccgatgttcgggagtgggcagactaccaccttcgcttgggaatcacccgtatctacctgtttgacacggacaatcccgagcctgtggagccagacattgcagtgcgtctcttcctcttggagggaggagagggccttcattgtagacagggtggtggggatgtgactggctga

SEQ ID NO: 318 - DNA, 654 bp, Chlorella protothecoides
atggagtgtcgtggtggtgacggcgaaggcaaggagtacgcttcgcctcaagagttctgggatgaggtcgcagccgcacggtcctccggggctgggccgcagtggtatgaccaggcggtgcgatactgggacacccaggaggccagcgacgatggcgtgctggggggattcggagagctctctgaccctgatatagtggatagtaggaagtttctggccaaggccctgcttctgcacacctaccaggaggtcgacctggtggagccatcgggtgtgtactgggcagggccactggcatcgggtgctgaggtttggggctctatgactagccccagaccacacgcagctgctttagaagtgcagggtgcacctctcaatccaccgtccaatgtccactcctcagcgcacctgctggagagggcgcggacagccttcgagggccgagctgggaaggatggcatcccacccggccattgcgtagtcaactacttccagcaggggctggaggccttccacccggagccccagcgctacgacgcgctctggctgcagtgggcagtcctgtacctcacagatggtggggctgagctgatggaggcagctgccaggggttggggcaggcgcccttcggcgatcagggatatcctcacatga

SEQ ID NO: 319 - DNA, 1575 bp, Chlorella protothecoides
atgggtaccgggaggagactctcaccactgcgagaatcggcaggccgggcgcgggccagccggtggcacgacagggggttgcgcatgggttcagccgggcaggctttcccatcccatattgataatgatatctgcagagtttcccattcaacatacacccagcctcctgcccgcatggtagtttccctggagggcgacgccttcgcccgcctctacccccgggagtactatgccaaattcgtctcacagggcatgcgccccgatggacgcgtcctcacccaggagcgacccatcagcatcgtgcgggacgtcgtggccggcgcagactgctccgcgctggtgaagctgggccgtgcgacggccctggccggcatcaagctggaggtggcgagccccgacgacgagcggcccggggagggcagcatcatcgtgcaggtgggtgcagctgaggttgggaggggggactgggcacctggtctcccccgcactggctgtgccaatgcaggagccccggcgagtgatcctgtccaggctcggcagcacccctgcccacccacgcctcgccgctttccatcccctgcccccccaaaacaaccaccaggtggagctgccgcccatgtgctcggccagcagccggcccggcctggtcagcccgcgcgccgcgcggctgacggaggagctgggcggcctggcagagtctggtgcgctgtgcgacctcgcccagctcacccaccccggcggccgctcggtctgggtggcctactgcgacgtgtacgtgctggacgcggacggcagcctctccgacgtctgcctgctggccacgctcgccgccctacaggccctccgcctgccagcgctggagccggagggggcgggcggcgcggcggcgccagcgccgcacgacacgccagaggggcccgccgcccctcgggccctgcgcctggagcccccgctcacccccctaacctgcggcgtctttggcggcgccctggttgtggaccccaccgccgaggaggaagccctcatggacgccctggtctgtctgcgggtgaacggcgacggccagcttgccggcgtgagcaagctggggggttcgggacttggcagggagcacctcgccacggcccacatggcggccatgcgccgacactcggcgctgcagggcccgtagacggcggcgcggcttgcgtggcccttcgggctgcgcgatcccagtccccgagagccccagggaaggctctgagtgcatcgagccgggggcctgcgcccctgcaccctcccagggccggcacaggtccgggcatcaaggcaatgtccttggggccaggcggtggcacagcacaggcagttcaggaggggtgtccctctgaagctgcaagatggagagtctgggctacccaaacacactctgcatggttgcgctggggcatgccggctgaaaaggggacacctcaggccctgcaatgcatgggccaccgggatgctggtctcaatcccacatggcccccaatcccacggaaggcatggctgccagagcatcccaacagcctgaacacgtgtgcgccagccctgtga

SEQ ID NO: 320 - DNA, 891 bp, Chlorella protothecoides
atgtcacaggcccgcggtctgtccagtgccctgtccgccgcctcctccgcctgcgatcacatccgcgactgggtcctgggcaccccaggtgaggcggggtggagggtaaaccggggtgccatcaccatgcttccctgtggaacagtgctggcgccggccatgggagggcgtgtgggagtgtcgctgtgcatgtgtttccttttgcagggggggtttaagaaactttggggtcccggtgccctcgagcacgtgctgcctcctgctgtgcacgctctgccggcggcctggggtacgcaatctgcacgaggcagcgccatggccgcccgccactggccccagacgctcgacactcggagactgacgttccacactcacacgcgggcgcccacagagggcacctttgtgagcatgggtgtgctgtccgatggaagctacggcgcccccaaagacgtcatcttctccttccccgtcaccaccaaggacgggaagtggagcatcgtgcaggtgtggagggggtccggaggggaacgttggttaacactctcgcggagagcactgggtggtggccgcccctgcacggcgcgcccgcactcgcacgcctcggccttgcaagctgcagacctgaatgactcgaggcctgctgccctgcaagcctacgcaccgggcccctgcctggccctgcgcccacccccctcccccctggcctggatcaccactgcagggcctggacatcgacgaccgctccgcccagctgctgaagaccaccggggacgaactggtggaggagaaggcgctggcccaggagtgcctggcggacctgtgaagccgcccctgacgctgagggtgggcctcctgaccaattcctcatgttccgctgggtaccatgtgtaa

SEQ ID NO: 321 - DNA, 819 bp, Chlorella protothecoides
atgcgtgggagccgtcgatcctctcccctcatcccatcgacacaacccgctcccacgcagatcctggtggtggccaaccccgctaacaccaacgccctgatcctgaaggagaatgcgccctccatccccgccgagaacatcaccgccatgacccgcctcgaccacaatcgcgccctgggccaggtgagaccttgcgggggacggctggaaggggggtggacatctcctgggcggtgccggggcgtgttggaccgcagccaggcacgccccttccctccccctcctccaccaccactgtaccccccctaccgcccaccgcagctgtccgagcgcaccgggacgcacgtgggcaaggtccgcaatgccatcatctggggcaaccactcctccacccagtacccggacgtcaaccacgccactgtggacggcaagccggcgcgcgaggtggggcggcttgcggagctcctcgtcggtggtggcatgagttgggggcctccataccgggccccctccccatggccccgccctggcatgcccttccgcgggacccccccctcaatccctgccaaccctggcggccccccgtccgaccccgcaggtggtcaaggacgacgcctatctggacggaaaggggggggggaggcgccgcctggggcgctggagggtgcagcagtgtggcggggtgctggagggcggcacttgaagggcagggcggggctggccgcacaggaggcatgcatgagttggggctgctctgaccctggtggtacatggccgcggatgctggcctgggacgagagggcggggcaggcctggtaa

SEQ ID NO: 322 - DNA, 306 bp, Chlorella protothecoides
atgggttttggaaacaaaggagcatgtgcttggcgacagcccagcaggacagccgccacgctgagactcccccctgacggccagcgtcgccgtaccccttgggttcacctgccccacgcctcacctccgcccctcccccgccaggccggcatggagcgcaaggacgtcatgtccaagaacgtgtccatctacaaggcccaggctgccgcgctggagaagcatgggaacaagaatgccaaggtgcgggcggggcgagtccgacgtcggcccggggtgatcgtgcccggcacctcgccatcgccttga

SEQ ID NO: 323 - DNA, 417 bp, Chlorella protothecoides
  modified_base (372)..(381): a, c, t, g, unknown or other
gcgccggcgccggacgcggccaagcgccccgcgccgcgcccgctgcgcgcgggctacgcggggcacctcacccacctcgccaaccgcctcgtcgcgacggcggaggaggagggcggcgcgctcgtacgcgaagccctgcgcgccagccccgagtgggaggccttcgttcgggaccagctggagccgcgcaacgcgctggagagcgtgtttgcctggcagtgcggccgccccaccatgcatggaggtgagcaggcttgtgggttggtcgttgaggaggggctgggggtgaaggagaaggggggcaaggggcggctggatgggggattgacgggtggatggccgagtcagggtgcccaggcaaggatcggaggnnnnnnnnnncgcagcatgccacctcgcagacccagcttgccatga

SEQ ID NO: 324 - DNA, 1074 bp, Chlorella protothecoides
  modified_base (47)..(56): a, c, t, g, unknown or other
  modified_base (786)..(795): a, c, t, g, unknown or other
atgcccgtgagaggggcagagctcgacttcgtggcgcagcattactnnnnnnnnnnaagagccatcccggaatcaagctctcaaaactttgaatccaaagatgtccgtgagaggggcagagctcgagttcgtggcgcagcattacccatacagattccgcaccgtcctgtgctgctgggtatccgagcaggacatcagagcccgcccgctccagcctgctccctcccacaatgtcccagcatcgtcatcggcggccgaatcggtgggtggcaggggcccgtgcagtatccgcgagcatcacctcctccattagtcttccagccctcccacctctggatggattccacccatcaaccgatactcacaattacctccataccaagcacagagcggtacgaggagcgatgcaccttcaccagctttgggaactggctgatccctgggcgcctgatgctggggcggtaccccttcatcgaacccagtcgctgcaggtccagggaaatgggcgaggcgcagcttaaacaactcctggaagccggaatcacaacattcatctgtctccaggaagagcttccgccccaggctgagctgaccgtgggtgggcacaacggcttccaggcatacaaacctattgccggtctgcttgctgcatccctggcaccccctcccagccaggagcagttcaacggtggggtggcttgggagcggggaggagacctggtcaagatacacattcatgtactaattgcagtttgtgctgctcctaaacattctcaaatacctgtnnnnnnnnnncagagacctcaccttcctgcaccaccccatctttgtgctgctcctgaacattctcagatacctgctgtgcctcttgccatccgcacgtgcatccacagcctcctgtccttgcccttccccccttgttcagggctcaggacccccgacctggacaagttcctgccaccgcgccgcaaggcggtggcagacccagaggcagctgcggcaaggatctccagagacctcaccttcctgcaccaccccattgtggacctgggtctgcctgagccagacatgtga

SEQ ID NO: 325 - DNA, 3222 bp, Chlorella protothecoides
  modified_base (2096)..(2105): a, c, t, g, unknown or other
  modified_base (2899)..(2908): a, c, t, g, unknown or other
  modified_base (3001)..(3010): a, c, t, g, unknown or other
atgtttgtttgccacttcacccaggccctcttcatcgtcctgccctacaccgtgtcggtgtatatggtgcgcgacttcctcgtggccggcgccgcgcccggccagcccgtgcccgagcagcgcgtgggcgtgctgaccggtgcgctgggcgccgtctcctccgcggccgcgctgctcaccagctacccgctgggcgcactgtcggaccgcgtggggcggaaggccgtgatcctggtggggctggcctccagcgtcgcctcgctactctggtacggcgccgcgccctccctgtcccaggccctggccgcccgcgcgctgggcggcgcgttcaacggcgtcatcggcgcggagaaggccatgattggcgactgctgcgacgcgcgcgccgccacccgcgccttctccctcttctccttggcctggggggtgggcgcgctcttcgcacccgtcctgggcggcggcctctcccgcccctgcgccggcgccctcgccggggccacctgggcgtgcggtgacgcgggcgccccgctgcgccgctggccctacctcctgccctgcgccgtgtcggccgcgctgtgcgcgctggccctggcgctgtgcgcgctggggctagaggagacgctgccggggaagtgcggcgacgaaggtctgggctcagggcaggccagcctgaacctcagcctggccagctccgtccagctgtcggtgcggcgtgagggtggcctggacagcgtctccctggactggccggcagacgaccgccctggccaggtggggccggaggcggaggcggcaaccctgctgccgcagaagaccgacggcagaacggcgcccgggcccgacggggcgggcgcacaactgccgcacacggcctggcacaaggaccggctggtcatactgtgcctgatcggctacggcgccgtggccttcatctacaacctgcatgtgaatacttcatcagagcgtgctgccctgcctgctcccctccgcatgccctgcgctcgaggtggccacccctccccctcctcgcccgccttccctctccacgcccacctcacgtgcacgccaccctccccccccgcttcacctccacagcttcgacgagctgctcccgctcttcgcctcagccccgcattccgagggtgggctggcactgcagccctcgggcctggccccctcaaacgcctttggcggcgccgtgctcatcctgttcaccctcctgggcctgggccccgcgctgcgcgcgctgggtgtgctccccgtcacccgcctcggcctgtggtgcgtactgccctttgcagtcctggtccccctggccagcgaggcgccccccggccgcggcgccctgctgcaggccacgctcttcgctggccaggcgctgcgctcgacgtcggccgccaccgccttcaccggctgcctgatcctggtcaacgccgcggcgcagcgctgcggcgcgctgggcgccgtcaacggcgcaggacaggcgctggcctcggccgtgcgcgccgcggggccgctggcgggcggcggcctctgggcgggcgccgtcgcgctgggcggcgcgccctggtttcctcgcgccgcgctgcagtacgtgccctttgccgcgttggcactcgtggccatgctggcgcagcacgtgtctgtgcagcctggagtcagattcaagccgttccctttggcgcactcagtcccagtggggcgtcctgtgtaggagcacatactgcaccccggagtcaggttcaagccgttccctgtggcgcactcagtcctagtggggcgtgctgtgtaggagcacatactgcacgaaggggagcacagtcacgacctcccactccgaggcgttgcctggaggttgggaggtattgtgatggagacaccaattcacccatgattgtacactacattacccttaccaatatcatcaccctagactcggtcaaggctgggcatggcgggctgatgcggcaagaatgctgggcccatcccctcacagcctccttctcacaaggcgctcacctggtttgtctaggtacgaccagccttgctccgcaccagggtccttccagcgctgcgtcaccaggtatgcgcagccnnnnnnnnnncacactacattacccttaccaagatcatcaccctagactcgatcaaggctgggcatggtgggctgatgtggcaagaatgctggccccatcccctcacagcctccttctcacaacacgctcacctggtttgtctaggtacgcccagccttgctccgcaccagggtcctgccagcgctgcgtcaccaggtatgcgcagccgtcagacgtggcccacgcgttctccggctcctcccggttcagattgttgagctggcgtggggaagaggctgtgccgccctgtcatgatcaacaaggacggcggcatgagtacaggtgtatgggtgtcgggagaatgacgtacattggggacatgcgcacattgctgcgctgcacgactgattgcacattgcaggctggcgaggaacagcaccacaaacctacctcctcggcgctgaagggccggggcaggagcccggtgaagccagacttgacgaactggagcctgtaccttggtccaggcagccagaaggagctggggaagcggtaccactccgcgccgaggcagaccggcacctcgtggcccgagccctgcagggagggcagcgccgcaaacacgagcggcggggcgcggtacccggtgtatagcgccgccaggcgggagatcgagccgagggcgaagagtgccagcacgccaagtgtcagtgcgcgcgaacccctgcgcgccgagtgcgctttccagcccagcatgcggagtgcggcccgactacttctcccaagggcaagcaccgtggtgccggccgccacacacatctggnnnnnnnnnnttgtccccagcccattcatgcaggcagagcgtctgtggccgggacgggtggcatgggtgctcgactccgcatgccctcaccaaccctccaccnnnnnnnnnncccagcccagcatgcggagcgcggcccgactacctctcccaagggcaagtaccgtggtgccggccgccacacacatctggggagggagcgcaggtggaggtggcggtcgagcgggggtgggtgatggcaggggggttagggcccagggaccgctggcactcgcatgccgcaagggaagctcggtgcagctgcagaccatgccgggcacatga

SEQ ID NO: 326 - DNA, 876 bp, Chlorella protothecoides
  modified_base (148)..(157): a, c, t, g, unknown or other
  modified_base (546)..(555): a, c, t, g, unknown or other
atgatgcagtcagggatgtcgtaccgagtgacactcaggagtgcccaagtgtgtctagcgacgggcagtgtcgaggatgcagggcaggctctcctaccatgtttctcggcaagaagatgcaagacctctctctcagccacacacatgnnnnnnnnnnagggtgggtgcgggacgggccatgatgcagccagggatgtcgtagcgagtgacgctcaggagtgcccaagtgatcaagcgacgggcagtgtcgaggatgcagggcaggctcccggaccatatttctcggcaagaagatgcaagacctttctctcagccacatacgttacgtatgttctacccaaaccgatgagtccttcaaggtcctcaacctatctgatgtccgcagggaagttggtcgttttcttctggctaaggatcgtctttgccgtggcctcctttgccagtgaagcatacctaatcaggtgggagcatggctgcttgtggaggattgacagggccatccttttgcccttgcgctggcctcctgctcctgtctcccttcaagcnnnnnnnnnnggaggattgacagggccatccttttgccctggctctggcctcctcctcctgtctcccttcaaagggcactgcatgcatgcgccagggatggcaaagtactgcgccccccccccccccccccccagatccatcgagcggagggtctcgccggccctggcgcgcatcagcctctccctcctcaccgccagcagtgcatgcttcattgcgtccaccgcgttcctgccttccaccttcaccggcctggcactggccattgccgtggccgccgcactggagcggcgggtcagtctgaccgtcgcagtctctgtggcaggtgcctag

SEQ ID NO: 327 - DNA, 1941 bp, Chlorella protothecoides
atggcgccgggcaggcccagagcgcgcagcgtggccagcacgcgctcgacatcctcgcccagcccgccctcgccgtccgccaggagcagcacgcagtccgcggcgcgggccaagtccagcgcccccagcgcgtcgccggggacgggcgggggcgggagcagggtcaggcgcgagcgccgtgcatcgctcgtggtgaccgtgaccgggcggggcggtgtgtgggagccggtcgcctcgggtgcgccgcacgccgccagcagcgaggcccaggccgcggtcacgtccagggaatcagagagcgggaacagggccaccacgcgcggcggggcggccgcccggcggctggccagcagcgctgcgcgcttcgactcccgtacctgcttggccgaattcaggcggtcggcccggcgctgctgcacccccgcgccggattttatgggggcgcgaccaccggcatctgggggattggtggggcagggagttggagagagggtggggcgccaaggctgcccacgcaatgctgtaggacccaccaccaccagggaggggcttccagaattgatgatgacagactccagaccccacgtagccctcgacacacctttgctgtctttatgcttttcacgggcgctcctaccagccctacggccagctttgtgggcctgtggaatgggtgagtgtggttggttgtgtccggcatgcgcaggcccggagcccgagtggtcccgggtgaatggccagagagtcccaatggattgcgattatgtagaaagcaggctcggagcccgagtggtcccggatgaatggccagagaatcccaatggattgagattatgtataaagcaggtaatggagtgtcatggatggtatgcctggtgtgttcaccttgttgtgttgggacccggcgccagccattgcgagtgactgaatactgctccattctcccatgcacggcgcgcgctcaagtttggccctcccgctgacattgaacccatgattgcgaatcgcgcttcaggggccatgacaaacctgcactatcgcgcaagtctcccacactccctgccgggatccctggccagacgcggaagcgctgtggacagaggcaggacggtgatccctcacgcgcatcccctgctgaaacaccagaatggcggaggtgtacgatcaggaagtgcagctcgagaaccttttcaagaccctgtccgatggattcaagaagctggacaagctgccagaaggcagcaagcgccagtccctgctcaaggagctcacggcgcacatgcaggaggccaagattcatgcccaggcatccagtgtgcactcacctccctttcccatcaacccgccggcagcctgatccgagagtttgagcgggaggcacgcctggacggcctgtcccccgaggagctggcggcgcgccgcaagcagctggtgcaggagctgaacggcttcatagggctgaagaaggcttacgcacacggccacatcccggggcgggacgagctgatgcaggtgggcccctctgggctgcccacccaggacaccagcaccgtgtcggacctgatggtgtctggccgcaaggccatcaaggagacggacgcctcgctgctgcgctccgagcgcatcgtcaatgacacggtggcggtgggggcgcagaccgccgagacgctgcagctccagggccagcagctggggaaggtgtggtgtgtgtatatgtgtgtgtgtaaggaaggggggaaggggcggtcggaggacgagctgttactttgcatggaggtcgctacatgtggaggtggggctgtggcctattggatgcctggaatgcaggccgcacagatggatctgaggggcaaggcctctggcctcgtcgcatgcaatgagccggtgggcttggggctcagtgtcctgcagagtctactgagtcgcacgagggatcgctga

SEQ ID NO: 328 - DNA, 489 bp, Chlorella protothecoides
atgctgggctggaaagcgcactcggcgcgcaggggttcgcgcgcactgacacttggcgtgctggcactcttcgccctcggctcgatctcccgcctggcggcgctatacaccgggtaccgcgccccgccgctcgtgtttgcggcgctgccctccctgcagggctcgggccacgaggtgccggtctgcctcggcgcggagtggtaccgcttccccagctccttctggctgcctggaccaaggtacaggctccagttcgtcaagtctggcttcaccgggctcctgccccggcccttcagcgccgaggagggcggcacagcctcttccccacgccagctcaacaatctgaaccgggaggagccggagaacgcgtgggccacgtctgacggctgcgcatacctggtgacgcagcgctggcaggaccctggtgcggagcaaggctgggcgtacctagacaaaccaggtgagcgtgttgtgagaaggaggctgtga

SEQ ID NO: 329 - DNA, 270 bp, Chlorella protothecoides
aagaagacggtgaccctgacgctgtgggggccgacggctgagggcctgggcgccgagctggaaagcagagccgctcagcaccccgtcctctctgtctccgcctgccgcgtgtcggccttcaacggtgtgtcggtgtcgaccctgcaccgcagcgtcctgagcgtggaccccgctgggcctgaggccgacgctctgcgggcctggtgggcgggcgagggcagcgcggcgcccaccacccacgtcggagagggcctgagcggcgcagcgggg

SEQ ID NO: 330 - DNA, 885 bp, Chlorella protothecoides
atgattcggtgttgcccaaggggccttccctctgcccgcaacctcccctccgtccatcccccacagaaacaagctgagtttgaggcctttgaccttgcggacctgcgccgccgggtgcaacaggtggagagggcatgcgccgccgtcggctcgcccaccgtgctggctcacaacgacctgctggccgggaacgtgatggtctccgacgctttcctggctgccgggaccgtggctggcgagtccaccgctgcctcgcccgtgtccaccacctcggcccgcaacgacatgaccttcatcgactttgagtatgtggattgggcgccacgcggctacgactggggcaaccacttcaatgaggaagaagcggcgggaatacaggtggatgagcatcaaaggacaggcttcagtgcttggcgccacgtgccgattgacggcttgaggattgacgggtctcgtgatacgggcagaccccaccggccccggggcagattgcgctcctgcactgcaggggccaccgactatggtgccctcttacaattcaagtttccccaacgcaggtacgctggctttgacggcgactacacccagtaccccagcgacgaggaggccggcgcctttctgcgcgcctacctggcggcggaggccggcgtcgccccggcagagatctcggcggacgcggtggcggacgccgtggcggaggccaacctgtatgccctggccagccaccagtactggggtgcatggtgcttcctgcaggcccagtggagcctgctggactttgactacctcgagtacgcgcgggtgcggtgggccgagtgcgccgcgcgcagtgaggccttcctggcagccgccgcgcagcgctttcccgtccaggagggcgcctga

SEQ ID NO: 331 - DNA, 477 bp, Chlorella protothecoides
atgcagcctccacggcaccccgacgccgcacctcagcattcatgggctcgcggtgcgcaggtgggcttcccgcgccgcgacaaggccaagttcgccgaggcgctgagcaacacgcattgcacggtgtgggtgcgtgcaacccggaagtcgcgcatggcgcgggagggccagctgctcgcctttgcccgggcgaccagcgacaaggccctgaccgcgaccatttgggacgtggcggtgagtggttgccagggggaccttggtgttcctttggtgctgaaggaggggcggaagctgatacacgagggctgctgcggtgcacagcactgggctgctcctttggatggtactgtgcagaaactcgcatgcccagataagcagtcatttccctttcaacacgctcaccgtgccaggtcacgcccggctggcagcgcatcgggctgggcagggcgctggtggagcgcttactggaggcgctga

SEQ ID NO: 332 - DNA, 876 bp, Chlorella protothecoides
atggcggcgctggactcggattttgcccggtggtggcggttgggaagcgagccgagcgccctgacaagggggcgcagcttcttgcatccgcggcatgagcctcgtacacacaggggcggtgccgtgcctcgccgttctttgaaagccgcaccctgtcgtgaaggcactcctcctcgcttgcagccctaccctgactcccccccaacaaacattcatatgcccacaggcgtagcggccgcctccaacgccaggttgtccctggccgacatccgcgaacaggggcccacctccgctggggtcaagccggtgttcagctccgccaccgccacggtggccagcatcaacccggaccagagcctgtactacgctgccaaccccgagaacaatcgcaaggtgcagggagagaagaggaatgggtatgtggaggtgaagggtgcggcgccgcacaccccattgcccttgctatccacgccgcgatgcgcccgtgcccgactcgcaggtcgtggagcagggccccggccagtggtactgcgagtacagcggcaccaccctgcccagcatggtcaggcggggggtccggctcttgccgcaggggtctggccaccaccggccgctgtgctttgcagtgagcacgcttcgagccggcatccacccccctcccatctcccctcgactcctacttcccaggccaaggtggtggatgagagcggggagtgctttgtgcaggtgttcaatgaccaggcgcaggagctgctgggcatgtctgccgacgacctggccgccctcaaggacgccgagccatcgcgcttcctggccacgctcaaggccgccagctggaaggactgggccctgcgggtcaaggccagtgcacagtga

SEQ ID NO: 333 - DNA, 1839 bp, Chlorella protothecoides
  modified_base (1369)..(1378): a, c, t, g, unknown or other
  modified_base (1445)..(1454): a, c, t, g, unknown or other
  modified_base (1548)..(1557): a, c, t, g, unknown or other
atgccccggtccatgatcaagcaagtgctggaccggggacgccaagcagctggcgcctggcctggagctgtgcaaatccgtcgcgcccgcctccccgaaacatcccctcggcctgcgcggaggccgggcccgggcccagccgcgcatggcgacatgacggaaaaggatgaagagccccgggacgcggatcatcaggttctggcgccggagcctctggaggatgagcagcggctggcacgccgcacgctgctggcggagtgtcgcgaggcgctgaaaccactgccctccgatgacctccacgagatcccagggaggtcagtggtgtcacagggaggggctcaggattgcgtgtgccgggcaatggcggtgcatcgcgccgtgtccttgggccaagtgccaggaatcctgcctgcaccgcctcctcccccttgcacccccagccattttgggagccttgcctgcaggcacgccgctcagcaatctgcccgggtggtgtccccccctccacgaccctccccccactccctcccccctcacaggccgggggtggtgtttgctgtcaaggactacagcaagcccgacacgctgcgcgagctgagtggcaaggaggcggcccgcaaggacgcccccttcctgttccgggccttcgagaccggacagccgcggccgccgcagcccgggtcgaagcgcgcggcggccccccgggccttcaccatccacgagtacctggactggacggtgaccgcgccggacccggtcacgctggacgacctcgactttggcggcttccgggtagtggtcctgtacccacgctacctttccctctggcccgcgccgggcgccgtcgaggctgacgtggcggccgctgccgcggaggacgagcgcctggcaaaggccgggggcgccgccgcggcaccgctgcgccaccgccgcctcgcctgcagccggccagccatgccggtgctccagacgcacgcgacgcccatctgtgcggcgaccattcgcgccggacccgggttcctggaggtgccattctacgccacccacgagtccaagcggaacaagggtgagacatgtaggagcgaggggggtgcaggactgggttcgtcgctggaggacctgtgccctggtgcgcccccctgtatgcagtgggtttcaaaccctgcaatcgcattcattgccaagaccacattcccccgcacaccaacaccacaggctatggccgggctctgctggaggccatcgaggccatctgcagggccacaggcatccccaccatcttgctctgtagcacaggtgggatcatgcagcctccgcgtctggaccagggtcgagggtgggtggcaggcctggcattggcggcggtctnnnnnnnnnnacgtctccctgtacgcagtgggtttcaagccctgcgatcgcattcattgccaagaccacattccccnnnnnnnnnnccgctcccttgggcgtggtggctggggactcttcatgcctggcccatgttatggctcttttgtccctgggagggtacaatgccactctcaggannnnnnnnnntcgctcccgtgggcgtggtggctggggagtcttcacgcctggcccatgttatggctcttttgcccctgggagggtacaatgccactctcaggaaccccatcccctctcctcatggacacacaccgccccacacacaacaacaaacctgcagatgaccccaagacgagggggacgtggcagcagctgggcttccaggtgtcgtcgcagagtcagcttgacgccctgggggttacacacatggacctcctccacatggacaacaccgtacaggttgggcagtga

SEQ ID NO: 334 - DNA, 1272 bp, Chlorella protothecoides
  modified_base (446)..(455): a, c, t, g, unknown or other
  modified_base (847)..(856): a, c, t, g, unknown or other
atgcacggtggcgaaatgacatccatcgttgcaagccacaatgcaccaaagcgccctcccctgtcacatactgtgcaggccgccacgaccagtctaaaaaggctcattccagaccccggcaagcaccgccagaaggggctgtgggcgaaggatgccgtcgccctagcgcacctcggcccggatccagcagagatgcagcgcggcgatcttgccgtccctgtggggctggtcaacctgggcagcacctgctacgtcaacgctgtgctccagaccctgtacgccatcccgcccttccggcaggccctctacgccgctcggcctccactgtcccaggatcctgtggtggcccagctcagggcagcttgctctgcaggagcttggttgtaccctgcggtgagcaacatggacagagcctatggggcgcttgatcccaccctcgtcctcannnnnnnnnnggccccgctgattctgggctgcccatggcagcttgctctgcaggagcttgggtgtaccctgcgggagctgtttgcgtgcatggagtggggtaggcgggacccactagaccctgggcccctggtcgctgccctgcagctggaccatgctgtgcagcaagacgggcaggaattcatgaagctcttcctcggactgctggaggcccgcttccaggcacaaaaccccctggatgccttgctcagggtgcgagagaggaaagggggtggaggagaggtcaggaggggcctgcagtgccaccagatgagcgtatccatggctgtgctggattgtccagatggcagtcactcaccactcaccgttgtgcccgccgacacgcactcagcacctgttccgnnnnnnnnnnagcctgctgcgccaccagatgagcgcatccatggctgtgctgggttgtccagatggcaggcactcaccactcaccgttgtacccgccgacacgcactcagcacctgttccggggagagagcgggtacgagacgcggtgttgccgatgcggccgtgcctcggcctcctctgggcggcgagaggggtactatgagctggcggtgccggtgtcgggcttccagaccctacccgagtccctggcctccctgctggccccggaaaccctgtccgggtgcaacagcctggcttgcgagtactgtggcaccaagacggaggccgagaggaagctgcgactggcctccaccccgcccctgctctgcatcagcctccagcgctttgtatttgattaccgggtacgctgggggttggagcggttga

SEQ ID NO: 335 - DNA, 594 bp, Chlorella protothecoides
atgaagcctcgtcagccccctcccaccctgtcaaaacgccccgcagccgcacgctgtacgactatgaaccgggtgctgcgcaccatcggccccgccgcgccgtccttccagacggaccccgcgcgcatgctgcgcgcgctgcgcctcgcggcccgagccgggctcgcgctggaggccggcacgcgccgcgctctcgtccagggcgtgcaccagatgaccggcctgaacttggtggggcgcgcgggctggggggcggacgagcgcctgtgccactccccgccgctgggaccgaggaggccgggccgcctcggtgcgacgtgcgcacgaccaggtggccgtgctctgcatctcacatcccaccacacgggccgcctcagtgcgacgtgcgcacgaccaggtggccgcgctctgcatctcacatcccaccacacggtgcggccgacacccccgctccacccaaaacctgcgcaggcccgggtgcagatggagatccacgccatgctggcctacggctcggccgccagctcactggacctcatgtggcgctaccacgccatggacgtggtgctgccccaggtcgcggcgcacctggcg

SEQ ID NO: 336 - DNA, 3111 bp, Chlorella protothecoides
  modified_base (187)..(196): a, c, t, g, unknown or other
  modified_base (320)..(329): a, c, t, g, unknown or other
  modified_base (594)..(603): a, c, t, g, unknown or other
  modified_base (1551)..(1560): a, c, t, g, unknown or other
  modified_base (1625)..(1634): a, c, t, g, unknown or other
  modified_base (1810)..(1819): a, c, t, g, unknown or other
  modified_base (1942)..(1951): a, c, t, g, unknown or other
atgctggggcggcggcgcagaggcgtacagggactgggaccgcttggattcgtgggaacggttcaactctgtgatggaggaatcttgcaatcgcgcttccctcggtccacctccagggtgcaacccggggaatggtatgcgctgccgcagtccccgcagctctacaagcagatgctcatggtggcgnnnnnnnnnngaagaaggggcgggattggtgccgcagccggtggcgcacgctggggcggcggcgcagaggtgtacagggactgggaccgcttggatttgtggagacggttcaacttggtgatggaggaatctcnnnnnnnnnntgtggcgggtggggtgtggcgtcgcagctggagggcatgcagtgtgccggggtgccaaagggaggccatagggtacggaggagaggaacgtgacatggtgtctccagcaaccctgtgcgtcccagaggggtgtcaaggtcacgctgcagccccctcccccccccctcaattctcgtgcaatcataccctccacgccccaacccctcgcaggtggcccgctgcttccgcgacgaggacctgcgctccgatcggcagccggagttcnnnnnnnnnngagaggaacgtgacatggtgtctccagcaatcctgtgcgtcccagaggggtatcaaggtggcccgctgctttcgcgacgaggacctgcgctccgaccggcagccggagtttacccagctcgacctggagacctccttcatggaccaggaggccatcatagggctggcagagggactcatggcacgggtctttgccacggtgctgggcgtggaagttgcggcgcccttccctcgtctttcgtacagccaggccatggagcggtacggctgcgacaagccagatctgcgcttcggtctggaaatgacgtatgtgaccgaggcggtcaggggctccgacttccggtgggttcctccgtgctggggggaggggggtgcacttgggcgctgggctgctgcaccgccgccagccgccggtgaaacggtggtcactccctccacctgcaggctgtttgcggatgcggtggcgcagggtggcatcgtgcagggcctgagggtgccccacggctctgccatctccaactcccggctcaagggcaagggcgacattgcaggaacggctccctcccgcgcctgttgcattcatgatcagaacgggacactcagtacccgctccttgcaccccactctgagcagcccaggcagccgcgcaagggctggggggcctcgtctcgctccgtgtcggggcgggcggggagctggagggcgcctcggcggttgtgcaggggctggggcccagctgcctgcagcagatgggcgaggtcctgggagcgcagcccgtgagtttggaacgtacagggaaggttctgatcgctggatgggtcaatgcatgactctcaggcatgctttggaggtcttccgtcctcatctgtccctgatcaacatcatcctcactgacacatgccagggcgacctcctgcttttcggggcggggctggcagccacggtgcannnnnnnnnnaaggtgaatgcctggagtggtcgtgcttgctctggggcgggaacatcaggctgccgcagagggannnnnnnnnnatgccagggcgacctcctgcttttcggggctgggctggcagccacggtgctcaagggcatggaccgggtccgacaacacctcggtcgctcccttggactcgtgaaggtgaatgcctggagtggtcgtgcttgcgctggggcgggaacatcaggccacccagctgccgcacaggggnnnnnnnnnncccgtgagtttggaacgtacagggaaggttatgattgctggatgcgtcaatgcatgactctcaggcatactttggaggtcttccgtccctcatctgtccctgatcaacatcatcctttctgcnnnnnnnnnnccttgcctctgcctcatgcacaagcaggactggcttctgggatacaaccatccagcctaccttgcctacgcaggactctgcccactccctgctgtgggtcgtggactttcccatgtttgagagggatgaggaagccggtcgcctggtggccctgcaccatcccttcaccgcccccaaccaggacgacatcgcgcaggccttatcttttatctagcacagcgagcaccccctccatctccaatcctctgcgcagggcgtcccgctggcagagtgcagggcacacgccttcgatctcgtgtacaacgggatcgaggtcggcggcgggagcctgcgcatctacagctgctgaggaccctggtcggcggtggctgcaagacaccctccagtggctgggacctgtacagtcactcactcccagcctttcagcaaagtcaccatccattccttgccctccttccccaccattcaggcgagacctccagcagatggtctttgacgccatcggcctctcacgagaggaggccgccctccagttcggctacctcctggactgcctggaccagggtgctccgccccatggaggtgggctgcatgacacatggcagtccattctccagcctgggagggggtgctcctgtatgtcctgggctggtttcacagtttttgcggcgccaatcactcttcgtgcgtggtcgccgaatgcaccacagccgccagcacccacgccgtccattcctcatcccatcgcaggcatggccctgggcctggaccggctggccatgctgctgtgcggcgccagcagcatccgtgacgtcatcgcctttcccaagacgacgcagggcacctgcgccgtgaccctggcgcccgcccccgtcggcgacgaccagctggcagccctgaggctgcagctcgtccccgtgcctgagaagaggcacgtgtgcacaacagcagagacggacagggcagggggagcacgaaagcggagcacagggaaggggatggatacattgttcatgctgccgcgctttcctccagcacctcccggatggcgacgacgtctgggtgcgcaggccccagctccagctcctggatggccagggcccgggccagcaggggcctgcccttggcgtcctcgccctgtgtgcacggttgggaggtga

SEQ ID NO: 337 - DNA, 843 bp, Chlorella protothecoides
  modified_base (467)..(476): a, c, t, g, unknown or other
atgaccttcctggacgtgcgcgaccacaccggcgtggtccaggtggtcgtcgacgccggctcgccccgcgccctgcacgacgtcgcggcccgcctccgccccgaggccgtggtcagcgtacgggcccgggtgcggcgccgtagcgaccccaacccgggcctgcccagcggcgcggtggaggccgagccctccagcatccaggtgctgaacccggtccagggtggcctgcccatccccgtttctgcaagttctccagagggcgccgacgcgctgcgagacgaggtcaggctccggcaccgggtgctggacctcaggtgtgggtggcgaggggcagaggctcggtggggcggggatggactcggcctgctccaggcgcgccggagccctgcgtgtgtcgggcaagggggtcgagggccaacaccgcaatgggtcgccgccgtcgatcgacttaagcccccattccttgnnnnnnnnnncaccgggtgctggacctcaggtgtgggtggtgaggggcaaaggctcggtggggcggggatgggctcggcctgctccaggcatgccggagccctgcgtgcgtcgggcaagggggccgagggccaacaccgcaatgggtcgccgccgtcggtcgacctaaacccccattccttctttcctccacccagacgcccgcaaatggcgctgaacctgcgcaagcggcacgagctgactcggtgcatgaggcgctacctggaggacgagcacggtttcttggagatcgagacgcccatcctggggcggagcacgccggagggcgcacgcgacttcatcgtgccctcccggtgcgagaaggaggtggaggggtga

SEQ ID NO: 338 - DNA, 1386 bp, Chlorella protothecoides
  modified_base (470)..(479): a, c, t, g, unknown or other
atgatgtggggaactcgggtccgacctagagatcactttctgcggcacctactgaaacaagtctctgcactgacgccccagctagctgatggcacctcacggtcaagagatttacctcgctacggatgggttctggcatcagcggccgtggccagcatcgctggaggcacatgcactgcagtagccgaggctcccaaaccagtatctaaggagaacaagcgacctgtttccatccctgcagggatggagtctcctcacgctggagcagcggcgaaaggtgttcttcaagtgggtccaagggtgggggtggggcgggttgagtatgagaggaagatcagggacctgagtcctccccacaaggtcttcgaatactttgcctcccaggtagggagggtgttcctaagggccactcctggtgcagctgctgatcgtgtgccagccagtcctcacacatatgagtggcctgactnnnnnnnnnnctttgcctcccaggtagggagggtgttcctgagggccactcccggtgcagctgctgatcgtgtgccggccagtcctcacacatataagtggcctgatcatccctcgcagcgccacggaccagctgcctggatgaccgcccaggatgtcatgcggagcgttgtgcctgtgtttcccccatcgaaatcggcagtgctccgggccggcagcctgtggggcgaacccagcccggaaatgaaagaggcagcggcctgccccaaggggtccgcattccttgccctggacatggaccgggatgggaggatagactatgaggagtggctgctgttcctggcactgctctccattcccacagaggacatccaaggtagagcagcgcctgggttgcatctgagccacgcctgcctcgtctttgctgcgtcagcttgctgctcactcagagcgaggactgagaaagccttctccctcctctccacccccttcccccctccagtggccttccacatggtggatgcaaaccactcgggatccatcgaggtgctggaacttgaagcactcctggtctcgctccggaagaggtactgcaagatactacctcacacaggcaacccgcccgccggtgacaccagcagcaccacaggggcccaacctgccatggcacaggcggaatgcggaggcgctcatggagtccatcacgggggcgcggggtgggagcctgacactggcacgctttgcgcaatttgtcaactcactgcgggggatgtgcatgctttgcaatcggatgaccagacccaactgcggccggctcactgctggagacctgccgccctccccaccagggatgaagtgatggccatggagtttgccttttacgacgtagactccaaggtagcggggttgaagggataa

SEQ ID NO: 339 - DNA, 1083 bp, Chlorella protothecoides
  modified_base (600)..(609): a, c, t, g, unknown or other
  modified_base (715)..(724): a, c, t, g, unknown or other
atggcggctcgtttgtttgaaatcacggaggaagactccttcctggtggtcgcgacgtacctcggcgagctgctcgatggtggcgaggcgcccgcaggggagcaggcagagaccccaggctctcgctttgcaacagagagcagggagctgtacaccagcgaccgcacggcggagctgctggacaagtacgtatctcagctagacaccgtgtttgccagcgctggggaggacacaggtgcgggtggtgtgaagtgggggtgggggagctcgtcgactgtggggcatgcacaacctgcccctgctcccgcgcaccactggcgactgtcccacccctggcacttctcccctccctccaccaggcaatctcgagagcgtgctggacatcctgtgccacctggtcccacgcaccgccctgtccagcccccagcaagtcctgcccgcagccaccaagctggccgccgccctcgcagcagacgtgcgtgggcgggaggatggacgtggggccagagggcggcgagggtgatgcaccccatacctgcaccgctgcctctaaccccgggcccctgtgctgacccatttctccttccttccctccccatnnnnnnnnnngagtgggggtggggcagctcgtcgaccgtggggcttgcacaacctgccccctgctcccgtacaccactggcgcccgtcccacccctggcacttctcccctccctcnnnnnnnnnnccaaacgtaccacagggtggcagccacgtgcaggtgcggctgcaggccctgaccacgctgtacaacgtgctggagtcgggggaggcgcggcacgcagtcctgctgcgcacgctgggcttcgctcgcaccacaggctccgccgacgcgctgctgccggtgatccgcgcctccgccgcctcctgggcccgcgacctcggtctggaccgggcgagggagcgggagctgctgtcagccgcggccgatgcgctggaaggcccctcctccacgccgcgggaaagcgcggcggaggtgcagcgcctgctggcccgcatcctggccagctacgagggcgtggccggcaaggagctggccgggggtag

SEQ ID NO: 340 - DNA, 321 bp, Chlorella protothecoides
atggggaggagtgagggcggtctggttgggagctcagcacggcggtcggggcagtcctgtgtcctcttcccgttgggcaaggatcgacagagcacagcaggtaacaaagcatggcctccacctcccgcacccaccgaccccacgcctgcgcagaggggcgagacgtcgctggcactgccgctgtaccaacgggcgctgcgcatctgggagggcgcgctggggccggaccacccagaggtggcgcacgcgctcaccgacattgcagtcatcttcctggaacgggtgaggcgtgccgtgcgagagggggccaggagggcatag

SEQ ID NO: 341 - DNA, 585 bp, Chlorella protothecoides
atgctgccgcgctttcctccaaggccctcctgcatcacctcccaaccgtgcacacagggcgaggacgccaagggcaggcccctgctggcccgggccctggccatccaggagctggagctggggcctgcgcacccagacgtcgtcgccatccgggaggccgggactcttctcaggcacggggacgagctgcagcctcagggctgccagctggtcgtcgccgacgggggcgggcgccagggtcacggcgcaggtgccctgcgtcgtcttgggaaaggcgatgacgtcacggatgctgctggcgccgcacagcagcatggccagccggtccaggcccagggccatgcctgcgatgggatgaggaatggacggcgtgggtgctggcggctgtggtgcattcggcgaccacgcacgaagagtgattggcgccgcaaaaactgtgaaaccagcccaggacatacaggagcaccccctcccaggctggagaatggactgccatgtgtcatgcagcccacctccatggggcggagcaccctggtccaggcagtccaggaggtagccgaactggagggcggcctcctctcgtga

SEQ ID NO: 342 - DNA, 549 bp, Chlorella protothecoides
  modified_base (362)..(371): a, c, t, g, unknown or other
atgctgtgggagactccggggtgtagtggcagtagtagggtttcaccggcccctgatacccacttccaggacctccaaggcgatcatagtgcctcctatgaatccatcccagacagggtcacagcgggtgggggactacctcctggggcgcaccatcggcgaggtgcgctggtgtcgcacgcgccgacaccctttcaggcataccgagcaacgaggggcattatctcttgcgaagaaagcgtgcgcattgccccagtcgggtgtgtaactcccaaagtccccacccaccctccatcgcctgcatcagggcgccgactccagggtggtctacgcccagcacgtggacacgggcctcaaggtgnnnnnnnnnncgccccactcgggtgtgtgactcccagagtccccacccaccctccatcgcctgcaccagggcgccgactccagggtggtctatgcccagcacgtggacacgggcctcaaggtggccatcaaggtgctggacaaggaggcgctgctgacgcgcggcggcgctgcccgcttcccgcgtga

SEQ ID NO: 343 - DNA, 351 bp, Chlorella protothecoides
atgctgacgggggagctgccgttcgacgccgacacgcccctggctctgatgcagtgcatcgccgccgccgactactccctgccgccgacggtgagcgcggcggcggcggccacgctgcgcgccatgctgtgccccgacccggcggctcgggcggggatcgaagaggtgtgggacatggactgggtcgccgcatggcagggcgatgcgccaggcgaggcggcgcgggcgcgcgggggagccgacctgtgtcccgagactcaggcggccgaggccttgctggagccggggtctgactcggcatcgggcatcgaggaagtgtccgagcctggcagccccgtggtgggtcggtga

SEQ ID NO: 344 - DNA, 657 bp, Chlorella protothecoides
atgcatggctggctctgcactgtcatgatctcacctcgcaccccatgctgccacatcattctgacattgctctcgacagggaacgacgagcaatggggaatacatgctgcccttcaagaccggggccttcctggctggagtgcccgtgcaacccgtcgttatcaaggaacgacgagcaatggggagtacatgctgccctttaagaccggggccttcctggctggggtgcctgttcaacccgtcgttatcaagtaccacagggtgagccgggacctagggcacaatctggcccacatgggagactattccccccctccgccatctcttcctgcttttgtgccacccccggcactctgtgaccttcctcgaggcaaccgtgccattcccggggctgctgctgagacctttgagtacttccaaaaggctcaaaggacacagaagtccaggatcattcaagatctctacaccttcctctttacactacagctgcctgtctatgtacctaacgaggcggagaaggccgaccccaagctgtatgctgacaatgtccgcaagatgatggtgaggagcagcagaggggtgtctaaatgtatgtgtctgttggagctgcaaatccatggacagtctgcatccctcctcgatggggtgttctcctga

SEQ ID NO: 345 - DNA, 318 bp, Chlorella protothecoides
atgtgggcatcaaagcgcaccaaagtccccagcctcagtgacccctcccccacccacctgcacacccgagcccaggtgcccatcacgctctacttcatgacgcatgcctactttgcgctctaccacgccctggccaacgtgctgataaggaaagcacggagcatggtgggcccgagaagtccaaacctgcgtatcctggccgaggcagtggtggtcttcgtgctcgcctactccaccgcctacgcggaaacgctgaccatatcacacttcccttactacacgcacaaggcaggagttgggaatgggaggggaagataa

SEQ ID NO: 346 - DNA, 666 bp, Chlorella protothecoides
  modified_base (376)..(385): a, c, t, g, unknown or other
atgccagggagccactgcagacccatgctcccaccgcatgctgatcgaaacaaatctccctccctgcaggacaaggagcgcatgtacaccgtgggctccctcttctacgccatctactttttcgtctccttccccatgttcttccgcatggatgaagacccaaaggcaaggcacatgggtgtaggaggtgctgagtgctggacagtgggccttaggtaccaatctctgaagggatggtcagggtccgttgatgcttggcgtggtggactccctctttacactctctttccaatcatcccccgcgtgccccaaaccccccaggccaagccatacacgctgtggaaagtggttgtggattccctggctgcatgcatgnnnnnnnnnnacttggcacggtggactccttctttacactctctttccaatcatcccccacgtgccccacccaccccaggccaagccatacacgctgtggagggtggttgtggattccctggctgcatgcatgctggtcaccctcctcctcgacttctggaggctggccgtgacagcacagccgggccttccctggctggcctgagcaggctggcttgtcttagtttggtggcttacaatgaaacagatcatgttaaaccacaccttggatcagaagagggtagcaagtga

SEQ ID NO: 347 - DNA, 552 bp, Chlorella protothecoides
  modified_base (242)..(251): a, c, t, g, unknown or other
atgctggcagagctggtggcctgccacgacgccgccctcgatccggccagtgcctcggccggcgccgacttcgaggccctgctggccgccgcggcggagccgctgctggacagcatcgagcgcagctcggaggccctggaccccaacgcctcctccaggtggggcggggtgtgggtccctagaggcagggggagtccgagggtgccagggagaaccggtgagggtcagcatgggtgcagaannnnnnnnnnacgcctcctccaggcttcactgtgcacggcctcccagcctttcacatgcctcggaatgttgagcgacgcttgtggcactgcttacccgcgccctttgctcctcaggctggacgagggtgcccacctggacccctctgaccgcggcatctacctcatcaactgcctggccctactcctgtcccagctggaaggggcggcatgtgccgagggcctggcggccagaatcaggtggggagttgatggggcagacgaggggtttagatggatggaggtgcagatcggatgcatggacgaagattga

SEQ ID NO: 348 - DNA, 663 bp, Chlorella protothecoides
  modified_base (606)..(615): a, c, t, g, unknown or other
atgcggcaccatcctctggagcctacgagcaattgcgtacaacgtcgcagatctcacatcgcaaaatcgtgcaccgcgctgagacaccccctcgacttcgccgcctcgaccatcccgtcccgacaggtccgactggagcagtgcctcctgtccggccccgccccagtgctgtgcttctgggtgggccaggtcctcaccttctacctggccacggtctccaagctcctggggccccaaagcagcctggcaggtgggtgtcttgggagggttgctgtgttgcgagcgtctcttgcgctccgcatgcccggctgccgttcctggccagcgccagaggtgcccagacctgcccttgctgatgcccctgaccatggacccctccccttgcacgcttcccgtccctggtcagaaacgctttcttcggtgagggccctcgccctgcgtgccttcagggagcagctgcgccagcgcaaggacaagtccgcgcggtacccgctggtcccgcccaaggacctcctgccaccacagcaggtgcggggcagatctttcgcggctgcgctgggggtacttgcggtgggtacggtgattgctggaacctcccatgtcaannnnnnnnnngcagatctttcgcggctgcgctgggggtacatgcggtgggtatggtga

SEQ ID NO: 349 - DNA, 1326 bp, Chlorella protothecoides
  modified_base (890)..(899): a, c, t, g, unknown or other
  modified_base (1122)..(1131): a, c, t, g, unknown or other
  modified_base (1283)..(1292): a, c, t, g, unknown or other
atgagggagggtttgaagggggctgtcctttgtgcagacgcatctgcgccatcagcacctgacctctgccctcgccgctcacgtgcgggccatccacgacaactgccgcgcactgatgtgcggccagcaccagcgcgcgggactggagctgatggaaagcatggcggggctgcaggaggcggcctacgagcggctgtgccgctgggtgcggcgccgcgccgccggcctggccgaggccgacgcgctggaggtggacccgggcctggcccgcgccgtggccgcgctgcgcgaccgccccgtgctcctggcctactgcatggacgaggtggcgcacgcgcggcacgccggcctcttccagcgcttcatcaaggttgctggggtcgggggtgcacgcaagaggggttggttcatgcatgttcaggcgcagcgtgcgagggtctcgctgccaggacagactgtgcggcgtcgcgggcggagcggcatgcacatctgctgctgactgcaggaccactgtgtggcgacgcgggcggagcggcatgcacatctgccgctgactgcatgaccgtccccccctcggcacggttccccaccctgcgtctgcatcccacaccacaggcgctgacccaggggccgcggcccatcgagatgcaggccggcgatacgcggcggtacgtgggggacatgctggcctggctgcacgcggccctcgagctggaggcggagttcctcggctcgctcttcggcgacggcgaggcggcggcgggaaatgcggcgggcgcagggaacgacgcggcggcgggcgcggctggccaggcgagcggggacagggaagcggcaggcggggcacctgaggcgacagcacctgccgcccgctcaaggtgggcaagccnnnnnnnnnngctcttcggcgacggcgaggcggcggcgggggacgcggctggcgcagggagtgatgcggcggcgggcgcggctggccaggcgagcggggccagggaagcggcaggcggggcacccgaggcgacaggtgctgccactacgactgatggcaccgtgcccacactccagcgcgttctggacaaggtgtttgagagcatctgccgcccgctcaaggtgggcgggctnnnnnnnnnnatcgccaggatgcccaggggatggcaaggcatggcgcccggggctgtgcacagatgccctgtgcatgcggcaccatcctctggagcctacgagcaattgcgtacagcgtcgcagacttcatatcgcaaaatcgggcaccgcgctgagacagnnnnnnnnnnatcgccaggatgcccaggggatggcaaggcgtga

SEQ ID NO: 350 - DNA, 2187 bp, Chlorella protothecoides
  modified_base (100)..(109): a, c, t, g, unknown or other
  modified_base (163)..(172): a, c, t, g, unknown or other
  modified_base (349)..(358): a, c, t, g, unknown or other
  modified_base (1426)..(1435): a, c, t, g, unknown or other
atgtacagtcctcttcaaccccaagggtggataccacagcacctcccattgggaatacttctcgaagcagagattggattgcatggacgcccttgggccnnnnnnnnnnaattgggagtacttctcgacgctgagattggattgcatggacgcccttgggccnnnnnnnnnnttcgcggaagattgaaggacagaccagatgatgagaccagtcttggttttgtgtttacatgaggcagcgagtttttccttcagtgtctgacccatgaccaggaaatcttctggtacatgctgcgcgcacggaaaatgaaagcatgttgtgacggagaccctgatggcccgatgtggnnnnnnnnnnttcctttgaagactggtatcgggtttttcagagaccgctgcaattgccgtggaggtggtcgcctactctttatacacattgatgcacggcaattgagccccgtcgcgagctacatcgcaggctgctccgccggctccgccggcattgtgaccgggttcccattcgacacggtgaaggtccgcctccagaaccagcagatcgggcatggcacttcctggggtaccttcaagggaatcctgcgccatcaaggggtcaggggcctcttcacgggcttgagcccccagctcgttggtggcgcgctcgagtgtggcgtgaactatgcggtgcgggcggggagcaggaaactgggtcggagggtgaaccaatacatggtgcagatttcttggatggcaagcccaggttcctctgatggaaaaggtggcccggagggctccgcacgagtaagcgctgcttccggccactgtccctccctcccacaactttttgatcgccccgtgcaggtgtacaacgaatcgctctcctacttgtctcgtgagtggcacgccccatcggcgctcagtgtcccgctggcaggcggtgcggcgggcttctttctcagcatcatcctcagccccgctgagctagtcaaggtggtggtccagggtgtggacgcagagtgctggcagttgcgtacatcagccacccccccattccagcttcacaccgcccgacccccacctcccaccctgcacagtgccggatgcaggctgctgatgcccggctggccttcaagacaccccgggactgcctgcgccacctgttccagaccgagggactgcgtggcctcgcgcgtggcttcagcggtaccctcgctcgggagatccccggcaacgccatctacttctccacctacaccgtcagtctttctgtggggttggtgtgggagggagcgtcaatgggtccagtcctctgcagcttgttgcagccctgtccctcacaccgtcccgcacccgaccccggcaggcgctgcgcagctgcatccccggcaagcctccggtgacgcgttcaggggaggggtgctccagcgcnnnnnnnnnncccccaccccggcaggcgctgcgcagctgcatccctggcaagcctccggcgacgcgttcaggggaggggtgctccagcgcccccgcgtcagcccccaccctgctgcagcggctggccaatgccagctcgatggtcctggccgggggcgcggccggcacggtgatgtgggcgctggtcctgcccatggacgtcgccaagacgcggatgcaggtggcgctgccgggatcgaggcgcgatctgtccctgccggccacgctgcgcgcgctgcggcgcgagggcaagctgtacacgggcctggcgcccacgctggtccgcgccttcccggccaacgcggcccagtgggtggtctgggagctggtcgcggggctgctggagggccactgagagagagggattcggtggctggaggatgtagggtctgggcctcaaatgtgccgccatgcattcccagcattcctcgcgggagctcggacagggattacaccttgtggactctgggcactcagcctcacaccccgagtgatcgccttgtaccctgtcagatgcatcgtgcggctcaacatgcgcggggtgctcagtcattgctgggtgagctggtctgcaaggtagtcgacaaacatcctctgggcggtcacggcatctggcgcttttgtcagcgacagattcgtgaccaggcggaggaaggcgcgcttgtgtcttcgcaactcggccacatgcatctggagtggggttggttcaagatgccagggtga

SEQ ID NO: 351 - DNA, 2049 bp, Chlorella protothecoides
atggcgagcaagggcggcagggtgaggcacggaaggcaacatgcagggcagaggaggggcctgagcatgccttgcgaggcaggtactgggagtgtgcgcacgaggccgatgcacatgccagctctgtaccacgttcccccatcgagtttcccttggcttgctctatctcaccgactggcgcacagggcggccttcttcctcagatgttgcccagagcgcacagcgctagcccctggatcagcatgttcctgttgtgcaggtcgttcttcagactattggtcaccagcatcagcacctcctggcgctcgtccagcagcagcatcaagcccaggtgcatcgtgcggtatccatgaatgccaaagcccatcccacatgtgccaagcaacaaagcaggctgcagcttgccttctcagggaagccgagggaggcgatcagcttcagtgtctccatctgtccaaagtgggtggggtagcccagcatgtgtatgcaggtgtggcggcattcagaggtcagagtaccaactggcccaatgcctgtaaccctccggcacctgtggcgatacgtgctgtcctgctccttgaaggccttgcgcagagcagcgctctccttggcgatcacattcctttcctccgcagctgtcttcgctgccctgacgtgcttgatcagatccctgccaggcaggacagcggaccgttgcctcggctgttcctaattcatcggctcacgccgggaggagctgaggcgtgtgatggtgagcacttgggtcgctggtgggtgatcatccgcgacgacacgcccaggctcatttccgagaagactcgggtccgccagggcgccagcgccggaactcgggctacccccatcctttgcgatggccttcatcgtcttctcgggccaccccagcagcgggaagtcgctgctggctgccagattgcagaagatggtccaagaggaaggccgtgcatgcctcgtgatcagcgaggagtccctgggcctgacccgcgacggctgctacagcggtgggcacccttgttagaccacccaggccatgcttgggcttccatccagcacatcttctacatatgtccgtgtgtcactcccagtacagaaatttggccctccttcgacccaacccccatcgcaccaccctccttctcaaccccaacagatgcacggagcgagaaggtcgcgcgaggccagctcaaggccgaggtcgagcgctgcatcgggcggcagcacgtggtcatcctggactccatgaatgccatcaagggctaccgctacgagctgtactgcctggcgcgaggcgcggcggtgcgctactgcatggtgcacgtggacacgcccatagagacctgcaggacctggaacgaggctcgtccagccgacgctcgctacgccacagccgtcttcgccgacctggcgggccgcttcgagcgcccagactctcgccagcgctgggacgcacccctgttcaccgtccgccccgccgccgcggagggcgaggcggaggtccaggcgcagctgcgcgccgtcctcgtcagcgcgctggacctcgtccagcatgctgaccgggagccggggtcggaggggcggccggtcccgccagccagcagagcgctggcgcccaccatcgccaccactaacgccagactgtcctcccagggatttgcatttgttctgagcaagtgggggactgtgcaaaggggacgggcgcagcaggttgatcaagggggtgctgttgggatggcgcggtgccaaggatcaccgctcaggccaggacaaaggataatgtctgtgctggaagttggtctcacctctcatcaatctgcatccagcatctcagcccatccagccccacgttcacccccacctgcagccaccaacctgttgcacgagatcgacaggggcgcgcaccaggtgatggacgccatctctgcggcccaggagctgaggccgggtggtgccccagggacagtccaattctccggcgagatcccatcgctgcgcatggacaggccggtgaggagggtgagaggctgctgttag

SEQ ID NO: 352 - DNA, 936 bp, Chlorella protothecoides
  modified_base (485)..(494): a, c, t, g, unknown or other
atgcttgcgggtgcgggaggcttgggtgggctaaatgatgggtcccctgcgattctgacccaggccgcgatgttacgtaccttgcacatgcacatggctgggctggctgctggctggctcccgcacttcaacccgggcatgtgcccgcacaggcggttttctcccctttataccccgttccctccctctgcgggtgtcaccctgatgctggagatgtgccatgccgacccagctgtggtcgccctgttccggccccaggtgccgcgcctggcctccctgctgcgctcgctgctggggtcccagagctacgccccggacactgacgtcagcggcctcaccgaccccttcctccaagtcaagggttccactgacgaggacctggactgcgcggatgggccaacatctttaactgcattcaaagcacgacctccgcacacacacaccttctctcccctccacacacccagctgctgcgcctgctgcgnnnnnnnnnntttcctccaggtcaagcgcgaacctttgctggaaactggctttgcgatgcagggtttcactgacgaggacctggactgcgcggatgggccaacatcttcaactgctttcaaagcacgacctccgcacacacagtccttccctccccttccacacacccagctgctgcgcctgctgcgggagctggggcgcggcgacgccgagagcagcgacgccatgggcgacgtgctggctgccgtggcatcgaacaccgagtcgacgcggaatgcggggaacgccatcctgtatgagtgcgtgcaggtgagagagctgggctgggaggggctggagtcgggttggtgtgggagggagacgggctcggcgctcccgcttcgccctgccctgcccgctctccccgctgtcgtcccccgcccccaacacctccaccaccacctccaggactga

SEQ ID NO: 353 - DNA, 1149 bp, Chlorella protothecoides
  modified_base (528)..(537): a, c, t, g, unknown or other
atggcggtggagtccatcggcggcctgcgggtgctggcggtgaacacgctgggccgcttcctggcccaccgcgacaacaacatccggtacgtggcgctgcacacgctggcgcgcgtcgcggcgcgagaccccggcgccgtccagcgccaccgcgccacggtggtggactgcgtgcgcgacgctgatgcgtccatccgccgtgccgcgctggagctggtctactcgctggtgaacgaaggcaacatccgggagctggccgccgagctgctggactacctggcggtctgcgacccggggttcaagcccgacctggccgccaaaatctgcgtgctggtgggacgccacgccccggacaagcgctggtacctcgactccatggccaaggtccgggggtgggcgagtgggggtgggaggggagcacgggatgaggtgctgagggccaggccaggacgagcgcgtgccagaatgttccggaagtctgaacccgacggcgctgggaagtggacccaagactttgacgagcccgcnnnnnnnnnncgagggccaggccaggacgggcgcgtgccagaatgttccggaggtctgaccccgacggcattgggaagtggacccaagaccttgacgagcccgcctccctccctcccctccaacccccaggtcttgcgccaggctggcgcgttcgtcaccgaggaggcggtggccgggctggtgcgcgcggtgaccgacgcgccggccctgcgcggctacgccgcgcgcgctttcttcgccgcgctgcgcgatgtgggccccggcgcggcgccggagccgctggcccgcgccgccgcctggtgcgtgggcgaggcgggggaccgcctggtggaggcgaggggcaggctggagggggaggacgcggcgcagggaggcaggggtggtggggggggtgaggagacatggcctggtgtgtttgagatcgatgccccggcgtggccgcatggaggtggcgcgaaggaccgggcagggagcgttgtctgtttgggggtcgcgtgcatgggggaacgcccctctgcccagccattgctttgcgcggagagtgaagcccatgcgtcagggagtcgacggccttggcagccgtcacggctctggcgactgcgtgctggccccgacccttga

SEQ ID NO: 354 - DNA, 1011 bp, Chlorella protothecoides
  modified_base (597)..(606): a, c, t, g, unknown or other
atgagcgctcaccgctctcgtcccccccccaaaacacacacacacacatacacacacaggcgccccggccaagcggatgcggtgcgtgaagtgacgctgacggcgctggccaagctgggcgtgcggctgccggccctggccccccaggtggcggagctgctggaccgcttttcgcgcgcgcccgcgccggaggtccagacccgggcggtggagtatgcgcgcctggcggcggcgcgcggcggtctggccggcgccgtgctggagcccatcccggccgcggagggcggtgcgggggccgaggacctcgccctcgtcccggccgagggcgaggaggccgcggggaacggaggtgggacgggtggggcggggctcctgggcgccgacccggcggctgacctggccgcgttgctgggcctggacgccggggctcctgctgccaccaacctgccggcgctcgacgctgcgccggtggacccgctggccgcgctgggcatgctggacctcgccgcgcccgccgacccgctggcagaactcctgggcggcggcggggccggggggctgcgcgccccggcccaagcggcctccgggcacacaccnnnnnnnnnnggggggctgcgcaccccagcccaagcgacccccggacgcacacccggcgccggtggcacggggggcggcccccggcgcggcggagctgaccgcgcgcgtcacctccgcccaggcgctggccggctggtcgctgcaggccgccgtgccgcgcttcgccacgctgcgcctgtccccgcccagcggcacgagcctggccggcccggggcaggagctgacgcagcgcctgcacgtggtcaactccgcgccgggcaccaagcccctggtcctgcgactgcgcctcgccttccagcgcgacggcgccggcgtgaccgaccaggtggaggtgggcgggtttccgcccgggttctaggggcgccgaggcggccgagggacgcggcacgccgagcgcaggttcccaccctctga

SEQ ID NO: 355 - DNA, 687 bp, Chlorella protothecoides
  modified_base (25)..(34): a, c, t, g, unknown or other
  modified_base (514)..(523): a, c, t, g, unknown or other
atgcgctggagctgcggcatgcacnnnnnnnnnnctgaaccagttccatcgaggcgcacagcgccgctgagtcatccaaggccccagttcaaccccccgtaccatctgccactccaggattcgctggattcctacctcttcccggatgcgctggagctgcggcatgcattgggcgagagcactgggccccggttctcggccctgaacgatgtcatcgtgaacctgctggacgagtttgccatggtcagcttcaccccgctcgacattggggatgaggagtccatcgagacggcgctcttccaggtcgactctgccatccaggtgggaccaggggggggtgcctttggggtgtggaggccactgtggcgtatgggaccaggcggaaacagcaatctgctgagcaggatgttgtgtgcatgctgttgcacacctcatgtctcgcatgtgcccgatggtgattatgagcttgcagcggcggcctgctcaggaaaagccttccccgctgaaacatgcnnnnnnnnnnatctgctgagcaggatgttgtgtgcatgctcttgcacacctcatgtcttgcatgtgcccgacggtgatgatgagcttgcagcgggggcctgctcaggaaaagccttccccgctgaccccgcagtatggggaggaccaggacgtgcggcagaaggagtacggtga

SEQ ID NO: 356 - DNA, 2304 bp, Chlorella protothecoides
atgctcacgacgtgcatctgcatcctggcggtggatttccacgctttcccgcgccgcttcgcgaagaccgagacgtttgggacaggtgggcgagagggcgaggatttgtggtgttcaatgcaaggacatgtggcgctggcacgatgcacagccggtgacccgggaggagcgatgtgcaccgtccagacctcaccagctcctctcagtccccacactccccctttccccaggcctgatggacgtgggggtggggagcttcgttgccacctcagccatcaccaggggtttcaggggcgccagccggacgggcgacgctcgtgcagtcaagtgttccagcgagtacggcgtgcactggaacttcttcttcacgctgggcgcgctgcggctggcggtgtcagtcgccgagggcctgggcgccgggcgagggctcctggcccccggtctggtgggcatgggcatcctggcagcgcaccagtatgcactgcagcgcctgggctggctggcctggatccacgccgagcagcgcacgctgggctccctcctctccgccaacaaggagggcctgggctccctgcccggctacctggcactccacctcctgtccctgagcctgggcgccggactgaggcgcacggccgccaacgcgaggcccctggccgttggcgcggccctggccttggccctccaggccgccttcctctgctcggcggcacgcctgcagcccgtctcccgccgcgcctgcaacgcgccctacgtcgcctggaccctggccctcaacgctcaggcggtgctcggcttcgcgggcggcgcggcgctggcggacaacgtcctgcccgcggccctctccgcgctcagcggccgcatgctgcccgtcttcctggcggccaatctggccaccggcgcggtgaactggggcatggacacgctgggcgcgggggactggactgcccgcgccgtgctcgcagtttatgcttctggtatcctgctggctgcgcaggctggatggcaagtggggcggggcgccgggacatgataagccttcctgacgtgtgtgttttagagtgccaagatgctgatctggagtacagaaccacgcagtcaaacagccggtgtcctccagggccgcagttgctgtgtaattctgcactgagagggcggtcccaggagggaatgcgagccccaccaccgcgctcttctgggatgaagcggcacaagcgagcaggccggcagcgacagcagcttcttgtggctgcacttgcgttcggcgtgcctgacgcattgcacataaaaaacgcacacagcaagcaacctccatcacccacaggcatcgctgctagcccgccgcccagcttcttccgtctaccattctgcccgtcccgccagtcctcaggcagactggcgcacggggatgccggcgcgcgccatgtcggccttgacctcggcgatggccacctcccgccggtggaagatgcctgcggccagcgcggcggccgcccccgtctcgcggaagacgtcggagaagtgggaggggcggcccgcccccgagctggcgatcaccgggatcgtcaccgcgtcggacacggccttgaccagctccaggtcgaagccgctgcccgcgccgtcgcggtcgatgcagttgagcaggatctcgcccgcacccaggtgggccacgcagcgcgccagctgcacggcatccacgtctcgcccctcgcgtccgccccgcaccgtgcactgccaccagcagtaccgctcgccgttggggcctgggattgtgtggttttcgggggcagggttgggatttgggggagcatgaatctctacggtgacgtgctccgtgtcctccggcgcgcgtacatacacacggcgtgggtcgatgctgaccaccaccgcctgcgcgccgtagtgggtgctgatggcctcgatggcggtggagccgtcgggcacgccgccgcgcgcgtagtaggcctccgccgccagcacggcgtcgccgccgatggacaccttgtcggcgccggagcggaagtaggcgccggccacctccagcgcggggtggtgcacccccgccgcatcggtgaagctgcggatgccgccgccgacggtgagggggacgaaaacgccgcgcgaggtctggcgcagcacctccagcatgggcaggtcggcgacgggggagtcgcggaagccggtgatgttcaggaaggtgacctcgtccgcgccgtcctcaaagtagcgccccgcaagctccacgggcttgcccaggttgcgcacctcgcccttggaggagccggcgccggagcttgcatctga

SEQ ID NO: 357 - DNA, 1146 bp, Chlorella protothecoides
atgtcgcacatcttttccagccaagcagcgcgcgtacgggtcgcagatcagggcagaagggccacgcagcgtctcgcgggctctgagcccggccagtgctcgactcagaacggtgtcctcctcatcggacaaggcccagtcgcccttcgctgccgggattcgtgcggccacatgtctttgcacagcactggcacctgtccctcgatatgggtgatgtggtcgacagggatcctgcccggggcggagcgaggaccttgccctgcacgtcgccatcatccctgctcgacacacaaacctctgatccacacgcatgtactacaatgcatcataggaaaggatccagaaatacatcccacgttgtattccttgcatcgagccactccatgtgttgacctctactgcccatgcatggttgatcatcgcgcgctttccagcctgcaatgcgcggttcttacgaccctccacctccagctatctcgtgcttgcgcctcgttcacggctgtgatatcacagaaagaatcacatagcagagccatttgccctgcaacttgcattggtatccctcccccttgtcggtgcgtatcgctgtgggtcgccatggccgactcctgggaggatcagagcgaggaacagatcacatacgagcctcaaaagcccaagctgaaccccctggcgtccagcttcagcttcagccctggcgcgagctccttcacgcccgtggctcctgcacctgcgccgaatccagccccagccccggcagccgcacccgcccccgcgcctgagccagccgagttactggcagcagacccaccgtcagcagaggtggctccagctcctgagacctccgagccgccctccgagccagagcccaaggcagccccagctgagacccggccggcacccgcagctccctccaaaggtgctgctgtgcacactggtctctgtctcagccattgccaccgcggtacccctgctgcagcgccagaggccatcgagacggtgacaaaggagctcaagaaagccacgattgcagcggaggaaagcgaggcgcagaaggctgcacggagggccgaggtcgacaaagtgctggccgatatcaccgcgaatgatgcacggtgcgtgcttgggaatgactgcgcggactga

SEQ ID NO: 358 - DNA, 2211 bp, Chlorella protothecoides
atggcgggagctccaggcacgccatctggcaagcagcacgcgcctcctcgggtgagagcttgtcctgtcggtgctcctcccacctcagatctcatctgccctccgcgaatcaagctccctcccaagctcccaaccctagcccccctcccccgtgtcacagctgccacctattacctcgatggttttgagtgtggcgccgagcgcttccaggacggtgcggtgaccatcaacaaccccgccctggtggcgctgcaggaggcccagctactctggcccggcacgccgctggaggtcctcgtcagcattggcaccgggtcggtgccgtgcgtgccgcgccccgccgcggtctcctctttcatggagacgggcaacatcctcatcgagtccgccacggacgtggagcgtgtggctgagaccctggccgccaccgcgcacctcatccccggcctgcagtacttcaggttgtgtgaagggttggaaggagggaggagaggagtcctggcttgggaatactgtccatctgcagacagccgtcggcgccgcaatgaacaactgccgtcacgggctaggttctgctgcaatttaggcaactatgctccaatccacacgcattctgctctccctctgctaccacttcctgcattgccccctcctcccaatatcattctccaggttctcacccatggacgctcggtgccagatggcgctggacgagatccggcaggaggagtgggccaagctggaggcggccacggaggaatgcatccagaactctgggcagcagctggactcggccgccgccgcgttgatgaaggtgggctttgcgtggcggtcatacttggggatgcagatcgctgcaagatccttgtcccttggtgtgaatcccaaggcacatgcgtgctgaaccccatttcttcggcgtgtgcagggcattggcatggagacaaagaacgatcagggctcgatcagggggctcgaattgtggtgctgcatgccccagagctgggtgcacggaaggcggagttgacagcacccctgccgactgccaacctgactgtgctctgcacagacagcttctttgcctcgccgacgccgctcagcaatggcgcagaggcgccagggccgaggacgtcggcggcatccggaccaacccacgatggcgagccaactcagcaggaagaagcgcaggagagcgaccaggaggagaacggccaggagccagagtcgcccctcaacccgccgcccactgcgtcaaccagcaaggatccgccggccgccacgcaaggcaccagccagggtgccggcggcggtctgagcgagtacctcacctcctggttcagccccagcaagggcggggcggggaacgctgatgccgcaagggcagagggcggggccggcgacagcggcggccccgccccttccttcctgccgcagtcggcccgctcgcgcaagcgcgcaagacgagctgttcttcatcccggcgccgcatctggtgccggcctctccctggccccactggccgcggccgtcgccgcggcgctgccgcctggcaggacggcggcggtcgtgctggacctgcctgtgagcagcgccggggacctggtgctgagctggcgcagcgagctccacgccgtgctgggcggcagccccgccgaggcagagtgggaggccaggtgcggacaaccgctcgccgccctcttctcccccttgccggcgtgcacgctgcctggcggcgaccagcgcctgtcgctgctgagtcagcacgcgcaggtcgtcggcggggggagatccgtggagctccgcctcatggagcacgtctcccccggccgcagcctgtccaccgccgaggcaagtgcacatgggagagggatgggagttgagggttcggggctccatctgagggtccgtcatacgtacccaggaacactcccactgcaggtgggcgagggcgcgctggcggcgagtctggcgggcagcgtcgtcttcctcacacgcacggcaaaccccgcctgggtggctgctctcctcagaggtggcactgccgcggctgtcgtggcacctgctggcgaaaagtcgctgactgtgcaagacctagaaagtgtgtggcccctcctagtagctgggcagccgctgcttccggtgctccagcgacatggtggcctgcatttgttcaccctcgggaccgatgacaaggtccagcgccacacttga

SEQ ID NO: 359 - DNA, 1791 bp, Chlorella protothecoides
  modified_base (191)..(200): a, c, t, g, unknown or other
  modified_base (353)..(362): a, c, t, g, unknown or other
  modified_base (862)..(890): a, c, t, g, unknown or other
  modified_base (1022)..(1031): a, c, t, g, unknown or other
  modified_base (1439)..(1448): a, c, t, g, unknown or other
  modified_base (1693)..(1702): a, c, t, g, unknown or other
atggcattttcgtcgaatcaggcctcgcctgcgcccagatactcagcctccgcttcaccaacacttcccacacctccacttgcaggggagaacgcgacggtgcagcgggccgtgggtcgggcgcccatgcaggggcgcggcgtgcgcatcctctccatggacggcgggggtatgaaggtgggcagaaggtnnnnnnnnnngcgcggcgtgcgcatcctctccatggacggtgggggcatgaaggtgggcggaaggggtggaatctggcgggcggcagccaggcgggcaggggttctctggacgcccccgcaccgaatgccacaaaggaacaaccgcctgccgcccatcctcgnnnnnnnnnngcagccaggcgggcaggggttctctggacgtccccgcaccaaatgccagaaaggaacaagcgcctgccgcccatcctcgatgcccgcctgggaactcaaccccccaccccgcccccccaaacagggcatggccacggtccgcatgctgcgagagctggaggcgcggaccggtcggcgtgtgcacgagctgtttgacctcatcgtgggcacctccacggggggattattggcggtggccctggccctgcgccgcatgaccctggacgagtgcgaggccatctacaaggtgctgggccagcgcgtcttctcccgcggcggcgcccaggaccgggaggaggggtggatggacagcttctaccgcaattttcactcccgcacccagcatgtgcgtgccgtggtggtcggctacaagcacgactcgggtgagggattggttggttgggagggggaagtggggcaggcttctacaatgatgattttgtggaggaggctagtaggtnnnnnnnnnnnnnnnnnnnnnnnnnnnnnctcgcgcactggattccactttgagggattgcttcatggcactgtaaggcagggcatccccggatctcctcaacaatctcccagacaccaccatctttgtgctcccagattccgctccgctggactgcccannnnnnnnnnggcgagacactggggtagggcaggaaggaggcctatgactgaggaggggggagctggggatggagagcgacccatccctgtggtctgggctgatttggagaagtctcgcgcactggattccactttgagggattccttcatggcactggtttgcgatttgcaccgcattgatttcacactctgcacccgcaatgacttgtcccatgcccccctcattcccagccatgtacgaggagctcctgaaagactactgcgacctcagcgccttcccagaggtgctgggcaagtccatgataggtgcgtgggaccggggcgtgctgccacctggcacgagggtcgtgcggagctggtctggtgtgcatccgcagagatgagcagggccaccgggcgtcagtgtgcagtcccaannnnnnnnnnggcgtgctgccacctggcacgagggtcgtgtggagctgtagggcaggacattcccggatctgctcaacagtctcccagacaccgccacctttgtgcacccagattccgctccgctggactgcccgagggtggcgctcgtggccaccctggcctcggaggtgcggaagaggggaggggtggggttttgcagttcagtattcctgagcaggccggcacgatgcctggtctgaggggggaggtctccnnnnnnnnnnaaactatgaagtgggccccgagctgcggggtaggatgcaggaggtgcggaagaggggaggagtggggttctgcagtgcagtattcctga

SEQ ID NO: 360 - DNA, 492 bp, Chlorella protothecoides
atgtctggcctaccctgtacgtctggaaggctggaggggctgcgtcagccctcagcaagaggtggagcactctcgaggagcagtgcacctgtgcgacgcgccaaggctatcattgcacgtgcgagtgagaagagggaggtcaccctcctggattatggtgcaggcaacgtccgcagcgtgcggaacgcaatccacaagctgggctacaccatcaaggatgtacgtggggtctggtgtggggctacaggttgtgcctcggacaatgtacgggcagcacgccacggctttcctcgtgtagcaccacgctccatgctgatagatcctccacacatgctcaccacatcccgtctttgccaggtgtcatgtgtcaaggacatcgagaacgcttcacgtattattttccccggcgtcggtgcctgtggacaggcgacggaagctgtacagcgcatggggtatcgcgaagccctcattgactatctgaaggtttgctaa

SEQ ID NO: 361 - DNA, 354 bp, Chlorella protothecoides
atgcctgggcatggctcgggtgttcaaacaccagtccacaccagtccccgtcatcaaagcccaccccaaacacacgccaccaggaccatctccgtcgaccccagcaagtcggaggactgcttccggggcgccaagttcctgcaccgcctgctggaggggctgggcgccgaggtcaaactggtgcagcccatggaggggaagaacccgctggtcatcgccaggctggggcgctgccccaccaagcccaccgtcaccttttatggtgggatgggggttgggggatgtgtggtgaaggtgcagcaagatgcaggctcactgtactgtgtacggcagcagcgttccgtgtgcccgtaa

SEQ ID NO: 362 - DNA, 654 bp, Chlorella protothecoides
atgggggacttcagtgagagcaaggcgagccgggaagaggccgagttgcgggccccgttcgtacgcaacgatcggttcggggaattcggcatgggcaacctccctacctgcctgaaggctgtgctggtgctggaatccatcttcatccttccattccgagctgtggggtccttcctgtgcctcttcctctactggctggtgtgtaggctgtccagcccactccctcctcagcaccgagccgctatcgtggtgcccatgggcaagctggcctgccgatcctgcctcttctgcatcggtttcttcaaggtcgagtgggtcctggatccagctgccggacaggggccgcgagccggaggcatagtgagcaatcactgcagctgggctgacatcctgctgcacatgtcccactccttccccgctttcgtggcccgggactcgaccgccaacctccccttcatcggcatcatcaggaacaggactggacgcaaccaagctgtgagtttaggagttgaggctctgctggctgtgtgttccctcatgaagactgcagcccatacccttgctgtcacagcggcggcgctgactgtcctctcccacctccgtctgggctgcgcagggtgtagcagacctggtgaagcaaaggatggaggatga

SEQ ID NO: 363 - DNA, 999 bp, Chlorella protothecoides
atgctcccaggcgtgccgagaggcctggccaagcgcgtgatcgcctgcctggatgtgcgcgccaacgaccacggcgacctggtggtgaccaagggggatcagtatgacgtccgcgagagcgcagatgcaagctccggcgccggctcctccaagggcgaggtgcgcaacctgggcaagcccgtggagcttgcggggcgctactttgaggacggcgcggacgaggtcaccttcctgaacatcaccggcttccgcgactcccccgtcgccgacctgcccatgctggaggtgctgcgccagacctcgcgcggcgttttcgtccccctcaccgtcggcggcggcatccgcagcttcaccgatgcggcgggggtgcaccaccccgcgctggaggtggccggcgcctacttccgctccggcgccgacaaggtgtccatcggcggcgacgccgtgctggcggcggaggcctactacgcgcgcggcggcgtgcccgacggctccaccgccatcgaggccatcagcacccactacggcgcgcaggcggtggtggtcagcatcgacccacgccgtgtgtatgtacgcgcgccggaggacacggagcacgtcaccgtagagactgcgacgccaggccccaacggcgagcggtactgctggtggcagtgcacggtgcggggcggacgcgaggggcgagacgtggatgccgtgcagctggcgcgctgcgtggcccacctgggtgcgggcgagatcctgctcaactgcatcgaccgcgacggcgcgggcagcggcttcgacctggagctggtcaaggccgtgtccgacgcggtgacgatcccggtgatcgccagctcgggggcgggccgcccctcccacttctccgacgtcttccgcgagacgggggcggccgccgcgctggccgcaggcatcttccaccggcgggaggtggccatcgccgaggtcaaggccgacatggcgcgcgccggcatccccgtgcgccagtctgcctga

SEQ ID NO: 364 - DNA, 261 bp, Chlorella protothecoides
atgggccctgagcccagcagctgcgccctgcgcgagccccactccaccttcgagggtccggggcgggcggggagcaagtacgacttcgtgaaggtccgtgtctggctgggagaggaccaggcgcactggtacacgctctcccgcttcctcatcagcagaaccctgacagtgacacagatccccgccgacaaggcctgcaggtgggagggaagtgccgtcccagagcaggcacgtgcatcgggggcgcttcccctcttctaa

SEQ ID NO: 365 - DNA, 1050 bp, Chlorella protothecoides
atgcgtgtgggtgggaaggcccatcgagatggtgtgaagcggaagggcaggtgggtgctgtgccctggagtggatgtgggtgatgacatcgtgcggcgcttggaaggcatcggcgtgtgcggatgcgccttgcgaggtgaggacccgcagctcgaggccaacaggcagctccaccgccgccgccgtcgcccacccctcccactcctccctttcctcccaaagatcgcgggggcgctggcctacctgcactcctgcggcatcatccacggcgacctgtcgggcaacaacgtgctgctcactgcgcagcccaacgatgcgcggcgctgggtggccatggtctccgacttcgggctgtcccgcatccgcggcatgcagtcggtgcactccgcgccgcatggcaccgtcacccacatgcccccggagctgctgcgcggcgggccgatgacccacgaggtggacgtctggagcttcggcaccctgctctgggagatgtgcgccgggaagcgggcctgggacacgctttcctaccaccaggtcctccatgccttggtcagcgagggccagacgctgccggtcaagagcctgtcgggcgtgccgccgctgctgcaggggcgcaatcgtgaggcttggccgggggggggatcacgaagtgcatcctgtgaggcagatgacgtttgccaagggacaggagaacgctccacgagggatggaccgatggcggtgaccccgggcaacacgatcgacaaccacgatcctcttgagtacagaaggcagcaggttcagacatggatgtccctccctctctcaccaaccccaccctcctcttccgcaggagctgatggcgtcgtgcctagccacagaccccaacgaccgcccctcctttgccaggatcgggcagaagctcggccagatggcgcgtgcccagaggccaagatcctcgcagtgactcagcagccccctggtatgctgcagctgggcagaagccctacgatgcagtgtcgaggaccccgcagctccttaggccaaccctgccgcctgaagaaagcctga

SEQ ID NO: 366 - DNA, 969 bp, Chlorella protothecoides
atgacctcccgcgaccgcatctcctcccatgtgccccccgccgccggcgcggcggccatcactccggaggccacggggcacgcgggtgcggtgacggcgctggccgccagcggcgaggtgctcttctccgcctctgcagactccaccatccgggtctggcgcctgccgaacctgacccacgagcgcgtcctgcgcggccacaggggctccgtgctggcgctgcacctggcgggcggcgtgctgctgagcggcgggcgggacgcggtgatccgcgtctgggattgcggcacgctggtctgccggcgcacgctgcccggccaccgcggcgacgtgctggcgctgaccagcgtgggcatcgccgtccccgccggcggggcgggggagtacgcagacctgctgtcccccggcctggcctcccccctggccagcgccgccgacatcagccccgccaactccctgtttctaggtgcggggggcgtcggggccggcaacggcatcggcaacgcagggagcaccacgtccaaccttcaccgccgccagccgctgctgtacgccagcgccagcgccgatggctgcgtccggctctgggacgcggccacctttgcctgcctgcgcgtgctggggggcggccccggcgcctcccctgtcatggcctgcgcgctgaccgagacacatgccgccgcggccctgccggacggcgtcattcgcctctatgcctgcgacgacctattcgtggccgccgccgggcgggcgctgggcgtgcccgtcgaggcggaggagccggggaggggcggggttgaggccaggactcggcgggggcagggcgccgcgcccaagcccgaggcgggggacgtggtcaccaagatggagagggagctggagcgcgcactgcgcaccttcatccggctcaggtgggaggaacggagggagaggaaggatctggcgtccaaaggaggaggttggctgtga

SEQ ID NO: 367 - DNA, 273 bp, Chlorella protothecoides
atgcagggcgatgaccgacctctgaagcggctcccggacaccgtccaggccaccgacaagctcccagacgggcccgagcccgtggcagtggaggtggagtacccgtcccgggaggagctgacgcgcgtggtgggctcgccggagcaagccctgtccaccctgctctccacgacgctcgcctcggcggactgggtggaggtgtgccgtgcgctgggcacgctgcgccagctgaccgtgcacgagcccgccgccctgctggagcctcacctgtga

SEQ ID NO: 368 - DNA, 510 bp, Chlorella protothecoides
atggcatccgccagtcgacagctctcccctctcctgcccgcaacatcgcgcgctcccccttccttgctgcagctggcggcagacagcgtggaccccgctgccctgtctgcgctgctgctgccctacaccgagcacaagagccccaaggtccggggccgcaccgccatcgtcctgagcctcgcgcaggccagggtgcaggtgcagccggagagcgggcatgtcgtgatgggtggtgcctgtgtcgatgataacaccctcggaggcatccccgtgccctccctgctggcggccagcggccgcctgctgaccgacaacacccccgaggcgcgcgaagccgccaaaaagctgcttgcccacgtgcgcgccgccttcgagcagacggaggcagcgggcgtcgccgtgcccaaggcggcggaggagggcgcccccgccccaactccctgggaggcgtactgccgggcgcagctgccggggagcaccgcgctcgccgtgctccgagcccagcaataa

SEQ ID NO: 369 - DNA, 642 bp, Chlorella protothecoides
atgtgccccacccccatcactccccccccctcaaggtgggaagccgccctgtcagcgcccacgacaccccccctcccgccactctcacccgcaggccacctggcggcctccgaccccaagcaccgcacccagatggtggcgcaggagggcgccctccagcagctcctgctcatggctctgtccgactcggagcaggtggcctgcgagacctgcgccacgctggcgctgctcgcctcgcacggccccgagctggccgaggcggtggcggcgcgcgatgtgtcccccgtgctgggcctgctgcgctctgaggcctcgcccgccgtcacgctggccgcgctgcgcgtgctgtgcgcgctggcgttgacctccacggccgccggcgcgcgcgtggcgggggaggaggtgctggacgcactggagggactgtgcacgcggcccggggtggagacaggggtgctggccgcggccctggaagccgtggggaacctgtgctttggcgagcgggtgcgcgccgcgctgcggcgccggcgccccctcatggacgccgtggacggcctggcgggggaggcggggggtgcgggcgggggcccggtgcgggccgccgccatccgcgtgctggccatcctgggtggggggagctag

SEQ ID NO: 370 - DNA, 225 bp, Chlorella protothecoides
atgctgctgctggacgagcgccaggaggtgctgatgctggtgaccaatagtctgaagaacgacctgcacaacaggaacatgctgatccaggggctagcgctgtgcgctctgggcaacatctgctcggcggagatggcgagggatctggcgcctgaggttgagaagctgatggggtccatcaacccatacctgaggaagaaggccgccctgtgcgccagtcggtga

SEQ ID NO: 371 - DNA, 642 bp, Chlorella protothecoides
atggtggcggccattgcgtcgggcatggacgcggccctggtggcggagacgcccgtgggcgggctggccgcctcgcgccgcctggccctgcccgcgcacctcttcgcgcagcgcccggggctgatgcgcgaggtcacgctgggctgcctcatcggcgtgggcagctcggggcgcacctaccgcggcatgtggcatggcggccgcgtggccgtcaagatcgtcgagtgctgggcagacccgggcgcgggggccctcctgcgccagcgctccgtggaggtccgcgccgagcaggacacgcacgcggccgtggtggaggccgcgctgggccgcgccctggcccacccccacatcgtgcccacctacgcctacgccggcacccagggcgagggtgcccatcgtcccatcaccacgccccccaccctaccatgcacacattcattcaccaaccccccctttccgcacaaaattgaaaccctccaggtggacgcgcgcggcctggtgcactccgccacctggatcgtgcaggccttctgcagccgtgggtcgctgatcgaggccgtgcagcgcggcgacctggcgcaggacggccagcccaacctgcgggccatcctgagcactgcgggggaggtgggcggggattag

SEQ ID NO: 372 - DNA, 804 bp, Chlorella protothecoides
atgcaggccgtccggattgccctggccgtgaagaaggacctggtggaccgcgggaggctggaggtgtcgcaggaggagctggaaagcgcgctcacctccgccctggcaatccatggcgtgggcgcacaccacctgccccgctaccgcacggtctccgccttctttcagcgccgagcgccactcatcatcctgctctgcggcaccgcttgcactgggaagtccacaatcgcgcagctgcttgcttctcggctgaacctgcctaacgtgctgcagactgacctcctgatggaggtgggacatgctgttcgtttatctcggatccctgctgctcgatgcgcgccgatccggcctaaaagcaccattcatgccttcatgccacctattaaacgaatccctctgcacctcacccctgcccagttctttcggggcagcgaggtcgtccccgctcagccctctgtctggcacgccgaggacgaggaggcgttggtgtctaggttccaggcccagagccgccaagtgcggcgggggctgtccggcgacttgcacaaggagtgtgacgtgtggcaacctgctgtccccgcaggatggcccttggctgagtacatccgatgcatggccggcactcctgacacacgggcacctcccttcctctgcaagtgcattgaggagggcaagtcgatcatcatagaggggtgccaccttgaccccagcctgtatttgaacgagtttggggcggcggcggtgcttgaggacgcacaggtggggcaggtggaccttggtgacccagccacgactcggagatga

SEQ ID NO: 373 - DNA, 534 bp, Chlorella protothecoides
atgcaacaggccgatcgtcccttcctcggcatatgcctgggcatgcaaatcctattcgacggctccactgagaatggcggcgtggagggcttgggcgtggtccccggcactatccggcaatttgacacctcactcggattgccggaaggagtcccccctactaaattgcgtcggggatcggcgggtgtactttgtgcactccttcgccgccttcccggacgaggagaacaaggactgggtcctggcgacgggaggtgcgctgcggaggggcgacgcaggatggagcgggagtcgactggtgcgcttgcatgtgtgcccgccaaacacagccccggccccgcccctgcagagtatgcgggtgagtttgtgagcacgctgcagaagggcaacgtctatgccacgcaatggcacccggagaagagtggcgctgctgggcttgattttatccatgggttcctggacccagaatgggccgccgctcagccgcgcctcgacccctccacatcccgtgcgtccaacggtgagcgggcgtag

SEQ ID NO: 374 - DNA, 255 bp, Chlorella protothecoides
atgtcaagcacctgcactcagactcacccacaccacgcccaccctcttctgcagaccaagtttgtgaagagcggggacgtggccatcgcccggatcgcgacagagcgctccatctgcgtggagaaatttgacgtggtgcctcagatggggcgcttcaccctgcgagacgagggcaagacaatcgccatcggcaagatcgtcaagctgccaaaggccaggtctggcgaggcgggggaggcaggcgagggcgcctga

SEQ ID NO: 375 - DNA, 693 bp, Chlorella protothecoides
atggacaccaatgaggaggagcgagcgcggggcaagaccgtggaggtggggcgcgccttcttcgagacccccaaaaagcggtacacgatcctggacgcccccgggcacaagtcctacgtgcccaacatgatcagcggcgcggcacaggccgacgtgggcgtgctggtcatatcggcgcgcaagggggagttcgagaccggattcgagcgcggcgggcagacacgggagcatgcgcagctggccaagacgctgggcgtgcagcggctggtggtggtggtgaacaagatggacgaccccaccactgtgggcgaggacggcgtgtggagccgtgagcgcttcgaggaggtggagaagaagctgacgctgttcctgaaggggtcagggtacaatcccaagaaggacctggccttcctccccatctcgggcctgtttgggcacaacatcaaggaccgggtggaccccaagctctgcccctggtacaaggacagcgctgcagccgggagtggcctggcctgttgtcccacgtcatctcgacgccgccctttccacccgcacccacagggcccctccctgttcgaggtgctggacaacgtggagccggcgctgcgcgacgtgtacgcccccttccgcatgcccatcatggacagctacaagtgggttgccatgctttgtgggcacggggggctggactga

SEQ ID NO: 376 - DNA, 183 bp, Chlorella protothecoides
atgcccgtggcgagaaagctggaaaaaatgctgggcgcgccggtgctcatgctgcccatgggccagtcctccgacaactgccacctggcgaacgagcgcatccagcgcgtcaacctgctgcgcgggaagaacgtggtcaagcgcctgctcatggaggcgccccgcgccaaggccgcgcagtga

SEQ ID NO: 377 - DNA, 1386 bp, Chlorella protothecoides
  modified_base (554)..(563): a, c, t, g, unknown or other
  modified_base (713)..(722): a, c, t, g, unknown or other
  modified_base (1014)..(1023): a, c, t, g, unknown or other
atgggggcggactcggcgtgtccactgtcggggctcgcctccgccatctccgacctatgccccgaccccggcatacataaacgccaatttagaccgcagtacttagtaacaatgccaagtaagagcacacagcgggatccgcttcagggcccaggcctgtttggggggggaaatcaagggaacttcagcgcaagcatagcgagtaccatttctctttcccgcatcgccgatctctcagaaaataagtcgacagatcatcatgatggctcaggcagtgatttcgggacccctgaacagggtttccgtgggtttgcggggaaccgccagccggcccggttctctggctggcaggcccctcgcccccacctcatgggtgcgtgggacagggcacaggctttcagcatgatccctgatgtgatctcggcgtccctgcatggtgttcccatgctgacacgtcgcctggacccccctcctttccacaggccccccggcccacctcccgccccgcccttgctaaggtgggttggaggggatgggaatgctgtggtgcatcnnnnnnnnnncacggccaacgacgccaatgtggatgtggataagtatgtcaaggatctgcaggccaagccaggggtgagctgcagggaagccagtcccggtgcatgccagccccttctcccaccatccatcacccaccgacatcgccctctcctgtgctnnnnnnnnnncagggaagccagtcccggtgcatgccagcctcttcccccaccatccatcgcccaccgacatcgccctctcctgtgtctgcagtgggacaaggtagacaacaagacgagcgtggtcgtgtatggcgttggcgccctggtcctgctctggctttcgtccaccattgtcggagccttaaactccgttcccctggtgagcatcggttcgtctgcattgagtggttgtatcgtgaatggggtgccttgcgcgtcgtgtttgagtgtagtgatacatttgctgggtcgattgatgtannnnnnnnnncaacaagacgagcgtggtcgtgtatggcgtcggcgccctggtcctgctctggctttcctctacaattgtcggagccttaaactccgttcccctggtgagcatcggctcgtctgcattgaggggttgtattgtgaatggggtgccttgcgcgtcgtgtttgggtgtagtgatgcatttgctgggtcgattgatgtgagcccacctgtttcaccgcaggtcccccgcctgctggagctggtgggtttgggctacaccggctggttcacctaccggtacctgctgttcaagtccagccgggaggagctgctggatgacatcgagagcctgaagagcaagatcgcgggcgagattgagtccaagtga

SEQ ID NO: 378 - DNA, 714 bp, Chlorella protothecoides
  modified_base (259)..(268): a, c, t, g, unknown or other
atggcggcgaagcacccctgcaccactgcgaggcagctggagcgaggcagcaagggtggctcccccagggcaagctaccccctgtccccccccgaacgccggtgtgcaggcgtgcagcccgtccctggcccaagctccccctctcgttcccccacatcaggaccccgacgcccgtaccttgcccctccccccacgcaggccgggatcaatcgccaggccttcaccacaaagctgtgtgtggcgcagtcccgcgcatgcnnnnnnnnnncaagggtggctcccccagggcaagctaccctctgtccccccccggaatgccggtgtgcaggcgtgcggcccatccctagcccaagctccccctctcgttcccccacatcaggaccccaacgcccgcaccttgcccctccccccacgcaggccgggaccaatcgccaggccttcaccacaaagctgtgcgtggcgcagtcccatgcctgtgcggccccgccaccccctctccccgccggctggtcgccctaccccgcctgggagcgcaaggccgctgacgggcaggacctggatcgggtgatgggcgagatgagcgaccagggcctgcgcggcaagatgtacagcagggaggagctgacgcagcagctggaggggctgggggaggacgaggaggaggagggtggcgcgggggaaggcgacgcccgaccggccgccgacgagctctag

SEQ ID NO: 379 - DNA, 816 bp, Chlorella protothecoides
  modified_base (273)..(282): a, c, t, g, unknown or other
atggagcagaacccagggcgacgagagggagccattgattacatggagcagaacccagggcgacgaagtgagaccttggcccacggggcgtgctgctatgcctgcatcggccattggggatttggagtgcacaattggtattatcatccttcagtcagatcgctcgagagcaggcgacacaaccatcccgacctgcgtgatcaaggaagctggtctggtcgacatgaagacactgagcatcagggtggcaagcagcctgctgctcctcctccnnnnnnnnnnctgatcgcatttgcagaaggtccccctaaagcgactccccgacggggggacatcaagtacattcagtgcgccttatgcgagcacctggccaagcatgcatggaggtccggtcgcgccttgctgaagacctccacggtcgacgagctgacactgctggagcacatcgagaagctgggcaccgcctggaggtctgagggggagtggctgtcccagctggacatcgtgaagcagggggacaagctggtcgtcatggacaagggcgagcccaggtatgattcacttcatgcaaccacacccacaatcaccctcaacctccccgctaacctgcagctgggcgtgtgtggtgtggcatgcaagaccctggaggcggccgccgacgatatccttgcctcgcatgacaccgacatcgcagaggccctctacacggtgagagggctggggtttcggagggctgttggggtcgattggcaggcaggcatgcgctctgggcgggccttgattccatgcctccaaggtacagtgcaccgtggctga

SEQ ID NO: 380 - DNA, 684 bp, Chlorella protothecoides
atggaggctgcggatgatcagccccacgcgatcgataccccgtcgtccgccctcaccaccagcacgcccagcgccgcgctggcgagcatcgagcggttggaggccagggccacggaggccctgctggtgcaggaggtgcggcaggcggtggtgggcaccgcagggacggcggcgggcgcgggcgtggcggggttcttcgccaccaccatcctgcccaccacactggaggacctactggcgctggcgctggcctccgcggtgggctacgtgtcggtggtgaacctgccgctgcgccgcgcggaggccaagcggcgactggaggagctgacgctgggcatcctcgaggcacgatacccacatcccagcaacagagcattggcccttaacggcacgcatccacaccatgatgtctgtgacgggattgcccctccccagctccagcagccagccttgcctgatctcaacccctccgtgcagatcgtccaaacagacatggaggcggacctggctcagcaggtggaggcctgctgcgcaggagtgcgcgaagccatcgcacccctcgaggcggctgccgccctggaggaggagagcgtggcagagttccagcgagagtgcgggcggctgggggaggccgtcgaggaggtgctggcgcgcgttgccaggctgcacattgcggctgactga

SEQ ID NO: 381 - DNA, 498 bp, Chlorella protothecoides
atggggacgagccgtgaggggacatggggaagcacagcacagttcctggtcatgagcgcgctgctgatcagtgggagaccaactcatcctgctggccaagccttcatcacggcgaacccgcgcaatgactcgtgcccgctggatggagccttgggcggcactgcacagccacccagtgacccccccctcactcccacccctccgcgcaggctgagggacagggcagcccacgtatacttttccctgctccaggaggcgctctgctccaagtctgacgtaccccaggcggccgccctgctggctcagtgcatcgggtgctgggccggcgagccgggaaagggcgtgcatgttgatgcagatcgccacgtgatcgagaagctgtcggggctggtggccaccagcggccaggggtccggtcagcaggctgccctcaattggacccaggtcgtcgatctcgcgggcacggccggcctcggcgacacctttgcgctcaggtag

SEQ ID NO: 382 - DNA, 534 bp, Chlorella protothecoides
atggcgatggtggcccgtcagtctcgaggaggggggaagcctcccctgccaccccccaccaccgctgcccgccagcgcgacgacaccctgctcttcgagacgcccgaggagctgcgctgcccgatcacacacgacacctttgtgaaccccgtgctcacggctggcggccatgtctacgagagatcggccatcgagcggcacctcgcgcaccggagcacggatcccctgaccggggcggagctgcccaacaagtccctcacccccatctacatcctccagtcccgggccatggagtacagggaggcatcggcacgggcctgcatcgaggctgccagcgagccacccccgcgagagccaggggcgcacaggcccatcgaacacctgcgcaggggtgtcgagctggcggcgggcaccaagctggccatccccggcctccccacggagacgctggagtacgtggctgcccacccgggcaacgcctatgacgagctggccctggtggcctttgcacgggggctctttctgtctgggtag

SEQ ID NO: 383 - DNA, 690 bp, Chlorella protothecoides
atggatatccgagcatggcactgtgcccacctgccgcccaccccattcctccacacacgccaggaggacgctgcgtcctccagcggcggcagcgcgtcggccgccgagctgatgggctcgtaccgcgaggcccagcgcagctccaccagcattccacttttacgcagcctggagggccttcgagccgagggccccgccctcgacagtcacctggcatcagcagacggcgccgtgcttgcgcaggggtcgcacgccctggtaccgtctgttgccgccgcgctcggccgggcggggggtggaggctcggcctcggcggctgtgcggcaagctggggccccttccaagcagacgcctggaggaaaaggcagtgacgacgagctggtggagagggagagggagctcctgcagcaggacctggtgagggacgcgctgagtcagctggacgaccccttcctcgtcgtggtggtgggcgagttcaacagcggcaagtcggcggtgatcaacgccctgctgggcgagcgggtgctggcagagggggtgctgcccaccacaaacgagatcagcctgctgaggtggcgcgagccaggcagtcagcagcccgaggtccagcagggcacggcatggggcggattatgctatcagaaatgcgcgcatataaagcctgtactgttcctttgcgaggcggagtga

SEQ ID NO: 384 - DNA, 474 bp, Chlorella protothecoides
atgcatgtactggtgtgcgttgggcagggcgacaccgggccggctgcccctggggccaccctgtaccctgcaggcaagcgacaggccaggctggctctgcctgccctgctcgtcgccttggactcaggctccgtggacaccgacaccatagaggcagccctggcacagggcgccaccggcattgtgctggtggaggacacccatggccccgcagccctgtatgaggcggccgtcgccgcgctgtctgcggtgcgagggcgctgccccgtgctgatcagggaccgcgtcgacgtggcctccgccacggaggccgatggcgtgctgctgatgcgcggggcgctgcccgtgctggtggccaagcgcatgctgggaggcggcggcgcgctggtgggcgccgcggtgggcagccgccaggaggcctccagggctgcggccgacggcgcctccttcatcgtcgtccaggttcgtgcttga

SEQ ID NO: 385 - DNA, 1344 bp, Chlorella protothecoides
atgccttgctcacccacccttccttgcctgccccgcgcaggggtggtcttccccgccgccggccccaccaccaaggcctccggcgcctccgtggcggcgtgcggtcccgtgactggcttccgactggaagtggatgcggggcctgaggcacaggtggtgctttccaccccgctggcagagtacatcctgctcaagccggcgccggggtacaagaagacgtttgggaacctgtttgtgcaggcagccctcgtccgggaggtgtgcctggcgctgtctccagccaaggggggtgaccttgaggccagcctggacgaagtgatcctccgcctggcccgctccaagctggaccatggctacgcgagcgcccgggaggccctgctcatcaatgccaagctggtcatcgcccaggtgctggtgtggggcagtgcgcaggagggctcaggtcctgcacttcacccttttggacccatggtcaaagttcaaccatggccttgcatgcaccatgctgccagcaacatgcaccctcccgtgtcccctttccagctgtccaagctggatgacgtgagcgggccaaagggcctcaagtacctcctgaccgagtgcgggaaggcgctggtgaaggaggccgccagctacaagtatgtgggagtgcagcgccctggtgccaccggcatccacatcagggacgacacccggcccgaggcggcaccggcagacgaggacgcccagaccctggccgacgccgactttgcgcgccagttgcaggcccagatggacgccaccgccgcgcgcgcggcgcggggcggcgctaagccgcgcggccccgcctatgtccaggtgtcggcggaggagattgcgaacgactaccccgcgcccctggcctacgccaaggaggaggaggaggtggacgagctgctgctggcggacgaggaggagctggggggcggggcggacccggagaccctcccgcgccgcctgctcacggacttcagcgtgtacaatgccgaggggtggctggcctccctggagctgctccccatgtgggccggcgtggacccgagcgtggagctgtacgcctcgggtgtggtgctcgaggacgacggcgacttctccgggggccaggccctgcaggaggaaagcgcagcgccggtcgatgagggcgctggcgggtcgtcctccgccgcgccgccggccgaggatgccgctggcgggtcgtcctccgccgcgccgccggctggggatgccgctggcgtgcgcatgtgcctgtctcaggtcaaggactgggttgtggagatggggcccgacatgctcctcatctccctgcgcaccgacgtcgcctggtga

SEQ ID NO: 386 - DNA, 1092 bp, Chlorella protothecoides
atgaccgccacggccaccaccatggtgagggcggtgtggcagagctacttcaccgtggccggcgcgggcgcgctggtggccgaggccggcgaggtggaggccggcgagcagcaggcccaggcgggggtggtggcgcgggaggtggaggaggacgagaatgcagacgagggcgaggaggacgcgcaggagagcgcgctggcggccgtgcccgcggtccccgtggccgtcgcgaagatggccggcggcgcccacgcgcgacgcgcggcccccgccgccgccgtcgtcgcctggaccggcgaggccctgcgcacggagggcgggtgcaccttctaccccagcgcgcgcgtgggcgacctggagctgcgcctgggtgacgccgtggcgctgggcccgcccgtcgacgaggacgaggcggcgtccggggacgaagggcaggacgccgcgccccgcctgccccagctgggcctggtgcaggcgctgtggcagcgcaaaggagggaagggcggcgacgcggaggtgcaggtccgcctgctcgtgcgcggacacgagacgcacccctttgggcaacaacctcacttgtccccacccactcctcaacaccccccccccaccaggccgctggccagcgtggcggcgctggtgtcggccagccggctcgagcgcgcctgggaccagaagcgccgcggcgaatacttccgcgccgacgaggagctgcgccaggccaacgccgccgcggcggcggagggcgcgcccctcacccacttctggaggcggcagtacgtgccggaggagggcatattccgcgacgcccccgccgacctccagctcggcagccgcctgcccgaccctcagatccccgagaccggggtgcaggtgcagggcaagggcttccgcaaggatggcgtgcgctacctccccggcgacttcctcttcctggggccggaggtgtttgacgccgtggagggcgcgcgcagcatcgtgcagctgccggagtacctctccaactcccgcttccacaaggtgacttcctcttgctgggggggaggatggggggggaggaggtgtttctcggccatgggggaggatttgtaa

SEQ ID NO: 387 - DNA, 450 bp, Chlorella protothecoides
atgcatggtgtaaaaagaggtgatgcatgttcgttcagggtgggaatccggcagactgtccgggaatgggctgtgcagccctcgccccctgctgtgcatgacgggtgcccccaccttccccggtgtccaagggaaggtccgcttccgggtataaagggagatggcgggcaccctgaggaccggttagaggcggctccccaatggagagtgaagagtgacatcgccatgtccctggacatcgatgacccgccgaactcccggctattcgtggtcgccgggcgtgcaaccagcgcggagtttctcagggatgtcttcgagcagttcggtgtggtgtcattcgtgaagtatctgcgggacaagggtgagtggacggcacctggacctcattgcccgccgaagcgggaatgggggcctccttcctgcattcccgggctgactcggggtcgttga

SEQ ID NO: 388 - DNA, 537 bp, Chlorella protothecoides
atgctggcactcccctccaccacaccaggggtggcgtacgtcaagtatgaccgggcctcctcagcggccctggccatcgagaacctgcatgaggtgaccctgaacgatggcaggggacctcgactcaaggtcatcctggcggaatcgccccacatgaggtgcttgccctggttgttgggcgcggaagggaagggggctggagggggagcaagggccggatccagggtctggcccgatgtgtgcacatgcctggaggccggcgcggccccagtcgcctgcgccatggcaagtaccacattgcaacgcgcgcgcctgcctgcctggtctgtaccgcagcggggaggagagggcgacccaatcaggaatgccacgatgcctggacgccggcgcggccccaaacgcctgcgccatggcaagtaccaccttgcaacgtgcgcctgcctgcctggtctgtaccgtagcggagaggagagggcgacccaatcaggaatgccccggtgtgtcctatccaaccatcccccccccctccctcgttga

SEQ ID NO: 389 - DNA, 1695 bp, Chlorella protothecoides
  modified_base (982)..(991): a, c, t, g, unknown or other
  modified_base (1107)..(1116): a, c, t, g, unknown or other
  modified_base (1189)..(1198): a, c, t, g, unknown or other
atggggtcggaggaggacgcaccccccgcacatcctcactgcaggcccaagaagggcaagctgaaggttcccaccctgctgatgtgggcggaggacgacggcgcattcacacccaaggtctttgaagacaccgaggcgcatgtagaggacctgaccactatcggcctgtccgactgcagtcactgggctcagcaggacaggtgtgttaccgacagcgtggaagggagcacggctgttgggggacagagtatcggttggatgggtggatttgactgtgccgagggtggaggccacttcccccgcaaggcaggctgcattgctcacagagaagcacttgccttcagaacatctttgggtgtgttcaattcttcaatgtttttctggacccctcctcacatcatcttcaaccccttgccagacccgagctggtcaaccggcacatcaccgagttcctggcaagccatgccacgacgctcggcagccggctctgaatggacaagtctgaggagaggcgagctcttggtgcgtctctgtgtacctttctcgaaagcgtgtggcggattccccccccggaccccccccgcatccccatgtcattgcctgctccccgattcagagctgctgcacagcgcaccacagccgatcaaacgtcgtcagtcaacctcacgtgtagcatcaagggaagcaaggcctgggcaagcgggcagtggccggagtaggggacaggctccatgcgattccaaggaggagcgaacgtcagatcttgggcggagcctgccccatctgcggcacggagtcaaaggcactgaaggcatctgcgccgttggaggtgggggaggtcgccgcgtgcacgttctggttggactactgcgccgcactcccgtccggtggagcggaggaggtggtgcagaagaaaggcaagccagctcgcgtcgccctcaccccgtccatgctgatcccccaccggccccggcccccgccnnnnnnnnnnactgcgccgcactcccgtccggtggagcggcggaggtggtgcagaagaaaggtaagccagctcgcgtcgtcctcaccccgtccatgccgatcccccaccggccccggcccccgctnnnnnnnnnntgcgcatcggcgaacccctgcttgggaggggaggcatgtttttttgttgggtgtgtgtttgtgtgtgtgttannnnnnnnnngccactgcacgctccccgctcacttgggtgggggcggcgcctcctccgccttcttctgcaggctcaggaggtccctgaaagcgtcggacaccccagccgagctggccggggcctggtcgcccccgggcggcgagtacagggcggggtacagcgccgccgggggtgcgggcgcgggcacgccccaggactcgccaaacgcgtctgtgccgcccgcaggggcgggcgcgtgcatggaggggccgttgccgttgctcgtgccggcgtcgttcgccgaggcaaaggggttgctgggcgccggcgcctgcacgccgccgccgccgccaaaggggttgctggcggcctgctgcggcgggggaggcatttgggcggaggggggcgcggcggggggtgcggccggcggcccccacgcgctgtcgctgaagaaggggttgctggcggggccggcgtcgggcgggggggcgaggccactgccgctggcaaaggcgggcgccggggcc

SEQ ID NO: 390 - DNA, 1398 bp, Chlorella protothecoides
  modified_base (24)..(33): a, c, t, g, unknown or other
  modified_base (145)..(154): a, c, t, g, unknown or other
  modified_base (284)..(293): a, c, t, g, unknown or other
tcatcaagggagaacgacgtccgnnnnnnnnnncaagcatacctgcggcaggcagcattttatctcacgggttacctattggctgtacctatctctggtgcccttgccatttccaaggttacaaggtgtgtgccacctcgcgccnnnnnnnnnngaggagcctacttgcaagcgcctgacctcgctgattcgcccgtcccttgcagggaggcccggcaagcaatcaccgagcagtacctgtgggcagctggcacggccctgccgtcgcagcctgcatcagcggnnnnnnnnnntgatggtgtaaactcacacctgaaccacctcccactgtccccttgtgcgacactcaggttcatcaagggagaacgacgtcctccacttgcgatccaagcgtcagatgcctccgccagggatttcgtccccggcctgcatcacagctggctggtggcaaatggcatccggctgcacacggttcgtgcaggtccatccacctccattcctcccaagcccgtcatggtcttcatccatggcttcccagaggcctggttctcgtggaggcaccagctcgagcacttcaagcaggagtatgatgtggtggcttttgacatgcggggatacaatgagagcgacaagcccctggtgcgcacgaggggctgggaggcgagggcaagcattgggcttccagccagccatagctctctatctctttggtgctgccctgcccggcccctgcagggcatcgactcgtatctcatgaggctgctggtgtctgatgtcgtcaccatcatcaagagcgtgagccccgaccgtcaagtgaccctggttgctcatgattggggcggcgtgacatgcaaggcttgccgaggtgcctcccaacttctgggagggggtttggggcctggcgtgacggtgggataccctcactgcttgctcaaagcatctgccaccacatcccagcccatccacccacttccctccacactccccctttccagtcgcctgggtgttggccagggctcaccccgagctgctgagtcacctcgtcgtcctgtgtgcgccacacccgtccaacttcctcgagaagatgaccacggcgcaaatgctcaagtcctggtacatcttcttcttccagatgttcacctccaggaagatggggttgagaaaccgcgatcgcatcagcccagaggtatgcagggttaccagtatgagatatggaggtcggcccttgaccccgcctcaggctctggccggcaggccctcaccctgcccaccccacaccccattcccaaacaggagatcgcgcgctacaaggtggcagccagccgcccaggagccctcacctccatgatcaactactacagggcattgtaccgctacgaccctagataccccaagtaa

SEQ ID NO: 391 - DNA, 495 bp, Chlorella protothecoides
  modified_base (189)..(198): a, c, t, g, unknown or other
atgggggttgggcaggcaaagccctgtcccctgatccactcaggcatggtggcagctggttcagcacacctcgttgtccctcgcaaggcaccgcgtcgttcaccttctccccccacaccgccgacctcatcatctcccaatcccacacacacaaaaccccctgcaactgcgcgcagtctggcagccacnnnnnnnnnnacacctcgttgtccctcgcaaggcaccgcgctgttcaccgtctccccccacatcgccgacctcatcacctccccaccccccacacacaaaatcccctccaactgtgcgcagtctggcagccatgtcaaggtcgagcacggtcagcacatgggcgagacggggatggtggtgacggtgaccggccccattgccaccatcttcaccgacgtctcgcgccaggagatccgcgtgttcgtcaaggacctggtccaggctgtggccgtcaccagcagcgtcgacacgtgcggggcggggtag

SEQ ID NO: 392 - DNA, 2562 bp, Chlorella protothecoides
  modified_base (746)..(755): a, c, t, g, unknown or other
  modified_base (862)..(871): a, c, t, g, unknown or other
  modified_base (1434)..(1443): a, c, t, g, unknown or other
  modified_base (2191)..(2200): a, c, t, g, unknown or other
atggcctgctctcccaacacgttccttgacaagctcccactggtctggcgcaggatgaggaagcctccaggcgacagaagaggtctgttgggtctcacttgtatcgcacttggattagtcaagagtcgcttcattgatgacattgccgaggtggatgacgacgacgaggacgacgagctggaggtgggtggcatcggtgccggcctggtctctcatagggtccgcataccctcttcccaccctcaccggcatcaggaggagggcctggatgacctcatcgacgacgcgggtgaacacgtgcacgacgccgctgacatgattgccatgcgccgccagatgcgcgaggcggagatgcaggcggccaaggacgaggagatgaatccagaggagctgcaggcctacctgaaggaccggtacggcggccagtcacactaccccggcactggcggggcggggacggaggactttggcgcggtggcgcagcaggccctgctgcccaagccttcggatcccaagctctgggtggtgcggtgtgcagagggcgcggagcgcgagggcgcgagtgactcgtcgctcggtgtccgaactgggtgtgaccgctccctcatgccacccgcaggcctcctgcaaaagtgctatgacctggcgcaaaaggggcgctccctgctcatcaagtctgccttctgccaggaccatctcaaggtgggtgtggctgcggtgcgcaagcccgcgcagccagccatcannnnnnnnnngctcatcaagtctgccttctgccaggaccacctcaaggtgggtgtggctgcgtaccctttcatcagcaggagacacctgcccattcctcctttcccccctctcccannnnnnnnnngtgcgcatgagaccctgccgcggcatgtctgcttgtccagtaccccttcatcagcaggagacacctgcccatccctccttcccccctttcccgacccccagggctacctgtatgtggaggcggtgaaggaggcgcacgtggcggaggcggtgcggggcatgcgcgccgtgttcaactccaagaagccgcgcatggtccccctgggcgagatgacggcggcggtggcggtgcaggtgaccgcggcccgcggcgtggacgtcggctcctgggtccgcgccaaggccgggctgtacaagggcgacctggcgcaggtggtggacttggacgcctcgggcgcgcgcgccacgctgcgcctggtcccgcgcctggacctggccgccctctccgcgcgccggcccgaggacgcgcgtgccaactttggccgcgcgccgcgtgtgcggccggccgcgaaggccttcagccccgatgaggtgtgtgagactggggaaaggggaagagggggatgtgagggtagggggttcagcgtggtattgtgggtatatcaaggaccaggctgtgtggtnnnnnnnnnnttcagccccgatgaggggggcaccgcgacggaagagcagaatggggcaagacccgcagctgccatcatcacacccaaccatgcacctgtccagcacctcagaaccctcccccaaacatccatcccctcatccattacatcaccccccccccaaatacaacaacaacaacaacaacaacaggctcggcagtacaagacgctggacgtgctgactcagcgcgaccgcaccacgggccagctggtgcatgtgctcaacggctcccagcgcttcagcgagggatacctgatcaagagcgtggcggtcaagggcctggccctggaggatggcctgcccccactggacgacctccagcgcttccaggccgcggcgcagggcggcggtggcggcggtggcggcggcgcgggcgaccgcgccggcgccgccgacctcgccggcctcgtacagtcgctgaccactgagggggaggggcagggcggtgccgcgcccacccgctttgccaagggcgacctcgtcctcgtcgtacagggtggggaaagggggcccgggtggttgacggggtgtcactttgtcgtgggggttgcggtggagaggagctctggatggttccgtcgggagtggggtaactgctgggcatgcctggcagggcatcatcccagggtaggcgcccgtcgccggccatgtttcccgtgcccggtgggccagagcccgagcgtctgtgtagtaccacgacccctccacctgttgccannnnnnnnnntggttgacggggtgtcactttgtcgtggggattgcggtggagaggagctctggatcgttccgtcgggagtggggtactgcttggcatgcctggcagggcatcaccccagggtaggcgcccgtcgcccagcatgtttcccgtgcccgatgggccagagcccgagcatctgtgcagcaccacgccccctccacctgttgccgtactccacacactcatcctccaggcgacctggcgggcatccggggccgcgtagaggcctttggcgaggacgggctgctcatggtcgcgcccaccgactccaagctccccggcttcaccgagctcatcggcctgcatccgcgcgagatccagaaacactttga

SEQ ID NO: 393 - DNA, 345 bp, Chlorella protothecoides
atgagggtgcgtgcggcagtgaagaagctgtgcgaggcatgccgagtggtgaagcgtcgcggaaaggtgttcatcgtctgcaaggaaaataaaaaggtgtttgggattgagttgtgcccctccttgcgggagattcgccggaggttggggtgcgagccgcacctggcccgggcgacctcatgcccattccaccctccctacacctcgcagcacaagcaaagacagggcatccacacggacgccatggctatcgccgagaagcagcagtcactccccacgcccagccggtcgttcgtagacagcggagcctctgtcggcgtgaagctctggcaaggtatcttgtag

SEQ ID NO: 394 - DNA, 531 bp, Chlorella protothecoides
  modified_base (317)..(326): a, c, t, g, unknown or other
atgaccagtgcctgtaccctgcacgcctcccatccacagggaagcccaggttcctttgtgaggctcctgctgctcagaggcaaggtggttggggcagtactcataggagatacaggcaagtcgcggggccccttgggtgtgttggctgtgcatgttgccagtcacactgcaactctgctggtagtcctgaggtgtgcctgtggtaatcctcggtcagagcatgtgatgaacagcacccagttatccttccaaccgacaacagatcttgaggaggccgtggagcacttgatactggataggctggatgtgggggcgtnnnnnnnnnntactgcaactctgctggtagtcctgaggtatgcccatggtaatcctcggtcagagcatgtgatgaacggcacccacttatccttccaaccgacaacagatctagaggaggccgtggagcacctgatactggataggctggatgtgggggcgtatgggcccagcctcctggaccccaattttgagctcgaccatgtctttgactga

SEQ ID NO: 395 - DNA, 1452 bp, Chlorella protothecoides
  modified_base (174)..(183): a, c, t, g, unknown or other
  modified_base (803)..(929): a, c, t, g, unknown or other
  modified_base (983)..(992): a, c, t, g, unknown or other
  modified_base (1047)..(1056): a, c, t, g, unknown or other
  modified_base (1288)..(1297): a, c, t, g, unknown or other
atgtgcccctggtggcagccaaccctttcaagtgacgctctagaagatcactgccccattcctttctcaactctcttccattccagctgcgtgctggtgatggagtttatcccagccgtcagcatcgcgacggcctgcgagactgggttcctgggccccaagaccctggcccgnnnnnnnnnngtgatggagtttatcccagccgtcagcatcacgacggcctgcgagaccggtttcctggcccccaggaccctggcccacgtctcacacgacctcggaaggtcagtcagccggtctgagtgcgttggtgcattggctggccgagtgggcgggaggagtgtgcctgggcgctgggcttctccaggcacacagcgtgatagcctgctggaatctccatatcccaaacaaatcatgcatcgcagcacccatcggcatcgagcaccgctgcgacctctttgcgcctcgaaccacctcaccaacctgatcccacgcaggatgctgtgcctcgacatgatgctgggcaacgccgaccggctgcccatcgaggcgctggggtggcggggcaacctgggcaacgtcctgtttgcacggacggggcgctgggtggggaggatggtggccattgacgccgtggtccagaggaggccgcccggcaggctggtgtgcactgaggtgagcagcagggtgattggggcttggggggcaaagcagatggtcctgggtgcggttctgggtccaccgactgcagccacgcgctgcgccggggtgcctcccacgagcaacagcatctcacctcggccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccatcgcggccttccagcaggtgctgtctcggatggaaaagggtctgagannnnnnnnnncggccatcgcggccttccagcaggtgctgtgtcggatggaaaaggggtccgaggnnnnnnnnnngacatggagtccagcttcgagctggcggccgccacgccgccccgcgccctcatcagcggtggcagcggggtggaggggcggtacggcggcggcgggggccctgggccgggagtgacggcgccctccgcggcgtcggggccctccggctgctcgccctcgctcctggcaagcccgggcgccggagcgggggccacggctgccgccacgccgtccggcagccgccgcgcctccnnnnnnnnnnggggcttggggggcaaagcagatggtcctgagtgcggttctgggtccaccgactgcggccacgcgctgcgccggggtgcctccgtcgagcaacagcatctcacctcggccacgtgcaggacgaggcgtgcgagcgccttgctgagctggcgctga

SEQ ID NO: 396 - DNA, 819 bp, Chlorella protothecoides
atgggcaatgcggcctcggcgactactgccgcggccttggatgcactggcttccgtgacaggccctgcctctctgcagctggacgatgagacatggcagcccctgctcaccgtgtcgactcctctgtcacggtggtcagaggacgagctccaggccaccatcaggccctactgcggtgatctgggtaggtcgtcgggccagctggttactgcatgctctcaggaatacgttataagggctgtatacattctgcctcatgctggatactctgtatggcatttgttgcaccccagcggagtattctcagtctccagtgcacacatggtcgatgccacatccttctcctccccgctccctccccaatccacgacagtgtaccataactgtcagacgtacaacctgcagcgactcatcgtcctgctgtgccgacctcatggagcacctcacgccggcgcagctccaggcattcctgtcgtggccagccccaggtgcgaactgaatgagggctgctggtggaggtgtgatgtggctgtgactggaagtattgctcccgggtccagttggcctagaccgtgcttgaattcgtgcacccatgaaaatgcaggcctcctttcgttctcttgcttggacaacagcagagcagtgcctcacatcaccccctgcacaggctcccctcacaaggtggctgtggagcgagatgcccaggaggaggagcaaacgcccgtggagcagcagctggtgggggcttgcctccgtgcgctggtggcccgcaatgatccggccgcgaggtcagtttggtacactggtttcagggaatga

SEQ ID NO: 397 - DNA, 597 bp, Chlorella protothecoides
atggtgccttggaaagcgctgcgggcctgctgtaccagcgagcagctgcacagctccggcgccctgcccgcacagactgcggcgcaggacagcgctggggacaaacccgtcacgccccggggcgcgagcgccctggagatcaactccggcggcctggtcttcttctgtctcttcaacgcaagagatgcgcacattgggagctgtagccccaggcaatccccacccccctgtccggggccggagtcatcggaggaggcgctgcgggcggccgccgagtcagcgctggctgaggcagccgccaacgggaggctttcgcccccgtgcaccgaggcagccgccaatgggagactttcgcccccgtgcaccgacgcagggccacgcgaggtgtcgcccagcgtgatagaggtcatccctggcgccaatgcccccctcgccgtcgccaagcggtcagcacctcatggctgcctggtgctgaagatccccgcctcccgcctccagtgccagtctgagctgtttgctggggaagtggcccggcacgtcgggttggcctgccccgacgggcgcatccttcgacaggcaaggcgggcgcatcgctag

SEQ ID NO: 398 - DNA, 261 bp, Chlorella protothecoides
atggctggagtggaggaggacacggcttccagcatggcctttgagctgttcacccacgtgacgtcttttgccggcctgaaggtggtcctgctgggaaggtacaatggccaggggctcgagaacgagccggaagcagacctgatctccttctcaaggactacacccccagacccctcccaggcacggagagggggtgcgggaagattctgggcgacgacgggtcgagagcattgcgcccatggtctacaccctctgcgttaa

SEQ ID NO: 399 - DNA, 618 bp, Chlorella protothecoides
atgaggagccgggcacgaccagcgcgggtcccgggcctgacctccgaggcggcgcagcgcctggtctccctgctggccctgctggcgcggcgctggcgccggctggcggccgacgctaccgggcttgggacgatggcggcggccgtgggcgatcctgccacggcagccgacggcaccccggaggcgacgagcctggccgtctctgagtcaacctccgcggccgccgccgagtctgcgcagctggcgcacgacttcctcaggatggccctggaaagcgcgagcgcggtgctggagcgcgcgctgccggccaacccggcgctggtctacgcgctgctgcaccgcggcgagctgtttgaggggctgccgcgggacgaccccggcctgcgcgtccccctggccaacatcctggccgtcatcgatcacttcacgcgcgccctggcgcgcagcctgggcgagggcgcggcggcgctggatgcagggacggtgatggcggccatccgccacgacagccgggcgtggcggggggaccgcctgcagcgtggggccgacctgcattttgcatacgaggaaggtgcggaaaaggagtgtgtggggaggtgggtcataagggggtgctga

SEQ ID NO: 400 - DNA, 750 bp, Chlorella protothecoides
atgtgccaagatggcatggttgtggtttcctcctggtcccctccccccgagctgatataccacatcccatgtccccctcgcaaagtctcctgccgagcactcccccgctcctcctttcaccaacccaaatccccctccgccgccttacagggtctgaggactgcgctggagtccctggcagccgtcaaggggctgttcgagatgatgtacgaggtggtgcgggactggatggacgagttcctggcagacatggagtccagcttcgagctggcggccaccacgccgccccgcgccctcatcagcagtgccagcggggtggaggggcggtgcggcggcggctggggccctgggccaggagtgacggcgcctcccgcggcgtcggggccctccggcttctcgccctcgatcctggcgagcctgggcgccggagcgggggccacggccgctgccacgccgtccggcagccgccgcgcctctgcgctggtgtcggactccccatcggcggacgtgggcctgaccacgcagaagatcaggcacatcaaccaggaggcgcagcacaaccactcggtgtcgcgcaaggtcgccgcctggcgcgacgtgttccgggctagaggcagcgagctgcggggcgcggtggaggagtggcagcagaagcgcgacgcgtccgggtcccgcctcaccaccggcttcctcgacggcgtgcggccggttgtggacgtgtacgagctcaaggtgggttgccggtcgtga

SEQ ID NO: 401 - DNA, 402 bp, Chlorella protothecoides
atgccgtcaaggggcatcgatgagaccttagcggaagccgcgaggatccagcttgatgtcatgcaaggcctggacagccccgagcgagccagtcacgcatctcccctgtccccccgctccaccgcatggcggtggctgggggagcacccggatgacgccgccgagctggcagccctgctgcatgaagccgccccgaagctcgggctcaagggcgactaccccgtctcccggagggtgaccccttcctttcccgccaagaccaccctgaggcgggacgaggccgacccggaggacctgggccagctcctccagcaggcagtgcccatacccacaggtgagacgtggtcggccgccagcctcatcagggttttggtgagccactccacttacatttgggtgtga

SEQ ID NO: 402 - DNA, 531 bp, Chlorella protothecoides
atggacggcgcggaggggagctgcgtggaaggtggtgcagtggggggcagcgatgcgactgcgggcagcggtgtagcccaggccaggcagcgcgaggggccgcctggcgcactgctgggccacgccgtgggccccacctggatcaaacacctggcccacggccagcggggcggggccttgacgctgcacctcggctgcgaggtggagcgagtgtcgcggggcacggcccctggagaccctgggggcccctggcccgtggcactggagctgagcgacgggcggtgggtgtgcgctgacgtggcggtggcggcgctgggggtcacacccagcacggagtggctcgggcccgagctggagcgggggcgggacgggggcatcaaggtggacacccggatgcagacgagcctggcgggggtatttgctgcgggcgacgcgtgctctgcgcccgactttgacaccccagactcccagtggttccagatgaggctctggacccaggtgaggaccattggtgggggtcccgagggctga

SEQ ID NO: 403 - DNA, 642 bp, Chlorella protothecoides
atgacgtcacgggactatgccgacggcactgtgctggagctgcgtgcggggcggctggagctggactctgtgctcgcctcagcaacggcccgccgccagcccgtgctcgtccagttcagcgcctcctggtgcggcccctgccgcatgatgaccccggtggtcgctgagctggcgcgggcccacacggggcgcctggtggcagtcaaggtcgacatcgaggccggcccgcccaacaaggcgctggccgccgccctgcgtatccagtccctccccactttccagctgtaccgcgacggcgcggtggccgacgcgctgcagggcgccaaccgcgccggcctgtcggccctggtctctcgggcgctcgccgaggcggggccggcgcccgacgccgacgacatggccgccaggctggcgcaggccctgggcagggtcaaggcagcgacctcgcgcgaggacttccacgaggccgcgcgcgtgctcctgcgcttcgtggggaacgtgctggaccatcgggacgacgccaagtaccgccgcgtgaaactggccaaccccgtctttgcgtccaaggtgggcctgggacgcattgttctttgttttcacagggggaatggggaggtaagggagttttccaacggctattaa

SEQ ID NO: 404 - DNA, 1170 bp, Chlorella protothecoides
  modified_base (161)..(253): a, c, t, g, unknown or other
  modified_base (796)..(829): a, c, t, g, unknown or other
cgtgggtgggtgccttgggtgggggggtgccttgggtgggggggctggacaagggcctccccctcgcacgcctgcacacactcctcacgccgcttccactccccaccactcccaggagctgctgctggcgcggctggagcacgcggcggggacccccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgcggcgcttgcacgggccccgcagcgcagcgcatgtcgcgctacgcctcggcggggccggcgcaggcgaggggggccggcgccccctccccgccggccagggaggaggacgaggcgtcgtgggcgtcgtccggcgcgcgcggcggcagaagcggcgcggagccgccgccgctgtcggtcgcgcgcgccatcctgcgcagcaagcgcggctggcgcgtggtggtgacggggcactcgctgggtgcggcggtggcctgcatgctctcctttcagctgcgcgaccagttccccgacctggagtgctgggccttcaacccgccgggcgggctgctgagctggaacctgtcgcggctcgcgcgccgcttctgcacctccgtcgtggtgggcaaggacgtgatcagccgcctgtccttcagcaacatgaagcgcgtggtggacgagatggtgctgtccctggcgcgctgccggcgccccaagctcaaggtcgtcggcgacctgctgctgaagcggcggggggggggggggggggggccccccccnnnnnnnnnnnnnnnnnnnnnnnnnnnnnnnnnnctcagacttcctgccccgtacacgagctgtcggacgaggtgctgcgccggctggagaagtaccacgccacctcccacctccacgccgccagccagccggagctgtacccccccggccgcctcatcttcctgcgccccttcaagggccagggcgtggctcacacctgggacgcggtgtgggtggacgccgccacgctcatgggcgagggcatcctgctggcgccctccatgctggcgcaccaccgcatgttcaccctcgccgacgcctttgccgaggtgctgcgggaggggcacgaggctgcgctggaggagctgagcaccgaccccgacaccccttgctga

SEQ ID NO: 405 - DNA, 1116 bp, Chlorella protothecoides
atgctgtaccgcacggcggtggaggacgtccccaccggcgactattccatcccgctgggccaggcgcggattgcccgcgccggcagcgacgtcacgctcgtcggctggggccagcaggtcctggtgctggagcaagccgtgagcgctgggcgcgccggcttgcgcgtagttcccgaggcagtgccccacccaatcacgtgccaggccaaggagctggcggcctccgacggcatcgaggccgaggtgatcgacctgcgcacgctgctgccctgggacgcagaagcggtggctgcctccgtcgaaaagaccgggaggtgggtgctgggaccatggcactcacaagtcgtgattgaaaggccacgggcacactggggtggtcgagggccgcgcagggccccgtccgcgcctgcagtctgtgctgggatgggcatggcaaggctcgtggtcagtgcttgggaggggcccagtgggcacatcacggtggggacagcccccccaaacacgacctgccagtggctaccacgacactccccggcgggccagtcacctgacgtcccccttcctccaacacgaggaccccgcgtgcgcccgtatacacaggctggtggtgagtcacgaggccccgctgacgtccgggttcggcgcggagatcgtcgccgccatctccgaccgctgcttctactccctggaggccccgccgctgcgcatcgcgggctacgacacgcccttccccctggtctgcgagcccctgtacctccccggcgtgcagcgggtggtggatggctgcggcgcacggtgccagggtttcaggggcagacaatgcggtggagcactgcgtgcacatacagggtacaattcagcaaacgcatcacggctgggaggagggaggaagggggaatgtcatcacggccgagcacatggtgggtggggcgggagaccggcgggtgcggatgcgccgtggaaacaaaggggcagcagggtgatgggggtccagggctgtggtcgcttcgagggcgcccgccgccggcgccaggttggggcgacggtgttcccatgtctgacgggccccgctcccgatgcccgcatcgcgcgaggccgacccgccacggatcatga

SEQ ID NO: 406 - DNA, 3639 bp, Chlorella protothecoides
  modified_base (91)..(174): a, c, t, g, unknown or other
atgcaccacacacacgctgccagcggtgtgcatgcaaacccatacctgcgacgccgggcatcaccgcaagggcctcggcgtgcctgccggnnnnnnnnnnnnnnnnnnnnnnnnnnnnnnnnnnnnnnnnnnnnnnnnnnnnnnnnnnnnnnnnnnnnnnnnnnnnnnnnnnnncgcccccccgccgccggcgagctctccagcagatccacagcgcacctgaggaggtctgtggggtcggggcagcggggcgcgcgccccaggctcgcctgcacgcaggcgtggagtgggaggggaggcaggctgtgggtgcgagcggctgtgagatgcacatcaggcccaaggggcctgcttgatctcttccagggtctcgtccggtcatcaaaagaccccctccaccactgccccccacacacagcatctgcctacaccacggccggcctcgccatgctcaccccgacagcggtggcaaactcgtcgtctgtgaggggacggtccaggtgcttgaactcccagcaccccaggtactggccaggcaccacctgggtgacggggatgatggccacggagtgggctgagagcgctcgcccacctcatccgtcatcactggactgggaccctcgtccggctgccgtgagagggcgtccgcctcccctgcatgcctggccgcagcatggagcagcgccgcgacgctgcccaggccacgctcctggccctggggaagaaagcgaggacggtgtgcgggggggatggggaggcagcacagagagagggcaagccgatgccaagccctgcgcggcgagtttccaatccgcgggccgcggggcagccgccctcctgggcattgcaatccacaggtctgggaaggaagcccatgggcaaggtgcctgcccctgtcccaacccaccggcgcaggccttcctatcaggtgaccggccacggcctcgtgctgaagcgccaggcgctgcgcgtgggccagcgccagggccctgcacggcattcattgcgttgagagtgcgattcaatactgtccccaccctccctcggcgcaccgggttctgggtcgaatcctaccaaatcacacaaaccagcatgcccaccccaggtcacgagacaactacaccccggcaggcgtcttacttcggcgtgcgggcactgggcagggtgccgaagagggaggtgagcctggtaaagtgcttcagcacgatgtcctggtggcgcggcgaggggggcaccagcgccatcagctgcatggtatggggagagggaggacgagttggcgatcgcgaccgcagaccggttcccaaatttggcgcaaacgatctggcagaagcccagctcctcatgctatggatccccgggcaacccccagcaacccaggctgcgtcccaggccctccatgaaaagcctgggcgccctgccttgaagagggcctgcaggagcactcccgccctgggtgctcctggcgcaggccctgcgagtgacgccgagcatgctacgactgggcctccccccagcgaagtaggccttgacgcaccctggcatggaggagtggggatctgcagccgatggccgctggttgatcgattcttgccaccttcgccaaccccagccctggatcctgcaccacagcgggagcctcacccggctgacccaaaagagttccctactcacatccagcttcaggccgagaactcggccgcactcctgcccggccaccgtggttggggggtgcttgctggcatggcgcacggccgcgtccaggggggtggcatgctgagggacaggacaggtcaagactcaactttctcatcaagtcacaataaccttgggtctgcgccgaggcgggggggaccgcacccacttcctgtcgacgtccgcctgacggcagagcatgctgatcctgtcctcggccagctggcctggcgccgtggggctggtcaccacaaccatcagcctggcctgcagggtgcgtgccgccgtccttgcggcggcagcggcctgggagcacatcgcccatgccttggggtcccccatcacgtcgccgtggcgcagcagcacagccagtgcccctggcgtgtgccgcatcagcgcctcaaagctgtgctgctgcatttgtgccggcgagagtgcgagtcgggtgtgggtgaccggcctgcaagccctttggcccatcccaggggttccgaggggctgggtgggcgaggccctagaggggcggcagcagtgaggatgggttgggctgatgggtttcagggtcaacttcggcaagctaaaactcgacgcacacctaggacctccgggctctgctgggcatctggcaccgtgatcaggcgcaccgcagggctttcatccgtggcagccagggcgatgaggagttgctgcgtctccagatccccgagcaggcctaccaccggtaggggcggatcctggaagccttcaaactccatgggccttcctgctccccctcgcggtgagagacctccacctgttgccaggactgacacgcgcgatcacccagctccaaggggctgtagaatcgaagtcgcgcgcgagctctgcgccgggagtcccggagacccgcgtctcctagtcatgttccatgagactaaaaatccgaccgatcggtggaagccacttttccgaatcatccaagcattggtgatcgaaccgaatcgcatcactgccttcgaagaggcgccggttcaggatccgtcgttaccagccatggcagcaattctgcgggccccaggcttgggaggagtctggggcaccgtgcgcggcctggccaccgcggtccgacaggcggaaccggccaccgctggtctcgatgccaagcagatgaatctctgctcggccgtcaacgacgcactgcacatcgccatggatgagaatcccaagacgcttgtatttggggaggacgtcagctttggcggcgtgtttcggtgcactgtgggcctcgcagagaagcatgggaagcatcgtgtattcaacacccccctctgcgagcaggtgagggcagatcaggggggcattgtcggctttggcattggcgccgctgctcagggctactcgcccatagtagagatccagtttgcagactacatcttccctgcttttgaccagaccagtgaatgtccacacgcatgccccccttgccagatcaccaacgaggcggccaagtatcggttccggtctggcggagagtttaacggcacgatgtgcgaccctaaaattggtgcatccaaccccgcatatgtgtgctgcggactattttcttgcagctgcagggccatcctgccagcttttatgtatgaacagcagcttcagcatgccgcaagaacagatgtccacctctccacaatctgtgcaggcgctgtggggcatgggggccactaccactcgcagtcccctgaggccttcttcacgcacatccccggaatcaaggtggtgatgccctctggtccccgcgaaaccaaaggttgccactcctccgaaacgaggactgtcctgaggatgtcgctgatactagcctgccgggagggctgtgtggcttctggctctccactgcacacaccttcccctctgccgatttcccctcccttcctccaaaggcctcctcctgtcggccatccgtga

SEQ ID NO: 407 - DNA, 666 bp, Chlorella protothecoides
atgcagcagcacagctttgaggcgctgatgcggcacacgccaggggcactggctgtgctgctgcgccacggcgacgtgatgggggaccccaaggcatgggcgatgtgctcccaggccgctgccgccgcaaggacggcggcacgcaccctgcaggccaggctgatggttgtggtgaccagccccacggcgccaggccagctggccgaggacaggatcagcatgctctgccgtcaggcggacgtcgacaggaagagcatcctggccttgcacatgagggatcaggtggggatggcgggtgtgctcagcacgctggtgcaagccgcacagaccagctacctggacgcggccgtgcgccatgccagcaagcaccccccaaccacggtggccgggcaggagtgcggccgagttctcggcctgaagctggatgtgagtagggaactcttttgggtcagccgggatccagggctggggttggcgaaggtggcactggctgccccgcccatggtcaaagatgctcttgaaagaagagctgggcgtgcacatacagaatcgatcaaccagcggccatcggctgcagatccccactcctccatgctgaaaattacacccaaccccaaccacctcccagctaggtctactgctggagatggggggccgccccgatga

SEQ ID NO: 408 - DNA, 183 bp, Chlorella protothecoides
atgggtgcgcagctcatccagcacatcaaggaccaggctgccaaggccgagcggggcgtgtacctggaggcatcctctgccgcctccacccgcttctactcgcggcatggcttccagcatgtgagggagcacaggctccacgaggcggccccgatcctcaacctcatggcctaccaccccgag

SEQ ID NO: 409 - DNA, 1503 bp, Chlorella protothecoides
  modified_base (383)..(392): a, c, t, g, unknown or other
  modified_base (455)..(484): a, c, t, g, unknown or other
atggcccccggcctgctgcacgagatggcccccctgctgagcccggggtccggcgccgacgccgccctggtccgccgcgtgctcagcatcctgcgcagcgtggtgggcgccatgcaaagcgtgacggggacgcatgccgccggggtcaaggccctgctcaccgaggtcctggccgagtgggcgccgctcctggccgcggtccttgccccgcgcgaggtggggtgtcacccggggtccggcccggacttggaggggttggaggagtggggcacggggggcgggatccggcttcaggtcttgcacaccgttgagcaggcgctgaagccctgtattgagaggctttggctgcccacgctcttcctccccaatcccctcctctcccnnnnnnnnnntggaggggttggaggagtggggcacgggggatgggattcggcttcaggtcttgcacaccgtannnnnnnnnnnnnnnnnnnnnnnnnnnnnncccagcaggtgcccgagctgtgggcggcgcagcgcgaggccctgggcatcctcacggtcctggtttcctccttcggccgcctgtccgcgcccgtgctcacgcccgtgctgggcacggtgtggcatcgcttctccgccggcctgccgcagtacgtggcggccgtggtggagggcgaggccgacgcggggttcggcgacccagcccccgccgacggtgccgaggcggaggacggcgagcgggcggtggggctggagggcctgctggcgcagaccatggagctcatcctgtgcgtggttgggaacgcgcggttccggggcctcatcgcgccgcacctgccccagctgctgggcctggcggtggggtacgcgcagatgacggcggagcaggaggagcggtggacggactgccccaaccagtacgtggcagacgaggaggacgacatgagctcgctgaggtgggctttggtttgttgggtgcgaggaaggcgcgggcagcgggtggagggagggtctgaaaggtggggttcatcgttaatggtgggcgccgggccttggagtgacgtccttgggcaggccgccagctgccctgctggatcctcttttgcctctcatccccatcaaaccactactccctcacccccacacccactcacccccacacccactcactaccgcacaaaatgcaacagggccagctgcgagatgctggtggacgaggtgttcctggcctttgaggaggcagccgccccggcgctcagccgagcggtgggcgaggcgctggcgcgctccggcactgcccgggcgtcgggccgtccgggctggtggcgcgagcgcgaggcggccctgctcctggtgggcagcgcggccgacacgctgctgggcctagggccccgcgcctttgacctcgccggcctcctctccggcccggtggtcgaggacctggcgcccggctcgccgccctttctacgcggccgtgcactctggctggccggccggctggcggcggccgcgccgcgcgcc

SEQ ID NO: 410 - DNA, 1953 bp, Chlorella protothecoides
  modified_base (614)..(623): a, c, t, g, unknown or other
  modified_base (1221)..(1230): a, c, t, g, unknown or other
  modified_base (1473)..(1482): a, c, t, g, unknown or other
atgaggggcggggcgaagggaagcgcccctctggggcttgtcttcaaggtcgagtcggggaaatggcgaggctgcgctgcacctcatgcgccgccgctcccaccctctccgcagaccaccgccgagggcattgcggggcgaaaagttgccgaggaggccaccaacagcctcctgggcgccctgcaggagggctacatcttcgtgcttcccacggcatcgggcgcaccgccggccaggggcagtggggaggaccaggcggctttccaggatgacagcgaggggttcctggccctggcggcgctggccggcgtgcctcaggtgcggatgcaagctggtcctgcctgggaatgtgagcggggtgttgatgtcactggagttctcaagctgcctccaggctggggcccctgctgcaggaggaggtggggaagctgtttggggcatcgtcccgggcgttgggtgccgacggcgccgcctctgggccgggcgccggcgcctcaaaggagggaagctggaggccgtttggcggcgcggtgccctccgcccgtgattccccgggggaaaagggcccccgcccccgcgacgccacggccgcccgggctgaggcgtgcaaggannnnnnnnnnatttggcggcgcggcgccccccgcccgcgattccccggggggaaagggcccccgcccccgcgacaacacggccgcccgggctgaggcgtgcaaggaggccggcaacgacgccttcaagtcagggcggtacgacgacgccgtactgcagtactcccaggccctggcgctggacccgggcaacgctgtttactacaacaaccgggccctggtgtacctgcgcctggggcggtacggcgcggccgaggaggacgcggaagcctcgctgcgcatccgcgtcagcgccaaggccctgctgcgcagggggtcggcgcgcatggccatggtgcgtgcgtcgtgcggttgggggggagggggagatgggagtggaagaatgcaaatcagtggggcgggagaggggcgggaggtgtgcgttgcagcagtgcagtgcagggtccaggggctggctcagagtatgagactgtggtggcctggttgcacactacaactgaggcgcagtgtaaaccaccgagtcgcctgcaatgcgccgttgttgagcttctccaccccatccttgcctcttccccccttgccccacagggagaggcagagggcgcagccnnnnnnnnnnccgtttcgtgcctggtgccgcgagcagctaatcgcggtgggcagcaccccggacctggccttgtgcgagttcctcatgaccgtggactccaactccgaggccgcagagtacctcacgctctacctggggaagaccgaagcggtgcgggagtttggtggggaggcatggggctcgaggctgtgcccggccaagcaggggggtggagccgtatcccctgtgttgggcggccacagggctggagcnnnnnnnnnntgcactacaactgaggcgcagtgtaaacaccgagtcgcctgcaatgcgccgttgatgagcttctccaccaccccatcctcgcctcttcccccctggccccacagggagaggcagagggcgcagccagcgactttgagcatgtgcttcgcctggagcccaataatcggcaggccagggaggagctgcgtgccatccagcgcttcctctccacctccacggacaaggctgcgtagcaattgtcaccagctgatgccggcccatgctgcctggcagcttaaccccgcccccacccccaaaagatacatgctcgccgcgcccactcaagcccagccattcattcttcgtgttaaagtcagccgagctcgcagtgcaccctactcacgctccccaggactcaatgcagtgccggggggcactcgcctcgtgcacaccagctcgcttcacgcgtccaggtttgccagcatggcgtag

SEQ ID NO: 411 - DNA, 654 bp, Chlorella protothecoides
atggagggtctcgtcgcctgcctgaactcgcttctgtccccagacccgcaggcgcggagggggggtgagaatgcgctggcccagggcagccagcagcctgggttgggcgtcgccctgctggaggtgtcccagaacccctccctgcccacgggcctgcgccagctggcggccgtgatcctgaagaagcacctgaaggagcactggaccttcgagtccggggccttccgcgagccgcccatcggggaggaggaaaaggcggcgctgcgggcacgcctgccccgcggcctggccgatcccgagcgcaagctgcgcaccgcggccggcatggcggtggcggcggtggcgcgctgggactgcccccaggactggccagagctcatgccgggtctgctcagcgtggtggcccagaagccatcgccggagcacgtggacggcaccatccggtgcatcgccatgtttgtggatgagcttggcgaggatcagatcctggaggtgcgctgtggtgctgatgaggtcgaggaaagaacggatggaggtggggagatcgagccggccagcacacctcgagctgaacagcgccgtgcactccctcttcgctacagccggctggtgtctttgtcctcggtgtggctgtgtctggcatgcatgacctga

SEQ ID NO: 412 - DNA, 1416 bp, Chlorella protothecoides
  modified_base (1285)..(1294): a, c, t, g, unknown or other
atggctctgaggagcgtgctcaggatacgacagggcctgctctcgagcctgcggatcctggcgaggccagccgcggacctggcacagctggacgctcctgccttggcgaagcccgactggcaggcacgccaagcgcgcgagacgatctcggcccaggtaccactcccgaggctccagcacagcctggcagggaaggaagcgaatcgtccagaaggctcctaccacatccagatcgtcacgggcagcgtgcgtggcgcaggcacgcccactcccgccctcctccagctatttggtgaagggctctccctgagggtcagcggctgcattcggatggctgctggcacacgacccccaaccccgcccaccccccctcctgcagatggcgagtcggagccgtacctgattggcagtgacggctccaccatggggtttgagagctcctcccgcaagacctatgtggtgtgcatgtgggtgaggggtgatgcgtcgggtgctggtggatcccggcggaactttgaatcagttgcggttgcaagtcgtgggacctggcgtacagctaccgggcacagtcggtgtgcatgtgggtgggggttgatgcgtcgggtgctggtggagcccggcggaactttgaatcagttgcggtgcaagtcgtgggacctggcgtacagccaccgggcacagtcggtgtcttcacctgtccctccccatccttgtccccttgcagatgaagaggcgggtgccagctctggctggttcctggagaggatcgtggtggtgggcccagagggcgacagctggacgttcccatgtgccgagtggctgggccgtgaccacgtgacccaggcaataggtaggggtcgtggttgtgcactgcctgctcaccccatgagcacaccctgcacccttccatcgccccccaccccaaccatccctcctccccgctctccactcccccccttcccggccaggctcccccgagcgcgtactggtcccgctcacggtgcacctgtcctccatgatggaccctcggtacaacctgaagagccagatgtcggtggccgcctccgccttctccatcccgcacccggagaaggtggcggagggcgtgcgcggagtcaaccgccgcggcgcggggcacggcggcgaggacgcgtacttcatcacccacgcctcggagacgggagtggtgggcctgggcgtgtcagacggggtctacgcctggcgcgagcgcggcgtggacgccggcgcctactcgcgcggcctcatggccggctgcgccgcggcnnnnnnnnnntgggtttcagcaccatcaccagtgccatgaagaatgccacccaggaccgccacctaaagaagttggtgcgaaggtctcgttggctggatgggcaaaggggcagccccagggggcactgttga

SEQ ID NO: 413 - DNA, 591 bp, Chlorella protothecoides
atgccggaaattggtgcaaggtgtgccgaggtgacccggcatgcaatggacaggacccctgttcctgaatcctaccacagagcccgcacttacagtggaggacgtgctccaaggaagctccaggtaccttcccgcctttctcctggtggtgcctgggaatgggacgctggcaagcactcgcaagctccggctctggagtgtcaatgcatctgcacatgccgacataaggggctcagggcaccctcgccccatgtcaccaggcgtgaccccggccagcccatcctctccgtcgacgcgaccgcacctgtcccccctcacctagcctctgggatcaacatggccctgggtctgctcgaaagtgccctgggccgcagactgcacaccttccacctcagcacggccgagttcggggggtgcggcaccggccgcgcgccctgcgccctgtgggaggccgccactggccgcgtctgggtgggcgccggggtggcgaggtcctgggcgcagggccacggcgtcgctcagctggtcgccgccgtgggtgctaggctggcgggcctggtggaaggcgtggccaaggaggtgcgggggtga

SEQ ID NO: 414 - DNA, 903 bp, Chlorella protothecoides
atggcggcggagcccgcccgggcctttccccgacccatggaacctccactcctgccgccacccgccacagagcccgtgaccaagatggtgagcctgtacaacacgctggcggtgaagctgatggacgccaagaactacgacaacgcgctgaccctgctgcgcaaggcgaggcggggaggaaggggtgggcggatcctgcaagccaggcacgacagcccctccttccccgcgccagcagtcagcatgaagacatgccctcctcccacccccctcgcgcaggccgaggccttgggcgaggacgacgggcggtggggccccgaggaggcacgcgctcgcccccgcctgcgctgcatcaccttcaacaacctgggctgcctgttccggcggcgcaacgcgcccgccgaggcgctgcagtacctggctcgcgcgctggagcagggacggctgggcggcgacgcccgcagcgcggcctccacccacctcaacgtctgcgcggcctacgctgggctgcgccgcgaccgcgaggcgctgggccacgcggagcgtgccgcgctgctgctccagcgcgagctcttcgtccccgccgcgtccagctttgcggagggcctggcggggctggcggcgcggctggccgccgaccggcgccacacgcagcgcaccgcggcctcggtgctggccatggcctaccacaacgcggcgctggcgcacgagcggctggggtcgcaggcggaggcgcgggtggcgctggcacgcgcgcgcgcggtggccgaccgctgcctgggccaccgctcgcacaccgccgcctcgctgcaccgcgccgagaaggccttcctcgccaggcaccagaggcctgtgccggcgcccaaggggggcaagaagccggacaaggtgagcggctactga

SEQ ID NO: 415 - DNA, 567 bp, Chlorella protothecoides
gcctgcgccacctggcgagcctgccccgactgcgccggctcaacctagggcgatgcgccgcactgcgcgacgcccacctggcccacctcctgcgcctgccctgcctccagtccctgagcctgcaccgctgccccggcgtgggcgacgccgggctggccctgctggcagcccacccgacgctggcggtggtgctggcgcccaacgccacgtgtgacgccggctgcgccgcgctggcgcgcgcgccggcgctgatgcgcgtcgtgttgcacgactgcccccgtctgggcaccgccggggtgcaggccctcctgcatgcgccgggggttcgccaggtggtcatctcccgctgtccgcacgtggatcagagacagctgaccggctactcactttgcactgggaggaaggaatgggggaaggaggtgtgtggagggattgggggagagggcggagccgggagcgtgtggggtccgaccacgcagcagagtgggaggatcgagcgctgtgcaggcccactgcaatccctgctcatcacatgcacccgacccctctcgacgccttgcagcagct

SEQ ID NO: 416 - DNA, 513 bp, Chlorella protothecoides
atggcaaagaagcactttgttcccctcgagagcaacccggaggtgctcacatcctttgcagcaaatctaggagcagacgtgtccaacttccagttcaccgatgtctggggcctggacccggtgggagatggcggggggatggggcctggggcacacatctcccgttggatgtccgtgagcgccctgggatcggcagatggcacccactcaatgcagctcaccatcaccccgcccaggatctgctcgccatggtcccgcgccccgtccttgccgtcatcctcctgtttcccatggaggcagcgccctcctctcgcggagcagcctctgaggcaggcaagaggcgtggtttgggatgtggaagcctgccgcctgtgcacatccaggtgtgcacaagtcggcctgaagcagtgcccgctgcccgttgtgatcctgactgcgcacaggatgccacatttcccgctgcgccagatgatttcgcgctgcaatcgttgtggtacacgaagcagacgatag

SEQ ID NO: 417 - DNA, 873 bp, Chlorella protothecoides
cggccggcaagtccccgtgccccctgggtaccggagcccaggggattcctggtgagaaggggctgcaattgtgacaagtaccgagtccagcctgctgacacaccgccgactgcctgcccctcaccctcccatccacccccacccaccaggggcctggtgaacggctggcgggtggagactggggcccccagcctccccaaggacgaggcgctggccaggaggcagaccatgcagcacaccatgcagcagcgcgtgcagaccgccactcccgggtcggggcaggctcggggcaaggcagtcgccgccgacatcccggcagcccaggcaggcacgtcgggggcgccgccgcggaccgaggaggcggcgagcgccccccacccgggcccggcgtccactggtgagcgggcagggtgtttgttatgttggggggggctccttgcctgcgttgcggtgcgtctgtctgggggccgcagggcgcccggtgcacttactccagatctcagcccccaccagatcccacacacctaccccccttgctcccatgctcgccctccaggcgaccccaccagggacgaagcagtggccgtcctggcgcatgcgctcgcgccgcggcgggcgcccctcgacgtcgccgccggattggagcagcagctgtggctggaccggaaggaggcggacggggccgtgggggacgcctacctctgtgccctgcggaccctctgggacgtgctgtccccgcaggtgggtctcttcatggcgacatgtgtgtggggagatgctgcgccgaactcgcgtggcgccacacatgtcagcagcaggcaggctgcaccgggccgtgcagcgcaagccaccccaggtcactgtgttccgtga

SEQ ID NO: 418 - DNA, 384 bp, Chlorella protothecoides
atgcggtgtgggggcaggaggagggatgtgtaccctcccttctgcaagactgtcaaggcggtggaggagactgaccaggcattgctgcggcacaggggaacctcgcttggggcacaggaggggatggcctgcagccgtgcaggtgactcatcagcaccctctcccccgcgcgctttccccgcgcaggccgccgcccaggccggcagcaccgccgccccggaagcgacggccgacatcgacttgcacttcgtgacgttcgtagagcatgggggccgcctctacgagctggatgggtggggccggggtttgttgcggggagtggcgggccggtctggcagcgctcgatctgggcccgcagccggcatggcctgtcgttgtccatga

SEQ ID NO: 419 - DNA, 438 bp, Chlorella protothecoides
atggcacttagacaacttgcccatgtaggccgtcaacttctgggctcgcagtccaggggatttgcggacctgctgtccaggcccgaagcttccagtgcgtggactcggggtgggctctacggcctgagtcagaccgcgagctctatcgccaccacgagtggcaagcatggcgatgatgcagctgcacaaacgcgggtaccatccgggtcaggggatggtggtgaggcggggaagccctccacatctccccggaaggatctggtcatgctcttcacatgtgggaagtgcgacacccgagctgccaaggctttcagtagacagagctatgagaccggggtggtcatcgttgagtgcccgggctgcagctctcgccatctgatcgcagaccaccttggctggtttgggcaaggaggtgggtgtgccagggtgccagggtga

SEQ ID NO: 420 - DNA, 939 bp, Chlorella protothecoides
atgcatgggttgagcacgcaccatcagcatgcaggcggatcggtgctggcgcccaggtgcttgcgcccaggtgcttgggtccaggcccctccaaagccctaccaccccttgctacaaacagacctggagagtcccgccagatgcgtgagggccagcgtctctctgccactgtacttccgtccgatgactgtgcccaggaagaggggcgagaagctgcccctcgctggccagaatgccagcaggttgcctgacagcaagtgggcggacacggggttcaccacaaccatccccgatcgggtgattatggccccagggggcgttggcaagagtttggattggcgggagcgcaggcagcatgtagaggggaggcaacgttccggaagggtccgcttccaggacggcggcgtgctctccaggttccccatcaatctcttccatgtgccgcccaccaccgaggtgcactggcccacctttggcgtgggcctgtcccccccacgacaagccaaatcaacatccggcctcggtcagctgctctacgcatcgatctccaccgccatccgcatccaagacatccagttcaccgcccagaacagggtgggtgggcaagggcagggacgagggtgtggtgaagcgggaagaggtgagccccagagtcctcttgccccgccccgttccatcgcccacacaggcccctctagccttgccatgcaggagtatgaaatgctgaccaagaccgttgatgtgggtcaagtctgcgccctggacttcaagatgtccatcctcgggaagtttgtcctcttctacaatggtgttctcgctgcgagagacttcctcatgggaacgaaggagaagaaggggttccagtgggagaagttcaagaaattgaggcgggaacgttccgcggtcgttttaaacaccaccagcattactccgacctga

SEQ ID NO: 421 - DNA, 876 bp, Chlorella protothecoides
  modified_base (78)..(87): a, c, t, g, unknown or other
  modified_base (532)..(541): a, c, t, g, unknown or other
atgccacggtgccgccccacaagcaatcccctgccacctcccccaaccccaccacaaggcgagttcgccgagtcggtnnnnnnnnnnaccacaagcaattccctgccaccttccccattcccaccacaaggcgagttcgccgagtcggtgcgtgaccagtttctctgcgagcgcatagagtacttcaacgccctcgaggaagccctgtacgaggaggcagggcacgcggaggagtgctccgtggcccacattgcccgtgccctcatggcgatggacagcgagctcagctaccgagcggcttccctgctggcggcgggtgtgtggggagactcggcctcggagctgatgtcagtcaagctggccatgaagagggtgcgtcttggggtggagcctgggacatgctgcgctgtgtgccacatgattcaatttagaggggatggtatcggtggggatgacatggtcagaccttcgcacccagaagttgatgagcctccatgcagatttcaagaggtacggtcaagaagggccaaannnnnnnnnnaaacccagaagtcgatgagcctccatgcaggtttcaagaggtacggtcaagaagggccaaaagaatcgagcctccagcgctcgtgcctccgtgctccctggaagactggctggtgcagccagcaaagggaagtcgggcctggccccgcagaaaggcaagtctccgggcatgccatggtcggcagtattgaagcagtccacagtgtggtgtcttccggacagggcgttgcaccggatcggattttactcatgttgcacacagtgatttctctcagttacttcagctatatactttgtcaacttatgtaccatcctcaggagcacgtcgcggtgtag

SEQ ID NO: 422 - DNA, 528 bp, Chlorella protothecoides
atgccacctgcgtgcagcttcctcatcggggcccagatcgagctggctgccgagttcctcaccctggacgctggggtagcgctggagcatccaaccttgcggccagggactcactgccgcctcattccgccgatgcaccaccctccacattcacccctcgctgccacattcgcatcaccaggcgagcgtctgggcgtcggcaccgacgacctgctccacgtccactccctcatcagctctgtcatcgcgcccaagtatgccgcccacattgtcaggggcaactatggatcccagggaggctttgtgctggacctggcgctcaaggacatcgggcacgtgcggacattggcgcgtgacgcctcctgccccgtccccatcgccgacctcgtgttcaacagcctgctgtcggcgcgggcgcagcatggccctgacctggactggagcggaatcgtgctccccgtccgccgggcggctgggcttggggggatcagggatgggggggcccccacagcagcgcaaggaggctga

SEQ ID NO: 423 - DNA, 375 bp, Chlorella protothecoides
atgcccaacacctgcatccgggcatgcacactccagtcgcttcgccaccaatactgctcccccctggaatgccatggatggtatgaactcggagcatctcacacagctaccaaaaccctgcacccctcttcctcacgcactcctcaggaggacctgagggtggccctgcatgcctacttcagggtggggctgccagggggcaagaccctgcagcgctttgatgagctcatgcaggccctggatgaggaccagcccggccccagcgtgcagtgggccaccatcttcgaggaggaccgggagttcaaccagggtgagtgggtggtgaaagggttgatggaagcagtagcgatgtgtccagaatgccacgctgtctga

SEQ ID NO: 424 - DNA, 639 bp, Chlorella protothecoides
atggtgccagtgcatcaactccagcctagttcaaacgaccctcatttgctcccagtttctggaaatactggaaggcgtgcacttgggcatgcacgtcttcatggcagaggccgcctgcgggcatctgctgctgagacagaggttgcgcagacggcggaggctcctctgcatgtcaccgtgcgacccccccttcccaagctccctgagagagagctggagttccactccgcacccgagggcgtgagtggctggctgaaccaggctcggctggcctttgccctgccatggcgacagatctccgatggatctgtcatggcattcacagtgagttttggaaagggagtgagggtgaaggacatgctgaggagcatcttgatgggacgtttgatgagattagccactcagcatgcagttctccctcgctcccgaccatgcagccccatgccaccttcccacacccatctgcagctgtctggagcgttgccagatgtcccacagggacgcttctcatcggccatgtcgatgccgctgctgacagaagccctgaagaaggcggctgctgatccgcggattcgtggcattgcggtgaagatcgatcccctgtccatcggttgggccaaactccaggtagggcactag

SEQ ID NO: 425 - DNA, 636 bp, Chlorella protothecoides
atggcgagcaacttgcacgagggcctttcgaagggcatcccggggtatcaggacttcctgcaagttttcaatcgcacatcgagcaagacaactcccctgcaagagcttggggccaaggtggctcagagcatccacgatctggccgactgtcgagtggtcttcagcgtctccagcaacgatgcctctgccgaggaggtgagacccgggcgtcgatgccatgacttgtatcaccacgttgacccgaagatggatctctggattgcaacggccaagttcatgcaacccatgactcctgattatgctgctcccaaccctcagctcttccttgcctggctggagggacgcacaggggagtgccagccagccgcctacattgactgcagtaccattcttccggagacctccaggagacttgcaaaccagggcgctgcccggggcgtgaccttcctcgcctgcacggtgtttgggcgtcccgacgtggcagccgccgggaagctgacggccctcctggccgggggcagggccgagctgcgggagcggctggtgcccttggtctccacctttgctggggtagccgtcaggaacctgggggacgacccaggcttgagcaacgccgcgaagctcaccgggaagtaa

SEQ ID NO: 426 - DNA, 432 bp, Chlorella protothecoides
atgctggatgcgggctaccaccaggccaaggaatatgcagcgcaaggctggatcactggcctcaagtacgaggacgaagtggaggagctgctcaagcagcgcacgggcggcaaggaggacagggtgctgcgcgcgccgcttcgtcgtgtggcggcggtgggcaattcggtgctgcggaagctggccagcaggcaggtgattgccgtggtgcggaccgcgggtgccatcaatggaggagggggcgggggcctcccctccactggctctgccatcaccgcgccagacgtggcggccgtcatcctgcgcatcgacagccccggcggcgacgccctggcctccgacctgatgtggcgggagatccagcagctggcggccaagaagccggtcatcgcctccatggtggacgtcgcggcctctggcggtgaggcttga

SEQ ID NO: 427 - DNA, 498 bp, Chlorella protothecoides
atgaactggctccgactcatcttctgcacatcaccgtaccgcacccttgtccacaacctcgcaggctactacatggcgatgggcgccacgcacatcgtggccgagcctctgaccatcaccggctccatcggcgtggtgaccgggaagttcagcctggagcggctgtttgagagggtgggtttcaaccagaccaccatctccaggggtcggtatgccgaggcgctgacgggagcgcggccccagtccagcgaggaggaggcctggttcgacgagggggcttggatcgcgtaccgctcctttcgcgatcgggcggcggcgagtcggggcgccgtggcacaaggcagggtgtggtctgggcggcaggcactggagcacggcctggtggacgtgctgggcggcatcgggcgggcgctccagctggccaagctggccgccgacatcccgctggcccagaacgtgcccgtcatcgagttctccagggcaaaggtggggcgttga

SEQ ID NO: 428 - DNA, 1839 bp, Chlorella protothecoides
atggcaacctccaaggatgctgcaaaggccccaaagcctgctctgtccagcaagttgatgggtctcaaattcatgcagcgggctgcacacaaagaagcagtccaaagcgctgcgacagaatcctcgcagccatctgaggacgtgagcttgctgggtggggtgttcgacatgttcttcaagaccaactgctcccgtgctgctccacaacgtggccacaaccgggtcagcttcggagggcagaacacggcggtcgaggctgaggcgcgccgatcctcagcgaaggctgctacaggggttagggaagaggcagtggacgacgctggggcaacagtgtccgatgctgacctcgcatccaggctggaggagctgcagtctgtcaagacagagcgatcagatggagctgccaggagggctgaggtgaagcaagaggctagatcgaggttattcccacctcgtcgatgcggtcccacgagactggcacctcagattcaatgtcgtagtgacataaacaaaaggatcgacgacatgtttggcaggcgcagacggtgcaggggtgccatcagcccttgcgcccatgtcaaggcaagattgagcggggagttgttgtgtggtatagtagtggaggggggtgaaggagccctggaagagggaggctcaactgtgccccgtatttcacagggctccctttgcctcttcgagattggattgcatgccaagtgcaatgtcctgctggatgaagccaggaccatccgcagcacctgcacccctcaccaccgccctcaccccaactcccccaggccctctggctccagctccagcccttcggtcgtggaggtccaggccagctccctgcagtcgggccagccccccccacctcccaacccctcgggtacagaccgctggatcttgcagtggcgcaacgccagctccgaggcagccgcggcagcctgcgccgccagcgactgcggcctgcgcttctcgcgcgtgctctccggcgcggcggcgcgcctgccccgcgccggcctggcctccttcctggccgtgcacggcgccgcgctggcggccctgcacgccgactcgaccgtctccgtggctgacgcgcatgtccagtcggtgggcggcgacgccgaccagctggcggccggcgccgagtcgcgggcggggcggtggggcctggaccgtgtggaccagtccgcgctgcccctggacgggctctaccactacgcggacgacgcggccacggtcaccgtgtacgtcgtggacaccggcatcctggccagccacgaggagttccggtcctcgagcggcaactccaccagccgcgcggcggaggcgtacaccacgctctcctccggtaccccgggctcggactgtcagggccacggcacgcacgtggcgggcgtggtgggcgggctctcctacggcgtggcgaagggtgtcgcgctgagggcggtgcgcatgctggactgccaggggcaggggctggtgtccgatgcggtggccgcgctggactggctggccgacaacgcggtgcgccccgcggtggtcacgttgtcgctgtccggggtggaaagcgtggcgctggaccaagcggtggccgccgccgtggccgcggggctgcacgtcgtcgccgcggccggcaatggcgacgtcgacgcctgcagcgtcagccccgggcgcgccaccgccgcgctcatcgtcggcgcctccgacgagcgcgaccgccgcctgtacgccggcgacggcgtggcgagcaactatggcgcctgcgtcgacctgtttgcgccggggtcaaacatccagagcgcgggcatcacctcggacaccgcgtcggcgtga

SEQ ID NO: 429 - DNA, 1758 bp, Chlorella protothecoides
  modified_base (1110)..(1119): a, c, t, g, unknown or other
  modified_base (1471)..(1480): a, c, t, g, unknown or other
  modified_base (1536)..(1560): a, c, t, g, unknown or other
atgcctcgcccaaaggggggaaggctggatggtgcagcaatgctcggcaagttttgcgcgcgcggtgcggagatccgtatgctacatcaagcccgattaacttggggcccgctgctggctcggcgaagtgttcagggagcgcaggtcctccaagatagacaccaccagccccggcgcgatgacgagtcggagcagaagagagcggaagccctcttcccgattagagcttggtgggtgcctctcgtgcggtgggggcgttcatcagcagtacctcgacgtccgagcggtttcccaccgagcaccctccccaatcctggtgcagccatagagggcagctcccgagaggccccaccaaaggtaatgtacgtctaccgtctgatgaagccgtcagagatcaagtctaccctggtcagccgcacggtgcgtcccctgtgggcttgcgggctggcaggggatgcccggcatccttgcctcgagcgcaaactgcagtgttgtgacccagcgccgcgccaggcagtaggcagatacccacccggtcacctttatctacacaagcaggtgtacgtcctgtggccggacgaggagcaggccaatgcgacgtggtacagggctcgcgtggacgagtgcaaggtggcgtccaagaaaggcgacctgtactatgaggacaccgacgagctggaaaccggggctgaccttgctgacctggtgtatcagggtcacatagcctttcgtgagtctgccggcgtgtggcacaggccctcaaaccgtgctgtatgtttttcacatgggtgtgcttccaaggtcacgagtatgaggcggggcagagcccctgttcaccgagccggcggcggcacaaacgaaagtgagcctcgaccccttcatcacgatctggggagggacgaggtgggcctcgacgcgccttacacagggcgggcactggaggagaggctgggccacctgcccgtcacggcagccagtgcaagccccgagagcagcatctcagacgcaggggcgcgtgacaacagcgcagaagactcaggtgacgcgggggtctgggcatttgaagggtcaggtgtaatggggcctatattgtgttgcggcaacatgcannnnnnnnnnacatttgaagggtcagatttcgaggtggaggcggccagggagcggcagagcggctcaaagcgccgtagggcctccactggggaggaagattctgatggggaacaggtgggcagcccctctccccctgaggtgtggctcgacaggggctgggacgagtgggcggtgggctggcgaagacggcctcagacacccagcccacgggctggcgatggcaggcccgcagtgcacacccccaccaggcattccccgggggatgaagacgccgatggctctggctcggacgaggtcccactcgtggctcgggcggccaagatggagcggcggcgagcctcccggggcggggcaagggggnnnnnnnnnnaatcatgcaggatgacgacgccgacggctctggctcggacgaggtcccactcgtgnnnnnnnnnnnnnnnnnnnnnnnnngcggcacagaaactgctccggcaggcgcaggggggcgcgtcgggcacgccgcgcagcaagccccagagcccctctgacttctacgggtctggcacgccccgacggcaccaggcagaccacctgtcggatgcgggcgtccaggagaaggcaagtgctagggctgggtcaaagtctgtgctgacaggctctgagttgtga

SEQ ID NO: 430 - DNA, 1416 bp, Chlorella protothecoides
atggcggggcgcctggccccggagaagctggtcacgctgtctgccaccgagctggccaacaagtcgcgggcatcagctccaattcatgaacgaccgcggctcaggtgtgatcatggcatccccaggcgctccacacactcagccttcacacccccaacctggcccccccccaatatgtgcccacacccacaggagctgaccgagtaccgtcggaggaaggaggaggaggctctgaagatggcggtgctggacgccgaggcggcggccaggttctccacggccgccgcgctggagacgcgggagagccagccgcgaaaggaggcgcaggaggcggccgtgcgcgaggctcgcggcggcgaggcagcccgggccgtgggcgaggccgccgaggcaccggacgcaggctccagcccgcctgcggaggagcctggcgccggaggcgccgcaggcgatgctgtcgccggcgccgccagcatggatgccggcgtgctggaccacgaccgcaaccccgtgccggagctggagccgggggccgacgtggcccagtccccgcccgcccggcccgccccgagcttggactgggcgcagatcaaggccagcgcggtggagtcggcggcggcggaggacgcggccgaggacgcggccgaggagctggagggctttgacgggtggacagcggggcgagaggaggaggaggggccgggcgacgcggcggcgcgcggcgccggccaaaccgacggcgccttgccgccgcccccgccctcgcccctggcgcacctcttctcggccgccactgccggctcctccccggcccccggcgcctggcggtcaaacctggtgctgcccggcgagggctccgtgctggtgaccctggagggcctggcgggggccgtatcccctgccctcctcctgggggatcgtgacgtggaggtgcgtggccgcgtgaccctggcgcggctggaggagttcctgctggacctgcgccactcgcgccaccgcgccgtcagcgcgggcgtggcggggctggcaccgggggcctcgccccgcgaggccggcctctgggccgacctgctggccctgtaccgcgcgcgggggcgcaccggggtcgcggcgccgcagccgggggtggaggcctacgtgctggcggcgggggacctggccgcgcgcgtgctggaggtggcggctgggagcggcggggcgggggctgcaggagcgctgcgggacgaccaggccctggtcctgctcatccacaaaaaggatgaagcaagattgagcagggcatcagggagacgttgctgtgtgaccgaggcaccgctttcctcaccacagccacgccacaccaaagtctcagccgtgcatgacccctcgcgccaccgcaggactggcggcccgagcccggggccagggtgccggtga

SEQ ID NO: 431 - DNA, 645 bp, Chlorella protothecoides
  modified_base (525)..(534): a, c, t, g, unknown or other
gttgctccaaaggccggcgtgctcgttgccccgaaagctggtgcactactggctccaaaagcaggcgcactgccagccccgaatgctaatgcactactggctccaaagccaaaatctccaccaaaggctggcgcgctggtggctccaaaagctggagtgccagcagctccaagggcaggtgtaccggcagccccaaaggctggcgtgctcgtggctccaaaggctggcgtgctcgtggctccaaacgctggcgtgctcgtggctccaaaggctggcgtgctcgtcgctccaaacgctggcgtgctcgtggctccaaaagctggcgtgctcgtggctccaaaggctggcgtgctcgtcgctccaaaggctggcgtgctcgtcaccccaaaggctggcgtgcttgttgccccgaaagctggtgcactactggctccaaaagcaggtgcactgccagccccgaacgctggtgcgctactggctccaaagccaaaatttccaccaaaggctggcgcgctggtggctccnnnnnnnnnncccaaaggctggggtactcgtggctccaaaggctggcgtactcgaggccccaaaggcaggagcactagtgctcccaaacaagctccctgcgcacaatggtggggaggatga

SEQ ID NO: 432 - DNA, 3198 bp, Chlorella protothecoides
  modified_base (15)..(69): a, c, t, g, unknown or other
  modified_base (2368)..(2377): a, c, t, g, unknown or other
  modified_base (2439)..(2565): a, c, t, g, unknown or other
atggtggggaggatnnnnnnnnnnnnnnnnnnnnnnnnnnnnnnnnnnnnnnnnnnnnnnnnnnnnnnnctgctagctgaagctcccggagcggaggccgctccgcctgtgaggaaacaagatgggagcctcatcatgccaagctcctccatagggacacgatccatacaagtcgctattcttgagcttaccaaattggaatcctccaaagctcatggtgagccgagcaaaggtgtctcgatcggtggagccacaggacccttccctctccacaaaaggccttcaccagcatgcaacgagacctcaactctaccaggcatggtgtcagggggagctctcgactctctcaaggacaggtttaaggaatattctgaacagatctacatgttgcagggccctgcgagggtgcccatgtcgctcgaacaaagcagacccatctctctcacctcttcctgcccctgccctgcccgctcctgcttcttaccggcgcatcgtgcccaccgatatagatgtttacatcccttgagggctcagtataatcctgatcgccgtgatggcgaggcagccctcgcccaggtacggagagactgggtgcccccctccccccctcccaatggctcacgaccccgcttcccgcccgaggagccccccaatcccgggcccagccccggaggcgggggtcccaatggcctcaccaaggcattcatagcaggcgccttcgtgctaggtgggcggtcgcgacctgcgccccggggttctgattgctggataggaacgggaatgcgtcatccccagcacccctgcacaccctccacacaccttggctcctggtctcatttcgtcaccctcttcagtcacgtccattctacacataattgtgcaggcatgggcgcaggcatctggtttgacacccaggtcaccttccagccccagaacgtcgcctctacggtgctggtggacaccaagacccccaacagcgagctgtgcatggccaacggctactcctccatggtcttcgaccagcgcatcttcctatccttcaacccgtgcgtcgtgtgtgttatgtgtgagggggaaggggggggggaattgagggaacgcagactcgcctgccctcatcgggctggaaagcctcattcagcaccctccctctaccacttcactcctgccccacaggttcaacgtttacgtggcccagccggaggtcaagcccgggtgcgtgctgcggcgcagcaacgtgggcgtactggagcgcaggggcctggtagacggcgaccaggtgtcggcctgcaagcgctccatgaacacctttgcctttgtgggcgacctggcggggcggccggaggtggcctgcgtctaccacagcgaggacgcggagaaccagtttctgcgggacccgaagatgggcacgcacatgcgtggcgtgggcgtgatgcccgacggcaccgcggcgccggcggcgcggccgggagcagagtgagcggcgacgtgtggcggccggcatggcctctccttgacccttgcggtgccctttgtggcctgacggcctgtgatcctgtgacctttgcagcacgatgcaacctgtcctttgcactcgccgcccaggagcacgcaatcatgctgggccactccacacctgggtccctgggtggaaaagaagcgcgtcgcacaagacctcgccagcgagggccagcgcaactgcaggtgctccggtcacacgttttcgctgccccacaagcagacccacgtcaccccaggaggagctctatcgcagcttccaggcagccttccgcggcggccagcgcctccgcagcctggacctctgagaaccccatgccgcacagggccgctacatcctcggcctccaaggggctggaccagcccttgccccgcccgcccgccgcggcggcacaggcccgaccgcgtcgcgcatgcccatgcgctcgcgccgcaggcgcctgcccggcgggcgcgtgcgatggccgcctgtggactcagattggtgggaggagagagggtcacggcccctccagcccaccaggggaccggatacggcgtggtatgggtgcgacggtcgcccagcagcaaaccagcacgccacagcctggacccccctccatgcatctcatcctcggaacccagcacaccaccagactcgctttcagtaacccccagccacccatgcagggcttgtcctcctgcacccacccatgcacaacgctctcacaacagccttgcatggtctgcaggcatgacaccaccaactccaccccaccgcaccactcaaagtcgtcgtcgtcgtcgtcgctgtctgccgctgcggtccgtgtagcggctggcaccggcgcgcggcgcttcacgggccgcnnnnnnnnnngctcgccttcagtgaaccccacccacccgtacagggcttgtcctcctgcacccacccatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgctgtccgccgctgcggtccgagtagcggccggcaccggcgcgcggcgcttcacgggccgcgccgccctttccttgggcgccgcgccgtcccccctgccgcccccgtccagggtcggggtgcgcgtcgcgcggtgcctgcgcgccacggcgctgctgagctgcgcccgcagcctcctcaggacggagtgcaggtcggccagcatgcccgtcagctcctcctgggtgcaggagctcgtgtcgcccgctgcaattttgtgtgtgtggatgtggtggtgttgccggggggacccaagcaaaatgtgagatggcaagcaggtgctggagaggccggtggcttggggatcacagggccatgctccaatcacaactctcactccggtgagaaccggaagaggatgagtgctcgctcatgcacaaggtatgcgttgtcagccgctgccccttgtcgtggtagatggcagatcgcaagacactcagcaccccacccaacacctcctagcccacgcacccagcagggggcagtcccgccacgccggtgcagtgccctgcatgctgtcctgcagcgccgccacctcagcctctgcctgggccatttgctcaggcgtcagtccatacctgggatgcattga

SEQ ID NO: 433 - DNA, 594 bp, Chlorella protothecoides
atgcgctacggcatcgggcgctgggtgcagatcctggccacggggctcctgccgggcaagctcatccagcagctgtacggcgccacccagcgcctactggggcagcagtccctggccgccttcacgggcctacgcatcgacctcgaccgcgtgagggcggagaacgagggcaggacggacgccccacgcaagtcgggcctcatcatctatgatggacgtgagtgctgggtgggaggtttacttgggtccaggggggctggtctacctggggcgggagaggagaggctgtggaagtgtcgccgctggcacaccaaggtgccaaatcttgcagggtgcattgaaggtctcggtatggcactggcccatggtcagccgggcttgcccatggaggatgacttcccgcgggaaggagcatgctccaagcctccccagcacaccctttccacagctgtcctgacgcgggaagacaaggatcgtctgcaggcagaggcgcaggagagggggggcaccgcctacgcacctcagggcctctgccctcacctccattcctgtgtgcagacggctcccaaaccttcagcatcccagccgtcctga

SEQ ID NO: 434 - DNA, 600 bp, Chlorella protothecoides
atgcattctgattcctgcctcggccagaaattgaggacccacaccccctcctccccatttcccccttcctccctcaccagcttcacgaggaagctgaagcgggtgacggccgagcagggcgcgcagttcgtgtcctacgacccccgcaccggcacctggcgcttcacggtggagcacttttcgcgctacggcctctttgatgatgaggacgacgacgaggacgacgaggaggggcgttcgggcgaccacggcgcaggagtgggccaggagaagccgaccccagtcggcccggcgtcggcgcggcgcggccgccggcgccaggtcgtggactccgacggcgaggggggcagcccaggcgccgccgatccggacagtccccggggactggctggcgcgcggcccccaccctcggcggggctggggctggcctgggaggaggacgacgaggaggagcgggaggacatgcagcagagtgcgtgctgcgtcgtgtgcgggcgccggggggcttggagaggggcttgttcagggtgttctggtggaggggatggagtgcaactgaaacgtcgggggggcatcgatggtttggatttgaggcgttga

SEQ ID NO: 435 - DNA, 1035 bp, Chlorella protothecoides
  modified_base (76)..(85): a, c, t, g, unknown or other
  modified_base (471)..(480): a, c, t, g, unknown or other
  modified_base (727)..(738): a, c, t, g, unknown or other
  modified_base (860)..(869): a, c, t, g, unknown or other
atgcctcaccacggtcgagcccttccttcccccgcagtgtcccggtcgtcactgaatcgcggattctacgcaccannnnnnnnnncatcccctccttcccccgcagtgtcccgatcgtcactgaatcgcggattctacgcaccagatgtccctctcaacatagtgccggaagtacccctggacagacaggagcgtgcatttgagcagtatggcaacacctcgacatacaacctggagaacgtgctgcggcaaaacatcctgacctccacctactaccagaaaacagccgtccccatcgagcagtggcaggatctggtggatgagatctactacaggtgtggatcgcatggcgtgcctgcgatgttggcgtgtcgtggcagtcgagtcctggtctttatgccatctgacgatcatgatcgctgcaaagggcgtggagaccttgaggtccccacaaaggccacagtggctggnnnnnnnnnntgcgagctggttggcgtgagggcaggatctctgcacagggcgcacccaccggggtcccctcaccctcgactcccgcagcgtggaccatgtggagccctggatgagcgggaacgcgcgagggccctccacggccttcaacctgctgtaccgactgggtcaattgaagcccacccccaaggagctgcgcatgatgctggaccacaaggactcgccctacatcagagcggtgaggtggcagatgcgtttnnnnnnnnnnnncgctctttccacacccttgtccaggtgggattcctgtacctgcgctacacatgcaacccccggtacctctgggagtgggtcaaggactatctcgaggatgctgagcgcagtgtccctcaccnnnnnnnnnnagactatctcgaggacgccgagtggttgggaagcgcagtgtccctcacccgcatctacacagctcctccttccccaacgacacatcttacaggaattcacacccagccccccagggtggggccactcggtgaccatgggctgcttcctccgggacatccttcttga

SEQ ID NO: 436 - DNA, 1251 bp, Chlorella protothecoides
  modified_base (630)..(639): a, c, t, g, unknown or other
atgcgtaatcggggggttgcgcggtgttggaaccccgaggacagagttggggtcgctgtggacccactgggagggcacccagtgcgtagagaagggacgacaacaacgatgggagagaagtatgggggcgtgccggactatggccatggaccctgccggaaagtctcacgcgcgggggtggggaacccggcgtgcatgtgggagcgcctagtcaacttcagccaagacttcgggaatccaagaaacccctcaacatacaccttgtcgacttgcactcagactgtttgcaagaagtggtgtgctattgctttgacacagcttccttgcaaacagatcagcggaggggaggtggattgggatctgtacaatgccaagctacaagaatggggccccttggtggctggcgccctctttggaataggatggtggtgctgggctgacgcactggtgcaggtcagcactggggagtcgggggcctacccattcagatacaactggccgggaatagtcgctacgctagcgctgctgctcatcaatgccttgccaaggaaagatctggcagaggcagcagagagcatcgaggacggcgtcgaggtgagggcaacatggagcccaggcggtgccatgcannnnnnnnnncaggtgcctgctctgcagttggcaggggctttgcaaaggctgagcgcagcaatgtggcattctcactgtgaggcggctccatgcccccaccctcctgctccatccgcaccgctcaagcagttgcgagcacggctctggcttctcttcagcttcctcacggcttttgcagccgtgggtggcagcgttgcagtgctcattcaatgcacccaacagtcccagttcgtgtcggtcggagtggtgcgtcctgtgaggtctggtgcattcccagttcgtgtcggttggagtggtgcgtcctgtgaggtctggtgcgtgtatgactcgtggggtatgatggatgtggccctcggtctgcactggatgcacgaggagtcaagggatcctgcaacttcggcccattatccacagcgcatcgtggatcagttgctcaatgaatcctgccgcacacacagcacgctggcagagctgttcgtgcgagcaccacctcctgtctcaaagcgcccctctccatacgcgcagggatctgtgctccaatgtggcttcattctggcaagcgcactgctgctctgggcctaccgctcagacgacgggggcggatactacacgggcttctga

SEQ ID NO: 437 - DNA, 282 bp, Chlorella protothecoides
atgcgggccagccggcatgggggcctgggcgcggaggtgcagcgccgcatcctgatgggcacctatgccctgtcggccggttactacgacgccttctacctgcgagcgcagcaggtgcggaccctggtgacgcgcgagctgcagcaggccctgcggcgctgtgacgtgctcctctcccctgcggctccaaccccggcttatgagctgggccagactgccgaagatccgctggccatgtacaagggtgagggggcggggcccgagagggtcatgctgccctga

SEQ ID NO: 438 - DNA, 465 bp, Chlorella protothecoides
atggacgaagaacctgtgacgacctgtgatggggagcgggtacttgcgcaggaggccaggcgatcggcccgcctatacttcttgcttggattcctagcgctgccctggctctgggcctgcagcgtttggttgtacctgccagcacttcggcagccacacggcgaccccgtcgtccgtaaatgtacgtcattgccgaattatgttgaggaggagctggggcgctcggcattctgcagcatgatgttggctggcaggtgtagctgccaatcccacctagcaatacccctccccactcttctgatcagacgtgcatcgatccgcaatctggctaggcatctacatgacggtgttcttagcctggttcctcatgttccagataggcgggcccggtctgctcggcaaaaggctgcgggcccggtctcctcggcaaaaggctgtatgagaagctggacgtccgaagcatag

SEQ ID NO: 439 - DNA, 900 bp, Chlorella protothecoides
atgagtcgtgcaacccacgcctctcgtcagggaacccggttaacaatgtatcaaatgcagtacaggggcgagggacggacacggcacgctgacgtcgccggtacggggctgcactggaggctcccttcccaggggggcatgatgcatgcaaacccccgcctcctgggcgcggagttgtgtttcccgccgcgcgccatgctcaatctgagggggggagggtgcggttcatgcaccaccattcaatggaccaagccaccaccgaaacacagatccaactgcatttgctcatttcaaccccgtaacgtcatccgtatgcctccatttgcccttcaatgcaatgcgcatggcctcgagcggcctgcgacgggcacagagtactcatgcggaggaaggccgagccatccacgctcgcaacgtctccaggccccatgccgctcggctgtgaggtgccaagccggcaatgatgtgtctaccggaagtgaagcggccgtgcatcgtcgctctgccatgcttggtggcctcgcggtgggtgcggcactcagcatgcctatgcccggtccggccagcgctggccccgtcctttccaaggactgggccattgtagacctgccaatagacccgggcgtggttcttctggacgttgatttcacatcctctgaccccaaccatggtcacacggcgcgacttcattcttcctcatgccactcatttactccggcaggcttcctgctgggcacaaggcaaaccctgctcgaaaccaaggatggcggtcgtaactgggaaccacgcagcgtcgcggccgcacaggaagagggcttcaactaccgtttcaattccatctccttccagggcaagtgggcaaggggaatgcggggaggtggactcgccgaggcaccatga

SEQ ID NO: 440 - DNA, 684 bp, Chlorella protothecoides
  modified_base (317)..(326): a, c, t, g, unknown or other
atgcggccgctgacggaggacgagacacggcaagtgttcgagaaactccacaagtacctcgggaaggccatcaagagcctggtggacaggacagacgacccattttgcttcagattgcagcgcaatcgggtgttctacgtccgggaggatgtcatgcgaagagccacaaacgtgagtggaggggggggtggggggggcttggggcacctgggcgtgaaacgccttgcactccccttcaagaagccttgctggtgtgccctctcgctacccaaacgaaagctttgctcgttccatcaggttgccagggacaagctcgnnnnnnnnnngcagctgggcgtgaaacgccttgcactcccctccaagaagccttgctggtgtgccctcttgctacccaaacgaaagctttgcccgttccatcaggttgccagggacaagctcgtggccctcgggacctgcatcggcaggttcacccacagcggcaagtttcacctcaccattggagcgctcgacatcctcgcccagtacgccaagtacaaggtgcgggaggtgcctgaggtggggcatgtggccacaccgtactatctcaaacgccgccagatgatgcatgcttcaaccttcagtcttcaacccgacacaaacactggggaagcctggggtggaaacacctccagtaaactttgctga

SEQ ID NO: 441 - DNA, 303 bp, Chlorella protothecoides
atgctgcccgccgtgtcacagggcataccaacaactaccacgctgtacaatctcacacctgacgccaacccccgccatcaccccacccctccacagggcgcaatcggcatcgcatgccgggaaggcgacgagccggtgctggagtacctgcgcacgctgagccatgaggacacgcgcctggcagtggtctgcgagcgcgctttcctcgccgcgctggacggctcctgccgcacccccatcgcggggctggcacaggacctgtcggtacctggagaagcaaacgtctttctgaggaggctctga

SEQ ID NO: 442 - DNA, 327 bp, Chlorella protothecoides
atgcgcacaatccccccccttcccatccacccacagaacaactacccagagacgctgggcaagacgttgatcatcaacgcgccctccatgtttgcggtgctgttcaaggccgtcaagccgatgctggatgcccgcacgcaggcgaagatcaaggtctgctccagcagctacctgagcgagctgcggaagtatgtggatgacgagaacatcccctcttacctgggaggtaggatcatttcagtgggtgttggggagttgcatcaaaccattcgcaagggattcatgccatgggcgttgtgcatcgcggcatcatgccgagggtcatga

SEQ ID NO: 443 - DNA, 456 bp, Chlorella protothecoides
atgctgggcaactggtcgcagcacctgtttctggagcccgcggcgccccgcggcagcctgggactggcctacaactgcgtggcctgtgcggacaaccagcgcacctacaatgacgggtaccatgccgtgcaccacctcaactccaaggcacgcacttccctctgcacccctctcaccccagcaaccctaaccccaccccgccccgcacctgtgcaacagacccactggacagagctgcctgcgcaattcgtggcaacactggacaagcaggctgcggcggggacgctgatcttccgggggctgggcttctttgatgttggggtagcggtcttcacaggcaactacgacctccttcatgatcaccttgtcaagtacacccctgcgctggccgcagccgggaggtgtgatgtcgaagccatgctgcgacggcgcttggcacccataatcatgtcgtga

SEQ ID NO: 444 - DNA, 357 bp, Chlorella protothecoides
atgtatggagggcatcttacatgcatctgccgtgcggggagcgagggagtctgtctaccacatcatgtggctgaagcctcattactcgactcttccctgatgttcctgacccacgccaccacgaccctgtgcacaggtgatgagggttggatcgttggcaagccggccatcctgttgcacagcaccgacggcggcaccaactgggagcgggtgccgctgtcggccaagctgccgggaacccccgttctcataaccgcgctagagggcaagggggcggctgagctgaccaccgaccaggtacctggagctgggcgcctggcgtggctgagcatgctcagcagagaccatcattgttga

SEQ ID NO: 445 - DNA, 534 bp, Chlorella protothecoides
atgtccgggcatgacgacctggatgccacgagcagccaccgagaagtcggggacctgcggcccgccgaccccgcgccctccgacgcccggccgctggcgggccgcagggtaggcgtcatcgccgagacggtcggcgagggcgtcgacgcgagcgtggtggaggcgctgcaggccagaggggggagggactggagtcaggtccagccaaacagtgcacgcggagatgtgaggggcggactcagcgtctctgtgcttgcggcctccaaggagtgtcgactcaagcccacagtgccctgctcgagcgtggggcagacgccgcctggaacgctgcccatcccaccacgcatccacagcgccgctcatctggagtcgctgggggccaccgtggagcaggtgcacctgccttccttcgcctcggggctgccggcctactacgtcatcgccctgagcgaggcctccagcaacctctcgcgctacgacggcgtgcggtatgggcagcgcgcacagcgtgaaggtgagagatgcgacggataa

SEQ ID NO: 446 - DNA, 432 bp, Chlorella protothecoides
atgggtgcagccgatctggatgacggtcccgttgtgcccgagatcggagaagagtacatagccctcgctctcgctgagcggcagaggattcgaatcgatgctgaatccgacaccgtggctgggaggcaggagtacctgtggaggcctcctcctttcgttgtgaactggctccggcgcagcttggtcgaggagcgagatctccctgcagcattcatgctgctgaacctggcaacaacaaccctccccgccgccctgctactctggagcactgggtgccgcagtcacctgctgggcgctgcctaccttatcctcacctatgcggcgttcctccagaggttcatgctcaccctccacttcacggagcaccgacccctcttcaaaccaggtgggccagtgcaggcgggcagctattcatatatcgcatctgcataa

SEQ ID NO: 447 - DNA, 345 bp, Chlorella protothecoides
atgggtttcaccccttctgagcgcctctggctgaccaccaagggaggtgacctgtactacacagatctggatacccagtccaagtttgagcaggccaagctggggtcccgcggttttggcatcctggatgtgaactttgccaatcagaaggttgggtttgcctgtggagggtctggcagcctcttcaagacagaggatggtggagattcttggaagcgcgagaggtccactgacgacgtggcggctaacctgtatcagatcaagttcacgcatggcaacaatggcttcattcttggtgagtgtccttggagcctgctgtaccgtggtggtgtcactctacagtga

SEQ ID NO: 448 - DNA, 876 bp, Chlorella protothecoides
atggcctcaatcaggcggatcagggagggggtggtctcccaggacaccccagctgtggaggtggtgcagggattcctggaccgcatccatgcgcagaatgcctctctgggagcatttatcaccgtcctggacaagtctgctctggaacgagccgagcagattgatgctgaggcgcgggaggggcgaccccttggccccctggcgggggtcccctttgccgtcaaggacaacatctgtgccaagggcgtgcaggtgcggcggggcagcttcatgcggaacaagtggagatgcagtgcgctgatacagcagccgcagcccaatgagtctggcttgcactcgcaccgcctgagcgaacggccacttcagcgccggctgcctgagccccccccctcgtcccctcttcccatcccagacatcggccggacatcggccgggtccctgctcctgcgcgggcacctgcccgcctacgacgctacggcggtggcgcggctgcaggccgccggcgccatcctggtgggcaagaccaacctggaccagtttggcatgggcagcaccaacgagaactccgggtacggccccgtgcgcaacccctgggacgcgcggcgcgtgccgggcgggtcctcgggcgggtcggccgccgcagtggcggcgggccttgtccccgccgcgctgggcagcgacacgggcggctccatccggcagcccgcctccttctgcggcgtggtgggggtgaagcccacctacggcagggtctcgcgctcgggactggtggcttatgccagctccctggactgcctgggcgtgctggcggggagcgcggcagacgcggctggtgggttgtgcaggtgggggtgggggggcgccgcctggcaataa

SEQ ID NO: 449 - DNA, 582 bp, Chlorella protothecoides
atgcaagtcgtcacttactctgttggaagacccgagccctcccatgcgctcgcccaaacatgctcccccgcccccgccgcgccgcagtactactttgagaccattttcccgcgcatcccgaccaaggtcaccgacgaggtgctggcggggctcaaggcacggggcctgccgtgcaaggcgctgggcaacgcggggcagggtggcgaggaccggcgcggcatcgccgagtccgccgcgcgccccgcctcggtgaagcagtcgctgagcgtggccatgggccagcgcgcgcccaaccgcgcctcggcccgcgagctgggccgcgggacgggggccgacctgcagctggagcaggtgatgaagaggaaggagagggcctcccccgtgcgcggggcagagaggagggaggccaggtcgcggtcgcggtcgccgcgcggcgcacccgtccccaggtgcgctgggcgtgcagcgtggggactggcggcgtcgtgctgccggggatgtcacccaggggatgttgagtcgctgatgagcggcagcgtcggggcttctgcggtgcgcgggcccatgatccccccctgctga

SEQ ID NO: 450 - DNA, 369 bp, Chlorella protothecoides
atgtaccgcctgcaccactgcatcatgcaccactccgggaacaatcggtggtccctggacgcctcgtccaccgagcgctaccagcgagacaacccgctccacttcctcatgtgcgtgcccgaggtgtaccccctcggctgggcggcacacccagcttgcatccccacagccggcctgtccccacctgtcactccgcggctggggccccggtccctcaggtccacaaaaagacatgctcgtctccccagcctcccaccacccgccttgcaggtactgggcgcggttcgctctggggagctggttcgagctcccctgggtggcggcccgggcggggcgctgggggttgctggccgcctgcctcgcctgtga

SEQ ID NO: 451 - DNA, 813 bp, Chlorella protothecoides
atgtcgacatctgatcatggcacggcagtggaccggaccgtctgcgatcctggcagccgggccaagatcgaggactactacggcgtgcgactgaaagacacagacccccgggccctggccttcgtagtggctcagagcaagtcggccgggaacgaggccttccgcacccaccgggcctgcggcatgcatcctgaaggcatggtcctgctccaatccctcctccccgcagaggcgatcaggctgtacagccaggccattgccggcgacgagtcggatgccgccctgtacagcaacaggtctgccgccttcctggcagagggtctcaacgatcaggcgctgtgggacgcagagaagtgcatcgccctgtccccttcatggccaaaggcacactatcggcgcgcctgcgccgccatgtccctctgccagtggcagggcgcgcggcaagccctggtcaagggcctggagcttgctcctggggatgctgccatggtgcgagctgactcaaaggctgtgcacagggcttgttggaggtgcacgtgggagtttggctgcaatcacgccggcgtgaacccacacccccctgtccccccccggacccaccaggtcgcgaggctggcggaggtcgactgggtgctgacgcagaggggcgccgcgcggcgagcgcaggctgccgtcgaacgtcgcggtgtggtgagccggctgcgagagctgcggtgccaggccgccaggcaggcggccctccgccagttcaagcagagcatgaccgggcctcgctgggacctggaagacctcgactggtgggctggcgattaa

SEQ ID NO: 452 - DNA, 1398 bp, Chlorella protothecoides
  modified_base (240)..(249): a, c, t, g, unknown or other
  modified_base (326)..(335): a, c, t, g, unknown or other
atggtcatatgcatctgtcacgggctggcgagcagcatgaatgtgatgtttcacggcagggccagagttgaacgaggcgcgggaatgggagatgcaaggaggaagctcacaggaacggtaatagttccctcaggccactcagtagcccaacaaagtgatgcagctggctttgtcgaagtgacaatgcatgctactgagcattatggttcctctggtggagtttgtgttctgcatgttgcnnnnnnnnnnaatccttgtggaatcacggagcgaaacttcgtgggcattgctgagaggatccctgtaaagacaaccgagaaactatnnnnnnnnnncacggagcgaaacttcgtgggcattgctgataggatccctgtaaagacaatgtatgatgcttctcagcttctcgtcattgctatccatctgcctgtctgcagccgaaaaactactttgtcgacaagctcaagggcagaagaccccagcatgctcccaatcaacggtgtgggagtacgcgttctgctcgaaaatgagaacataagttcatcgcaacttcccttcccacgagctctcctcttccgccgggcagggtccggaaccggcggtgctctgacccgcctcggtcgtccagcttcaacacgttttcaacatcacacttccaaatccatccgagcgcgaccagtcatgcctccagccggtcgatcctgtaaggatgtaatgtcgaaacagaagggcaccgcctgggcggccatggagatggtgaacctgtgcggtgcctgcccacccatcgaacgcatggacagctccatcctgggactaaaagcaagccgccatctggcgctcagcaccaacagcatcgacaagattggtcccttgacgggactcagcctggagaccttgtccatggggcgcaactgtttgaagcggatcgagaacttggagggcgtggcgcccaccctgcgccagctatggatcagctacaactccattgagaagctggtgggattctgggtcttgggtatcagttggcacatcaaaagctctcctgtattgctgcttgcttgtggtcaaagaggcatggttggatctctctgttcatgggctcaacagccatgtgtggtatttctttgcccaccatccagttctaaacagccccttctccttctcactctggtacaaagatctggaggagctgctcctggcaggcaacccactgcacagcgaggcggcagctgcaggaaacctgactgcctaccgcctcgaagtgctccgtcggctgccacgcctgaagaagctggatggcatccccatcgaggtcgaggagagggaggcggtacgtgccctccctcggctgtagtgccgggtgctggacatggaacgaaagcaccctcatcaggttga

SEQ ID NO: 453 - DNA, 630 bp, Chlorella protothecoides
  modified_base (286)..(295): a, c, t, g, unknown or other
  modified_base (547)..(556): a, c, t, g, unknown or other
atgtgtcgtatcactgttacactcaccaccccctcctcacaggggccggcagcgacgcagagcggcggcggctcgccgcgtgcccccgaggagggcctcaagatcaagctcaaggtcccaggcctggcggaggggtctgcgccgcacgatgagtcggccccccagcccccgatggagcctgtcgccacccctgtcgctacgatgggggcccctgtcaccgccccccgccaacctcaggccgcaccgttccccggccagtttgcaacgcccggcgcggcgcaggcgnnnnnnnnnncggtgcctgtcgccgcccctgtcgctacgatggggccccctgtcaccgccccccgccagcctcaggccgcaccgttccccggacagtttgcaacgcccggcgcggcgcaggcggccatcgcggcgcatgccgacctgctccagcgccgctacggcctggggctggaggcctttgctcgcctggcgcccgtggactggccctcggcgccggcagcgctgctgtcgcgcgacgtcacctgcgcgctgctgcgcnnnnnnnnnngcgcctggcgcccgtggactggtcctcggcgccggcggcgctgctatcgcgcgacgtcacctgcgcgctgctgc

SEQ ID NO: 454 - DNA, 639 bp, Chlorella protothecoides
atgggcgtggaaatgaaccaccaggtgcagcgtgcgcgaacggcctgcagccgtgcgagatcaaatccggcgttcctgcacgtcgtgaccgtctcgctcctacaccttgtccaacacgcgcagagggcgatcgagcggggcggaggtctgctaggcgagggccccagcgtcgaggacgagctggcgggcatcagcgacgacgacattcccgcagactttgaggcctcgggtgagggggaaagggtggatgagaggggtgcctccatggaaggactgggtgcagcagtccatacatccggacccctgacgctcatttctgtcctcgtttcacgggtcctgtcctcctctaaaccagatgaggacgacgaggcggccagcagcggccccggcggcccctccgccgcccggcggcgggcgtggcagctggtcaagctgcgccgaaggcaggaggcggccagggtcgcggccgccgaggcagaggccgcgcaggtggagagggagcgggagcgggacgcggcgcgcggttcgcccccgccccccacctccgatttcaggctggctccccacctcgtgcctcgccttttagctgtctgggagtttgtccaggtgtgcgctgctgtgggggtggtggattcgtga

SEQ ID NO: 455 - DNA, 1737 bp, Chlorella protothecoides
  modified_base (428)..(437): a, c, t, g, unknown or other
  modified_base (1036)..(1100): a, c, t, g, unknown or other
  modified_base (1657)..(1666): a, c, t, g, unknown or other
atgcatacttccacacgacaccgtatcccaggtggacaccagcaccgtggtgacggagcgcatctccggggccatgacgaacctggtgttccgctccacctgccccaccgcggaggcgtaccccaccgtcatcgtccggctgttcggcccgggcaactccctgttcagccagaaggaggagcgggacgtgttcctgctggcgggccagacgggcatcggcccgcggtgcctggtggagttcgagggtggcagggtggaggagttcatcccgggggcaaccctgtccgcggccaccatgcgcgcccccgagatcgtgcagctgacggccaccgccctggccgtgttccacgtgcgcatgacggcccaacgcgccgcgcgcggggccgtggggcccaaagaccagcccgccatcttccggcgcatcggcnnnnnnnnnngcgcgccgctcgcggggccgtgggggccaatgaccagcccgccatcttccggcgcatcggcaagtggcacgccaccgccaccggcctggcacccgccctgctgcaggagcttggcctggaggacgttatggacgagggggggttgggaggtggtgtgggcaaccctgctgcctctggatcgtgctgtgaactgatcccagggcccatattgcatcggaagggtccactcacccctgccactcctttgtggcccgccctcctgatgtgtaccgtgcaccccttcccccttcatccccctccaccacacacacacgtacgcaccactcatctactctcttcaggtggcccagctgcggcgctaccacgagtccaccttcccactctggctcggcttctgccacaacgatctgcagtacggcaacatgctcctctgccccggccgggacgcatcgccgcagggatcccccgcgggcccggccgaggagtccgccacgccgccgggcagcccgcgcgccgtgctggcgtcgggcgacgcgctggggctcagctaccccagcgcagaccccggtctggcgtcggcggcgggcggcggcgacgcnnnnnnnnnnnnnnnnnnnnnnnnnnnnnnnnnnnnnnnnnnnnnnnnnnnnnnnnnnnnnnnnngcccggctcgccgccctcgccccgcgcggcgacggagcacatacgcctgatcgactacgagtacgccacgttgaacgacgtggccttcgacgtggccaaccactggtgcgagtacgcggccgactaccactcgggggaggcccatgtgctggactttgccgcgctgcccggggatgaacagaaggcggccttcgcggaggcctacgcggacgccatgctggcacaggcggcggcgggggcgggcaggctggcggagcgggtctgcgctggtgaggtcgacgccgggtgccgggagcacggcgccctggcccgcctgctcgtgcagaaggcggaggcctacgtccccctgtcccacctgaagtggggcctctggggcgtcatgcaggtgtgtgttggggaggttgtgtgggggaagggaggcggaatgctatcaaggggaggcagacatgagcagcggcccagacctccgatgtcgacttcgactacctggagtatgcgcgacagaggatcacgcagtaccacgccaccaagacacggtacctgtgagataagccagnnnnnnnnnngatgcaggtgcgtgttgtgggggaagggaggcggaatgctatcagggggaggcagacatgagcagcggtag

SEQ ID NO: 456 - DNA, 843 bp, Chlorella protothecoides
  modified_base (647)..(656): a, c, t, g, unknown or other
atggcgtgcagcagtgagtggattgagaggcaggggattgggaggggggttggggcgaggggttggggcggagagctgcacaccaccactgcgaccaccaaacacaccgacccaccattatattacccgccgccccccccctctacacacacacacatccacccacccaaacacaggcagctgcttgaatggtgccggcccggggctacgctgcgccagctgcatgagcagagcgtgcggctgctgaccgagggcgtgtcggacctgggcctgctccccgggcgctccgccggcgccatcgcgcagggcgccattcgcgctttctacccgcacagcgtgggccactggctgggcctggacacgcacgacgtgccgggtgtggcacatgacacccccctccagccaggggtcacgctgactgtggagccggggctgtacatcccggaccaggagcggtacggcgcgctggccggcatcggcgtgcgcatcgaggacgtggtccagatcaacggtgcggtgaagagtgggtgggttgagcaaggggtgaggggtggggaggtgggtgaggacgtgggctgggacaggcaggaagggcaggttggtacacgatgctcatcgcgtgggtgtgccggagatcgccaagtctnnnnnnnnnnggggaggtgggtgaggacgtgggctgggaccggcaggaagggcgggctggtacacgatgctcatcgcgtgggtgtgtcggagattgccaagtcctggatgccggagccgtcgacgtgggcatcgatgactgtctgtcgccctgatcccattgatggaaaaggcggtgagcgcctgctgtcacgatag

SEQ ID NO: 457 - DNA, 753 bp, Chlorella protothecoides
  modified_base (43)..(52): a, c, t, g, unknown or other
atgatgtccgtcgaccgggttacggctgcagctgtggctactnnnnnnnnnnagttgtcacgggtctgctgtacctcgactagacttccctatccgattcccgctcgctccgtttcgcaggcggtgaccagccggtctagggtgatggtggtcacccgtgctggctacattgggtccccaaccaacgtgaccgggttacggctgcagctgtggctactccactgttcatcatgtgtgagtgtaccaatgtccacctgccccccaccctccggccctgctgttcagatcatggtgctgtccaccttccttcccatcgtggcgggcaggctgggccttgcccccaccgcaacccggcacaccacccccggcctgaagctgtatgaggacaagtccgcgggcctcatcagcggcgacccggcaggtgcagcgcggatcggaggggaggatggctttgcatcactgtcccctgcccacaagcacgctccacccgccccaaccctcccgcacagggttgaccatttgggatgtgctggcgctgggcgcgctgggccacatcattggggtgggcattgtgctgggcctgcacaactctggaaacctgtagggaccgccgtcgaatgcccccccgcagtggggatgcccgaggaaagcgggacgccagcaggcaccgtaaaaatgagaagacctgcccacagaattgagcgatgccaagccggctctcggcttgacccccagccaaaaggccttgtctga

SEQ ID NO: 458 - DNA, 255 bp, Chlorella protothecoides
atgcattctccagatggcactgttctggtgactcatggcggcgtggagatgggccaggggctgcacaccaaagtggcccagattcccctcgcccaggtgtacattgccgagacagccacagacaaggtgagggaaggggcgctcctgtatcttggcaagcttggttgtggggtgctaggatgcccactcaacagcagcagcagtgctgtctgggcctggcgccaggctgggcatggtccatgtcgtgcagcatag

SEQ ID NO: 459 - DNA, 528 bp, Chlorella protothecoides
atggtgtacgatgtcctggccgtggagcgggccgccacggccgctgcgcacggcttcggctcctaccgccagcaggtgtcgttaggcctgcacgtgattgtcacgatggccgccttctacgcctttggcctggtggcgggccgcgccacgctgcccccgggctggcagccgcatgtggcgggcctgggcctcgccactctggccctgctggtggagagcctgctcttcgtcatccgctccagcgcgcccgcgaccgcgcagcgcgaggccgccgcccgtgcgctccgcgagcgcctggaggcgcaggcgcgtgcacagcgcgccgcggcgcagcgggatggcgaggcagggggaagggcgcaaggcggcgagggggcgggggctgcgccggcgcaagacaaaggaaaggcggagagcacgccggcgagggccggtgtggcggaggaagcaggtgtggagcccgacggcggcccggacaagggccccgagccggccaccctgcgcctgcgggccggcagggcggcgtga

SEQ ID NO: 460 - DNA, 483 bp, Chlorella protothecoides
atgccctgcaatccatggccaaacccaccattatctccaaaccaggacattgtgaacgctgcttacttggatcgcgtggatctctcggcgcacggcttctacagcacgcccgacattggcggctttgggagcgagaagccctacaactacttttgttatggtgccgctgtggcggaggtggaggtggacaccctgaccggcgacttccacgtgctccgtgctgacgtggtgatggatgtgggcaagagcctgaaccccgcgattgacattggacaggtggagggcgcctttgtccagggcatgggatggtcttgcatcgaggagctggtgtggggggacaagaagcacccctgggtcaagccaggctggctctttacgcgtggtccggggacgtacaagatcccgtccgtcaacgacatcccggtcgacttccgggtgatgctgctgcgcaactctcattgtcacaggacgccccaggtgtga

SEQ ID NO: 461 - DNA, 294 bp, Chlorella protothecoides
atggtctccacctgtgagcctgacagctccctcctgcaccgcgccgtgaacgcctgcctgtgcccgctgtatggcgtggagggggcccacgtggtcaccgtggaggggctgggcaacccgcgcgacggcctgcatcccgtgcaggcccgcctggcgctggcccacgggtcacagtgcggcttctgcacccccggcttcgtcatgtccatgtatgccctgctgcgaagcaagcccgagccccccacggagcatgagattgaggaggcgctggcaggcaacctctggtgtgcctga

SEQ ID NO: 462 - DNA, 288 bp, Chlorella protothecoides
atggccccccgcgccgccgccgcgctggtcggccagccgctggaccctgccgccgtgcagcgcgccctggcagcggtgcgggaggaggtggtcattgcccccagcgcgccgggcggcatggtggagttccgccagtccctagtttcttccttcctgttcaaggccatcgtgcacgccgcgcatgccctggcggaggacgtggaggcctacgccagcgccttcccgccctcctacgcctcggtcgaagagcgcttggacatcgatgccacgctttgtgccctggcatga

SEQ ID NO: 463 - DNA, 1692 bp, Chlorella protothecoides
atggccgccgacttgcaggtctgcggcgaggcgcagtacaccgacgacatcccgcccccaccgggaacgcttcacgcagccctggtcccctccacccaggcccacgcccggctgctgggcgtggacaaggggcccgccctgctcgtccctggcgtcgtcggcgtgttcacggccgaagacgtgccgggggggaacgacatcggggccgtggcacacgacgaggagctctttgccacggtgggtttctggattctggggggggggaggggagtgttgggttggcatgggcggcccaatctcgctgcaacctctgtcttgatcgccgccgcgcatggcgctgcccgccccgccccgccttgccctctgatcgggtcccattccaaagtattcctacttccccccacttcaactccacaggagatcgtgccatgcgtagggcaccccatcggcgtggtggtggccgagacggaggcggcggcccgcgccggcgcccgcgccgtggccgtccgctacgagccgctgccggcgctcctggacatcgacgacgccatcgcggccggcagcttcattgagggctgggggcacagcgtgcacagcggggactgcgccctggccctggaggcgagcgacgtcgtgctggagggctgggtcaagatgggcggccagggcagggcggggtttgtgccaaggtgcgatcactccagggcaatgggccaaggatcgacgtgccctcacctattcggtgcacgctcgcgcccaaggcctggcgtccacccccattcctattgcgaatgcttggctggccatcctctccccccccccgccattcacgggcgcccactcctccacaaacaggagcacttctacctggagcccaacgccagcctggtgatccctggcgagggcggggaggtgacctccttctcctcctcccagtgccccgacaagcaccaccgctacctggcacacgtcctgggcctgcccatgcacaaggtgacggtgcgcaccaagcgcctgggcggcggtttcgggggcaaggagacgcgcagcgcgttcgtcaacgccgccgcggcagtgcccgcgcacctcctgcgccgcccggtgcgcatctgcctggaccgggacgaggacatgcacatcacggggcagcgccacgcctttgccgccaagtaccgcatcgggctgagctctgccggggagatccgcgcgctggacgtggacatctacaacaacgcgggctattccctggacctgtccttcagcatcatggaccgcgcgctgacccacatcgacagcgtgtaccgcatcccagccatccgcgcgcaggcgagggggtggcaggggggatgggggatgggcatgctgatcatggagcagatcatggagagggttgccaaggagatggacataccgctcaacaccctgcgcgagcggaacatgtacaatgagggggacgtgacgcactttggccagcggctggaggggtgccaggcccggcgctgctgggaggaggtgcacaccctgtctggctgggcagcgcgggaggccgacgtggcggccttcaatgccgccaaccgcttccggaagcggggcctgtccctgctccccaccaagtttggcatctccttcaccaccaagttcatgaaccaggccggggccctgatccactgctacacgggtgaggaggtctga

SEQ ID NO: 464 - DNA, 420 bp, Chlorella protothecoides
  modified_base (69)..(78): a, c, t, g, unknown or other
atgaacaagacaagccgcctgtgtgggcgtccacgggtttcagagggcaatgggacggggaaatgcctnnnnnnnnnncatgaacaagacgagccgtctgcgtgggcgtccacgggcttcagagggcaatgggacggggaaatgcctcagtcgatgtcgctctgccactccggggtcaattcaccatacctctgggcccccgttctgactgcagggtgcgacggtgtggtgagcatctgggacggcgagcacaagaagcggctggcccagttcacggggtacccgacctccatcgccgccctggcgttcaacctcgccggcaacctcctggccgtggcctccagttacacctttgagaaggtgcgacgagcgtgcggctttgggggctggatacgagatgaatggggggttggggtttag

SEQ ID NO: 465 - DNA, 1977 bp, Chlorella protothecoides
  modified_base (265)..(274): a, c, t, g, unknown or other
  modified_base (1122)..(1131): a, c, t, g, unknown or other
  modified_base (1489)..(1498): a, c, t, g, unknown or other
atggagcatgtggaggatgtgccaggaggatctggctggagctggcaccccctcaacattatggatgcctgttgcaaccttgtgcaactcaccacagcttcatcgcaccccctgtacaggttcaatcgcaagctgctcaagaaggtatgtaacagcataatcacctgtaacaacaactcacaccctcgtcgacaagcagtgcatccactatcgagtccgcttggggcgcgcgacagtgtattttgcaaggggagacctcaaagcnnnnnnnnnngggccccattgtcctgcccctccatcactaggtattccttggccatcattggttgtcgtggcatcgttcgagggggtggcattgagcatggtgtggccgagcctagacggctgtacgagggtccacatgccggcatcgttgctggagcaataagaaggttgtcctcagcaccatgcgcatacccttttcactggaatttaccaacagtattattgtggcctggccctctgagtggagcatcgtgccacaccctccaatcatgcgtcaggtgggaggatggggtcaggacctcaaagcgtttgacagccgctgatcggtgggaggtccacagcgcggatgaggtggctctgaccctgggcgagatgcgcctccgcgtcattcagcaggtcgatgtggaggagctcggaaagggctggagcggtgcaggccttgctgctccaggccatgggccgcgtgccagtaagaagtacttccttaacatcctcttccagcacctgattcctctcccgtcggcgtgggggcctgcctctgggacggagccctggtcctggccgcctacctcctcaccctccccaggcaccgcttccacggcatgcgctgcgtggagctgggcgccggagtgggcacgctgggcctcgtggccgccgggctgggcgcacaggtcagcgcgcgagggtcatgggtggggaaggccgcagtcgggcgcatgccagaccttggagagggaacgtgctctctggacaaggtcccccggtctcaacagggggtctggggtgggagtgtgcaccttcccatcccctcaaggcgccactcctctgccgaatgtgccccccacttccctcctcacnnnnnnnnnnggtcatgggtggggaaggccgcagtcgggcacatgccagaccttggagagggaacgtgttctctggatggggtcccccggtctcaacagggggtctggggcgggagtgtgcaccttcccatcccctcgaggcgccactcctctgccgaatgtgacccccacttccctcctcatcccaggtgaccatcaccgacattgccaaggtcctcccgctgctcaaggacaacctggccgccaatgggtttggcccggaggcacggtgtgtggcaagagaatggagtgctgggattgttgcaaagttgtcccttggggaggaggcgcttgtacattgggtttggagaccgctcgtcccacatctnnnnnnnnnngtgtggcaagagaatggagtgctgggattgctgcaaagttgtcccttggggagcaggcgcttgtacattgggtttgcagaccgctcgtcccccatcctgccgccctgagagcccgccctgctcatgcccgtcacattcccagcacactcaaccctggaggcccccctcccacacacacaggccgtcacatgagggccaggcctgggccgaggccggcatcctgcactggggcgccccggggtggatggatggggtccgcctcctggcggcccccccgggggtcgacctggtgctggcggcggactgctgctacatcgaccaggacggcgagtcgccctccacgcccgcattcgtggaaacctgcgcgggcctgtgtgggcctgacaccctggtcctggtctcctttgagcggcggtcgccagaggtggggtacagaggcggggggggcagggacaggagggccatcggctcatcattga

SEQ ID NO: 466 - DNA, 1116 bp, Chlorella protothecoides
atggtcgacatgatcctgcgctgggccgcagtgccagggaagcacgtgctgccaaagtcacacccccataccgatcataacccagatgtcacaaagtggaagaccaaggggacgtggggcgaggaccccatgaagcccatcgagacacaggtgaggtcggggtggcagggaaggtgggggagaggatgctgccagccagctgtgaagtctgcctttaccagggccttcaatgcgcagcacctacgccccaagaccggcttcaagatggaagggggggtgaagaagaagggacggggcggcggcgcctccctggagggcggagcggatgagtttggtgaggagggcgaggagacacaagctggagcggaggaggaggaggaggaggagcttgaccccgtagtgatacagcaaaagccttgggaacgctgcatagtgtggcctgatgtcgcaaggatcctccttgtccctctccttaatggtcaaaggattatggctcttttcctctttcttccccacgcaccaatacgccctcatgtcattgcagttgatggccatgaagcacaagggcatgagcctgaccctcaaagatgggtccacggcagcgagaagcagcgggaagggcggcagagggagggggagtggaggtcgaagctctggcaaggcggtctctgggaggggagggcgcgggaagaaaggccgttgttgattttcatggccgatatggaaatggaagaagagctgcaggcggcgttgacactgcgtgaagtgacgatgctcatccggacaaatgcaaggccagacaagcccgcccccacagtcggtttagcagcgtctcgtagaatttattaccgagtgcccggggcagactctgctgtaagatcgagtcaggaagctcgggaagcaattaccgcatgtcacgcaatgccccagtaccgcttgatcgccaccaatgatcgcgccaaagccttgatcggcccgcacggctgcgatatagtgctgtatggcgacactcggattggcagaggggttgcggggccccagaccttcacgctacccgttgactggctgcagttcagctcacggcattgccgtgtatacagcgccgatgtgagctga

SEQ ID NO: 467 - DNA, 648 bp, Chlorella protothecoides
  modified_base (387)..(396): a, c, t, g, unknown or other
atgcgcactcacatgcaatcgtgtgccctggctgggtgtcgggaagggattgcgacgccgccagccgggtgcccagtgatcctgccagctcacataccccctaaccaacccccctcttctcccaacctcccctcccccctccaaaagggcttggcggggctggacgccgtggcagtcatcgtggacgacaaccacacggtgtggcccaggaacgccgccaacctggtggcggtggagcagtaccactacttcccctccagccgcacgcggcagggactgcacggacccgcgctgctggacctcgcgaggtgcccttgttgctgtcgtgtgtgctttcttttttgggggaggggggcccgcgaggaatggcgtggcatgggaggacannnnnnnnnnacgcggcagggactgcacggacccgcgctgttggacctcgcgaggtgcccttgttgttgtcgtgtgtgttttcctttttgggggagggggggtccgcgaggaatggagtggcatgggaggaccgggtgggacgagcggctgcgcgccagggttcccatgtgcattctctgggggttagcggacagaggccgctgccggagcgctcctctgcccccccaccgtccccctgccacacaccgcacgcagggatga

SEQ ID NO: 468 - DNA, 1221 bp, Chlorella protothecoides
  modified_base (35)..(44): a, c, t, g, unknown or other
atgctcatacccaatttccgtgcgcagccgctcannnnnnnnnnatggcccagtagctgtctcttggaggcatcaatatgcacagtgtgggcccttccacacccctcaaccacgaatcgccctgattttactcatacccaatttccgtgcgcagccgctcgggctgcatgcgactggtacctgaacgcagatcccctggccccagacccctacaacttcaccactgcatctcgccaagcatttgcattggttgaatttgtgaggaaactgggcagggatttgccttggccagccacaatgcctgcggtcgtgcccattgatcatgccaggcactccccccccctccgcacagttcctgtcggagaccagggtatgggacggcctcccaggcgtgaagaacagcctcctgctgatgggaggcgaggaggatgtcgtcatgcccgtcgactcccagaagctcgtcgcagcaagggctgcgagagcctggtccatcgttttcaaggaggcggggcacacagcggtcctccagttcccagagtgtctgtttgcatccatgcgaaaggagttcaggttcccagatttatcgaggccaggcagatctccggtcacgtgttggcggaatcgcccttgccgaatcgacgtactcgcatcgattttggtccgaatgaagacgtttactcctcggtgcatccctcgctgaacccaattcgtgtttggccctcagacctggcagcggaggcccagcatgtgtccctgtctctttcgccatacctgccgaatattcatggcggtagggttgatacttcacaccggagcgcacgctggcacattacgcaccagagcacaccaacagaactacctgcatattcttgcctcactcaacccgtttccctccttgcagacacttatggcctcaggggtcccgaccctgaggtcctggacttctgtaatgtgacggaggagatagcacctgtgagggtagcatcctcttcagacttccatgggcccctgatgcatgcagaaataaccaacgcacgcatggcctacttccggttcggcaatcggaacaccactcgtcctccccttttggtttttgctccgtttgggttcaccatgggggacatgccgacaccagccatgctggctcttgcagccaggcaggaggtcatcttgttcgaccatcgaggccagggccattctctggcaagttgcgagaattga

SEQ ID NO: 469 - DNA, 414 bp, Chlorella protothecoides
atgcctgactgccaagttttcacctcattcacccccaaaattcccgcagagatcggtggattcaaaggccctgaccctgaggttctggatttctgcaatgcaaccgaggatgatcaggccgtgagggtggaggccgaatcagactttcatggccccttgatgatcgcggaaatatccaacgctaccatcggctacttccgatttggtgatcagaccacagggcggccacccctcctggtgtttgctccctttggatacacgatgggggacatgcccagacctgccatgcggtctcttgctgcccatcaggaagtcatcctgttcgatcatcgaggccagggtttttccacggcgagtattataccagaagggaagggggtgcagtgtacggctgtatgtcgggctgctgtttaa

SEQ ID NO: 470 - DNA, 1539 bp, Chlorella protothecoides
  modified_base (1370)..(1379): a, c, t, g, unknown or other
atgcagctattgtgcagcacatcccgtgtgcatccttcggtcgtgccaaaggcctcgacgacgactggcagatgtctgaaatctgaagaccaccgttgcgtacctgaaaaactaggaaagggagagctggggtgcgctcggaccccgaccccctcgtacacatacgtccctgtccatgctccgacgtggctcggccaacccaacggccgtctgcctggcaatggtcctcctgtgcctcagacccgccacaggtatggtctcctgtgcattagaaagactcggacatacctgtcgggcgggggtaaggggcgagctgccgcgcgcgaggccgcttatgtgcctgttccgaggcccgcggaggtgctcttcctgatcgaatcgtcgttttcatccctccctgccctcccatcgttccacgctcgcctcccaggcgcagtggtggggcaggcggccccagtatccgaggagggcgaggtgctgcagttttgcaacaccacggcaccccccctcctcgcctccaccagctccaagcaggacctgatcgggccgctgctccatgtcgccatctccacctccatcgtggggtaccacagttttggctgggccgattctggccgccccaccctcctcctcatccacggctttggccagtcactggacatgtgggatgtgaggctgctggagcctctggcccgagagcagagggtcatcatctttgacacccggggcgtcggcgcgaccgaggcaagtggaggactttggggtcatttaatccgggcaccgagggtctggcgcatctgtccctgggggaagaatgtcggctgtgaccctgcctggtcacagatctccctggaagaaatgcctcaaataccacacagtccccctttccctcgctacattgtgcaggacctcaacattagcagtccgctgaccattcaaagcatggcagaggacaccgtggagtttatacagccagtccaaaccccgaggcccgccaacccccaccttcctccccaacatgaccccttccaggcgttacagctgcccctaccccccaacctgatgggtgtgtcgatgggcggcttcatcgccatcgccgtggcagcgctgcacggtgacgccatccacagagccatccccatatcggccagcgctgggagtctgggttcggagccccccaccgacaagggcctcagcattgtcgcccagccggagaggaggcccctggacatgctcagcctgttctaccccctgaacacgacacggggtgaggctgaggctggggtggactctaaagggtcagcgctggtaggcgctgccatctcctcatgggagatgcccagcctggggatgcaggcgattgaaaccgnnnnnnnnnntggggtggactctaaagggtcagcgctggtgggcgctgccatttcctcatgggagatgcccagccttgggacccaggcgattgaaatcatccccccttcccatcccagcaccccgtcacccacaccaacactcctgctcaggtgcaaaggcagcatgtga

SEQ ID NO: 471 - DNA, 237 bp, Chlorella protothecoides
atgggggcgtccaaggacctggagatgtcccccttcgaagccgggcgccgcttgctgggatacgagggcgaaggcctgtcgctctcggatcaaatggacctggtcttccaggacgctgacctggtacccctcctggtccaggagaactacataaaccaccgccccaagattgcccagaacgacacgatgcgcatgcaggtcggagggtgtgtgtgtgtgtgtgattacgtgccctga

SEQ ID NO: 472 - DNA, 216 bp, Chlorella protothecoides
atgcccccacagatcatcgccaaggcagcagacgccttctccgcgggcgacctggtgaaccgcagggtgcggcagacccagaactgggcactgtccccctttgcagtggtcatgggcacgattttcccagccacctacatgcgcggtgggcgggaggtgctgggcctgtaccccatggagcccaacttcccgaggtggggtcagttcatggcgtga

SEQ ID NO: 473 - DNA, 402 bp, Chlorella protothecoides
atggggcggggacttgcgacgcatgggcgtactccatcctgtgatcgctcgcctcaccagcccttgccactgccgggcccattccccctttccttgacaaaacctgcttgcaggccgaccgtgcagcagatcaccaagcgtgcgcaggagatctgcagggccgagggactggccgtgaacgatgctacgctggccgccctaattcaatcggcaaacggcggcgacatccgactgatcgtgggccagctgcagatggtgcgacggcgctccgccagcctctcctacgaccaggtgggatgccggctcggggtctctgactgtgcgatctgggcggaggttcagtgctgtgcaccggtgaagtccagctcttggctgggaaggagcgtcgccctgcagacttga

SEQ ID NO: 474 - DNA, 564 bp, Chlorella protothecoides
atggcccattttcaccttcaagtctcgcccaccctcttcctaggcgggcaagaccagcgtgctggaggccctgaaggcggcatgcgaccccagcgccggcccactgtgggcctcaacatcgggagcctggacctggcggggtccccggttacagtgtgggatctgggaggcgcaccggggctgcgcaggatctggaccgagtactacggggaggcacatgccgtagtcatggtcgtggatgccagcaccccatcgcgattccaggagtccaagcacgcgctcgacagcgcactcggtgagcaggttggggcaaggggtgtgtgcaacgaggaactcttcgatgcccccctcctactgcttgtgcacaagcaggatgccaatggggcttgcagccccgaggaggtggctgcagccctgggagtgcatgctggtggggaggggcgcctttgccatgtggcagggactgccacgaatgaccccatgggggtgaagaacgccttctcctgggctgtgaaggtgtcgctgacagggcccagggccacactgcttgccagcaggggctga

SEQ ID NO: 475 - DNA, 1413 bp, Chlorella protothecoides
atgtcgcgcatcctggcacgccatgtgggtgtagggtgcgaggcgcatgcactggtgtgcagtggcgggcatgatgatcacggcgcccggcgacccaggtccgcatacggtccccgcaccagcgccggccccggccccgcttgctcacgctgcttcctcccctcccccccttgtcccccttcccaggggctgcaggcgttcccgctgcagggcaaggccgccaccgtccccggcggcgtccccaaccccctcttggccgtgccagatgacgtgcgggagaggctgtaccgcaacatgcaccgcctgcgcgcggtggccaacaagctgccctcgcccttcccgcccgccctgcgggcgtgcgccgccctcgcggtctcactcctgcgccagaacttcttcacccagggccaggcgcgcatcctgctgccgctctgggagggcgaggccggccagggggggctggagccggacagcacgaccagccccgacccggggccggcggcatccgcagtcaaggggtccgggaaggggaactcgggcccagcagagaccgcagggaggcccgccgatgccgaccagggagctcccgcacaggaccagccaggcgtcgggcgggggtcgggcggcaggccgcccctgcccccgcagcaggagcggtggcggatgcaggggcaggcaccgcttgcctcctgcgctgcgtccggcagggagagggacgcggacctggcggaggctgcaggccagccggggcccagcttcgtgctgcccatcgatccgcgccgggcgccggcggcaggccgaaagggggcccggggcccgagtgcagtcgcgagtgcccctcacattcccgacagggtcgcatccggtaccggggccgaccccagacagaccagggtgaactcgagggaacccccggcgaccatggcccaggcgccgcagagcggtgcagggcagggcgcgggcacgcccgccttggcggcacgggaagcgggttctgtgcctgagaagaggcccgaggagctcgactgtgggaaggggagttgggggtgccggcttggccaaggaggatcatgggcttgggtgtggaggtacaaggtacccgcatcgcgcaggagggaggggaagtcagaggctggggtgcatcgacgcgccctctcctcgtggacccttgttcctcccccgcgctgcagtgtacgcccccaacaccccccaacaaccaggcgcggcaagttgtcgctagtgctggacctggaccacaccctgctcaacagctgcacctttgccgacgtggaccagcagagcgaccgcgacctcccgagccgcctgctggcccacctacgctgcgaggcggcggcgctgggggcggaggaccgccagctcttccgcctggacgacgtgcaggttggcaattga

SEQ ID NO: 476 - DNA, 483 bp, Chlorella protothecoides
atgactcggtacagccctaggcgcaccgccctcatggctgcggcgggtctctgtgttgccgggccggcagggcatgtcttcctgggttggatggagcagcacgtcatggcagccactccgatgagccggacagctgtggccctcaagttcactctggatcaggtccttggcctggtgctctggcaagcggctttcctcacaataaaccccagctaccgtgcagcggctcgaaacctgttgcgcggccgggagacggcagtggagttgcaccccaccattcgtggtgaaagtagacaaagtgttgagaagcaggtaccgcattcgtcactcctgcttcgcaaaaggtgcactggtggcgagatggacggctacgccgagcccagcccccaaggcggccccaccaagcgcgagtcggggatcaccatgctgcagagcagctgcagccgcaccaccgaccagagctcccacctgaagagttggtga

SEQ ID NO: 477 - DNA, 297 bp, Chlorella protothecoides
atgctggcggaggccaccatcacggaggcctatgggcgccaggccctggccatcctgcactatttcaatgtggagacggcggtgtgggatgccctgccgcttgtgaggaaccccgttctgctgattgcggggcagtacgacatcctggtgccggtgcagtcatcgcgggccatggctgcacgcctccctgccccctggctggtcgtcataccggaagcagggcatggggtggcgtcccagtgcagggacactgtgctggacctcgtggatgccttcctgggctcccctgatctgtag

SEQ ID NO: 478 - DNA, 582 bp, Chlorella protothecoides
atgtcctctcgcctgcgccggcacgacccgtcgctcagcagagaccctgatccctcccccaccccggattgccaggtggcctcgcgccaggcgcggagccgcggcggcgcgctgtcttcctcggaggccggggtgctggcgctggagggcctgcaccgcgccatcacgccctttgtcctgcgccggaccaagggtcaggtgctgaccgacctgccgcccaaggtcctgcaggacgtgcgctgcacgccgacgcccctccagctcgagctgtgcgaggcgctgcgctctggaggggggatgacggtgagctggatgggggggccggaggacgggggagggggtgctgaagtggagggggtgctgaagggagggggtgctggggtccacgtgtgcagattgagacacacaccccatggttccagtccgtgccggcggctccgactccatgcatgccggtggccacctggcaggacctctgctgcacgcctccacacacacacacacacacacacacacacggtgcccttccccttgcacgcaccggcccctgcatcaccccgcaacctcccccaaacccgttga

SEQ ID NO: 479 - DNA, 660 bp, Chlorella protothecoides
ctcgagcacgcgctggcctcggcgcgggagggcgcggcggcgcgcggcgcgcgggtcgaggcgctggagcgcgagctggcctgcctggaggcgcaggtggagcagctgaccgcggggctgacgcacgcgcgcggccagaaggcgggcctggaggcggagctggctgcggctcggcgcggggcgtcccacctggagctgctcctggacgccgcagagggggagaaggaggcgctgggcgaggcgctgggcgaggcgcgcgccgaggccgcgcgcctggtggccgcgggccaggcgctggtcaaggccgagtctgccatcggcgccgcgcaccgcgccgcggacgacgaggctgagtggggcttgggacgcgacggcggggaggtcggggatgtggcctgcgccgacgccgacgccagcatgtgcaccccgccgccgcaccgcggcgccgcccaggccggtttcgaggaggacctgcgccgtgcggtgcacgagaaggtggccgcgctggagatgctggccagcgccgaaaagcgcatgctgctgtccgaggagcggggcgaggcggggtgggatcgaggggcggggtcggcgagtggcggcggggcggcgtcgggtggcggcggagcgggttcgagtggcggcgggggcgggcgcggcgac

SEQ ID NO: 480 - DNA, 1068 bp, Chlorella protothecoides
  modified_base (15)..(24): a, c, t, g, unknown or other
atgagaatggctttnnnnnnnnnnatcgcggatctgaggcaaggcagaatggctgaagtggcaggggatcgggtggtgagggaggtccagctcttggtgtacgatgagatccactacctgagagacaaggagcgaggagttgtttgggtaaggctactattcgtgttgagttattggtacgacatgggcgcatggaccccgggaaagatgtcatggatgcccaattcattgcacctacaaatccttgcaggaagaaagcatcatcctggccccaagatgtgctcgatttgccttcctgtcggctaccattcccaatgcgagggagtttgccgagtggattgccaagatacacgagtcgccttgccacgtcgtgtacacggagtacaggcccacacccctggagcactacgtctttccggcggggggcgatggcctgtacatggtggtcgactcaagggtgattgccttgtctcctacacgacgtggcaaggacggtgcttttctgaccctgacccttgcgaatttgatgacagggaggataactttggcaaagctgttgcagtcgtcaatgacgtcacaggcgactctgtttcggcctccaagaggcagaagaagggtgcaggcggaggcgatcccaccctcgtgataggagatggaaaggaaaagtctgacgtggccaagcttgtcaagatggtgatggagaaaaacttcgatccggtaaggcagttaatcacaccttgctcctggcttggggaccatgttgctctgaccatggactctggattcaggacgctgagctgtcctcgcacattggaagcgcagataatcattttcagcttcagcaagaaggaatgtgaaagcctggccatgcaaatggttgcgatggacctgaacacggctgaggagaagcagatgatcgaagctgtcttcacgaggtgtgaggaccaatggggtccaatagcagacggaggctcaggtgcatgttggactcagcctcagcggtgccatgaacttcagtcgtgctccgccgattaccactctgcagtgccattgacgtcctatcaatag

SEQ ID NO: 481 - DNA, 675 bp, Chlorella protothecoides
atggaggaagccgggaccgactgcacaactcctataaatgttgtcgagatgagtgggaagtcctgtactcacgaggtagcctggccgcaaggtgggtttccaggaagtggtcgacggcggagtggagcatgccaaactgcagttgagcatttctcatctagagcgtcccccgacttctcaaacatgacaggaagccatggaagcctcttgccccctcctcactcttctaagccaatggctcggcagtaccccttcaccctggatcccttccagcaaacggcaatcaactgcctggaagcaggacactctgtccttgtggctgctcatacctcagcagggaagaccgttgtcgcagagtatgcctttgcaatggcactcaggtacgcccaacggcatgtggcagtgggctccttgctgttaatcccagtctggggtaggctccgatattcaccccatgcatgtctcactgcatcctccctgtcacacaatcagagacaagcagcgtgtcatctacacctctccgctgaaagccttgagcaatcaaaagtaccgggagctgcagcaagagtttggagatgttggactgatgactggagatgtcaccatcaacccaaatgccagctgcctcgtgatgaccaccgagattcttcggagcatgctctatcgcggatctga

SEQ ID NO: 482 - DNA, 1188 bp, Chlorella protothecoides
  modified_base (562)..(571): a, c, t, g, unknown or other
atgtcccctcccaaacacagtcattgccgtttgtcggagggcggcgacgccttcagccagatgattccttgtttgagtttggcaatcgcgagagggagaggatcgctgccgaacaggtgcgcagccgcagggtgtggaatgagcaacatgccagctgtgggtaagaacatgggtgctgctattgctctggtggcggggcaatctcaatgggctcctcttcaaaagttcatttccagcagcaattccctccttcccttgcagcgagctcggtcgctggccgatgcgattacagtaagtgcccctcgtccagcccccaaaatgatggtgcatgtcaccgagagatcgcaggagtttgcatgccgccactgtcgtgcctcacttcccagtccgcacctccttgacctccacctgactgagatgcacgacagcttctttgctgcacaggctgcgcgtcgccttccggtaaggttcaatgcctcttctgccgggcatgtctcaggttctgcgactctgccggtgtgttgccctgggatatcatttgcggctcatcctttccccaccnnnnnnnnnnagtatctggtcgcaggttctgcgactctgcaggtgtgttgccctaggataacatttgcggctcatcctttcccctctttccatcatgcttcaggtgtaccgttgcttggtggagagctgcgagcacacaacctgcagcacagaggagagaagagagcacctcctggaagcgcatggggggagaagggctcgagcgaagcctgtaactgtcatacaggcatgcaagggaccgcccacacgtggagacctgtctcagccagacgtcgtgaggatggaaacagagggaggaccggtgggcgtggaagagagtctctcgaggctgagcctgacaaatgtggacctggctgtgccaaacagggtcgaatttggcagaaggcagtctgtcggcctgttcccacgctcacagggcaggcaacgaggatgatgcttgctcacctgtccatcccttgcattcttacccatgctgcttgctgtgcattgcaacattgtgagatagtcgcatgcaagccactgcaagaggccctcagaactgaaactggacttcgcgggtgtacccgagcctgtccaggtgggtttccatggccttcatcatgggcagaggcccacaccgcaggatga

SEQ ID NO: 483 - DNA, 2091 bp, Chlorella protothecoides
  modified_base (67)..(76): a, c, t, g, unknown or other
atgcctttcatgtcgatgtcagcctcaaaaaggggaagaactttattcgaccaatccggtcaccctnnnnnnnnnngtaatgcctttcatgtcgatgtcagcctcaggaaggggaagaactttactcgaccaatccggtcacccgcagaggccccagacataggaggtggacagcatgaagtccacctgtgtcgccatgcaagcgagtcaggggtgcaccctcgcctctgcgcgccacccggcacccgtaaaggcccaggtacggttccgctccgatttcgtgcaatggagggcgcctggcgccccgctcccgccgctacccagttactcgcgccggacccaccctcacgtggttcaatttgcaggtcggtcactgcctggccagtcgcccggccaggcccgcacacgccacctcgaggtgcgagacagtggtgcaatgcgtttgtgtcaccgtgcttcgacgcctgtctcgaatgtcgtgggccctcaatcgctggctgggaggccactggtcatcactctggatttcacctcgtcagcaggggtatgtgtggtcaacccccccaccccatccaccccccgtgcagggtcgctggccggcgcagcagcgcccagcccacccaggcgaccctggcccgcgattccggcctgagtgaggccgccgccgtggtctccccgccgcgagaggcgctcggccccgtgccctaccccgcccccaccccgctcaaggattgggtggaccgcttcggcgacgctccgcgcaagggctcggacatcctggtccaggctctggagcgcgagggcgtggacgtgctgtttgcctaccccggcggcgcctccatggagatccaccaggccctcacacgctccgactccatccgcaacatcctgtgccggcatgagcagggcgagatcttcgcggcagagggctacgccaaggtatctgggcgcgtgggcgtgtgcatcgccacctccggccccggcgccaccaacctggtgaccggcttggcggacgcgctgctggactcggtcccgctggtggccatcactggccaggtcccgcgcaagctgatcggcagcgacggcttccaagagacgccgattgtggaggtgacgcgtcagatcaccaagcacaactacctggtgatggacgtgaacgacatcccgcgcgtggtgaaggaggccttctacctggcgcggtcgggccgccccggccccgtgctggtggacgtgcccaaggacctgcagcaaacgctggcagtgccggactgggacgcgcccatggcgctgggcagctacacggggcgcctgccccccgcgccgcgcgccgagcccctggccgcggtgctggaggcggtgcgcgccgcgcgccgccccgtgctctacgtcggcggcggctgcctggatgccgccgccgagctggcggagtttgtggccgccacgggcatccccgtagcccagacgctgatgggcctgggcgccttctccgaggaggaccccctggccctgcacatgctgggcatgcacggcacggtgtacgccaactatgcggtcaacgacgccgacctgctcatcgcactgggcgtgcgttttgacgaccgcgtgacggggaagctggaggcctttgctgcgcgcgcgcgcgtcgtgcacatcgacatcgacccagccgagatctccaagaacaaggaggcccacatcccggtctgcgccgacgtcaagcccgcgctggcgctgctcaaccgcatgctgcgcgccgcgcccgtggaccgcgcgcagttcgcgccctgggtggaggcgctggaggccaagcgcgcggagttcccgctgcgctacccgaccgaccgcgacgacctaataatgccccagcgcgccatcgagatgctgtacgaggagacggcgggtgacgccatcgtcaccacgggcgtcggccagcaccagatgtgggccgcccagttttacaagttcaaggagcccaggcgatgggtcacctcgggcgggctgggctccatgggctttggcctgccatcaggtgtgtgtggtggggggatggggtgggggtgggggaataatataagggagtttgcttcttga

SEQ ID NO: 484 - DNA, 273 bp, Chlorella protothecoides
atggacatggacgagtatgtggaatccttcagcccctcgctcatggacaccgttggagcctgggcacagggcgcgcgctttgtggacgttttgaaatccagtggtatccttgagggttccattgttcgggccattcggcgccttgaggaactgcttcgacagctgggtaacgccctccgaacaattggggagcttgaactcgcagcgaagtgtgacaaggccatcgaaagtatcaagcgcgacattgtttttgcagcatctctgtatctgtga

SEQ ID NO: 485 - DNA, 1029 bp, Chlorella protothecoides
gggggggtgggaggtggggacacgggggggtgcggttcctgggctggcgttctgagacgtctgattggtgcggggagcgatgcccagggtctaagtgacaggaaggtcgacccggctcgcgcacatagcagcggtgctctgagagctggcacatccaagcctccaggcacctgcacgtcggtgactcgtacggggccggtcatctttgccaaggcagcggcgctctggatgggtccaatcacgtgcaccatatccctcagcatccaacttctcaccacctcgcacacaactcccctgtcccaggacgtcgctgggggagacgacggtgtggaagaagggcggcaaccggcgccggggcgagatcgtgaccatcgccgtgctccccgcaggtgggtcgacagggtgggggccatcaaggagccctcggtcgttggggctgtggtgaagatccccaatgaccccaggaagcttgtgtcaggattcttctgtaggcagtccgccacacttccagagctgtcagccccatccgcccctccctcccaactccccagggcgtgtgagcggtggagcttctgcgatggaccccgtgacgaggctggcgacggagctgcgggggacgctggagctgatgtggggtcccactctgctcctggatgccgccagcatcgcggccgccttccccaccacccacgcgcgcctgaagtccagcttccacaggtccaagatggctgcagaaacagagaaaagaacgcttgctgcaagacacaggaaagctctggggcgctatgcacaggagcacgaactcacactcccccacttccctggatccccaggttcatcatccttgtgggcgacggccgcgactcgccatggtcgcgcatctgcgcaagccaggcggattgcaccctactggtggccgacccagcgtgcaccgcgccacaggtgtctgagggagtggtgacagggaggcttgagacaccctgggccaactcctctccactgatgagacggaggctggttttgctttga

SEQ ID NO: 486 - DNA, 2088 bp, Chlorella protothecoides
atggacggcgtaccatccggcaccgcggcctggctggacgcccgtcccctgctcacccgccaccaccacatccggcttgggtttgagccagacatggcccgcctgtcgcgctggatggccggtgagcgtggtgagggttggccgtgccgagtgtcttttccttggttgcctgcgtcctggacaacctcaggcacactgcgtctctcccttcccaccacgcgcccgcctgcagaccgcgcggtgggcgtggtgctgagcggcggcgggagccggggcctggcgcaccagggggtgctcaacgccctggcagatgcgggggtgcccatcgacgttgtgggtgggacctcccaggtgcggtggagggcgtgggactgtgatgcaaaggcgtattgtgcggtggcgagggagggagtgggagccagcatcggtttgacagggggcggtcgagtcacagcagcagccttgagagccagtgtgcgatggtgctcagccaggacatggttcgagggtgccctggggtcttctagcctccctcattcgtcccctacccaccctccgatccatgctcccatccccttcccacgcacagggcgccttcatgggcgggctgtacgcgcagaacctgcgccgctcggctatggaggacgcagtgcggcgatatgccacagaaatgggatccgtgcggaagctgctcatggacctcaccctgcccatcatttccggtgtgtgcgatcctggggccggcggcgtggctcaaccaagagcggagtcttcaagcaacagcccatcctcactgccctcccagtgtttaatggcgcggggtttgaccgggtcgtgagggaagccctgggcctgcagcgcatcgaggacctctggctccgcttcttctgcgtcaggtgggggggttacgtgcatcagctatgggaggtcacacgcgtgatatgcgccgggtgccgcagggcactggccatgggctcgagggtcgctgagggagcgagctggaagcctcccatgccgtcgcagtgcagttgtcccctgtctcgggtcccatctaccatttccctccaaacgatcccagttcctcccctgacacccccccccccccttcccaccctccaattgcagcaccaacctgtcgcgcggcgcgcccagcgtgcacgagcgtggcctgctgtggaagatgtgccgggccagcatgaccattgtgggccttgtcccgcccgtcttccacgccggcgacctgctggtggacggcggctacctgaacaacatccccgtggacgttatgcacgggctgggcgtgggcacggtcattgtggtggacgtggaggaccgggaccagtcggcgtggcacaacctcacgccctacgacggcggcgtgtccggctggcagctgctctgggaccggtggtgccccgtggaggcctggcgctacaatgtgcgcatcccgcgctacagccagctcatgaactcgctgacctggatgagccaccagcagacgctgcgccgcgtgagccaggagtacgtcatcgacctctacctccggccccccgtcttccactaccgcctcatggactactacctggcggagcggatcgtgcgcgaggccagccagtacgcctgggtggtggtctccgagtggcaggccaagatcggcatccaccggaccgggctggcgggcctgctccacgccgacagcgccgggttcccgaggtgggtggtgggtgtgtttgtgtgcttgcaggggtggggcagaagtgggtgtcctgctgcccggacccctcgggcaaagtgctggcgcctcacccctgtggagaaccacgtgctagctgggcccaagggggggggggggggccgccgattgaggccgcagctcggcgacgctgcgccatcaggggggcaccacccaccccagactccacctggccgatcaccaccactacactgcaggacgcccagctccctcacgctggtggaccggtcgcgcagctcggcgtgcatgacgcagctgcaggggaagcagcggggccgggtcgcctttggaccccggaacgcctcgctggagctgccgcgcgggtaggctgctag

SEQ ID NO: 487 - DNA, 1503 bp, Chlorella protothecoides
atggcggcctcccgcctgcgggtggcggtggacgctggagcctgggagccggagcccacagagcttgactttctcctgtctttattcagcagcgaggaacgagcggcatgcatggcatttcggcgggacgatgacaaaaagcgcgcgatcattagtcgcttgttgcaacggcatgcagcggcagtttgcctggggcttgactttcaccagttagccacgacacgcaccaaggggggaaagccctttgtcaagaatcctaggcccgacgcagcacccttgaactggaactacagcgtgtcccacgaggtgggtgggggggacgtatgtggttgcggtgcagcagagtggcatgcaggtgctgcctgttgcaccccgcgcacatcggcccggccagccccaagccatgctggacttcctgaagagcttccgggctcagctcaccccaccagagtgggacagcatcatggccctgcagcccgacgaggcggcgatggaggcccagttccagcgactctggagcctgaaggaggcatactccaaggctctggggctggggctggcggcgccactgggcaaggcatccttcagcatatcccccgactcgagctgcgcgtccctctgcctgtctggcgcggagcgggaggactgggccttcaggctgcacaagctgccgcaggggcactgggcggccgtggctcgcgcgcccccggctcagatcgtggatgcgcacggcgtgagtgggttgcgaggttgctggaggagcatcgactgggtttggaaggcgaaatgggcgctgccacagtgttctctgccacgctgacgaggacggattttgagccggaggagtggcgtggggtgctgaccgcccccgagccggcctttgccctgcccctggggcaagctcgtactttatgcgttcatttaccagcgcgcaagtcaaaaaagagggctgggagggggccaaacagtgctcttgatcctgcagtctggacgaaaaggcattcaaggggtggtggtgaggcgggggcgctaagcgccgctccccaagctcgcccccggcgacccaaactcctcccccacgtcgctgatggggaacaggatctcgccctcggggtccgctccccacgcgccctcccccccctcctccgccccgccgcgcttgcccgccatgcgcgacagcgtcggcaggtggtcggtggcgggtggcggcatggtggcaaacccggcaacgctgccggacccctgcacggcgtccgcgcgccgcgccctcctccgcccgccgcgaccctgcagcgccagcggcagcgactggtacgtgtgcagtgtgtcgggccccagcgggccgagcaggtgcgccggctgctcctccaagctcttcgacaggctgtgtgtgcgcgcgtaagagggggggagaaggaggtcaacctcacgtatccgggcagcacaccagatgagaagcctcgaggaaggacacgcagtgtcaagcaaacggtgcaaacatag

SEQ ID NO: 488 - DNA, 1434 bp, Chlorella protothecoides
atgcactgtctgcccccaatgtgtcgactggcgatgggagtgcatcacacgaccctgagagactcagggcctgggaaagggaggggcgcagcatggcgactcgtggacagaggcgcagaggcacgtgcacgtgagaaaaggaggggggagagttggcatgcagccccgtcactgagcaacggggggcctgcggacgaggccggggcctgtccgctgccgccaccccagaccccagccctctccacgctcagtagcgcccaggttgagcaggcggccctccgccagcacgatgacgccgtggccgtcggggaagatgaagcggtcgacctggggcttgatggtctggcgcgtgatgcccgggttctccagcaggccggccatgtcgatctcgttgtcaaagtgcccaatgttgcccacgatggcattgttcttcatggcggccatgtggcgggccatgatgatgtccttgttccccgtggtggtcacaaagatgtcggcggtggacaggcagtcctccaggggctgcacctggtacccctccatagtggcctggagcgcgcagatggggtcgatctccgccacaatcacgcgcgcgcccgcagccttcatggcgctggcgcagcccttgcccacgtcgccgtagccggcgatgaaggccaccttgcccgccagcatgacgtcggtggcgcgcatgatgccgtcgggcagggagtggcggcagccgtacacgttgtcaaacttggacttggtcaccgagtcgttgacgttgatggcagggaagagcagcgtgcccgccgccgtcatctcgtacaggcgcttgacgccggtggtggtctcctccgacacgccgcgcatgcgcttggccatggcggtccagcgcccggggctggtggccaatccgtcgcggatcacgcgcagcacgatctggaactcggggttggtggtggaggtggggtcgggcagggtgccgtccttggcgtaggccgcctccgccttcacgccctcgtggatcagcagcgtggcgtcgccgccgtcgtcaaccagcaggtcggagccctcgccgtcggcccagaccagggcgcgctccgtgcaccaccagtactcctccagggtctcgcccttccaggcgaagaccgccgcagagtcgcgagccaccgccgccgcggcgtggtcctgggtggagaagatgttgcaggaacaccaccggacctccgcgcccagggcggtcagggtctcaatcaggaccgcggtctggatggtcatgtgcagggagccggtgatgcggcagcccttgaagggctggctgggaccgaactccgcgcggcaagcgatcagcccgggcatctcggcctcggccagctcgatctccaggcgaccgaagtcagcctggctcatgtccttgaccttgaactgcaggaatacggtgagaggtag

SEQ ID NO: 489 - DNA, 1401 bp, Chlorella protothecoides
atgagccaggctgacttcggtcgcctggagatcgagctggccgaggccgagatgcccgggctgatcgcttgccgcgcggagttcggtcccagccagcccttcaagggctgccgcatcaccggctccctgcacatgaccatccagaccgcggtcctgattgagaccctgaccgccctgggcgcggaggtccggtggtgttcctgcaacatcttctccacccaggaccacgccgcggcggcggtggctcgcgactctgcggcggtcttcgcctggaagggcgagaccctggaggagtactggtggtgcacggagcgcgccctggtctgggccgacggcgagggctccgacctgctggttgacgacggcggcgacgccacgctgctgatccacgagggcgtgaaggcggaggcggcctacgccaaggacggcaccctgcccgaccccacctccaccaccaaccccgagttccagatcgtgctgcgcgtgatccgcgacggattggccaccagccccgggcgctggaccgccatggccaagcgcatgcgcggcgtgtcggaggagaccaccaccggcgtcaagcgcctgtacgagatgacggcggcgggcacgctgctcttccctgccatcaacgtcaacgactcggtgaccaagtccaagtttgacaacgtgtacggctgccgccactccctgcccgacggcatcatgcgcgccaccgacgtcatgctggcgggcaaggtggccttcatcgccggctacggcgacgtgggcaagggctgcgccagcgccatgaaggctgcgggcgcgcgcgtgattgtggcggagatcgaccccatctgcgcgctccaggccactatggaggggtaccaggtgcagcccctggaggactgcctgtccaccgccgacatctttgtgaccaccacggggaacaaggacatcatcatggcccgccacatggccgccatgaagaacaatgccatcgtgggcaacattgggcactttgacaacgagatcgacatggccggcctgctggagaacccgggcatcacgcgccagaccatcaagccccaggtcgaccgcttcatcttccccgacggccacggcgtcatcgtgctggcggagggccgcctgctcaacctgggctgcgccacggggcacccctcattcgtcatgtcctgctccttcaccaaccaggtcatcgcccaggtggagctctggaccgagcgcgactcgggtaagtacgagaacaaggtgtacgtgctgcccaagaacctggacgagaaggtggccgccctgcacctgcccaagctgggcgccaagctcacgcgcctgacgccggagcaggccgcctacatcaacgtcaaccccgatggaccctacaagcccgccctctaccgctactga

SEQ ID NO: 490 - DNA, 1719 bp, Chlorella protothecoides
  modified_base (895)..(904): a, c, t, g, unknown or other
atgcgcacgagatccatggcaacgcaggaaggggcgcagaggggtgaacgctcggatgcagacccctcgcatcacggcaggcgagggagccgcacccagctgaaatacccagaaatcgttcgaggtgccgctgggaagacaaccctgcgggatagccaaggggagcgcacggctggaaggatgtcagctcgggcaagcctgttggcggatcttcgggaggcagagatcgttttggcaacaaagcggcctcgacggcccatcaaagccattgaattctttgggcaatccctacgacaggtaggacccccttcaccggtgtgtggtgctggagggggtgggtcggggatggtcccggctgcgcgtccgaaaggctcctccctgcacccaaactttggttccgacctaacacaccgctacaaagccatcacctgcgttaattgctggccacctccctgggctaaattctccagctcacattctctgccccacgctcgccacccatcagcggtcctctctcccgccatgcaggagtacaatgcgaatatcgatacaccagagggccaggtcgagtttcatcgcttcctagtgaatgtgggttccggcgcccatggggcttggcaggagacccctccccagaagcgcgatctgtacgagcacgcagccgccaacgacgagcagcgctacctgcgcgaacagcacgactacaagggctggcagcagcacgcgctcaacctccagcgccagctggcgaccgacggcgggggcgtccgccccgggctggacccctactacgcccgcctacttcagcagcagcagcagcagcagcagcagcagcagcattacatgcagcagcagcagcagcagcttggaccttctagccaggccagggagtcgnnnnnnnnnnagcattacatgcagcagcagcagcagcagcagcttgggccttctagccaggccagggagtcatccctgagccccacctatatgcagcagcagcagcagcagcagctggggaggcagcagcagcagcaggggtaccccagcttccacgagcagcgggcagcccacgttcagctgcatgcccagcgactggcgggcaccggctccccagacgtcgggccgacggggcacggggcacctgggccagggccgggcccagagtggtctgtggactcgcgcggcagccacccgcagcagggccagggccgggccggcggcgcgccgggcgcccaggcgcacgccaagcgcgagctgcccggcggcagccccgaccctggtgacgcgctggccgcaggcccccccgccaagcgcccgacgccgtcgtcggagccggcgccggggacgaatcccccgggggcccaggccaccgtggccgtgatgtgcggcgcgatgcacggccgcctgcacatcgccgaccagcgtgtggcatgcgagtgccaggcctgcgagttgaagccggaagcggagcgcctgatgtcctgcacccagttcgaggtgcacgcgggcgcggggtcggccaagaagtggaagacctcgctcaaggtgccgccgggggcggagccggaggtgcgggccggcggcaacggcatgcccatcgggcgctggctggacctgcgcgggtacgaggcgggacgcggcggggcacgaccccggcaggaggggcagggcgcgggcggcggcgccgcggcctccccggcccagcccgcgacggagcgcccg

SEQ ID NO: 491 - DNA, 1233 bp, Chlorella protothecoides
  modified_base (1138)..(1147): a, c, t, g, unknown or other
atggaggccattgacaagctggtctccctgctcatctatgtggttgccgccgtgttctcgctccaggctctgggcctggacgtcaactccgtgctggccatcggcggcgtgggaggcctggcagtgggtctggcggggcgggagatcctggagaacctcttcacgggtctcatcatcctctccagcaaccctttcgaggtggggttgtggcgtactcgtcgtatgggggtgttggaggaagctttggtgggatggcagttcgccttagggactctctgctgccatcagctcgtcctccctgctaggaccttggcccccggagcctactccagcagccgtgggcgaggaggtactgttccgccccacctctggccaggtggtggagggcatcgtggtggacgtgggctggtaccgcaccaccatccgctccttcgagcgcgaaatctacaccatccccaactccgtcttctcgcgcaccgtggtcctcaacgtcacgcgcaaggtcaaggagtggcgcttctacgagttcctgggcatccgggtggaggacacgcgccgcgtggaggctgtggtcaacgacatgcgcaagatcctgcgacaggtgggcgcgggagtgggttggcgggtgggagggagagtgtcggcgggtgggagggagagtgtcggcgggtgggagggagagtgttggcgggtgggagggagagtgtcgtcgggtgggggagagtccagggactgggcttggacggcatctggctggtgggggccgaggggcggtgtgcatggagtctgaccacaccccaaaccccctccatcccgcaggacacgcgcgtgatccagcggctgcaccgccgcgtgttcctggacaagatcactcgggaccaggccacgatctacacctccttctacgtggaggccctgaaccgtgactccttcatggccatcaagcaggacctgctcctcgcgttccgcgactgtgtggagaggaacggggccaccatggcgctaaaccggctgcagctggagatgctgcccggcgggtctggcagcggcaacgagctggccgcgctgtcgctgcaggcgccgacggcgccgaccgtggacgccacgcgcctgcctgctctggcagacggtacgtccnnnnnnnnnngagctggccgcgctgtcgctgcaggcgccgccggcgccgaccgtggatgccacgcgcctgcctgccttggcagacggcacgtctga

SEQ ID NO: 492 - DNA, 459 bp, Chlorella protothecoides
gccggcggcggcggcggcggcacgggcccctcgcccttcggcctcctcctgtcgcagcagcacgggggggagcggtcggagggcccgcatcacacgccctccttctcctttgccaacctccaaggcctgttcgggggcgacctgtccaagatcccgggcctggccacgggcctgtccctcggccagttcccttccatccccaacggcatgatgagcggcgagctggagcagctgctggcccagcacggcggcggcgacgcgctgttcggctcggggcgcgcgccctcgctgggcggcatgagcaagctggagagcctggacctgccggaccacccaggctcctcctccgtcgccaccaccgcagccgaccgggcgggggcatcgctgtcctcggcctcgcgcggcggcatgccgcccaaggtgggtgtccagggtgctggtggaggaggatgtgcgtga

SEQ ID NO: 493 - DNA, 483 bp, Chlorella protothecoides
atgcaggtccaggacgacctggcggcaggcttccagcgggcggccgtccggcacctagccgatcgcacggcgcgcgcggcgcaatgggcggcggcctccgaccccggcgttcgccacttggtggtgtcagggggtgtggcggccaacgccgccgtgcgcgccgcgctttccgatgtggcggcccgcgccgggctggagctggtggctccaccccccgccctctgcgccgacaacggcgtgatggtggcctgggcggcgcaggaggcggtggcggcgggggcggcgacgctggccgcgccgcccccggcccccgtggcggagcgggactgggaggacgtgaagccgcgatggccgctgaccggggagcgccaccccaacatggccgcggaggctgcgcgcagcgccaagaagcagcgcatcttccccagcctgacccagctggtggcggagcaggccgcgatggaggcggcccagaccccatga

SEQ ID NO: 494 - DNA, 432 bp, Chlorella protothecoides
atgtggtgcacacaggctgtcggttccccatgcagtgccggtacccttcgactcccacgcctgctgccccggatcactgcccctggaagcgctccaccccccacctctcccccgccagcgcttccgcgcctgattctgggcatcgagagcagctgcgacgacacgggagtgggcatcgtctccccggatggccgtatcttgggagcctcattagcagggcaggcagccatccacgcggcctggggcggagtggtccccaacctggcccaggaggcgcacgccgccgccatggagggatgcatagccgaggccctggatcaggccggggtgcggccccaggacttggcagccgtcgccgtcaccgtcgggcccggcctcagcctgtgcctcaaggtgcgcaggcgcgagggaggactgactccctcggcctga

SEQ ID NO: 495 - DNA, 1242 bp, Chlorella protothecoides
atggcggaggagggtaccagcccggaggagctgcgggcaaaccttcgcgagtatgaggagcaacttgagcaggttggaggcctgctcctggatgacccccacaacgacgagtacaagggcatatacgaaagcctgaccgagggacttggtgtgggatccatcctcctcgccctcatcccctcacaggtcatccagctcaccaaggagctcatcgcggaggggggacccagcccatcacaacccccggcccagccccaggcccccacagccgcggcccccctcatccaccccgcggccgccatcaccaccgccccggacctgcgcctgccctccatcctcccccccaccgtggccgcgcagatcaggtcggcccggcaccgagcggcgtttgcggggcaggcccccgccgcctgggccatcggtgcccccgtccaggccatctaccgggaggatgggcagtggtacaacggcgtggtgtcggcggtcagcgtctccggcaagttcatcgtccagtacgagggctacgaccaggccgaggaggtggagcgggaggaggtgcgcctgcgcggcgccgaggccaacggcggctacaccggcgtggtggcgcccaagaagcggaaggtgaacgaggaggtggcgctggaggagatgcccgcttggctccagataaaaccagagggtgagtcctgtatggactggactgggagcgggggtggtgggaagccgtgggggggggcaggcgcacagaacgacgagaaggtcaaggcgaagaagaagaagctccaaaaatcgtacaagtcaaagcaacgctttgccaggatggacgttcaaaccaaggagaaggccaactcatggaagaactttgtgtccgggaagggtgagaccggggttgggagctgtgatgggttatggtggtatcaggatgataggtttctgcgtcaggactggcctgcaagatcatcttttatcagggaggatggcggcagatgccatgggaacaactggttgggagaagcattcaagtgtctgcatcaacggcaatgggaacccccacctcctacccctgccctgcaatttcccataggctccaagaagaagccaggattcatgacggggcacaagaaggagagcatattcaaggtccccgatggtctgggggcgcgtgtgggcgtggtcggcagcggcaagcccatgaccgagtttgggcatgcgcggcggcacgactttgccgccgacgcctga

SEQ ID NO: 496 - DNA, 342 bp, Chlorella protothecoides
atgcagtttgtggcggatggcgtcttctacgcggagctgaacgagctgctggtccgcgagctggcagaggatgggtactccggcgtggaggtgcgcgtcacccccctgcgcactgagatcatcatccgtgccacccgcacccagggcgtgcttggtgagtggctgggagggtgtcacggaggggcaggggtggggcgagtgcggaatctcgaaatttttgtccggcgggctgccgcccagctcatgctggggaccagccgacatgggagtgactggcttttgggccgtccctttgaccccactggggatcttgctccctctcgaatctgccggcacccgtga

SEQ ID NO: 497 - DNA, 372 bp, Chlorella protothecoides
atgttggcatctggcgtttgtggccaagggctcctgcaccgacctatgcaacactcactgccctcacaacagcggctatcctttgccaagtccaagtctgaggtcatcaccaggctagaagccggcagcaagaaggcgaagaaggacaagaagcctgcagaggcagcaaaggacgccgagaccgcgcctgccctcgcaaacgggcggggttctcacgccccctctgcgaccccggcgcagcgcagcgtggacgttggtgagccgaaccagaccctcttcgtggagaacctgcccgaggccaccacagccgacatgctctccatgctcttcagccagtacaatggtgtgtgcctggaatgggcccttccatga

SEQ ID NO: 498 - DNA, 354 bp, Chlorella protothecoides
atggacatcccacccaaccagacggtgtacatcagcaacctgtacgagaagctgaacaaggatggtgagcacacaggaaaagctgctcctggcgatcaaaatcttcccgagaagcgcattgcccatgccaagaagctgctgtatgcgctcttcggccagtttgggaaagtgctagacgttgtggtgatgaagggggcggccttgaggggcaaggcttgggtggtctttgccgacgtcggcgctgccacagatgctctccgagccatgcaagactttcctttcttcgacaaacctctggtgcgtggggtggagcctttggggtggtggatgagggtggcaggagccgaggtctga

SEQ ID NO: 499 - DNA, 2136 bp, Chlorella protothecoides
  modified_base (248)..(257): a, c, t, g, unknown or other
  modified_base (1913)..(1922): a, c, t, g, unknown or other
atgctctttgactggctctaccctgccaacttccccgtcatcctggcctgcctggaggcctggtccggcgacccggtggtcaccacccccctcctcaagttcgtgaacgagtttgtgctcaacaagtcgcagcgcctcatcttcgactcctcctcccccaacggcatcctcctcttccgcgaggtctccaaggtcgggggaggggaggccgtgcggataagggggggtggggaggggcggatgagttnnnnnnnnnncttcgactcctcctcccccaacggcatcctgctcttccgcgaggtctccaaggtcggggaaggggaggccgcgcggatgagggggggtggggaggggcggatggatcttttaaagggagcgtgtgtgtcgggtggtgacgcccataaccttgctccctcgagccttgtacaacaagtcctggtgacatatggcaaccaggtgctgtcggcgccgcggcctgcagacgtgtacggcgggctgtacaagggctcctggatctgcctgtcaatcctcagccgcgcgctgggcggcagctacgtcaactttggcgtgtttgagctgtatggcgaccccgcgctcaacgatgcgctggacatggcggtgcgcctggcgctgaacatcccgctggccgacatcctggcctaccgcaaggtgtggggggttgagggtggtggtggggagaaagaggcatttgggggatgtgccgagctggggcctctgaggcagggtccagctccggtcgaacggtactctaaaccagggaacccaggggtctcggcttgcttggcgttactgaggccctgcccagccgtgagacagcataggatcacacgcagctgttcacatggctgcccgtcagagcctcacaacgttgctccacccagtcctgccccacccagcctccacacacaccttcacctccccatgccgtcccccctcccccaaccaccaggtgtgcaaggcctactttgcgctggtggacatgctgtgcgcgagccacgtgccgctgctggcagcacgcgacacgcccacctttgtcttcctgctgtccagcctggacgcggggctgaagagcctggacgtggccgtatccagccagtgcgccgcggccatcgacaacctggccggctactacttcctgcacatgcccggcgggcacagccccaatgccgcggcgcgggccatctcggagcacgtgcggcagcgccccgacctcttcccccagctgctcaccaccctgttcgagatcgtcatgttcgaggactgctccaacatgtggtccctgtcacggcccatgctcagcctcatcctcgtcagcgaacaggtgctgagaaggggtggggtggagttggggggtcgggggcaaggggatttgggaagataacaaatgggggagagggttggtggtatggggcgtcgaaggctctcagggttccgtgcgctgtggcggctgggactcgcagggacgctgcgtttggtcacgtccgccgagggcgtcgtaaaggcgcctgctcaagtctccagcatcaacctactcaccaatatactccccacccaaccatcaatcctccccacacaggtttacgagcatgtgaccaagcgcgtggcggccagccagccccccgagcggcagagccacctggcggcgtgcttggagcgggtgatggcgggcgtgacgcggtctctggagcccaagaatcgcgacaagttcacgcagaacttcaccatcgcgcggcacgactaccgcgccaggacatgatggcgggcgggccggcgacggggcgtcctgcgtgtgtcgagtcgcacactggcgtcgacagcgtgcgtctcgttgggcagtgtgtcatttttaggcagctgccattcccagggatgttgcaggacacacccggcannnnnnnnnncgcggcacgactaccgcgccaggacatgattgcgggcgggccggcgacggggcctcctgcgtgtgtcgagtcgcacactggcgccgacagcgtgcgtctcgtcgggcagtgtgtcttttttaggcagctgccattccccagggatgttgcaggacacacccggcgtgcccctgcgtgctgccccggatcaaggggatcgcaagctccaaactga

SEQ ID NO: 500 - DNA, 1665 bp, Chlorella protothecoides
  modified_base (9)..(18): a, c, t, g, unknown or other
  modified_base (1583)..(1611): a, c, t, g, unknown or other
atgccgacnnnnnnnnnnggggagagaagaggagggggaattgtgcggggtagcggccttggaataaagagaacatggctggggcctagcagatcaggtcgccaagcgtcctggctggagtcggtgaggactgtcgtgcaagacgggctgacggacgacccccttgactccgaggagcagctgcaggtggtgtgggtggtgggctgggcgcctgggcggcgggggcggggtgctctggtcgatctcttcacggacattgaatgcagccctcttgccttcacatgcctccctcactctcccccccttcacctctgtgcgtccctcccctccacacccctccaggaccagctggactcgctgccgtacctcttccgcttccagtacgagaagatggccgaggcgctgacgagagcggcagacccgctgatcgcggcctacgcgtcccgcggcgcgggcggcgccgtcgccggcggcgccgcctcctcctcctcccccccgcgcgacgcggcggtgctggagggccagctcacctggatcgtgtacatggtgggcgcggtgctgcgtggccgggcctccgcctccggcgccgacgcgcaggaggcggtggacggcgacctcgcagcacgcgtcttcggcgtcctgcgcgcggcggagggccccgggcacacggcgcgcgcgggcgcggcctcgcgccgtcggctggagctggccctgctctccttcctccagtccttccgcaaggtgtacattggcgaggcggtgatgcacagcagcaaggtgtacgtccgcctgggcgagagcgtgggcctggcagaccacgccgcggtcatgaacgtcatcctggccaagatggcctcaaacctcaaggtctactgcggcgcagaggaggtcatctccgccaccctggagctcttcaaggtgtgtgtgggaggagttgtatgtgggggatttctgggggcgaatgcatgtgctgggtgtgttgtcggatggatggcatggcagtgccatattgggtggtgggacggtgtcttggccgcgcccctccgtgtgtcctgggaggaatacctgcgaagtgaaactacaggccaagtgccacaacaaccaaccccatgcttgggtcctgacgcgccgccaccctccacacaggacctggcatcggggtacatgagcggcaagctgctcatcaagctggaggccatcagctacctgctcacacaccacaccgcaggcggagggtgtacgcgcggtggctgggatgccgaatgggcattcaagcctgtgtgcattcgatgccacccacaaggtaccaggctcggggagtcgggctctccccggacagccactgacgctcccccttcctcccaccccaatcccccagagtactttcctttcctggcggggcaggcaaacctgcgggcgcggaccaccttttactcgacactcgcgcggctcctgttcatggatgacacaccggatcgcttcaaggcctttgtggcgcccatgcagcaggtgtggagggctttagaggggggtttacgggagggtgtgatgagttgggttggggtgctcgagctcgacgattnnnnnnnnnnnnnnnnnnnnnnnnnnnnnaccaaaggcgcgcctccccaccctggccccgacccatcccacccccatccctag

SEQ ID NO: 501 - DNA, 1524 bp, Chlorella protothecoides
  modified_base (536)..(545): a, c, t, g, unknown or other
atgatgatgctctgtgcgagcctgggcgcctcccacgccacacgcgctccccagcgctcccggcgcaccagggggagcggcccgtcctccctggtcattgggcgcggcgcgatcgcccgctcggcagaccaccccacccgcggccccgacgcccgccccgccgtggtggggaccccgcccctgcgccccctgcgcgtgccctgccgcgccggcctgtccgtgggcggccccaccgacggcctgcccgtctcccccgccggctcgccgccctcctcgccgcggtgcagcgtggagaccaccgacttcctggtgctgggctccggcatcgcggggctgagctacgcgctggcggtggccgagcatgggtcggtggcggtggtgaccaaggcggcggccgacgacggctgcacgcgctacgcgcagggcggcatctgcgcggtgctggacccgcgcgactccgttgccgcccacgcgcacgacaccatggtggcgggggcctggctgaactgcccggaggccgtggccgcagtctgctnnnnnnnnnnctgcgcggtgctggacccgcgcgactccgtcgccgcccacgtgcacgacaccatggtggcgggggcctggctcaactgccccgaggccgtggccgctgtctgcgccgagggcccggccctggtgctgggcctggcgcgcctgggcgcagagttcacccgcgccgccgtgccggcagggcgtggaaggggcggcggtccgggcggtgcccgcgccgccgcgcggcgcgtggtgcacgcggccgacgcgacgggcgcggagatcgagcgcgcgctgctggcgcgcgcgcgcgcgcacccggccatcaccttccacgagcaccgcgtgggcgcggacctggtgctgggcgagctgcccggcggcggccgcgcctgcctgggcgccgacacgctggacgcgctgaccgggcggcgcacgcgcttcctggccctgtccaccatgctggccacgggcggcgccggccagctgtacccggtgaccaccaacccgggcgtggccacgggcgacggcatggccatggccgcgcgtgcgggcgcgccgctggagggcctggagttcgtccagttccaccccactgcgctcgtggcgggggagcccgccgccgccgacggccgcgccttcctcatctcggaggccgtgcgcggcgagggcgggcgcctgctgaacgccgcgggcgagcgcttcatggcgcggtacgacgcggcgcgcatggagctggcgccgcgcgacgtcgtggcccgcgccatccatgccgagatggccgcggcgggggccgaccacgtgctactggacgtgcggcacctgggccggccggccatcgaggcccacttcccgaccatcgccgcgcgctgcgcggcgatgggcctggacatggccgccgcgccgctgcccgtggcccccgcccagcactacatgtgcggcggcgtgcgcgccgggctgggcggcgagacggcgctgccggggctctgggccgcgggcgag

SEQ ID NO: 502 - DNA, 384 bp, Chlorella protothecoides
atgcaggccgcctggaacgccaacgggcactgggtgctgtccgccagccgcgacgcctcctgcgccgtgcacgacatgcgcatgcgccgcgcgctggcctccttccgcgggccctccaaggacgtggtctgcgccgcctggcaccccatccacgaggacctgtttgtggcgggcgggaacaacggctccctcctctactggctggcctcacggcccgaggcgccggtgggcgctgtgcccgctgcgcacgagggcacggtttggagcctgggctggcacccggtggggcacctgctggccagtggcggcggcgactttgccaccaagttctggtgcaggtggaggggctggtgtgtcctggttggcggtggtgctgggcggtag

SEQ ID NO: 503 - DNA, 264 bp, Chlorella protothecoides
atgcgtgccgacaacgcgctgctggagcaggcgctgcgactgctggtggccacgctgtccttcgactttgtgggcacctgcctggatgagtcggcggaggacctgggcaccatccagatccccaccgcctggcgcccggccatcgaggacgcgggcacgctgcagctgctctggggctactacgcgggcaacgagccgccactgagcagcctggcgctggagagcctgcggcggcatggggggcaacggggagggggaatttag

SEQ ID NO: 504 - DNA, 321 bp, Chlorella protothecoides
atgacctacacccgcagcggcaccttcctggtctcgggcgacgacggcggcgtggtccgcttctggaagaccaacctggagctggtcaagtcggtgcaggcgcacggcgagtcgctgcgcggcctggccttcgcgccctccgacctcaagttcgccaccgcctccgacgacggcacggtgcgggtctgggactttgcgcgggtggccgccgagcaggtgctagcggggcacggcggcgacgtgcgctgcgtggactggaacccgcgctcctcccagctcgtgtcgggtgggtttagaggggggggtgggggcgtgaggtga

SEQ ID NO: 505 - DNA, 561 bp, Chlorella protothecoides
cgggcgcggccgcggcgacggcgaccgctccggtcgccgcgagtacgaccgccacgacggctctggccgcgggcacgagaccgagaaacggtccggcggcggccgcggcaactggggcgccgaggttgaggccgccggcgaggagcccgccgagcgcccgcccccccctgagcccacccccgaggaggtggaggccgcggaggcagcccgccgcgagcgcgaggaggaggagcgccagctgtccctgtcggcctacgaggcgcagcaggcggccaagcgcgccagcctgaactccgccaagggccccacctacgtggtggataaggaccagttcaagggcatgaagtccttcaccaaggtggaagaggatgtcggcctggacctgcacaagaacgtgaagaccatcggcgccaacaagggcggccgcgacaaggagctgaagcagaaggagctggtcaaggacgtcggcttcaggatcgcgggcgacgacgcgccccgtgggcccccagccggtggccgcggcggccgcggcgggcgcttcgagggcggccgcggcggcgg

SEQ ID NO: 506 - DNA, 1314 bp, Chlorella protothecoides
tggacacttcgtgagatgggctgtggggagccttgggcacttgcacttgggggcgccatttgcaagctgcctgatgtcaagatggtggatccatgctcatcccggtttcacacgcaagtcagtgagttctcccatgacaagccgcaccttgtcctccacgactccagagaaccggcctcccgtgagattgccaagagcctgaacatgttgtttggaggcatcgacctcgaccccaccgaccggctctttgcagccctcctcgttgcagagcaccagagtgacctgcgacagcgtagcgtgcggcacatgctcagcagagccggtgcgcgggaggaggtgctgggtgtcctgatgtgtgctgcgctggggggcacctctcgctacatccgggtttggtggccattcaagagggccatggtggcagctccgccactcaacttgtcacttttgcatgcagggttcatcacaaacatgcagaagcgagggaccttcatcactggacctcagcgtcgagatggcgggcaactggagcacttccctgaacccaggccaaagcagtctgtgagctggcacctgcccccatcccccttcagcaccaaggccgccgacatccggcccatgtattgccgcacgaccctcaagctggacgagggggcgttggaggagggtggtcatcttgacaaggctgcatcggggacggactcccccagcctggagtgggtgcgggagcagctggggacccgcctcactctggcctaccgatatacacccatcgtcaccccagtctgcctgccggccgtgtactgcgaccacctcacgccacaggaagcggctgacatctactcgggtgtgtggtggtgtgcgatgggcttgaacatgcataggccgggtggacttcctgggccatctgtttccaggcaagccataaagctccagccgcagtctgctcatccctggtgccctcaatcatggggccggctgagtggggtgagtgtcaaactggtatctgacattaacagcacctcctgggtgtctcttgcactgcaggcgtccacccacctgtgctgccaacgtaaatctgttccggaagtgcatgagcaaggtgtttcgactccagaactcgtacaggcagcagaactgtctgtgtgggagggcacctgcatgacccagggatggaagcgtctgcatgagcaacgtggcagggctcacaggatcgctacgttcctttctcccctacaggggtctcattccccagtgatcacaattctccacttccactcccctgcagacgccaacacttctgggggcgccctg

SEQ ID NO: 507 - DNA, 1290 bp, Chlorella protothecoides
  modified_base (70)..(90): a, c, t, g, unknown or other
  modified_base (632)..(641): a, c, t, g, unknown or other
  modified_base (1034)..(1043): a, c, t, g, unknown or other
  modified_base (1122)..(1131): a, c, t, g, unknown or other
atgatcacggcagaattggatttccccttattacagaatcatgcatgcaggcacgcgcatcgtcaattgnnnnnnnnnnnnnnnnnnnnnaactcagcatcgcggggggtagagaaaggatacagcattcgagagttccacggtactcagggcttgtttcgacgatatcgggcaccctcaactatcagcagattcggtctctgtcgaggtgtcggaggaagtgtgacaggcccggacgaagccgtattgcataggcgaggaatcagcagcagcaatctctgtgtgcctggcctgctcgatcccaccctcgaacgcttactgcagagggtgatcgtctaccccaactatgtcaacgccgggaggacggtggcagagggtcggcgtgtcccacgggtgccaggtggggcgcttgagtatgctggagctgaagacccaaccgcccctgagatatacgactgcatagtgaatggactgaagttgccagcagaacttgaggtgaggatggcccctcatagagctgtgagagatgaagaaggtctcatccagaaagccccaacagtgtttaggctcgccctcgaggtacctgtcatctctgccatcacctccctcaaaacaacaacctgcacattgcnnnnnnnnnntgaggtacctgtcgtctctggcatcgcctccctcaaaacaacaacctgcacattgcagaacaaagcctatccgcgagaggcgctgctgaggggcagggtgcgggtggccctgcggggccccgacggcaagccgctcaaccccgctgtcacaagcaggagcaagctcctgcgtgagatagcagccctcctgcctcgccacccagccagggtgaacaggcccaagcagcctgcaggaggggcggccgcagcggcggccgccgcggccgcagcggcggggagcagcgcgtccggcagcaagcagcagacacttttgcaccaatctgcactgctgttagtgcactggacatctggaggaatggcacctggtatgggaaggtacatttcggggtggtnnnnnnnnnntgccacacgagcaactcactcggcggcgcagcgtcctttcgcgagacactgccccgcatcaggacgtggtgcatacgannnnnnnnnncggctgagctccccttactctgtcctgcgaagctcgacatttttgcaccaatctgcactgctgtcagtgcactggacagttggaggaatggcaactggtatgggaaggtacatttcggggtggtacagggcatgctgtggggctgccaagggaaattga

SEQ ID NO: 508 - DNA, 537 bp, Chlorella protothecoides
  modified_base (321)..(330): a, c, t, g, unknown or other
atgacgtggcttgagactgctggctttgccaaagacaacaggaccctttgccgcagcccagacatgcctgcttctcatcggcagccgttggccctttgtgctgtgcagggcgccatccacgagagcatcaaggctctggatgccaggggcatggccgccatcgcgagcggggacgctcaacgctttgccgactaccttcaggaaacggggaacaccatctgcggacggcatgccatcgccatcctgctgcaggtgcagctgttagtcgatgggtggagggtctggcgctggcaatcgcagacctcaagcccacgattgccnnnnnnnnnntccacccaatctcaacaaggtcctccactttgtcacaggcgctggccatcgcagacctcaagcccacgatcgctttcaacaagtacgaccagtcctcggcctgcacacgcccctcgcactccagcgtcagctacgcgtcaggcatcgtatgcaccacgtcctgatgcggggcagcgtctcgcgcaaggacgctgcgccgctgagtga

SEQ ID NO: 509 - DNA, 564 bp, Chlorella protothecoides
atggatgattctgagttcgtgcttccacctgatgaacacagaaccggacaaagcatgcgcccccatctgaacccaatgatcacccaggaagcgtgtatttgtgatcggcccttcccatcactttttctcccgccgctgcctcctctccccagccaccacttacaggcaagggcctctcgaagtgcaggggggcaagatgcgcttgctggggttagcactggctctaaagcatcacctgggtcgccactgggggatgtgcctgtggactcgggagtgtatgaccagctgaaggcaagcggtgcctttgacatcgcgtctttgtcccaagacgaggcaagtgctgtgcagtgcagcatgcttttgagtcctgctcttcggaacagccgaaactttcttcgagggtgtctatcatctctgacccactgcgcacccgctgttcatcgaacaaacaagcaggaggaacatagcattgagatgcactgccccttcatccagcatgttatgagggaacgcagcttcaccctagttcccatcatagtgggagccctcagccggcagaggtga

SEQ ID NO: 510 - DNA, 2724 bp, Chlorella protothecoides
  modified_base (1262)..(1271): a, c, t, g, unknown or other
  modified_base (2085)..(2094): a, c, t, g, unknown or other
  modified_base (2402)..(2411): a, c, t, g, unknown or other
atgctctacttgcgtcaaagagatcctagagtccagatcggtgctcgaatccccgacagtctcacaggattgggggccaaggtctgcagaaaggcctcgtgcagagcctgcgccggcccgaccaactgtgacattcggctggtcgatccacgctctcatgcaacacgcattcttggctataacgctgttaatctacgtgatacgataggactgcgtgcacgatccaccccatcagccttgaaacagggcgcgccatgtcctcgctttctcgatcacttgcctttggtagaattcattcagcctcaccatctccagacaataccaaaagcgcagtccaacgccagccgagccaacccttctaaagcaaagaacgaaacgcatgccttggtgttgcccggtgtcttccagtgggccccaggtggccatggagaactcctcatagaggtcgacctccctagacctcagttgtaccctcccccaaaatcgcctgcctgggttctggatagccttcctcagggcctggagggtggggcgcgctcccctcgtcctccattctccgaaatcaggggaattctggtcgccagcctcctgagtgctgccctaagccctggcttgtcctctcattatatggctgggttggcccatgatgctcagggaattctggtcgccagcctcccgagtgctcccctaagccctggcttgtcctctcaccatatggctgggttggccaatgatgctcagcaaaagatctcatatcgtcaaggggaccaccgatcccttcttccgcataccaagttctcgcgcttcatttctcggtgcacggctttctttacgtttgatatccacaaccctctcaaaggtacaagccgttctgtcatagaagatgcagcatgctgttggaaaccgtacgctggcatggccgggtgctccgaagctctcgccccaaaaccggcgcccgcatcccatcatgcaagccttcccaaacctaaggacactgttcaaaggcaacaaggagcgcatcgagggcctggtggtcgagttggagggacgaaaccccacggcagctcccgtcaccagccccctgctgaatggacagtgggagctcctgtacaccacctcagactccatccttggaaggagtcgcccgtccttcttgcgacccaagggccctatataccagaccctgggtgcgcatggggaggcggagtggatatcttgctagtctttgtgtcaaatggaggcgacatggtgtcttgtgttgnnnnnnnnnngggccctatataccagaccctggattaccgcatcctgcgacacgcaaccttgtccaccccgccgcatgcagacaacgagagcctgcgtggcaagaacagagagacgacacctcttttcaatgctgtcgaagccgagctggagcccatctcagacagtgaggtggctgtgcagttcaagcgcttctggctggctggcttcatccccgtccctgcgccagccagcgccagagggaggctcgacaccacctacctcgatgaagaccttcgtatctccaggggagacaagggcaacctctttgtgctgcgcatgaatgataagaacgcggagtgtgtgttcgaacaattcgtcccttgggctgcgcatccacctgcagccgaatatccaattgttctccgacacatctcttaccaacgcgtgctagcatggcgtgctgtgttctgtaggtgctccgggcccagtcccaggtaccacatggccatcaccgacgctcgcgtggctgcggcggtcgtgggcggcatagctcttggaatcacgctgcagttcctcgtaagtgggattcgaggatgcatagtatgcctccctgctcccaagcttgggaagtacaccctgggcccctcttccctggtcatagggcttgcggtgtcagcggccacaggctcatgttttaaccctgtgcgcctccgcagggatgcttgttgtggcacaactggtggcccatgctcacaggtgagtcgttgtttgaaggggttatcagctcaaagccctccccatgtgaggggactttcactcacccttccaaattttcatgccggnnnnnnnnnnggcacaactggtggcccatgctcacaggtgcgtcgccttcatgtatgtgctggtgcccatgcccgccctcttcttcggcggcgcccccgggtcaaacctggccagctcatgggtcgacgcgggcaagttcctgaccggcttctcggccgtcgggtccgtggctatccctgccatcctgtaccatgccggggtgagtatgaatggggtgtgcagttgcgtgagggtccagccccaggatcaatcgctcatccattgcagaccgcacctttgcgccccctcaatttcattccttcgacgatgccacctannnnnnnnnngggtgagtatgaatggggtgtgcagttgcgcgagggttcagccccaggatcagtcgctcatccattgcagaccgcaccttcgccccccctcaatttccttccttcgacgatgccacctgtcccagaaaatcgtgggaggagccctggtcatgcagctggtggctgtgggggtgctggccgccacactctttgcctgggactacatgtcggaggtcgacgagggcggtttctactcctactgatgccgaagcccgaaggcttttccacttgctctgcccttgccctttgctctcccgtggcactgcgttgctga

SEQ ID NO: 511 - DNA, 792 bp, Chlorella protothecoides
atgctggccgcgccggtgcgggtgcggtcccagatcagcgaagcgttgtccatcatctccagccacgacttccccgcgcgctggccggcgctgctgcccgggctcctggagcgactggaaagcgcggacgaggtccgcctggcgggtgtgctggccaccgccgactccatctaccagcgctaccgcgcccagttcatgactgacgccctgtccgccgagctggattacagccagcaggtggtggcgcccctgctggccacgctgcgccgcctgaccccgcgcatcgccgagagagcggcggacccacccgcgcaggccctcctcctctccaacatccagctggtggtgtccatcttctactccctcaactccccgggcctcacagaggcctttgaagagacgctggacgggtggatgtcggagttccatgggctgctggtactggaggctccgggcgtggcggagaaggatccagagaaacagagcgtgctggacgtcgttaaggccacggggttgtggggtttgcatgctggcatcaagcaaggactcgcaggctacgctgtccacccgtgctcagcgacgtgtgctcgttggaagtcacacgaacccctctgtccctcgcattcccccccaccgcagatctgtgaggccctgatcctgttcctggagcggaacgaggaggagtttgccaagttcctgcagacctttgtgcaggacgtgtggaccctgctcttctccgtttcccagaaccccggacaggcaggtttccttggtggttggtgggcggggtga

SEQ ID NO: 512 - DNA, 918 bp, Chlorella protothecoides
atgtctgacttgtcgctacttcccatgctgtgctcaggcttcaccctatcactttgtgcagaaagcgcggcaagggaccgtctgggccgggatgcaggggttgagaggggaaagaaggatcgcagcgtgcccctgcagtctgtgctggagcggatgagggcgagaaaggcggccgctctggccagggccccccagcctcctgctcccttgattccctcatttgacgatgtccttggggccttgcctgcacagcctgcgaggagcaaggccctccctgcagcctcacaaactgtggctgcggataagcgcgcccttgccccagagccggccacgccggcggagagcgccgcgtcctctgacctcgagctggtggatgaggagggcgaggaggcctgcaacatcgtggctctgcccagcacgctcaagcaacggcgaccctccacccaggtgcaggggtcctgggaacgtgccgcaaagtggctgctcctgattaatcctccggaccttgacgactttgaggatgatgtggacagcgaggaggagctggaggatggggatgtgctggtcggcgagggagctggtgcacgcgagggcagcgccgactccgatgccagatcagcagcgtcgatgagcgagagcgaggagtcggactcggatgatgatggtggatccgaaggggcccctaatggaggcgacggcgacagcgaaagcgccttgagtgacggggcaagatccgccccaggtagttccccgcctacggcagaggaccctgcggccagcacggcgggggatgaccctggcagcgcaggtgcccagcaggaaagccccagcctggcagatgtgctggcggcaggggctcgagcggagcaagccagcagccaaggtgtggcgtggggatgtggagtgcttgggaactga

SEQ ID NO: 513 - DNA, 213 bp, Chlorella protothecoides
atggcgacggtgcgtgcagcataccatgcgggcacctggtatgacgaccgagccagatccctggaggctagcatcaggaaatggatggaggatgcttcccatccggaccccgtcggcagcatacgggccctcatcgggccccatgccggtttcacatactgtggccacgtgctggcccatgcctacaaaggcatcgatgccggcagcgtgtga

SEQ ID NO: 514 - DNA, 423 bp, Chlorella protothecoides
atgaggaagcgttctaccctggaaccccccatccctgcccatccctcccgcccttcgaatcccaatcccaccttcccgccacctccccgtcccagcctcttggcaagcgagtccaatgtggtgcactcctacgccgccatcgccgtggacaagctgctgagtcagcgcgagggcggcgccctgcgcttccagccccaggagctggcggggtgcctgcagggcctgctggagcgcctcttcgcctgcttcgccctccctgattcctcggagaacgagtatgtcatgaaggccgtcatgcgcgtcatcgcgtttgtgggtgagcgggggcatggaggggcgagggaggggggggcgagagggggaggaggggcggagagtggagattcccctgttgcccccgaaggggaaggaagaatgcggtga

SEQ ID NO: 515 - DNA, 270 bp, Chlorella protothecoides
atggagatgccactctgcgcaacccccggaatcctgacgcctacgagccacgcccgagcggcttgggcggccaccctggcagctgacgctggctacacgcagtggctggttctacagtcgggccacaacggctggcgctttgatgcgaacgtaaagccgtaccatagctatgccgcgggggaggcgccgccggagccggaggacgtggccacagagcttccggatcgagacgagggcctggctgagctggcggcgctgggtctgctgtga

SEQ ID NO: 516 - DNA, 528 bp, Chlorella protothecoides
atgaactgggtggagtacgtccgccgcgacacggagggcagcgacagcgacacccggcgccgcgcggcctcggagctggtcaaggcgctgacggcgcgttacccggcccagaccaccgagctcttctccggctacgttgcatccatgctggcggaggccggcggcacagggcgggcggcccgctggaaggccaaggactgcgccatctacctcgtggcggcgctgacgctgcgcggcaagacggccagcgcaggcgcgacctccaccaacgacctggtcaacctccaggacttttatgcacaggagtctgccccccagcctcatccatctccttcccacccccgccccatccggcagcatgtcgccccggagctggccgcggctgatgtgaatgacctccccgtgctcaaggcggatgctctcaagtttgcaaccaccttccggtcacagctgcccaaggccaccgccctggccaccttcccacacctcgtcaagtgcgcggggggggtggggggctgcagcgactga

SEQ ID NO: 517 - DNA, 990 bp, Chlorella protothecoides
  modified_base (743)..(752): a, c, t, g, unknown or other
atgcctcaacggcaccccggctcgtgccccggttcggcctctgcaagcgctgactcaccttgtgaaagggcgctcaccagccaatgcctgtctcttcccccaccactgcaggcgtacgcgccgcagtaccccttccccaaggaggaggcctggtacttcatcctgggggacacatcggccaacgccgccatgtgcctgatccgggcgtccctggtagccgccgaggccgccggcgcgcgcgccgtcgtgcgcgcggtggccgccgggacggaccccgcggccgtggaccccctggcggaggaggccgacgcagcggaggacggcgccgcgccgcggtaccaggaggtgagcgcggcgttccgcgccccgctcaaggcggggcgccacgtcttgaccttggcctgcctcccggactcctgcctgggctgcgaccgggccgtgcccatcaaggtcagggtggtggaggccacgcgcgccgagcgcgagggccgcgcccaacgcctcgccgccgccgtggcggcgggcgaggacggcgagggcagctgggagcaggtcggggcatctgacgccgaggagggctccgagtccggatctgagcgcgaggaggaggtgctgattggcggggggggggaggggatttggagggggtccagatctgcatgcgtgcggtggaatccgattggtaagagggtggggcagaggagttgtcttatgagagcggaggggagccgttgccatgagtnnnnnnnnnngtccagatctgcatgcgtgcggtggaatccaattggtaagagggtggggcagaggggttcccgtacgggagcggaggggagccgttgcaatgagggtgctccttggccccgtctgacaacccgccccgctttcttttcattccaggagggagagtacgacagcgacgagtatgggacagaggagtcgggcggggagagcgaggaggaaggggatgccccgcagcccggcaccacctga

SEQ ID NO: 518 - DNA, 1806 bp, Chlorella protothecoides
  modified_base (118)..(127): a, c, t, g, unknown or other
  modified_base (333)..(342): a, c, t, g, unknown or other
  modified_base (1214)..(1223): a, c, t, g, unknown or other
  modified_base (1278)..(1287): a, c, t, g, unknown or other
atggggcacctggggctacacttgcgaaccccaagactgcaccgtggcattcacccctgcgcaccaggaccgcccttggatgacaaccacgccctcaactcgcctccatggcactttnnnnnnnnnnactgcaccgtggcattcacccctgcgcaccggaaccgcccttggatgccggccacgccctcaactcgcctcccatggcacttaaatcagggccagaacgcagcgctggatgacctgcgccgccgcgtgctcttcctgcaccccgacctgaaggagaagagccagttctggaagcggcgcgccagcatcgtcaaggtgccacgccannnnnnnnnngcggcgcgccagcatcgtcaaggtgccacgatgttctcacagaggttttgttgggagcttcttggtggtggggtgtctccgtgtgctgatttgctaccccaccctggcgcctcagccctgctgcaatcccacccatacccaccagctgatatttatctcccccccactcaattcgacccaggcacatctgctggtcctcgcccacctctcgcgcgaacccatccctgccgcgctgacaaaggacgcgaacttcatcctgcaaaagtgcccggccctgctcaaggagctcgtcggcatcgcctgcgtcccgcgggtccaggttcgttgactggctggagggagcgcggctggatgctttggggacagttacagctaccttccctgcacggcagcaggaccggccgggcttggggtggctggagcgagacacagctccctgtgtttcggacggccgggcttggggtggctggagcgagacacagctccctttgtttcagttctccttgtagaatatctcgtcgacacggccgccaactcccatgcgctgcgactcacctaggtgcctgccacctctttcccaatgcagcccgggtacggctggctggcgccggcgctggggtccgtggagatgatgcagcacttggtccaggccgtcccgatccaggctcggaagggaggaaagggcggcgagggggccgccaacctgctgcagctgccgggcttcgactccgacgtccttcggcgcctggtgaagaagaaggtcaagaccctggcaggtgtggttgccgtgagggcggggcgggtatcatagtgcacttgcaggcggctggatggggatggcctttggggcaactgtggagcagtagccatcnnnnnnnnnnggatcgtggtgcagaatttgtaccttgcaagcgtttcgattcctctagctatccnnnnnnnnnngctgggtggcgctggagcgttattttgaggactcctcccctgccagggtcctcctgctccaccctccctccctggatcgtggtgcagaatttgtaccttgcaaacgtttcgatgcctctagctatttctcatcctcaacccaacaagcccaccccccccccatccacacccacgccagacctgcgggccctcgcgccggaggagcgggcggccgcgctgcgcgacgccggcctggagtcggaggaccaggtggaaagcgtggagaccgcgctggcggcgctgcccacgctgtgggtccgcgcggaggtgacggacgaggcgggcgaggcggccgacggcgacgccagcgtgctggcgggcgaggtgctgacgctgagggtgcgcctggcgctgacccgtgccgcgcatgcggtgccaggctttgaccccgacaccattcgcggggcgtcctccctgggggaagggggccccccaaagttggtgctcctgaggatctgggaagggcgtggaggagaatga

SEQ ID NO: 519 - DNA, 2586 bp, Chlorella protothecoides
  modified_base (2044)..(2053): a, c, t, g, unknown or other
atgccagtgggaggtaaggaggcgctcacgccgcagtccacgcacgcactcacgccgcggcagaggggggttctcaaaggcgctcacgccgcaatccatgtatgcactcacgccgcggcagggggggggtcaaaggaggctggaggggcacccgctatgccccgtccccgtgaaccccctttgaaacactatgcaatgaacaccctgtgtgccgtaaacccggcctcacttgttggagcgggtgaggtaccaggcggccagtccgaggggaagcacgatcccgccaaacagcagcaccaggaggatgatgggggcagtgttcttgtcctgtgcaccaaagtcagggagcgtagggggggtggagctttactcagcgcttgcaggaaccgacggcaggctgccggcaagcacaccaactttcgctggatgcttctccacgctccacgcctttccctgcatccgacatcgcagtcctacacagcatgccgcccacatcagcacccgtgcacctttgagaagaaccactcaggcagagccacgctgcagaggggggagagggtcacttggcatcggcagagccgaccacctgcgacaggcaggccagcctttccctgcatgccatgcggtcccccactgagcaagtacacaccctccccctgcgcacctgacgctggtgggcaggctgccatgggttgggttctctgcctgcgccgccgcggctctgcggtctgggcatggcctgccaggccctctccagatcgcccaccacgccaatctgtcgccatgtcaagatctcctgagcccatgcccagccctcccataccataccttggagatgtagttggcaaagtagtccgcggcggaagggtccgggttcttgtccggatggtacaggagggagagcctgcgatatgccttcttgatgtctgcgtcgccggcagtgatgggcagctccaggatctggaaggggtcgaactgctgcacagcattcgctcgggacgacgtatacctgcacaacataccgttgtcagagtagagaagctgagagccaagctcacagacgacaagattctctggatgttatgtttcagcgaatacactgccgctccagaaagacgcaccagaagagagcaaggactttgtgacctgggcgtagcgtgggtgtcggggtttggtagccgcccgtacccacaacccgaggcaggaccagccggtgaggacccgcactaccataccttgtcgtctggtccgctcccatacagcttgtacaaggtatatggaatcagtcctcgtggaaacccgcctcttggcaattttgaaaggccacgacagtttgacactcagttcagcgaccagtacgctacaggcagggagtttggccaggaatctctaccgcggttcgcccctcgcgcgccaatgctgctgagctggatccggaaacgcgatactgattttgagcctagtagtgataggatctcgacggttctcccaggatctcaccttattgccgcccatcaccacaacatggaccgtgctaacgccctccaacgggagcttcgagaagaggcagatgcctttcaagccatacagcaagacgtcaataagaaccataacgccaggcagcagttcctccaacagcagaacgagaacgagatggtgtttaagatatctggcgaggagggtgccgtgtacaagcttataggccctgcactggtgcgacaggacgctctggaggccagggccaatgtgaaaaagaggctggagttcattgcatccgagctggcccgcctggattcgcagctcaaggctctcgaggagaagcaaaccaggaaacatagccaggcaagcattgtctgggcgctgggaggggaatgggccatgatgcgctggtctggggcccctacagccggtcgtcatgtacattctggtgcccttggatggcaggtgcgtcccgtgtgtggcccaccatgccctccatcccttctccctgggtcccaacccctccggcagatgatcaagctgcagcaagaggcacagcggttgnnnnnnnnnnttcccgtgtgtggcccaccatgccctccatcacttctccctggacggcttagagtgtgcctagcggaggggcatcatcgaagcagcctctcctcgccatctggattgagctggctcccctgtattcaatcttcacctccgcctccactgtgctctctcgatttggagtgtggtcctgattgtacgcagcagggcatgacacagagcgatggattgacccttgcatcacccagaccaggagcaagcaatcaattcgccccgggccgcagcgattcatcgtcgtcccttgcccttcttcttgcctcccgcgggaggcttgggaggcggccccttgcttgcttccgcgggcgcggggactgcatggggaagggagggtctgggcgtcggaaatggaaagcactgcttgccagcattgtgggtgcccatgagacctcctctatggcgaatgcattcccccaattccaaaccccgcacccccacctgcggccctgtccagggtttcgtccacctttccggctccctgactgcccttga

SEQ ID NO: 520 - DNA, 405 bp, Chlorella protothecoides
atgcgtgcaggcaccgcgctctgctttgggagtgcacagagctgcaccatgttctgcgccggctcatctgagcactcggccaccctctccccacgcatgcccaggttcgacccggagcatcccgggcccatgccggatccggagcgctggctgcccaagtggcagcgcgccgaggcgaggaaaggacggaagaagaggagggacaaggtgcgtgctgaggagttgtggggggggtgggtcagacgtgacaagcaggctgtttggttgcggcgtcaaggtagccgctcggctggggtcgagcagcgggcagccgcgaatgagtgcagggttggaggacatggtcatcactccctgtggggatgtgctgacgaaaaggagatggctgggcatggtcgctgcatctga

SEQ ID NO: 521 - DNA, 366 bp, Chlorella protothecoides
atggtagtgcgggtcctcaccggctggtcctgcctcgggttgtgggtacgggcggctaccaaaccccgacacccacgctacgcccaggtcacaaagtcctggagcaccaaaaaggccggacagagtcttggggagcgtgttaggtatacgtcgtcccgagcgaatgctgtgcagcagttcgaccccttccagatcctggagctgcccatcactgccggcgacgcagacatcaagaaggcatatcgcaggctctccctcctgtaccatccggacaagaacccggacccttccgccgcggactactttgccaactacatctccaaggtatggtatgggagggctgggcatgggctcaggagatcttga

SEQ ID NO: 522 - DNA, 1908 bp, Chlorella protothecoides
  modified_base (842)..(851): a, c, t, g, unknown or other
  modified_base (1211)..(1220): a, c, t, g, unknown or other
atgacgcacggtgacgaaggaaagggcgcatctcggccatcgcttaggatttccgccatgatgtccaccacacccccgcatgatgacctctgctggcctgtcctctcgttgattacttcggcattgcacccgaggcactctcccgacacattgccgaaacaccatggcgtcgttagtcctgcatgcgggtctagggatccgtgtggagccccaagtgcagccccggtccatgggctcgaggcatgccggattcagtaccggcagccgcctgtccctgcaggccccgccctccagggtgtcggcaaagcgcctgcacatgaccacaaccgctgctgccaccaagcagcagagggcccagcaagtccaggtgctgcatggttcatgaatggtgatgggagaccaggtggcagcctgtccacttcttcatggaggaccctgaacaccggcacccctcgattcggtcttcctgatggactctttaaacaccgcaacactcgcaggttgacatctccaagcctctcggcctgccccttgctaagcccctctctgcagacgctggagcaggggcggaccccacaggggggcctccgcgtcaagagcgcatctggcaacgctgccaaggcgggagtccaggttggcgacaccgtcatctacacctcatccttcttcggtgatgagctgtggcctgccgacaagctggcaagtgcatggagaagggtgttgaggtggcaggagttagcgacataccagggacctgatggtgtccagcaagtgtttcttagtatgtcatgtcgttctatgacttgtgttcctcaaaatactcccacccctttccaccgccnnnnnnnnnntgcacagcaggcttccaccttgtcgcagcacatcccaaacttgtgtccctcaaaccccccccccctcctccaccgctcaacctctcaacagagctttgcacgctcggccatccaggcggccccatctcccatcaccctggtgttggtcaagggggaaaacaccagcgtggacgtcaagcgcctggtcaagaagagcgcgcccccccggttcgggcgccggctgagcgccacggagaaggagagggccacccacatctgcctggactgcggtgagaatgctgtggagaggggtgcaggacagacgcggggaactggagggggacctggggggtggggtggggggagtttgaagttatcagnnnnnnnnnngacagacgcggggaactggagggggacctgcggggtggggtggggggagtttgaagttatcgatatggcatgcaggggtggccgggcaatgtcaggcatgcttgtcacatatactggagatgcccacacgcatgcttgccctgaccccagatccagtccagggtctcatcgttcctcccccgcctccctacaccaggctacatctactgcgacgccacgccctgggaggacctgcccagcgactatgtgtgcccccagtgcaatgcgccccggcgccgcttcgtgcggtttgaccccgagtctggagcggtggtgcaatgcgccccggcgccgctttgtgcgtttcgaccccgagtctggagcggtgggtgcagggggggccacggtggaggttcggggacagggacctccttgcatgcaggcgcatgccctgacaggctgctcccccccccttttgttgaggctgtccgcagggccaccctttgctgcgtgtgtcgccctcattcctgcccaccctcaacgccaaaacccacctctcccaatgcctcgcagaccagcggcgccagttttgatgccgctcgctgggcgacagtggcggcgggcctcatcggtgtggccctcctgggctacctgggcctcaagatctagtgtctggccccatccctctcttgtgaactgtctcggatga

SEQ ID NO: 523 - DNA, 996 bp, Chlorella protothecoides
atgctcccttccacaccctccctttgccccctctgcgtgcagctggcggatctctggtctgtgggtgtcatcctgtatacgatgcttttcgggcagtatccctttgccgcggcgcagcccaacgactgcgagtatgcgcgcaagatcatcaaggcagaggttggtgtggtggggcccgtcggaggtggggccgctggtcgtgctggggaggagtccgggggcttgagcagcgcaacccctcccacctccaccctgcgctggcacgccgcgaggcctgcaccccctgcccctccgcagtacgatgtgccgccgagcgtccctgcctcggcggacgtcctggatctcctggcgcggctgctggtggcggacccgcggcagcgcatccccatcgccgagatcatgcagcacccctggttcctccgcgacctccccctcggcgcggccgacatgaacaggttctatctggaccgcgctcccgtcctccacccgaagagcttccgagttgcaagcggggatgggggttggcgcgcatatgcaaagctggaagcatgggtggtggctgtgggagagcgcgtgctcagttgggcaatccctctcgggagggcgatggcgattccatccgtcctcacaagggccacttgcgctgtcctccagctcatgtcgctccacttgcgctccctccctcacttacgatctacatgcccttaccttgtccctcccccccccgcgtacctcccatgctccctgcagctcgaaaaggacatcgagcagatggtggacgtggcctccggccccgtgtcggcgcaggaggccccgctggcctgctccttcgacggcgtgcggctgctcagcatccagatgagccagggcggcacgtcgctgggcatgctgggctcctcccagcatggatacctgtccagcacctcctcggcgcgcatgcagagcaccctggggtactacggcgcgcagcccaacgcctcgctcatggtgccctga

SEQ ID NO: 524 - DNA, 639 bp, Chlorella protothecoides
atggcggggggttggcctgcaaaccgcctcgcatgcctgccgttcgtccaggccctgaccctcccgtgggctgccagcccaaccctccccaacctgaccccgggccgggatccgctgactcagcaccgccctcttcccccccccagcaaaacccggcgtgccagccccagcagtcccgggacctcgacctccggcccccccaccccccctcccctcgagtacattccccccatccccggcctcctccactaccgccagatgggcgggctgggcacgggggccttcggccgtgtgatcctggcgcgggacacgcgcgacaacgcgctggtggccatcaagctcctcccccgcggcgacttcatcgccaccttcaagacctacgtcatgcgggagatcatgcaccagggctcgctctggcacccccatgtcgtcgcgctgcgggaggtgttcaccacgccgcagtacctggccatcgccatggagtacgcggcggggggggacctcttccgccacctgcgccacgagcgccccgcccagcgcctgcccgaggcagaggcgcgccgcgtcttccagcagctcgtcatcggcctggactactgccacaccagggtgggcgcacgcggaggaggggggccctga

SEQ ID NO: 525 - DNA, 804 bp, Chlorella protothecoides
atgatgcgggcgcccgcccccaggacctccaccggcgctgcctcgccggcagcagaggaccctgcggcgcgcctgcgacgcctggtggtcgacctggccccgccgcgggtcgggtcggcacccggcgctccggcaaagggcacggacgaggcgctcgccgcggacgcggcgagcgcgggcctgaatgccgagcagcgggcggcggtggccagtgtgcgcgccggggcggagtgcacgctggtcctgggtgtgccggggtctggcaagaccagcgccatcgtgggcatggtccgagcgatggtggccggagggcacagcgtgctggtgtcgtcctataccaacaggtctgtgaccatgagtggggacggaaggcgggtggattgtttggtggtcctgagactggggtgggtgcggggacgggaagggaggagggcgtcggctgcagcatgcgggtgcgcatgcgtcccgattgcagcacatgcgcgcgtccatggcggcgcatggcagcaacagggagcggcagcccaggcgcgggtgggaggagagctgcaccgcgagtcttgcggcccgcccttcccgtggcgcgctaccgcgcggatgggaggggagctgcaccgcgagtctggcggcccgcccttcccgtggcgcgctcccgtgctcttgaccgtgcccacccgagcgccccagccccctgcaacactgtacgagctgctgcgcctcttctcagagccctgtcacatcccgaaccccctgccctccctccccccgcagtgcggtggacaacatcctcctgaagctggctga

SEQ ID NO: 526 - DNA, 867 bp, Chlorella protothecoides
atgtcgaagagtgccccagggctcttggcgcgggccaagagtctccttgaaggagtcaaggcaccatgggcggtcacgggtccgctgtcctctccggagtacgcttctcatctgccacgcgccggggagtaccgcgagcgcgcaccagggagccaaggagtcagggctatggtgcctgccgctgagacaaaccgtgtctacgacatcaagtacttcagtgagtgtgagggtaatcatggtgggagctcatccatgtgcagccatatttctgatgcccagtgggcaactcctcctcttgctttcttgcagcacgggacgctcgccgcgcacacctccctggcggcaccatcaagtacgagtactacgacttcagccctgccgagaaggttgaagccctggaggtgggtggtgcagtggggtggtctcaatgggcatgccgtcctcacaagcaccatctgctggttatggcactggagacagcaccaaccccgggcaagaagtggcagaggcccttcaagcccatcctcgaagaggacaacaatgggtgaggggggtgcagggtggcgtatatcacttagcccagaacaaggcgcattgccaaacgtacaccatgtgagcgctgcagcgctgctgacttccagagtacacatacagaaagctctgctctggaagggtggcaagacacgcagatggcctctcacacgagcagttgatgttagtggcccttatcgaaaggtgtacatggctgtaacaattctctgggtaagggagtgtgagagatttacagaggccggaaagacactgtgcctcttgggcgcaaagtgctcccgattctgcccagcgcgcagctggcgacgtctagcataa

SEQ ID NO: 527 - DNA, 519 bp, Chlorella protothecoides
atgcagatctcgacgcgacgtaagccagcacgcgtcgggcagctgagcacacttacggcaatcaatccacaggggctctggctatctaggctcctctcgctctttggagatactgaggcacggattctggtgctgggcctcgacaatgccggaaagactacaattctatgtgagtgttttgcaagggctcccaaaggtggtgcgaccgtttcccgaccatcactcaatcttcaccttcatccatttgcagaccgtctccatgtgggcgaggtggtgcagaccattccaagtgaggtggttggggtgttcatggggggtgcaagcatccaggtctcgtccctgcacagggcgccatttgcttggtgcccatcactcccacccaccatcaccctgcattcccaaccaacagccattggcttcaatgtcgagacggtgacctacaagaatatcaagttccaagtgtgggacctgggcggccagaccagcattcgcccctactggcggtgctactacccgtga

SEQ ID NO: 528 - DNA, 570 bp, Chlorella protothecoides
atgccgagcagtgcggctgcgcaaacagggcggcgtatctcgcccgcaaagaagcgggccgacgacgctgcggcgcacagcggccagaccgacgaggcgtccgcctcgaggaggacgggatccttgccaccgccgagccccgaggccgcgcgctcgctgcgcgaggctaaccgcgcgctggtcgagcgggtcagggcgtcgctgagcgccgaggagttcctcgctttccgccgcgagtcctccgcctgggtgcgcagcgagctgacgagccccgagtacgcggcggcggtggtcgcgctgggcctggcggacttgatcccggacctggccgccacctgccccaacccggccaaggcccaggagctggtgcaggccgcgccgcgggtcaagggcaagcgggtgcgcagggtgggggtggtgggctggcgagggtgtgcgggggctgtggtctgcagcgcggggaggggtggccctcgccccgctggggtcggggtggcgggctggagagggtgtgctggggctgtgatctgcagcgcggggaggggtggctctagtcccgctgggttttaa

SEQ ID NO: 529 - DNA, 396 bp, Chlorella protothecoides
atgagtcgacagcactccggacctctggccgaggacagcttgccgcaggaggacagctggcccagccagtccgtcaaccctttctaccacgaggacgacgtgcagctggatgccctgggcgtcatcaacgccctggagcgcacctgcgcgctggagagcgccctgcggcaggccatccaggacacccaccccctgagcactacgctcgactgggacttccgtgccgcagacagggagaggaaggcactgctggccatcacagagcacctggagttcctggaggacaagctccgggagttcaggttcatgacagcctctgacgaggagaaccgggtgggtgctggcggcatgctggtgacaggggcctcagggccatgccagctcgcctgctcatga

SEQ ID NO: 530 - DNA, 1203 bp, Chlorella protothecoides
atggaggacctgtgcatcgtgtgcgcggagccgctggtgtacacggcatatgggccatgtgggcaccaggacgcctgctccaagtgcgtcctgcgcctgcgcaccatcatgaaggacagccgatgtgtgctgtgtcagcagccatgccatgccgtgttcgtcacccgcgccatgggcagttacacgggcaccctgtcggccgacgagtgggaggagctgccggagagggtggagcagggcaaggccttcctgctggcccaggcccaggcctactttgatgagcaagcccacttcaagaccatggcggggctgtgcaccttctcccaccccgcgctcctggacgcccagaagaggttgcgggatgttttggggcgggcgtggaggctttgggccgccgccctccgtcccctccccccccacaggcccattgtattccgcaccctccatgccctgcgtgagggtgtgaaggaggctctggaccagcacttctgcgggcagtgcctccaggggcgcaaggtattcaccgccgagcagttactctactctgggccggacctggagcgccacctgcgccagggcgatcgggagggccccctcgccgaggccggcttcaagggccacccggagtgccacttctgccggcgccgcttctacggcgacacagagctgtacacccacatgcacacgcagcatgagcagtgcttcctgtgcaagcgggtggaccccagcaagcacgtctactaccgcgactacccggacctggaaagtgagagcatatggggtttggggaggaggggccgctgggaccggcgccctgccgaggtggaggaatgcaggatcgcatgggaaggaagggaagtgaggcctccttggaacaaagattgtgcaattggcttggtgctgggcatcgagcctgccatagtcacttggacactccctggccgatccccccaccacgctcttctccccgtacccctcagaccacttctcccagcagcacttcccctgccagcaccccagctgcctcgagaagaagtttgtcgtcttcgccagcgtccaggtcagcagtgtgccgtgtacagagggtgggctttccaaatctgtccccattgcctccatgtcattgatggtgagggagaaggacgtgcagccctgctcccgcgtcccatggaccctgccatgcaatgccacttgctcgcttaa

SEQ ID NO: 531 - DNA, 804 bp, Chlorella protothecoides
  modified_base (508)..(545): a, c, t, g, unknown or other
atgtctctccgggagcgacggtgcgcccctgccactgctcggcatgcaatgttccagccagatcacctacaaggacgcggaccgctggccccttgcagaatcaatagcttcctggacaatgtggacgtgggcgacctcatgggtgcaagggcgctctgctggggcctggctgcagtgacgggtggctcaggagggtggcacgctgtatttgattcccttctttgccatcaaattacaggtaagcttgcggggctggacaagaagctgagcaggagtctggaggaagaggtcatggagtcttcctccccctctgagctgtccaagtctcctgtgggcccgctcgtggactccagcaggtgcacaggggctgccgttagggtggccgaacatgctggttcgtggactgatgggactgggagcagtgcccagaggcagcacccacacaccagtgctctagcgccctggcatgccgttagcctcatccgaagcagacctgacttgcgctacnnnnnnnnnnnnnnnnnnnnnnnnnnnnnnnnnnnnnncccccccccccccccccccccccccccacttttgcaaggaggagagcctggtggggatccaggagcttgtctcagcccgcctcctggaggccgccaaggtgggttgggggttcaaggtcctatgttggtacctgaatgcatgacggtgagcaggctgtgctctgagaagcgccaggaggattgtcgcccaagacgaagaggaccaagccccttgctgatggagtggggtggatcaaaagcttgtgaggacctcacctga

SEQ ID NO: 532 - DNA, 444 bp, Chlorella protothecoides
atgcctggccattgcctgccgctggtctcagccgaccaccttcacactggcccctgccccccagactactcgtcccgaccggagaacttcacgtgcttggtggagtgtcggcgggccgtggcgcaggacctggggctgcaggaggcggacctggccctgagcatgggcatgtcgggggactatgaggccgccatcgccatgggtgccacccacgtccggtcatcggggaagggggccccacgcccggtgatagccactcagttgccgctgctggatcgcgtttggattcgggcccatgatgcgacggcccacctccgggagcaatgccagggtggcagcgggcctggtggctttcatgggattaatggcgagctaccccgtctacgtcgcgacccggggctccaaggtgcggtgggaccggacgtggccagcatggcaccatga

SEQ ID NO: 533 - DNA, 1059 bp, Chlorella protothecoides
atggccctgcacctggcaggcgccgcccaggcgccgcatccagcgcctgcaccacgcagctcattctccaccccccccgacatgcgctgcacccctcgccgctacatatgcttcacgcatagaattacgcggtccacgccccgaagcggcgccgccccccgcgcaaccacggcccaggcaggcatcgactcccacacccctcgacgcacggctccgttccccctgctccgcgcagcggcggcggcgggcctggcggcgcttgtgctgcacggcgcgggccccgccgaggcggtcctagtgtcgcccatcgcgcgtgtgccgcggtcggcggaggcggcgctgcgccgctcagtccccgccttcaacccggatgcgcgcgccatccgggaggggctggagagcgtggccttcaagctgcgcatcccgcagcgcaaaccctgggcctccatggccgaggacgtggcggcgggggctgggctcgcagcggacgaggggcgggcgctggcggggacgcccagcccggccctgtcccaggcgcggcgcgcgttgggcgaggtgcgcgcggggctggccacgctggctgccgcggtggacgcgcacgacatcgaccgctcctcccagcgcgtcgccgccgcgctggccgccgtgggccgcctggagctgctgcaggccccgggcctggcctttcgcgtccccggccagtacgagggcctaccgcggctgacggggcgcgccgtggtgcgcctggaggtgcagcggcgcggcgggggcgccgacgcgccgagcccggaccccgacatgctggagctgacgctggacggcttctccgcgccgctctccgccggcgcgctggccgccgccgtggccgacggcgcgctggacgggcagccactcgccgcatcccccgtcgccgtggtggtcggggcccagaccccggacgacccgggtgtgccgctggagatcctccccgccggcgactttgagcctgtgtaccgcacgcccctggacgtcgccgcgggggagctcccggtgagccatgggtttggggatgggagctga

SEQ ID NO: 534 - DNA, 432 bp, Chlorella protothecoides
acgtttgtgtaccgcaccagcccggagccgctgaccagggtgctgcgctcgctgacccaccccgaccagcgcgccaaggccggcgccgcgccagttgtgtacgtggggcgctacgcgcagcggggcagtacggtgcacaccagcctgcggtacaacgacagccgggccactgagctgcgcgcgcggctgactctgcggtcgacggtgcggggggccaacaaccgcctggccgtggactccttcttcagctgggacggggtggagggcagctcccactccttgttggaggagggcgaggccggggagggcgctggcgaggggcggcggccattccagagggggctcaacccctttgtgtttgtgtcgtaccagcaggcgcacaagagccccctgaacctcccagtcacccagatggactacttcatcccgggg

SEQ ID NO: 535 - DNA, 852 bp, Chlorella protothecoides
atgctgctgcgatcctgtcgcctgtgcgtcgccagggtgctaggcattttgccccggtctcagacccccgtggtggggagcagactggcagcctggagcttggtacaagccaggccccttgtccgagtgcctcagcttgttcctggaccctgcagtctcaggagcgtcacacagagggcggtccatgaggcagcgagtgcgcccagcgaagcccgccctggcaaccctaccccaccagcctcctcccactgcatcctgaacttctatcacctcgtggacatccccagaccgcacgaggtgctggaacagcaccgggccttcctggagggcagggaggtgcggggccgcatttacatctcccaccagggcatcaacgcccagtgtggcggcgtcacagcggatgccgtggcatacgtccagtggctggcacaggagcagtccctctttgagccgcttcctgtgggtgtagaagatctcggtcggcaaggcaccgttgggggagaatccaggggggatgcggcgaacggtggcccacccaaccggcccagagaccaagatagaggtcgacacccctctttcccttcatcatctgctcttccccatgcacccttgaagggcctgcggtacaagctgtaccccgcagacgaccatgccttcccccggctcaggctgaagttccgccccaacctcatcagcttggcgggggggatggcggcggcgccggtgaccgatgcccaggcgcgtgccacacccttggaccccctggcctggaaggagatgctggcgcaggtgggcttgccggccctggggtgtgggtgtggggggggtgcctgctcaacccatgggcgatga

SEQ ID NO: 536 - DNA, 750 bp, Chlorella protothecoides
atgggcgaagatcatcataccgagtatccggaggactcttatggaccccttggccttctcccaggcttgcagcttgccacatcagagcaaatcagtccatgctcgcttatgtacacctgctttccccactcacaccctcgcttgcctcccccctctctcacactccaggagatcgtggacaaggcccccctcctgccaaaggacatccggtggcactttgtggggcatctccagcgcaacaaggtgcgcagcttgctgggcgcggtccccaacctggaggtggtggagtcggtggacggcgagaagctggcagacaagctcagcgcatttgtgctggaggaaggtgcgacggcgctgggctggtgtcaagagggttgggtgggggggctcacatggaggggtgcatgcgcaggcaacgctgcgattccatggcctgtgacgagtcagcatcggttgcatcctcagccaaagcgcaaggagctcgcaacgctgcgcgctcctgttctggctcatcgggaacccgcatcgccaatccactccccccatgcatgtgcagagcgggagccgctgggggtgatggtgcaggtgaacaccagcggggaggtgagcaagtttggtgtgagccccggggaatcgtgcgtcggcttggctcggcacatccaccagcaatgcccgggcctgaagctggtgggcctcatgaccatcggcatggcaggtgtgcaaggtggtggaggggaggggggtgcatga

SEQ ID NO: 537 - DNA, 546 bp, Chlorella protothecoides
atgccatccatgcacaggtacggcttcgtccgtttccagtcttttgaggacgcccaggcggccatcaacgccctggacgccaccaccacccacggccagacgctgcaggtgaagtttgccgacgccgacgctggcccgccggccgcctcccccgtgtcgggcctgaccccctcagagagtgtgtatgtcaagcacctacccgccgcctccacggtgtccgacgtccaggccctgtttgagggcatcggcggcgtgcaggacgtcaagctcttcccctgcctggaccacttccgcggcgcctccgcgctggtgcgcatggccagccgccgcgacagcgagcgcgccatcgccgcgctgaacaacaccacgcccgccggcagcctgcagtcgctggtggtgcgctacgccgagtcggccgccgagaaggccgcgcgcctggcgcggcgcaaccccgtgcgcgctggcacggggctgggccccggcgccgccgccaccgccggagtgctgggcgctggcctcggcggggccgcgcacgcggacctccag

SEQ ID NO: 538 - DNA, 1257 bp, Chlorella protothecoides
  modified_base (655)..(664): a, c, t, g, unknown or other
  modified_base (869)..(878): a, c, t, g, unknown or other
atgctgtatgtggcgaacgccggcgactcgcgcgcggtgctgtgccgggatggcctggccctgccgctgaccgacgaccacaaggcggcgcgggaggacgagaccgcgcgcgtggaggccgcgggcgggcagatcctgttctggaacggcgtccgcgtcatgggcctgctggccgtgtcacgcgccatcggcgaccacagcctgcggccctacgtcattgcagagccggaggtgggcgggttccactccgtgggtgtatcggggggggagggggtaggtaccgcctgcctactgcacacgtgtgagggaccctgtgatgtttgtgtgtgtggaggccgtggcgaccgcagccctgcggccgtgcacagtgacaggatgagcacacacaaacccagcccactcccactcccctcgcaggtcaccatcgtgcaccggcaccctgcagacgagctcctggtcatggccagcgacgggctgtgggacgtgatgggcaaccaggaggcttgcaccctggcccgaaagtgcctcctccgcgcccgccagcgtggcagcagccgacagggagtggggtgtcgagacggcggggtgttggggtggggtccagggtgtgagcagcacggaggaacagggcgtggagggcggtggagaatcgggnnnnnnnnnncgaccacagcctgcggccctacgtcattgccgagccggaggtgggcgggttccactgtgtgggtgtatcggggcagggagggggtgggtaccgcgtggctgctgcacacgtgtgagggaccctgtgatggtcgtgtgcgtggaggccgtggcgaccacagccctgcggccgtgcacggtgacaggatgagcacacacaaacctannnnnnnnnncagggagtggggtgtcgagacggcggggtgctggggtggggcccagggtgtgagcagcacggaggaacagggtgtggaggggcggtggagaatcggacagcgacgtcgtggacactcaggccgtcctcaacccaccccgcatcggcagagcgcggcaagagtggcagccaccgtgctgacccgcgcggcggtggaccggggcagtcgggacaacgtcacggtcgtcgtcgtggacctcagcagcgcctcgccggaggaggcggtcgccgaggccgcgtcagcggtgagtgtggggtgggattgggggcggggaggggggacgtgcggatgcagtcagcctgtgcactcaatcggatggtctattgaggggcaagcctga

SEQ ID NO: 539 - DNA, 921 bp, Chlorella protothecoides
atgggtccggtcgcccttttctcggacgcccgacccagcacgcatgctctgagcctgcgtttccgctgcccgcacaaggctgccaatatcgcggtaaagcagccagcagcacgccgaggcttgcagcccgctcctcgccaggcgcgtacgggagtctggaggggccgggcgacccggtgccgggctgccttcagcccgttccccttctctgagtcggattactaccgcgccagccttcagttggtccaagtcgcagatggggtgagccggcatcccaggatcggtgtacagagtttatccggggctggatccgaggaccccgtcggttcggggcagggaatgggtgcaacaggccggctggtccccagcccacccgggtgctggcaccccccttcaacccctcaacaccatggccccatttcccccctagacaccacggtgctcggccccccacccccacagacgcccggctccgccagccagagctcaggccacctgctgctcatgcgcgatggcccacgcggcatcgaggacactgagcgcggcctgatcctggcggtcgggggcgataccctctccggcatcgcgctgctgatgcagggccgcgacggcgagcgcccgctctgcctggacctgctctggacggtgctgcagcgggggaaggagctgagcaagcgcgactggcggctggagagggtggccatcgtggagctgcgcggcatggcctacatcggccgcctcttctttggcgacggcgcggggggcgcggcttgggactgcgattgccgcccctccgacggctgctggctgtcgctcaaggtggggtttgaggtagagggctcgggagaaaggggcggtggcatgagaggagcccacccgcgagggagcgcatgcccgtcccgtttcccccttgtctcatag

SEQ ID NO: 540 - DNA, 981 bp, Chlorella protothecoides
atgtggcagcgtgtttgggcctcgcactccaagaggtcgctccgcaaggccgccttcatcgcctgcgcgggtgtcatcctggtcgtcttcttcaccggcttccttggtctgctggcggcgtggtcggggcgcatcacggccgacaccaaccccaacctgtacctgttcgaggcgctgcgcggggccatgaacgaagccgggctggtgtccaacgccatgggcgtggtggtgctcctgctcaccatcaccatgaacgagtcggcggtggactccatgcagaacgggctgacggcggccatttcctcccacttcctgcgcggcctgcccctgtactgggcgcgcctggccgtgctcgtcatcaacatccccatcatggtggtggccaccaagggctacaccgtgctccagctcttcctgctcactaacatgctctgcgccaccaccgcgggccccgtgctgctcggcctggtggagcgcctgcaccccgtgtacggcggcgcctccctcctcttcacctccatcttcaccattttcctcacctccgtctacggcatcaactttgcgtgggtggacggtgcgtcgcgctcccacaacatcgccgagggcatgcactacacctggatcgggaacaactacgactaccgcttcttcctggtcgccatcggcgtgtccatcggcatggtgggcgtcacatccgccttcaactacctctcccagacctacctgatcaagaagaagccggaggtgctgggcttcaccgcgccggccacccacccccacatcccgcgctaccatgatcgcctcatgcatgcgccggtgcaggcctccagcggcagcgaaggcggcgtcgacgacaagatcgcggcgggcgatgggctcaagggcggcgcgccgcacgacgcgctcacccgcctgtccgcgcagctgccggaggcgctgctgcacaccgccgacgagaccccgggccaccgccccgcctga

SEQ ID NO: 541 - DNA, 588 bp, Chlorella protothecoides
atgaggaggtgtgtcgcctcactcaacaggcgggtctgggcagagtcgtgtcgccgagaccgagcctggcgtgtcggagcatgcgcgagggcactcaccactgatgcggctcgcgagcagggcgccacggctcgcgcgtggtgggcgggctccctcgcggtgggggcatctttcggcctcggggcgtggtacctggccacccaccctgggcctgccctcgccaaggacgtctccagcctcccggagtacagcaaggaggaagtcgccaagcaccgcacccccgaagaccgggtctgggtgacttacaaggagggggtgtacgacataaccgactgggtagacatccaccctgggggaaaggcccggctcatgatggccgccgggtccgccatcgaccccttctggtccatgtaccagcagcacaacacgcagcaagtgcgggacatcctggaggggtaccggataggcagtctggaggggggcgccccgccgccgccggaggacccctacgcggacgaccccaaggacaggtgtgctggaaggggaggaggacccataacgcaggccatatatcgagggagggggtag

SEQ ID NO: 542 - DNA, 1719 bp, Chlorella protothecoides
atgtcacccggtgcggccgcgccacaagttgattttctgcctgcatcctgtcgtccgtcgtacgtgcccacaaccccgtgctctcatcctcccgccccctcttccatccctgtccccagctactgcgagcgctgcggtcagaacgcaacgccagactggcggtacatcgtgtccatgcaggtcgcagaccacagcggcgagatctgggtgacagccttcaacgaggccgtggtagatatcaaaggcacgagccttcacaccagcgtattaccgttgctggcctgccgccagtttgtgagacgatccactccatacaatgcatacgacagccccggagctgatcggcgtcccagcgggcgagctgcggcagctgtgcgaggatgggaaccctcgcttcgccttcctcgtccagcacgggagagtgcggtttgggaatcgaggacggcgacgttgtttgcatgccctggggtaaagggagcgtcttgcggcgcggccgcctggcagaggcgatgctgtcaaacccaggatgtgcctgccgaggtgcctgtgcatatcagatgccaagttttgggtatagcacagccacgaggatccctcagatctcgattcaacctcacacccaccccgaactcgatctctcaacagcaagcctgcttcaagacgtacaccatgaagctcaaggtggctgaggacacgtacaatgacgagaccaagatccgcatctccctggtctccgccaccgcgccggactacggcgccgagtcgcgcacgctgctggacctcattggcaagctgcagcgcggcgagcagatcttcggcccccccgtgcccgctgcgggagggccaggggcgctgcccggggtcgcgaggggcggtgccccgccggcgcagcagcaggggtacggaggcgggtatggggcaccggccccccgccctgccgtcggggggtacggcgatggtggcgcggcccgcggcgggtacggcgcgtatggtggcacggccctggccaatgccgggtggttacagacactcagtgtggaggaatggattctggagtcacaccagcaggacaaagggggatgttggggtgctctccaaggtgatgggtacgatgagaaggggacttggccccgtggaaaaggtattctcgagcagtcatccacctggcctgcgtcagaatcgatggcagcaagccggtgcacagagtctgaatcatccacaacctcaaacccccgtcaggctgtccatgaagttcccagtggacaggcgctgctccacgtcggcaaaggagctgacgtcctgcccccagagccaggcgtagcaccccgcccgccgtgcgccaaacaggtcgtttcgccggtcgtccccgacgtgcacggcctcggcgggctgcacgcccagctcctcacatgcggcctcgaagatgcaggggttgggcttctcggcgccgatctgtgtgcgtgtgtgttggaggggggggggtcagggggcagaaattcgcgggggttgaggtgtcggagcttggggctcggaggatgtgaaggagatcccttcagccggtgttgctgttttggggccacaggggagtctgaacatgcatgcaaagcacaatgttgctgggcaggggacccccccgcctccaggatactttcagacgcatgcaggttcacagcttcaacccacgcgccaccgtctttccacacacctcggcggagatga

SEQ ID NO: 543 - DNA, 366 bp, Chlorella protothecoides
atggtggacgtggtgggagtggtggacagcgtgcaggactggacctctatcaccaagcgtgatgggggcgagacgcagaagcgctccatgatcatccgggacgagagcgggcggtccatcgaggtgacgttgtggggcgcctacgcgctgaccccgggcgacagcctgcaggccaccaccgccgcagggacccaccccgtcctggcagtgaagaatgcgcgcgtcggcgacttcaacggcaagacgctgagcacagtctcctcctccaccgtgctcatcgacccgccggacgtggccgaggccgcccgcctgcgcgcgtggtgcggcattctggggggaaaaagagaggcggaagcttggtgttga

SEQ ID NO: 544 - DNA, 834 bp, Chlorella protothecoides
accatcctggagcagggcggacagtttgccggcatcaaccgcaaggtccagctgaagccgctgcgctgggcctcgcccgcggagggcgagcccgccgcccgcccgcgcgtggctgaggcgctgctgatcctgaagcacggcggggtgctgacgcatgcggggcggggccaggcggaggcgctgggctccctgttccgcaacatcatgtacccgcagcacggaccgtcgggtgggggcctgctgcgcctgcactccacctaccgccacgacctgaagatctactccagcgacgaggggcgggtgcagtgctccgcggcggccttcaccaagggcctgctggacctggaggggtcggcgctgacccccatcctggtcagcctggtgaccaaggacacgggcatgctggacgcgtacggcaagggcgccagcgaggacatccagcgcgccaaggccgagctgtacgcgcagatgacgctggacccggagacggggacctcacgctgcgccgccccgcactccaccacgcccctggtctccccgcccgccagcccaaagcccgcggagggggtgggcaggggcggcagcgccgagtccagcgtgcacggccaggcgcggtcgctgtcgcgcaacgcctcggccagcgcatccaccatccgcgccgccgccagcgcgctgaagctggcccagggcacgctcgcgggtgaggtcgggagggggaagggggtcccaagggggggaaaagatgggttggaacggcccaggatagactcgggagaggaaggatgtgggggagaagcaccggtgcagggaggggcggtgctcggagaaggttaa

SEQ ID NO: 545 - DNA, 816 bp, Chlorella protothecoides
atgatgcagcagcttcgtcacctctcacacacacaccaccaccacatttacctctgcgccgcagactcggaggcagagggctttgtggagggcgcctccaacatcgaggggcggccccacatcttccccatgcccgagcagccgctggagacgctgaagaccatgcacgtgctgctgggggcgctggtggaggacctgcaccagctgtgcgtggaggagcagcggccgaatgccgacgccgggcgctcctactccgtcctcaaccaggaccccaaggactgggtgttcgaggatgacaagccgtgcagcggcgagcggctgctcctgctgtacgatcgctggcgcaagctggccaaggccttttacagcgagaagaagagccagtttgacatcagcaaggtgccggacatctacgatgcggccaagtacgacgcgatccacaacgccaccatcatggggcccaagatcaaggacgtctacctggtcagtgggggcgcatgggtgctggattggacgctgctgttctccttgctttctgcagtcccttcagggccactcctcacccatgctccacagacggccaaggtgctggccgatgccgccatccccaacgagtacgggatcgagccggagggcaggctccgcatctccacagccatctgctcacaggtgtggagtcagaggtggaactggacagggtgggaaggcaggcccctggggcatcccagcggcatcgagagtatccaggatggtggaccacatgcctgttgcggcagcaggaagcactgccaccatgccgtgaccgctgaaccatag

SEQ ID NO: 546 - DNA, 786 bp, Chlorella protothecoides
atgtcgggggctgtagtgacgcgaagggtacatgacgccctctgtcgacaccaactcctcgcttacgcacgaatgatgagcggggtggcgtctctggataccttgcccagcagctctggcctcgggaggcctcacgtgcgcattccatacgagggcgtccgtgttgccgcccggcaacaaccctccgccaatgccttcctgccttccttcaaagccctgctggtggatgcagcagggactttgctgttgccatccgagccttctgcgggggtgagcatcgcatgcggagagcgccgagatcgcatggggtggtcgggcttgttttcggattggccatcagcgggctgccacgaccccgacttcctggaggaggtgtatgcctactttgcgcacggcgacgcctggcgagtggccgacggcgcactggaaagcctgacccgcatccgcgcctcagggaccaagctgggcctggtctccaacttcgacacccggctgcgccccatactgagagagctggggctggacaatgtgtttgatgccgtgctcatctccgccgagatcggcgccgagaagcccaacccctgcatcttcgaggccgcatgtgaggagctgggcgtgcagcccgccgaggccgtgcacgtcggggacgaccggcgaaacgacctgtttggcgcacggcgggcggggtgctacgcctggctctgggggcaggacgtcagctcctttgccgacgtggagcagcgcctgtccactgggaacttcatggacagcctgacgggggtttga

SEQ ID NO: 547 - DNA, 1629 bp, Chlorella protothecoides
  modified_base (19)..(28): a, c, t, g, unknown or other
  modified_base (419)..(428): a, c, t, g, unknown or other
  modified_base (678)..(759): a, c, t, g, unknown or other
atgccagcgctgtctccgnnnnnnnnnnttcggttgaatgcatgccactttgagctgcccgcgaagcagcatcagtgtccttctggcttttggggaactgggtccctggtgggtatgaagccaggcaccaagttgcccgcctccaacaacttcattgcaggagctgaccatgccagcgctgtctccgaccatggcgcaaggcaatctggtcacctggtccatcaaggaggggcaggaggttgcgcccggggacgcgattgccgaggtggagaccgacaaggccaccatgacgtgagtgcttgcagggcagggatgattgttttcgggttgggtgcagggcctgcgattgccatgtcagaggatgtagtggggtccttcagaatcctcgcccccccccccccccccccaccatcacacannnnnnnnnnattgtggggttcttcagaaccttcgggggccccccctccccaccaccaccatcacacatcccccaaaagccagtcaaccccctgttcctttgctgccaggtgggagaatcaggacgacggctttgtggccaagcttctggtgccggagggtgcgcaaggcatcgaggtgggcgcacccgtcgcaatcctggtggaggagcagggggacatcgccgccttcaaggactacgcagggccctccagctcccannnnnnnnnnnnnnnnnnnnnnnnnnnnnnnnnnnnnnnnnnnnnnnnnnnnnnnnnnnnnnnnnnnnnnnnnnnnnnnnnngccccagcggtcagcggtcccacgagctaccggctgggccccgccgcccgtatgctcctgagcggcagcggattgggccccggcgacgtcacgcccaccggcccgcatggcatcgtcaccaagggcgatgtcctggcggccctggcctccggtcaggccccccgggccgcatccactgccacggagggcacggagcccgccgcgaagccggctggcaaggagggcacggaggccgctgccacggcgccggccgccaaggaggccgccaagccggcctcaagcgcacccgcgcctgcacaggaccccgctcccgcctcggggcgccggcgcaagacgcgtggcgggcacaccgacgtgcccaactcccagatccggcgcatcatcgccgcgcggctctccgagtccaagtccaccatcccccacctctacctctctgccgacgtggacatggatgcggtggcggcgctgcgcgcaggcctcaagacccagggcctgaagctgtcggtcaacgacttcgtggtcaaggcggcggccggcgcgctggccgccgtccccgccgccaacgcgcactgggacgtggagggggcgagagcggtgcgggacccgggcgtggacatcgccatcgccgtggccacagaggcgggcctcatcacgcccatcgtgcgcggcgctgatgcaaagtcactgccggacgtcgccgaggaggtgcgggagctggccgcgcgcgcgcggcgtaaccggttgaagcccgaggagttccagggcggctccttcagcatctccaacctgggaatgtatggcatcgacagcttctcagccatcatcaacccgccgcaggtggggtggagagggaactgtttggggatatga

SEQ ID NO: 548 - DNA, 642 bp, Chlorella protothecoides
atgccgccagcacacgccaaacacctgtcatgcaatggaaccattttcgcagaggagtcggaggaagaggacaccgctgcagacgatgaggccggcgcaaagtccaggagcagcagcgtgaacgacttctcctctctggatgaggaagccatgtctggcacaaaatggaagggcaagggaaagaagaaagggaagaagaagggtcacggcgatctgtatgctctgctgggcctccagaatgagcggtggatggccaccccagaccagatcaggctggcctaccgaaagtctgcgctgcttcaccacccagataaacagggcatccccagtggggacgaggttgggaagcaggaagcagaggacaagttcaaggccatccaggaggcgtacgagaccctgtttgaccccgccaagcgccgcgaattcgactccctggacgagtttgacgactcgctgccgggggaggtggaatcggcagaggccttctacacggtgtatggccaggccttctcccgcaacagccggtgggctgtgcaccagcccgctccaacgttgggggatgacaccagcagctatgaagaggtgcgagccactgtgctgtgttgtcgatgctgggagttggaggacgttgcgaagtgttga

SEQ ID NO: 549 - DNA, 180 bp, Chlorella protothecoides
atggcggtgggggccagtcggacggtgacggtcatcggcgccgacggcgcgctcgccaccaagtcggtcatgcgggtgacgctgtccgcagaccaccgagtgtacgacggcgagattgcttcggacctcctggccgccttcaaagccaatctggaggctcccttcaagctcctgctctga

SEQ ID NO: 550 - DNA, 687 bp, Chlorella protothecoides
  modified_base (58)..(67): a, c, t, g, unknown or other
atgcagcctgcggcgcatgcggctgcaagaatcctggaaggcgctgaccgggctggcnnnnnnnnnnccccatctcgtgcctggcataccagtgcgccattccatcatcctaggcactaccaccatctcccctcaccgtgcagcctgcggcgcatgcagctacgagaatcctggaaggcgctgaccgggctggcctcgcggctcgcggcggaggccggcgcaccctccccacccaccgaatcagacttcctctgggcccacgccgtgttctggtcccgggccatcgccttcccctgcccgcccgaggcgctgcctggtggaaggtcaacaaccgccggccccagcccgcaggagggcgtcgtgccgggcctggacttctgcaaccacgccatgcgcccagtcgcccgctggaccgtgtatggcgcggagctcgacggcgcgggcggcggccgtcgccacgtgcacctggtccccagcgtcgcgccgcccgctccgggggccgagctttgcatcagctacggcgacgacaagtccaatgaggagctcctcttcctctacggcttcgcgctgccggaggccagcgggctcgcccgcctgatgctgcccctcccgctgccggccgcggcagaggactggacgccgcgcctgcacgcgcgcgtggcgctgctggcggcgcgcgtcctgccg

SEQ ID NO: 551 - DNA, 1197 bp, Chlorella protothecoides
gccgcgcccccggactcgctgctgggcaggttctccctggcggcgctgcacctgcgcggcgcgcgccgcgtcgccacggcctggaacgcgctgctgcgcacgctgcgtttcgagtaccttgagcacggcgcgggggggcccggcggggggggtgcctcgcgcgaggggggcccggtggacctcggcgccgcgctgccgcaccagcacctgcagctcttccagctcagcgtggcgatgctgcgcgacgctgaggacggccccgcatgcctggccaggcgcgcctcggacggctcggagacctcggcctcctccctcttcatgtctgccggggaggagggcgtcgcggatggcgatttgggaggggtgggcccgctggacgctggcatggcggacacggaggtggcggaaggcggcggggcgagcggcggcggggcgagcggtggggatgagggggccggctcccttgatcgcggctgggaggacgatggtctcgaggatggcagcccagcgaagagcgggtcggcggagcgcgacgatcctcccgtcttgcagacacgagcgcatggctcgggttccgccgccggccgggccctcgagcgtcctggcagtgatgaggcgagccataccctcgctgccgtgcctcagggcgtggcttccattctccccggcgcgtacctgctgcaccacccagacgtcccactggccgtgcccgagacccaggcggcgccgccctgcaccgaggaggcgctgctcggagcgggtcccagcagcggccaaggagaggatggcgggggagtgcgcgcctcgcacgccgcgctcctggcgatggccgccccgggcaacgcgtgggcggcggcctggcagggcgcgcgcgcctgccccgccgcgcggcagcgcccgctgcaccagccccgccgcgaggcggagcgcgctctgcacgcgctggagacggtcctgcccgagcacttctggcgcgcgctgctggcggtggcgcgcagcaccgcgctggcggtgttgcaagccagtgaagtcgccggcatggcgcccgtggccgggcagctggagaggtatgcagtgaaaggggtagggggcggacactggacggcacgtcgaaccgcagaggggtggccgagtgcagggcccagcgcgcggctgtgggaggaccccggggacgatgcgcttcgattctcgagatga

SEQ ID NO: 552 - DNA, 366 bp, Chlorella protothecoides
atggcagtgtatgcgaatgcgtctctcggggctcggcagggctggggccagtgggcagcgcagaagctgcgcctcccattcgccccccagcctgtcagcctggccgccttcccgctgtccctggccctgaccggccagtccgtggccgccaggtccccctgtctgggggctggaatggattcgggggccgtcgacgagcgcgacgccgttatcctatacctggcggcgcagcgccggctcggtccggcctcgcagttgcatccctggctgcgcctgctgcccaaaaccttcacgaccacgctcttctggaaggacgaggaggtggagtggctggcggggacgacgctgcatcgggccacgctgtga

SEQ ID NO: 553 - DNA, 1863 bp, Chlorella protothecoides
atgtgggactccccttccaggccgggatgcctccttgcgttgctcaggcctatacacactctcacccacgccccgccctgccatcactgtggccgagtccctccccctccatcgagacgcggccagcatgaaacattactgttgtggcgagagcagaggggccactcctctcctgcccgctgttcgagttcccaaaccttcccttgtgtgcaattgcgtggcagtgttcaaatttctcttgagggcaatgagtggcttgtcatcccgctgactctgtactcctttacgacacgctgtctgctcgagcggggccatgggttgcaggcagggaggatgcatgcaacactcattcctgtcgtcgacagaccagggtgtcgagccgacaatcaggaaattaagaagcgcagcaccaaagattgtacctcattgcgcggctgcttcctgcgccgctcttcgtcgctgcatggccgccgcaaagtcggcctgcagccgcgtcttgagcaggggggtgggggccgagtcgccccccgccgccctcgccctcgccacctccaccgccgcggggctggccgtggcggcgaggctggaggcgttcctgggggtcatgcggggcagcaccagcccggctcccagggcggggatgcctcccatggccgtcacccggctctccaaagagcgcaggctgaccccaaagggtgtcgtgtccttgctgtcctcgggctgtgtgcgggagggggtctaggggccttacttgagaagcctggagcagttgtcgctgaattccacgtgcagcgtgctcgggaacggggaatggcatcagaatctggaggtaacgagacgtcctggggagccacgtcaacaagtgaaccccgcagttctattgtcaaggatatgctcacctgggagcccgacacgccaggctcctgctcacaacccagcagtgcgtcccactcccgcatctgctcgcggtggctggcgatgaagccctccctctggacagtcaggaaggaggccaggtccgagcgcggaacctcggagaggtgcgagaggctggtgtctacctgcctctgcagggactctagtgacatcatcaaccgacgaagactttctttcgcctgcgctctggtcacgccggggccggggggtgagcccgagccgtcggtagaggccatacctggcagtaggctacacgacagcctcgggctgccgtgcgggagagtgtgttcatcatcccgtcgtgctgtttattccgtccgtaagctctcgtcaaacatcccccggtggaaaggcgggatccctggttttgtcactgcgggtcagagccaaggcgttcgcgaccttgttccggcgtgcttcttcctttacacctcctgccgtcgtgctcatccgcgctgcggctgcctgggcgagggggtgacgcccgccgacaaccctgctgcagatcaagcaggagatggcagtggccttcctcaacgaggtgttccaacgcctagaatgcgcattcatggggatgctggttggcggtctcaggttgcagggtcctcgacctgcgcaccaacgcctgccccgtctcacatgccgacacgctccattgacttctgctccagcccaagtatcttctcccttacccttctatttccacagactgtgcgagacaagtgctttggcacctgcgtgaccaagccgtccagcagcttgagcagcagcgagcagcagtgcttggcacggtgttgtgaccgatacgctgaggtggggagcaccggctggctgttctgtcgaggctttcagcgctcaggccacccaggtcgtcaccaaggctaccctggagatgaatggctaccagtgatcctttgctgtttttga

SEQ ID NO: 554 - DNA, 735 bp, Chlorella protothecoides
atgtcggctggggcgggatgggcccacggacggtccacccgctccctacgctcactgcttgagcgtgccatctggttcgccaaggccgcggctgccatccacgtcttccgcaactacgtcgcggagttcacagtggtagacggtgacgggtgcgctcttggcccatgccccaactcccttgcaccaatggaacccccacacgctggggcccctgcctccctgcagcccattggactcagcatgagccccaccttcaacacccatggcgacgtggctctgctggagcgcgtctcggtggccacacgcagcatcaaggtgggggacgtggtggtggcgcgcagcgtgcaaaatgtgcggcacatcgtcatcaagcgagtgctgggcctggagggcgatgtagtccccctgccggggtcgaccacggggcgcagggtggcggtggtgcccaagggccatgtctggctccagggtgacaacttccacaacagcacagactcgcgcacgtatggccctgtgccatatgccctgctacagggcagggttttcctgaaggcaagctggggggtggaggtacatgctgacctagattggtggggtgtccttgaggctgtgggcctggtcggttcttgcatccggcaatttggtggtcaagcgaagatatggccaccacaggatgcagggtgggtccgcagcgggatcccagattacatgttccctcacggaactggtctctga

SEQ ID NO: 555 - DNA, 255 bp, Chlorella protothecoides
atgtgtgaagccctctccaatggagccatgtactcatcaggcccccttccacctcctgcagaccgcgccaagttcctgggccccttctctgagggtgtcaccccctcttacctcaagggcgagtaccctggcgactacggctgggacaccgccggtctgtccgccgacccccagacctttgcccgctacagggacatcgagctgatccactcccgctgggccctgctgggtacgctgtgctggtggggtttgtga

SEQ ID NO: 556 - DNA, 765 bp, Chlorella protothecoides
  modified_base (330)..(339): a, c, t, g, unknown or other
atgtattctcagtgctcttccctcctcccttgtgctcgttcctcccaaccattatgggcctcatcgttcttacacaaaattgaagctacgcaaaactgccatcaccccaaagctcacggggaggaccaatgggaaccaaggaagaatgcacagctggatcaaaccgactctggctgcctggctggccacccgcctgatatcttcacagggcgatcagtgagcgagcagagcatcttgaatggagacgcaaaggaagagagcaaaaccttcttaaccgcctgcggttgtgtgtggtggggagttggtggcggcggcgaagccgttgttgtnnnnnnnnnngccggtgacgatggcctggacgaagaagccgaagttggcgaacatggcgaggcgcccgttcttcagctccttcaccttgagctcgtcaaaggcgttggggtcgtcggccaggcccagggggtcgaaggggccgccggggtactgcttgtcaaggtccaggccgatggactcgccgccgccggagcggtaggcctccgcgcctcccatgagcaccacctgggcggccagggtggccacgatggactgggcgtgcaccagggaggggttgcccaggtagttcaggccgtcggagccgaagatgccggagccagccttgaaccagacggaggtgtcgccggggaaggcgacggcgccgttgcgctgcagcagctcagggacgaggatgccgagggctcctggagagcgtggaggagagtgggagtgtga

SEQ ID NO: 557 - DNA, 837 bp, Chlorella protothecoides
atgaaggctgtcgcctacgactgtatttcgcagttcaacctcctccataccccccaaccccaaccaaaatcaggcctgttcagcgccacgcagaccgaggccgtccaggccctggcgagggcgggcctgcgcaacgccgtgcgcgtcaacgtcgcggtgtctcgcgcggccgccgccccgcggcccgatgtggagggcgtcgccgaggcggcgggctgggaagcggagctccagagggatgagctggagcagcggacgccgggcacgctctccatctgctaccacattgtggaggccgtcgacaagctcgctgtcctagcccactttctgcagtgtttcagtcacgtggccctatacaccctccttgatgcccctccctgcaacaccccccacccccccgcccatacaccccacgccaacgcacaggcccaccccgacagcaagattatcgtctacttcctgacctgcgcctgcgtggatcacgccctgctggcgctgggcctgctgcccgacacgcgcggcctggccgtcagcgcgctgcatggtcgcatgaagcaggcggcgcgagaggcggtgctggaggcctacgcggccgccgccaccggcgtgctgctctgcaccgacgtggcggcgcgcgggctggacatccccgacgtacactggatcgtgcaggccgacccgccccaggaccccgccgccttcatccaccgggtggggcggaccgcacgcatgggccgctcaggtacatggtgggagggggcggggagcctggtggcagtggtgagtgtatgcgtgtgtgatcacgcttcctgccggcaggtggaagggccgggctga

SEQ ID NO: 558 - DNA, 480 bp, Chlorella protothecoides
atgccggaggtgaagaaggcgggaatcaggttggccggcttcgagccctccgccatagatgtggacagcagtgagcagggtttgttggcgggtggcgatgcgcaggggattgagttgggtcgtgtcaagttcaaggacaaggcgcgggagaagcagcggcaggcactgctgaagaagcgggaggcggaggggccgcgggagtccgccaaggcggcccaccgcgcggcgcagcaggccgcccgccaggcggctgctcgccaggcgaccgaggcggtgggggcgggggcacggctgacggccgccaagcggcgtgcactcgaggcggcggatgaggcggaggagttggccaccgagtacaccatgctgaagaagctgcggcggggaaagatctcccaggttggtttgggggagttggggagtgcttggaggtcagtctttagaagtgtttcctgcgggaggaaggccaagggacgcaagtga

SEQ ID NO: 559 - DNA, 252 bp, Chlorella protothecoides
atgacccaagagaagcgcatggtctggagcaccgtcctctgccaggagacagcgacaagatatgccttttcaccatcctcccccttccttccattcctatgtgcagtggagatcctggtgctggacgaggcggatcgcctgctggacatgggattcaaggtccagctggacgccatcatctccgccctcccccgccagcgaaggacaggtcagcgcgggagaatgttggagatgaacgccaaagattcatga

SEQ ID NO: 560 - DNA, 819 bp, Chlorella protothecoides
atgcttgcccggctcaaacccgtcgatgtgagtcggtgcatcgtggcatggcccaggggcatgcagggggccggtggtgtcgggccgtgcctccgcccgcattctgccgagcctgcgaaagcttggcgccgccgagggctggcactgggcaagaggctgcgccccaccacggtggcgtactttacctccgcagcactgctcgtcagctacatcgcctgggcctccctgggcgccgccttcacgccggtgcccaggcacggacaggggggggatcacatccagcaccccccgcacaaggtggccctgctcttcctttcacggggcagtctgcctatggagccggtctggaaggagttctttgagcatgccgcgctgctgcggcagtcgcccgggcccagcctaggcaggaagacctgggaggatggcgggggccgacgccacgccagaggcaaggacagcgcaccttcctcgatcgatcgcatcccacgggcctccccccaccccggcggccgctctgctgggcagaggacggcccgcgaggctgccctcccacaggacttgcgagccctcctggatgaaagcaccggcctcctccgtctcccagacacacaggccatgctttccagcgataaggcagcggaagtccacgacacgcacaacgagctggcctctggcagcctggaggccccattctcggcgctgagccccctggatccgcagggccccgtcgcgcgccaggacctgttctccgtccacacccacacccgcgccgcctttgccttccccccaggtacagggtggggccggactggagcctga

SEQ ID NO: 561 - DNA, 408 bp, Chlorella protothecoides
atgcacagggagcacattgagggaatgggcgccatcgtcgtgaaggccgacgcagccagggcggatcagatagatgcagccatggctggaatcgatggactgcaggcggtggtctcgaccctgggcagcattgctgagcctggcacgtcctctggcggcaccctgggcacggttaacctggtcagggcggctgctgggctttctgtcgagaagtttgttctgctgggcgccggggaagcagtggaccacttcaagatctacgatggcctcaattatgtcatcatcgagccgcgcagggaaggccctgcctccgcccaggaggtggcgcagaccctggtgcaggcccttgtgacagatgcagaggacggcaaggtggtgccgtccagtggtgcagcatccagtgcgtga

SEQ ID NO: 562 - DNA, 264 bp, Chlorella protothecoides
atggctgggcgcgacttccgggaactgggcggaatctcctccgagacgctggccgtcctggacaaactgggattccgcacggctacgcccgtgcaagaggccaccattcctctttttgctggccacaaggacgtggcagtggacgcatgcaccggctcgggcaagactctggccttcctgatccctctcatcgagaagatgaggcgtctcgaggagcccctgacgatacatcaggtgggtggcgggccgggcatcgcgaggtag

SEQ ID NO: 563 - DNA, 387 bp, Chlorella protothecoides
atgccaggcgacgcgctgctgctgctcatgccgcatgaggattcctacgtggacttcctaggggtgcgcaaggtgcccctccgccccgcgaccccggcggtgctaggtaccgcggccgcggatggcgccgccaccagcgcgcggctgcgggccgccgcggaggccgaccgcgctttcatggaggctggggtcaaggcctttgtgtcgtatgtgcgcgggtacaaggagcaccactgccgctacatcttcaggatacaggcgaacagcggcgctggccaggcagccaagaaatctgtggcgtgggagagtcgtctgggcacaggcccgcagcaccagggggtagcttcttcgagctcacagagcctgcacctggccgaggcccactga

SEQ ID NO: 564 - DNA, 369 bp, Chlorella protothecoides
atggcagaggcagcacgccccgtgctgcaccttttccgcatcatcctgcgggctcaccgggagaagctgccagctcccatgcgggagctgggtgacacttatgttaaggacgagttccgcaaacatcttcgtggcaagacaacccaagagcagtggcggcagttcatggaggagtggaggcgctatgccgggaccctcgcggcgtcagatgggcctcaggcttcgggcggtgtggccgcagctgacgcttcgggcgacatccctccagagatcctggagactctgaccccagaccagcgggcacggctggcaaagctccgcgcggaggcccagcgactccgtgcagacttgctgggggagtcccgctga

SEQ ID NO: 565 - DNA, 777 bp, Chlorella protothecoides
atgctgcaggtcggcgcctccaacgagctgccagagagtgaagaactggatgcgctgtacgaccgcttcctgctgcggaggcaggtcgcccaggtctccagcgcccagctggggaacctggcgaggctggcggctggctccctgcgtgctacgacccagacatcagctgacggcgccggggcggcaggcggccgcctggagctggcagatttccatggcaccgccagcaccgcctatagcgcggtggaagtgccggattcggtcatcgatctgctgaccaccactcgtgactacctccaggataagtgcgagccgcccatctacgtgtctgacaggcgcttcatgaaggcgatcaagatgctgcaagtggcagcccatgtggatggacggagcgccgttcacgagtacgactgcctcctcctggagtttgtcctggggtctaggcccgatgacagccagaaagtacgagcctttgtcctggagaccattgcctccgaccccggcctgcagcagctggagctggtcttcctgggcctcttcgggcgggcatgccgagctctggaaggcgggaatgagcaggacgtcgccgaggctcagcaggaggcaagccagctggtggagctcctggacctgcgccagggcagcgtgggcttgaccctggatggggggtttgcagatctgggggccaccatctggcagtcagagggcagcgtgcgtgaggcggtccaggttctcacccctcccatgaccgagaacagaaagaaggtgggcggatag

SEQ ID NO: 566 - DNA, 762 bp, Chlorella protothecoides
atgatgatgcaggggcaggccactgtcggtcccccgcgatgcggctccatgggcaccccattcagggcgctccccattccatcaccgagactccctggctctgtcaggcgcagtgattgggttgccaacacgccttcccagactgcaagcaaagcctgcaggtggaagctcgccgcagtgaagtcctcccagaccctggagacggccgacaccgacctcatccagctcatatcggacatcagtaaggatgtagactccaggcatgctggtctgctgagggacgccaagggtgccacccccgatattgaggggctggacagctcattgagagggaaggcacagaccgccatcctcagcctccagtctggactgctggaaagggagaccgaggtccgcctcctactgctagcggctctgtgtggcgagcaccttctgctcctgggcccccccggcacggcaaagtcggagctgagcaggcggctggcagagctgacgggcgggcgctactttgagcgcctgctgacgaggttttcggtgcccgaggagttgtttggccctctgagcatgaagggcctggagaatgatctgtatgagcgccagacctcggggtacctcccaacggcggaggtggccttcattgacgaggtgttcaaggcaaactctgccatcctgaacgccctgctcaccatccttaacgagcgcctgttcagcaacggcagcgcaaggttggaagtccccctgctgtgcctggtgaggaagtga

SEQ ID NO: 567 - DNA, 1062 bp, Chlorella protothecoides
  modified_base (61)..(70): a, c, t, g, unknown or other
  modified_base (842)..(851): a, c, t, g, unknown or other
atgtcctgcaagcctccacccctgggcctcccggagtgggttggctcctccggcccaccannnnnnnnnnagggaacttttgatgtcctgcaaggctccacccctgggccttccggagtgggttggctcctccggcccaccatccttccccgcgccggaaccttgagagcgcaaccaccagcaaaagtacgggttcggcatgacccaaacggattctttcgagtgaactcaagatgtgtggtcggtgatattcgggtcagcatgcagtccgggagtgcatgcctctccctgccactcgacaggcaggcgcggaatggaggccgggggagcaaggcgctccccctggcctccgccagatctcaattaccggtgctgacgacagtacaggagcctgtggcgggtctcgcggaggtagaggatccccagtgtcgcatctgctgggggggaagtgatctggagcctggtgagacggaagctgtggcggattgtcgcgagggcaacccatgcacggcatgccggcggagcttagcttgccctgcccatgcttctcatggtcctgtgcatcactcacccagctccctctcgatcacgccaggtggtcgcctgctgaccccatgccaatgtcgggggagtgtggcccacgtccatgagcgatgcctgagcgagtggctcaatcaggccctgctggtgaaggccccccaccaggcctactcctgtgacctgtgccaggcatgttgcgcgtgcacgagcagtgtttcagatgctcctttcggctccattcaggataatatcatccacatggtggtgcatgcatcatgctcttcatgcttcccagccctcannnnnnnnnncctccttttggctccattccggatgatatcatccacatggtggtgcatacatcatgctcttcatgcttcccagccctcattgttaagcgcctcatgtccccttccttcacaccctcccatatccaggctccgtaccatgcgacccgctccgctttcctccctcagctcccgcccctgcggctgcccttccagggcctggcgcgggagctga

SEQ ID NO: 568 - DNA, 354 bp, Chlorella protothecoides
atgcaggcaagcatcctgagtacgacacggtgtggcccggcactggccggtgtgccaccagcccgtcccggcgccgtggcccgcggtcgctcgggccgtgtggccctgcgcaccgtcgccgcggtcaaggatgtcttcatgcctgccctatcctccaccatgacggagggcaagatcgtgagctggctgaagagccccggcgacaaggtggcaaagggggagtcgatcgtggtcgtcgagtcaggtgggtggcttttcatgctcatggggatcgcggccggaagagcacttttgaatggcttgtgttggttcatgggctttacctcctctgatcagcccctggtgggttggtaa

SEQ ID NO: 569 - DNA, 1131 bp, Chlorella protothecoides
atgcgcagggtgatcgccacgccgtatgccaagaagctggccaaggaactgggcgtggacctggccaccatcttcgggtccggccccaacggccgcgtgaccgccgctgacgtcgaggccgccaaggccggcgctgcggcccccgccgcgcccgcggctgcccccgcggccactcccgctgctgcagcggccgcgcccgcgcagggcaaggcggcgccgtccgcaccccctgcagccgccgccccggccaccaagggcaaggcggcgtcgtccgcatcccctgcggccgccgccccggccaccaaggtctcggagctgaagggcacgacggtgcccctcagcggcctacagcaggcggtgagcaagaacatgctggccagcctggcggtccccgagttccgggtgtccatgaccatcggcactggcgcgttcgatgccctgtaccgcaagctgaagggcaagggcgtgagcatgaccgcactgctgtccaaggcggtggcggtcgcgctggagtcgcaccccctgctctacgcctcggccaccgccgacggcagcggcgtgacctacgcggaacacatcaacatcgccaacgccgtggccatgcccgacggcggcctcatcacgcccgtgctggcggacgctgacgcggccgacatctacaccctctcccgctcctgggccgatctggtcaagcgcgcgcgcgccaagcagctgagccccaatgagtactccagcggcaccttcaccatctccaacctgggcatgtatggcgtggaggccttcgatgcggtgctgcccccaggcaccgccgccatcctggcggtggggggcagccgcccggtggtcactgccggcaccgacggccgcattggcgtggagaagcagatgaccgtcaacctcaccgcagaccaccgcatcgtctacggagcccaggcagcgggtatgctcaagggtggtgtttgttttcttggagaggagggcggggtgggagatttgcatgccctgcgcaccatggggctgagagtgggtatcactcctgacgttcttggtcgctcgtcaccatccccggccctgctcacctcatcctcaccaaaatcctctgacaacaacgccgcgcagagttcctggtga

SEQ ID NO: 570 - DNA, 324 bp, Chlorella protothecoides
atgcctgcagatacgacccagtgccgcgccgtttttcaccgtgcgaccagcaggagcacagcagttctccaggtaagatacatgtcgtgcccgctgaatcctgggtccgggcatgcttctgagtgtacccgtgagcatgctatcccctcaaaaacttgcatctcatcatgccgcagggtgcggttccagggctcgaggatgccgaggaggcctggagctgggtcctctgtgggctctgggtggatggacatgcccgagtccactcctctccctgaagacattcaagtctttccgcgactgaaggagcgagatccttacaagtag

SEQ ID NO: 571 - DNA, 2061 bp, Chlorella protothecoides
  modified_base (74)..(83): a, c, t, g, unknown or other
  modified_base (853)..(862): a, c, t, g, unknown or other
atgcaatatcccatctgcctctgcctgcctatccgtgtatgccatgcattgtcgatgagcgagaggggataccnnnnnnnnnnccatcctctgcctgcatatccgtgtacgcaatgcattgtcgatgagcgagaggggataccccatccgccaatgcgcccagcatgcggcgcaggcacctcaatcggctatgcttcccgaatcatacacctcgcttctaggagtgttgaggaattaataagtgtcggcagagttggccgcccacttggagcgttcgggctcccctccctgaggtggcgagtccctgtggttggcatgagcgcatcgcatctagatgctgatgtaactatcgatgcagtccttgctgcaggtggtgagacgactacctccgaggtctgctctacctcatataagactgattcacattcaaacaatgcagcttcatgtgatcctgctgtaatctggacagagggtgtccggcacttgctgagcgagggcctgggccctgcccgcttccaggcggccacgcggcggctcagggtgcctcctctcaccacctgcctgcgcgtgaactcggcccgcgccagccctgctgacctgctgcgcctgctgcgcggcgcggccgaggcgcagggcacgcccgaggcggcgctgccccgcctgcaccccctcatccccgaggccatcctcatcccgggcagcgggccccacagcgtcgactactcggccgcaggtgctcgcctggatcttttgatcggcggggtctggggtgcaaccggctgtactgcaccagactttgcctggctctggttgcagcctgccggacacggctgcctgcactctcgcagcgatnnnnnnnnnntggggtctggggtgcaacccgctgtactgcaccagactctgcctggctctggttgcagcctgcaggacacggctgcctgcactctcgcagcgatagggtacccccaaaccctcctcctgctccacgtctcacctcaccgcccctcctgcacgtactgggactgcgcagagggccgagaggtggtcatcgtgcgcaaggcgggggaggcggtgctgcggggggccgacgtgtttgtccccggcgtgctggccaccacgcccggcctgtgccccggcgacgtcgtcgtcgtctccatcgccctggagcgccccgggtcggagcgatacggcatctcgcgcggctaccgcctgggctcggacccgggcctggaggccagcgcgccgccgcgtgtccgcgtcgggctggggcgctgcctgctgtcccgcgccgacatgttccggcacgagcgcggcgtgggcgtggccctcgtcgccagggtctaccgccccggcgccccggcctgcgcggtgccgcccggcacggccatgctgcagaacctgcccagcctggtggcggcggcagcgctggatcccgcaccagggtcgcgcgtgctggacatgtgcgcggcgccgggggggaaaacgacggcgctggcgggccgtctcgcggcggcggggcaaggcggcaccatcaccgccctggaccgctcccacgtcaaggtggcgcacatccggcgcctggcgcgggaggcgggtgtggaggcgctggtgacggcgtaccgcgcggacgcctgtcgctgcgtgcgggggctggcggcggggtcgaccggcgcgggcgagcggggggcgacctgcgccaaaggtgcggggccggctgccgagcgggggccgtcgagcgggccgccccagggagacgtcgcgggggcgagacatcctcccgagtcccagctggccgcgcccatcagcgagggcctgcggcgacgcctggagcgtcaggcgctggcgcgtcagcgccacggccagcaaccgatcctgtcggcgcacacggcggaggtgaggggtggtctccggtggggtgctgctgggcccgctgagggtgggcctgcagcgccgcatgccacagagtgccgctcgcgcagccacgcatgccgccgcgcgtgtgctgatgccctcctcgatgcgcgcatgccctccctcatctgcccagggcagggaggctga

SEQ ID NO: 572 - DNA, 1050 bp, Chlorella protothecoides
  modified_base (333)..(382): a, c, t, g, unknown or other
  modified_base (1017)..(1026): a, c, t, g, unknown or other
atggacagcctgggtgcacgtgaggtggctgcttccacgaggctgctgggctatgaggcggccggcgcagctcagcgcctggacacctgccgggggttgagggcgtgggtggcacgggccaccggcaactcggcgaccagcgcgctgcccgatactgagcatgctgccgccgccacgcccccgcccggcatgggggcctcagctcctaaatcagttgggaagaacgccgggccggcacggcagccggcggcagtcccccggggacggaacggcctggccatccccagcaccgaggacttcaaagtgacctttgcggcagcagcggcgggccgnnnnnnnnnnnnnnnnnnnnnnnnnnnnnnnnnnnnnnnnnnnnnnnnnnccctggccgccgtgcagtcccagggctcccaagcctggcatgaggcgcgatcagcacggctcactgcctccgccttctcaaaggcactcgggttctatccaggtgggaagagcagggtgggacagactgtgccgggcctgggctttgtgagctcagaggctagctgccgctttggagtaagacctgcgcggcctcaccctctcaccttgccaggagtgcgtcgacagctgtgccgctaccttccctttcgcagcccaccagtgacacgagatcgtgagacgctgtggaaggagaagctgggcctgctgcctccgttccaggggaacgatgccacgcgctggggcactggggctgaagcaagggcgctgcagtcctaccagcgcaacacaggtcggtgcaatgtggatgccattcgcagtgtgccgagggcgtgccctccaaagcctgcatttcccgtcctgaatgtctgcggccctgggatcaggacgcctttgtcaccatgcgcgcacccggcgggccaactccccagcgacttgccccgctctgtcccacagggtatgtcgtgcagggctgcacatttgccgtcaaggcggatgatgcggtgcatggctggctgggcgcctcgcccgacgggnnnnnnnnnngaagcctgcatttcccgtccttaa

SEQ ID NO: 573 - DNA, 2472 bp, Chlorella protothecoides
  modified_base (1460)..(1469): a, c, t, g, unknown or other
atgcgcgcacccggctggccaactccccagcgacttgccccgctatctcccacagggtatgtcgtgcagggctgcgcatttgccgtcaaggcggatgatgcggttcatggctggctgggcgcctcgcccgacgggctggtggaggccggggctggacccccgggactgctggagatcaagtgccctttcaacaagggtgccccagaggaggcctggccgccgcagcatgcgatctggtactacatgccccaggtatggagcacaggcccggcgcatttgtctgcctgcaaacgcacgaaatcccgccggaagactgtcacctgccagcattgtcctcccaatacacgcccctcattatccccattcaatcccttctccatggcccgtctcccctgccacactcccccctacccagatacaaggacagatggagatcatggaccgggagtggtgcgacctgtatgtctggactccggccaacggcgccgctgccttccgaataccgcgagaccgggcctactgggcggcctgcttcgacgtgctggcggagttttggtgggcgcacgtggttcccgcccggctggcactggatggggggagggaggaggggctggagggcatggcacccccgccgcagcacccagccacagagtggctgaaagccgagagccatgccatcactgctcttctgaaaactcaaggctggttgggcttgagcctcatctgggtattactcctccggctgccactggccttcagacccagccgacctgcgcattggggggcgatcacacttgggtccgtcctcctcctcctgatcctgggatcgcactcgcttggaagccctggacgcctcctggccctgaccatggcgcatccgatcgtgctcaggaactccaatggcacggaggtggacatcctccccctgggcgccatcattcagaggctacgggttgccgacagggacggccaggtggccgacgtcgtcctgggtttcgacagcgagacaccatacaggaatgtgctgcaagcctcgatggttcggaggctgacagggcctgtttcgatggtgcacaggatggcacctccccgtacatgggggcagtggtgggcagagtggccaaccgcatcgccaagggccagttcgagctggacggcgtgacgtacaagctgaatatcaacaacggacccaacagcctgcatggtcaggatgagggggggaagatgggaaatttgcgacacacgagtgcaggcaatcaccctggttgtcttgcggcaagaatgaagggcgtgatgtgtggtgcatgcgttcatgttcctgctgcagctgcaatcaggcaagtccgtcctgctggagtatgtcagcccagatggggaggaggtgaggccaatggggcgaaagagctgctgacggatgggccgcttgccctgccgccacaactacccgggcacggtgactnnnnnnnnnntaggctgtccactctgatgtccttgctttctccccctaatccccatcccccagaactacccgggcacggtgactgtcagcgtgctgtacgagctcacagacgccaacgagctcaggtctggcacgatcctggatcaccagctcaccatccatgggtgggtaggcttcatggtgctggtggctgggcactaacttgtggtgggacccggaaaggcagtgacaggatggtgggcgctgtgcactgcatgtgtaccttgggaggcggccctcgcggtggagcagggaccactacacccctgtggacgagacccagatcccaacgggggagattgtgcccgtggcggggacgccgtttgacttcaccaccgcacagcctgtgggccagcgcattgccaagacggagggtgcgcgtcggcgagggcaggctatgggctggacattctgtggtggatccagttggacaacacacggcccagaacatgtctacattcacatcctgcacagtgccgccttcccccccgcctgaacgtgcagggggttacgaccacaactacgtgctgtttggcctcggaccggctgccaaggaccgggtcaaggacggcgcggcattctctgtcgccaagcaggctggaagggcatgctcctgcgctgccgccaaggagggaaggatcgacagctcgaagccccctgactctcccccgccgctctgccactgcagcccgcagccagccatcaccctggtcgaccctgcctctgggagggccctggaggtctgcaccaccgcgccgggggttcaggtgtactcgggtgagtctgggagccctcgggctgccagcgccagcctggtgcaaggaactcgtgccaccactctaggccagagcccggagggcaggagaccgcatcgtgcccgatgcctcgtcgctcctcagacgcctggcccttccgatcactgcccctccccgcccccccctgacccacaggcaacttcctggacggcaccctga

SEQ ID NO: 574 - DNA, 441 bp, Chlorella protothecoides
atgagcaggctcaagggcttcagcaaggcaggatccgttcgcatatcaaatctcaacattatgggtctctcgatcagtgccgtcagtctcaactccctggagatcatgacacgacgctccacagaaatcattgtggccgtggagtgtctcaaggcaggccagaaggcttgtacggcagacagcaatggcaacatcggctctggcaacaagggcaagaacaaccttggcgccaagaacgttggagacgacaatattgggaactccaatgtgggcactgctaactggggagatggcaacaagggtaagggcaaccgctgcttcaacaagactggggatcgcaagaccatcaacgactgcagcctgctcgagttccggaagtacgcgtgggtcattggcaatccaccgcctcccaccaagaagtccccacccccacccgccaag

SEQ ID NO: 575 - DNA, 273 bp, Chlorella protothecoides
atgtccctggctgcccgccgcgcggcagtgctgccacatgacccggaccttgcattctgctactccatgctgaataagcaattgccggagcagctgcgggacgcggtgtgcgtcttctacctggtgctgagggcgctggacactgtggaggacgacatggcgattgaccaggccgagaaggttcccatcctgctttccttccacgagaagacctacgagaagtgcgcgtggcaggccgcgttgttggggggtgctgccgctggaggcgcatga

SEQ ID NO: 576 - DNA, 405 bp, Chlorella protothecoides
atgctgggcctccagctgaattcccctggtcctcttgcacacgagcttgggctgcatcctttgtccccggatgtaggcctggagagcgaggagtttgcctcgctgcacgagctgtccaacggcatggggctgttcctgcagaagaccaacatcatccgcgactacctggtgagtcgcgggtggactggaggagcacaggcaccaggtctgcgccctgttgaggcgggcccaggcgggggactggaaggccctcagcctaatggagaggacatcatggaggagccagcgccccgcatgttctggcccaaggagatctggggcaagcatggcgacagcctggaggacttcaaagatccggagaacgccgaggcggcggtcgcatgcctgaatgacatggtacagtga

SEQ ID NO: 577 - DNA, 360 bp, Chlorella protothecoides
atgaagtgtgggcacgggcactatgtggagctcatggagcagtatcctgtcgtctgcgccgctttccaggggctggagccccagtaccaggaggttatcaccgacatctgccggaggatgggggctggcatggcagagttcatcgtcaaggaggtagggcttgctgcgttgcggtgggggaaggaaaggaatgcgttccggaaagggaagcctcctggtccaggtatacctccccatcttccgtggcaccctggcaccctggcaccaggtggagacagtcgaggattacgacctctattgccactatgtcgccgggctggtgggcgtcggtctgtccaacctctttgccggctcaggtga

SEQ ID NO: 578 - DNA, 1419 bp, Chlorella protothecoides
  modified_base (174)..(183): a, c, t, g, unknown or other
  modified_base (635)..(644): a, c, t, g, unknown or other
  modified_base (1097)..(1106): a, c, t, g, unknown or other
  modified_base (1185)..(1194): a, c, t, g, unknown or other
atgcagtatgtgtacttcgatcctggaccttcagatactatttcgatgggcaaatgcactgtgccggtcgcgtctccacgcaggcgccgtcacgcaaagcacgaccgggacgggttaggcggcttgctgtcgtccgcttccccagccattccgtgctgcggtctctgctcgccnnnnnnnnnntttatgatgtcaagcttactatcagcggctagctgtcgtccccttccccagccattccgtgcagcggtctctgctcgccaaagaccatccgggaggagtgtagcgctccaccccacgcaagccaacgtagcaaactcaaacactaccgatggcgactgggtcgaaattggcaagctgaccataccgcatggcgtgcatggcgacatgcgcgtttcccccagcaccgacttcccagacgacaggctgggcacacctggcatcaggtggctggcacctcccgagaccaagatgcggcgtgcggtgggcgctccacaggaggtcaccctggagagaggaagggaggtcctgtacaaggtgatgcgcgggggatcccagagatttagtttctttttcaacctgttgtcctgccagcagaggattgtcgttccttgtcaccctatcacaagtgactnnnnnnnnnngtacaagggcaatccatgctggctggtgaagctgcaggggtatgactcgccggaggctgtcgatgagctgcgtggccaccgcctcttggtcccctcctcggagcggccgccgttggaggacgaggacgagttctacgtacaggatctggtgggcctgcgagtgctcatgcacgccgacgggtcgccggcgggtaccgtgaccgacatctttgacggcacaggatcggagctactcaggctttcatctgcacctctccaaagcccctgctcccatgtctatcgtgtcagccctctacaaaaccatacccccgcagggacccacgatgtgctgcagatcgaggtgccgggccgccccacctacatgctgccctttgcacgggagctggtccccgtcgtcgacctggctgccggggtcatgcgcatcgagccccccgagggcctcctggacctggnnnnnnnnnntctgcacctctccaaagcccctgctcccatttctatcatgtcagccctctaccaaatcatacccccgcagggacccatnnnnnnnnnnccgtgtcggggcctgaccccgacgaggacggggccggcgagggcggggccggcgagagtggagcgggtgaagccgcgccgcgccggcggcggcgccggcgccaaagaaagggaggcgtggccgaggccgccccagccctgttggcagggcctccagagggcggcgagcgctcagcttgactgtttttttgcatcggcgggcgtgctctcactcgcccttctttga

SEQ ID NO: 579 - DNA, 858 bp, Chlorella protothecoides
  modified_base (296)..(360): a, c, t, g, unknown or other
  modified_base (415)..(424): a, c, t, g, unknown or other
atgaccagcgaagtggcagcagggccccgtcgggcgcccctccgagtcatcgttcgggaagggtcgagcattgtgagacacttggactgcaaagttgaccctggtaagaccaacaagccgcaaaatctcaccgtgtctgtggcgggcattccggcagacctcactgagggcgggctgctggagctctttggcaggtttggggaggtgcagaggatagcgctgcacggcacccgcacctctgctgccgtgctgtatacaagcgttgatggacctcgaaagatatggaagcagagggnnnnnnnnnnnnnnnnnnnnnnnnnnnnnnnnnnnnnnnnnnnnnnnnnnnnnnnnnnnnnnnnngccttcaatggcatggacacagtgcatgcatttgctgggtggaggagcacaaggnnnnnnnnnncaaacgaggagcccatcatgctgcaccaggctttgccagagacacccttcggcctgaaaggctgggtggaggagcacaaggctggccggccagggaatgccaagcttcaggcgcagttggatgcctggacggaagcgtttgaggcggccgaggaggctaaggcagcggccgcaagagcggctgcacaggcagacgacggctggaccctggtgcagcggcacaagggccggaagaagggcgtggacgaggctggcgtcgtgggaggcggagtggcagcccgtgcggcctcttctgccgcgcgccgcgccaatgctgaggtacacgccaacttctaccgctcccagctgcgcgcctcaaggcagtcgggtaagtgtgtggattggtatccagattgtggtttggaacacactgcttaccgggtggcagagtgttga

SEQ ID NO: 580 - DNA, 1041 bp, Chlorella protothecoides
  modified_base (880)..(889): a, c, t, g, unknown or other
atgggacgtctgcatacgcccgactccagcgtgcttcaaggccgaacatctaggtcacacatgcagacattcgacatgatctacgtcgcgtcgtctgctgcatcacttcttagagggggtcaggggagcgtcacccccggacccgcaacctccgcacatgctccccagctcacatccctgaggcgctacgcccggttttgcgatttcacgccctttctgccacatggccggtgtcaacagcggggtgggcgggcaccccgcgcggagtccgtgagcctggtgtcggaccgggaccctctgtacctggacgacgccatcgttccccaggccgaccaggaggagctactgtccaagtaccagttctttcccatggtgagagctggtgatggccgggctggtgggggctctagttgtctaccgggtctagtcatccatgcatggcacccctggcagggaggaggtatcatggaccacatgcctctttgccctggcactcccaccacaagttgcctcactcataaccacaaatcctggtccctgcaggattcttatgtcttccaggtcccaaaggacgaggagggccgactggacctggcaggcacggtcatgctgcaccgcggcacgggtgagaagggctcccccgaggtgctgggccgcctgcccgaggcccccacccgcttccgggacctgccctgggactcggagttcctgggcaacaagctggagaagcaggcgccgcaaacctgggtctgggccacctacctcgtcggctttgccgcgagggatgcccccgggctggatctggggtgcgtgtaccgcctggacggcatgcgcggccgcatcgagcagtgccgggtgcagcgctttgccgctccggacnnnnnnnnnngcaggtattgtgcgtggggggggtcgcgccctctgaccggggtgcctgcccgcacacggggcgcgctcccactcccagccatgccgctcgccctcctcggcgcccacacactgcccgccccactgcacccctccgcagggacggggcggtga

SEQ ID NO: 581 - DNA, 639 bp, Chlorella protothecoides
  modified_base (293)..(302): a, c, t, g, unknown or other
atgggaacattgttttgcctagatgggtgtcaggattggggccctgagctgctcgcattgttgccaacgcgtccaccctccggggagactaccaacgcagaaccgcacagcggacggcaaggaaaccgtcgtgggttacaccttctccgagacggtcaaggtactatttatggagagccagtgctggatttgcctttcaagacgcgggggcagcatgggagcagcgtgcatctgtcacattctctggcagctgtgttggactcaggcatccactcccctcgccatgccatccnnnnnnnnnnctttcaagacgcgggggcagcatgggagcaacgtgcatctgtcacattctctggcagcgtgattgacacagcggtgggaaaggcaggcgacgccctccggatcaatggggtcaccttgtccatctcctccgatgccaagaaggaggccatggcccaggcacggcgggcggcggtcgctgacgcgctggcgacggcacaactcctggcgtcggctgctggggtcaaacttggcgcgccagtgtccattgtcgacagcaacaacgggtttccagacgcggggaatgtgaccagctgtggtgagagggaatgggtgcagcggctttcgagtgtggggtag

SEQ ID NO: 582 - DNA, 579 bp, Chlorella protothecoides
atgatgcatatatcccacggatgtttcgctgaccaacagcctcagtttcgtcggcatttgcgaccttgcgatcgggagcatttctcggcctggcacaaccacattgaaatagatgcagcaggcgcagcatgcatgacggagaatgatcacccccacccccgcacgtttcgcctgcaccggcttgccctaggacaagaatcaatcgctggaacgcaagatgcattaaccgttttgtcaacaaggttgaatgggctcgaaacccaggcagaactcttcccacagcaattctgggtcgaccagcaatacctggcaggtgcaagccctagcagtatttcctttcgactcgtagcggcaaccatgtcaagtcgcatgcctgtagcggcaagtgtatgcattgtgctcatgactcttcagtctatgaatggcatgacactgccaaagctcgacatcagtgggcaacttgtgttcgaccagcttctccacctggcaaccttcagcgacgacctaaatcccgccgtgactcgcatcctattcacaggtggagtgtggaggcacaggcttttcgatttggatgtttga

SEQ ID NO: 583 - DNA, 1044 bp, Chlorella protothecoides
  modified_base (953)..(962): a, c, t, g, unknown or other
atgttcactacagtgcagtttacctgggaggatgggcatgagccccggcaagtcctggctcgacatgcgcgcacctccgacagccaccctcgagtagccggactacatgccttcagggtgtatcgtatccataagacatggcggagattatatatttcgacactgccacgcttgagtatgcatcttgctgaagaaggcctcgtagctctgcattcctccgtacccatggggattcccgggattttccttgttcagccgctggcgcagcaggaggccttcttcttggcctcgggcgtcgcctcggtcaccttgattgcagttccgctgctgggggcctgcacgatgcgtgtgagggtggggggaagggggtcggttcctgggtgcatctcacaggctacctctgagggccagcaccagcgcgttgttggcttgcaggctgagagggtggtgggaggtcaggtagtggggtggggcagcctgttacccactctcccacatgcttcccccaagaaacccttgctccctccaagccctcatcccacgcacctgcaccgcgtcctccgcggccagtgccttcttggagacgatgtggtagatctcggtgaggatgcgctggaaggcttgctccacgttggtggcctccagggcggaggtctcgatgaaggacaggttctcgcgctcgcagaaggacttggcatcctccgtctggacggagcgcaggtgccgcagatcgctcttgttccccaccagcatgatcacaatgttggcgtcggcgtggtcgcgcagctccttgagccaccgctccacattctcaaaggtcactgcatcttgggcagggcaaggggggagctaggtggctgcccctgcgtccaaggggtgcacgccgcaggcccattgaatggacgccgctgcagcatggcgtggcgacgtggggccgccccaccatgctccannnnnnnnnntcgcaggcccatcaaatggacgccactgcagtctggcgcggcgacgtggggccgccccaccatgctccaagccatgcattaa

SEQ ID NO: 584 - DNA, 732 bp, Chlorella protothecoides
atgctccctcccgcccttcctttccttggccccctaccccccctcgccactcacgcccagggtctaacggtggtgcaaaacaagggccacaacgaccacgtgaacgcggtggagtatgcagacgacaccggcaacctgatctacaccggtggggacgacaagtatgtcaaggtgggaaccagggcgggggttgggatggagacggagggagggtggctgcctggcgacgggtgggcgggtctcatgtctgcacccacacgttggagcccacactcaccgactgctggccatgcccttcccccgcccctctacatcctgcaggtctgggaccgacgtatgctgagggcacgcgcccggaccaagccggtgggcgtgttcatcgggcacacggatggcgtcacccacgtagacagcaagggcctccccccctccccggctgcagtgtcccttgggcgtgttctactcgcccagactcttctcacatgcgtcccctcgcagggcgatgggcggttcctcatcagcaacagcaaggaccagagcatcaaggtttgggacgcgcggcgcatgtcccccagcagcgaagtggtcaccgccgagcggggcggcgtgcccaccttccagtgggactataggtgggtggatgagatggtgggggggtcgggatgggtgggtggatgtgttcatgggtggcgaggagaggctggcaacttgaggccgcagagtctggtctga

SEQ ID NO: 585 - DNA, 291 bp, Chlorella protothecoides
atgctggtggggaacaagagcgatctgcggcacctgcgctccgtccagacggaggatgccaagtccttctgcgagcgcgagaacctgtccttcatcgagacctccgccctggaggccaccaacgtggagcaagccttccagcgcatcctcaccgagatctaccacatcgtctccaagaaggcactggccgcggaggacgcggtgcaggcccccagcagcggaactgcaatcaaggtgaccgaggcgacgcccgaggccaagaagaaggcctcctgctgcgccagcggctga

SEQ ID NO: 586 - DNA, 222 bp, Chlorella protothecoides
atgcgttcacagaagcagacggagctgctcagggctgcggtcagggtgcttgccatggtggaggtagaggtggagcttcaggagggctccgcgctggaggccaggtcctcaggcatagaggaggagctcacgaggctggacgagatagacaggctgcagcaggggtggtgggagaggagcgctgccgaggacgaggtcgagaagctgctccagacatcctag

SEQ ID NO: 587 - DNA, 582 bp, Chlorella protothecoides
atggaggccttcctgggactggcacatttcagactgcccgatacgatgaggctcataccgcccctcctctcatcccatcccccctcgccttccattgcccagaccctgctgaagggctcagagaagctgatgagcatcgcgcgggagcgggaggcggcgagcctgccggtggcggccgccccaccccgtggcgcgcagcgcgaccgtgccgcggcgggcgcctcccccgccgcggcgaccgcggcgcaggagcagaagcaggcgctgctggcgaccgagaacgcgctggtgttcaacgaggccctgatcgaggagcgcgacgcggcggtgcgcgccatcggcggccagatcggggaggtgcaccagatcttccaggacctggcggtgctggtgtcggaccagggcgcggcgctggacgacatcgaggccaacatctcgcgcgccgcggcgcacacgggggaggccaacgtgcagctggtgcaggcggagcgcagccagcgcgcggcgcggggctcctggtgtgtgttgctggccgccgccgccgccatcctgctggtcctcatcctgatcatcgccgcgtga

SEQ ID NO: 588 - DNA, 342 bp, Chlorella protothecoides
atgaccgaggcagggctgatcgtccgcgaggacaccatcggcaacgtgtatggcgtgttggagggttctgaccccactgcccccgccgtgggcaccggcagccactgcgacgccatccccctggcgggggctttcgacggaactcttggtgcgctgcgacgcgctgtagggttcttgggagccggcgagccgccgaggggatggggggctgatcagggaggtgggatgggtctgaagctggcaacaccctcttccaagctcagcccgggcacacgctgtggcacggcggagtgcacactcccccgccctgcacaggtcttgtgtcaaacagcccccgcataa

SEQ ID NO: 589 - DNA, 501 bp, Chlorella protothecoides
atgagagcattagaatcggtccgagatcaggtggcgagcggcttctcctccctgaaaggcagccctaggtccgcggagggtagaagggcttttcgagctgacacgcgaggccgctacacccatgttggtgtactcatgattcgccctcaccaattgctgccatggccgcacagggatctgttcatcatcttcgtgctcaaggtgctggagagctacaactacttctccctgtcgcgcatctttgtgctgtatctcaccgagaactttggggtggatgacctgacagctgggaccctgtatgggctgtggggcaccctcctggtcctctacggcttcatcctgggtggggctatcgacttcctgggtgaggctaggcctggtcgtgaacagcaaatggtgatgggatggggatctcgggttgtcagagatggtggtcctggcgcctccctagcaaccgctgtgcctgaggagaggctttctaccagaccagtgctggtctag

SEQ ID NO: 590 - DNA, 930 bp, Chlorella protothecoides
atgttcacctccgaggagcccacccgcttcggcctgagctgcagcggcagccgcgccatggccggcgcgctggaaggcgactacctggccaccctgcgcgacgtcaacggcagcagctacctggaagccgcccgcggcgcggggtacggcgcggccagcctggacgccatgctggccggcgcgcggcgcacgcgcgccgacctgggcgccttcctggagctgcacatcgagcagggccctgcgctggaggcggaggggctgcaggtgggcctggtcaccgccatcgccgcgcccgccgccctggccgtgcgcttctccggcgacgggggccacgcgggggcgcaccttatgcacctgcgcaacgacgccagcctggcggccgccgagttcgcgctggcggtggagaggatagtgctggccacggggtcggaggacacggtggggacggtggggcggtgggaggtctcgcccaacgcggtcaactccgtgccgcgtgaggcggcgctggaggtggacgtacgcgacgtcgacgccgaccggcgcgacggggtggtggccgaggtgctggcggaggctgcgcgcatcgccgaggcgcggcgcgtgcgcctcgagacccgcgtggtcagccaggacccaccggccgccagcggcgaggcgccgctggcggccctggccgcggcggtggagcacctgggcctgaccagcagacgcatggtgtcgcgcgcctaccatgactcgctcttcatggcacaggtggggaggggggtgggcggcaaggggcggctgtgtctttcggcaaagagtgagggggctccagggacgggcagagcgctgtgcggttgtcacaggggcgaaagacgcggtcgccgcagctgccaatgcacactcatctggggtttggcatcacgatgtcatacctggtatgcgtga

SEQ ID NO: 591 - DNA, 1110 bp, Chlorella protothecoides
atgacggtggagcagccggcggccaagatgctggtggagctggcaaagtcgcaggacgtggtggccggcgacggcaccacctcagtcacggtgctggccggcgcgctgctgaagaagtcgctggagctgctggagcgcggcgtgcaccccaccatcatctccgacgccttcaacctcgccgtgggccgtgcgctgggcttcctggaggccgccgcgctgcccgtggcggcgggggaccgcgacgcgctggtccgcgctgccaacacctccctctcctccaaggtcgtgcaccagtactcctccctcctctcccccatggccgccgactgcatcctggccgtttccgaccctgcgcgccccgaggccaccgacctgcgggacgtacgcctggtgaccaaggtcggtggcaccatcgacgacagcgagatggtggatggcctggtgctggaccagcgcgctgcaaaggctgccagcggtcccacacgcatcgagaacgccaagattgcgctcatccagatattcaaagcattgcatcagtgcgaggaggctgggcttggagcaccaggaggaggagcgatgaggggcctgccccctggctgcacagccacacactgctgtgcactgcccaaatttcccatcccttccctcacccatcgtcccatgtaccatgttacagttccaagtctccccccccaagtccgacatcgagaacaatgtcatcatcagcgactatgcacagatggaccgcatcctgaaggcgagccagcacaaactgaccatgaatgggtttgcctgttggcgcagtcatgtccggcataccagagagcatgcagttcccgctcattttctgcagttgtcccgcactttcctcccatgggctcgcacacacaccctccgaccccgtccccactcacatcacatgagcaggaggagcgcaactacatcctgcagctggtgaagaagatcagggcctctggcgccaatgtcctgctcatccagaagtccatcctgcgcgacgccgtcaccgacctctccctgcactacctggtgcgagtgtggggtcatgtaatggctgttgagatgtgtcggtgcatgcgccgagcagggtag

SEQ ID NO: 592 - DNA, 726 bp, Chlorella protothecoides
atgcagcaagacgctgggctgctcgcccattgcgcacgtggaccacatgcgcgccgacaagcttgccagcgcgggcctggtggaggaggtgcacgtcggctcaggccgcgtggtcaaggtgacgggaatcgaggcgcgcggagcgaccgccaccgtgctcctccgcggctccaactcgctggtgctggaggaggcggagcgctccctgcacgacgcgctctgcgtcgtgcgctgcctggtccagaagcggttcctcatcgccggcggcgggtcgccggagatcgagctggccgtcaagttgggccagtgggccaagaccctggtggcgtgtattgttggctgagggacatcagttggtgcagcctgcattgtcctgggattttgggacggcgtctggttgtgaggttgggtatcgaggtgaagatcgagggaggaggctgcgccaggggcaccgtctcttcatgtgccttggcagtgactcgtgtccaatacccatctgctatgacccccccctcaaacactacacccttgcagggcatggagagcgtgtgcgtgcgggcgtttgccgaggccctggagatcatcccgggcaccctggcggagaatgcgggcatgaatcccatcgaggtggtgaccgagctgcggcggctgcatgccgcagggcaccaacaccacggtgacttgatgttgttttcagcacatgaggctgatgggtggctggactga

SEQ ID NO: 593 - DNA, 2199 bp, Chlorella protothecoides
  modified_base (1046)..(1055): a, c, t, g, unknown or other
atgctgcgaaacacgtcctctggggcgttgcctactgcattccgtcccaggggtcccttctcctcccactccggagatggtaagggctcgtcctgcagagattctggtctgcattggatcaccgcttacagtggtatgtatactttgtacactgtctcggcatcacccgcccactcacctacgctcgatccagtgacgtatgtgaacgcggaggcagtggtcagggaattccatgaggccctggcccgttccagtgatatggccgtggcggtggctgccattacagccctcacttccgttattcggtccagctcggcctccactgtgatggggctggagaaggagctcaaggacgctgccaatgccctacaaaggtggggttcctgggaagtcaacgtgagagcgtttgacctgtgtgcaacttgccatgcatctcaaagccctgaatgggtccatgtgctgacaagatgcaacgacacagccatctccctcaaggcagggtgtgacctattcctgaggtatacaacccggacatctgccttggagctggacaattttgcgatggtgaagaagaagctgatcgagaggggtcgccactttgcaggtgagctacctgtcgtagtgtttactgctccgaaatgggtatcgtcagtgtttgactgcggccccgctcccaatctcttcgcagacacctcgaagcgggcgcgcgctgcgattgctgagcagggtcagaggttcatccggtcaggattcaccgtgttgtgccacgggtactcccgcgtggcactggcggtgctcaggaaggccgtcgcagcggaaggccgtagcagcggtgaggggatgccattgtgcgggcttggggcgctgctagacttggcgggttgctgttctactgaaatttcaatacgttggcacctggaggaggctagccctggcgtcctgaggctccggcctgcctccccttccaaccacgcagggcacccaattcaatgtgatcgtgacagagggccgcccggacgagaccgggatcacaaccgcacgcgccnnnnnnnnnngcctccccttccaaccacgcagggcacccagttcaatgtgattgtgacagagggccgccccgacgagaccgggatcacaaccgcacgcgcgctcaaggactcgggcgtgcccacctctctcgtcctggacagtggcgtgggttacgtaatggaaaagtgcgtggtgtgcgaggactttgctgtgatgcttggaccctggccaggcagctgggaggaggggccgcgctggtcatgctggataccatgctcctggctgggcctgccagccgggcgcttgctgctctgccgcgaccctcctgtgccctccccttcattccccttcttacccccacttcctcttccctgctccctctcctatcccacaatcatactcccccatcccagcttccccactttcctcctccttgccagggtggacatggtgctggtgggcgccgaggcagtggtggagaacggcggcgtgatcaacaagctgggcacctaccagattgcgatcgcagcgcgggcgcactctgtccctctttacgtggcggccgagtcgtacaagttcgcgcgcctgtacccgctgagtcagcgcgccctgcccctggagcgcaagcagatcgactttggcccactgctgccgccccaggtggcggtggacaacccctcgcgcgacttcacgccgccggcctacatctccctccttttcaccgacctgggcgtgctcacgcccgcggcggtgccacgctcgtctggaggtgggaggtgcgagcgtccttgccgggtccctcactgtgcagcgatgcaggacgcaacggtgcagatggaatggcggctgagaccgtctgagtcacttgccgaaggctgcaggaggccatggcgctggtgcccggacccctttccctgctggttcaatctgccacacgcagacagtagcaccccctgtcactgccaccctgctgcgttgtacaagaaaaggaggaagcagcctgccaggggcctatcggacgggcacaatgtcgtcgatcttgaggatcatgcgcacgcactccgtggccagggaaagcgcagaggaggtcaccagcaggggctgcaccaccttctcctccagcatgtccgtcaccaaccccttgcgcacattgatgcctgggagggcgggtag

SEQ ID NO: 594 - DNA, 765 bp, Chlorella protothecoides
  modified_base (561)..(570): a, c, t, g, unknown or other
atgttaaacaggtggcgcagcgagcgatggccggcgacacgcaggcggggtctgacttcttccagaccgagtacctgctggaccacctcatccacaccctgcgcaagccccacgtggccctcatcgacggcatcacctttggcggcggggccggggtttcggtgcacggcaccttccgcgtggccacggagagtgcggcaagccatggccatccctgccaccgctcctcatcccacctcacgccactgcaccccatacaggaccctttttgccatgcctgagtgcgccattggcctgtaccccgacgtgggcggctccttctacctgcccaggctgccgggcgggacaggcctgtacatggccctctccggcgcacggctcaaggtgcacagggcttgggcctggggcgctcttctatggggtcgggatagatctctggtggcctgtttgggcttgcatgatggtttcaggagaggttgggtgccaccaaatcgtaagacggctggcgatcaatcatccctgacctccttttccacccctccccagggagcggatgtgaannnnnnnnnngggagagggagcggatgtgaagcatgccacgctggccacacactacctcccctctgcgctgctgccggagctggaagcggccatccaggggctggggcatggggcctccaagcagagcatcggcgagctgctggacagcttccaggctcgcacacaagttccagccggggagctggccgcccagaggtgagctga

SEQ ID NO: 595 - DNA, 1848 bp, Chlorella protothecoides
  modified_base (705)..(714): a, c, t, g, unknown or other
atgccagtcttgggtcacagtcatctttgcttgacacatatacgacgcgctttcgcaacctgcagctctcgcccattgcgtgtcccctcggccgcatcgcgccggtcccccaaatctacctgggtgtccatgggaggtgctgtcgagactgctgccgccaaccccccttctgagtccatagctcgcaaactggtcggcgccaagggcttccagcgtcacaacccgctgaccgacaagttccccatccaccgcttccaccactttgagttctactgcggggatgcgacaaacaccagccgcaggattccctccacccctccccgatcacacaggtttggcctgggcctggggctgtcccaggtagccaagtctgaccagggcacggggaaccagaagtttgccagctatgtcatgcgctccaaccagctcatcttcaccttcactgcgccctacaacggcgcggggggcgaggcctccggcccggacgccggctccccggttccctggtacgacgtcgacgccgcgcactccttcaacaggaaccacggcctgggcgtccgcgcagtgggtgcgtcggctgcggtggtaggatttggtgcagtgtcgtggggggaattgatggtcggatgcacatccagcgggcgcagagatgagctgcagtcattttgtagatccactctggcgcatgtccgacccggtgtgacnnnnnnnnnnatttgtgtgatactgttgggaccccagcctggcgtcaggatgtttgcccggccccttcttggccccctgattcttgcactgtccatatcacgagcatgtgtgcaatcctcatctaaagtatcgaggtacgccttccaagccccttcacattcttactcccctcccccttcacaccctcactctcttccccccttcctaggcatcgtggtggaggacgcggcggaggccttccgcatctccaccgccaatggcggcatccccgtgcagccccctacgcggctggccgacgcgcgtgggtcgctgacggtgtcggaaatcgtgctgtacggcgacgtggtcctgcgcttcctgtccggcgactactccggctcctacctgccggggtacgaggaagaggcgcgccccagcccccgctgcttcggcatccgccgcgccgaccatgcggtgggcaacgtgcccgacctgggcgcgcaggtggactacctgacgcgcgcgctgggcctgcacgacttcgccgagttcacggcggaggacgtgggcacgatcgactcaggcctgaactccatggtgctggccagcaacaacgagatggtgctgctgcccgtgaacgagccgacgcggggcacgcggcgcaagtcccagatccagaccttcctggagcagaacggcggccccgggctgcagcacctggcgctgaagacggacgacgtgtttgccacgctgcgcgccatgcgcgctgtgggcgacgcgggcgggttcgagttcatgccccgcccgtccgacgcctactaccgcgacctgccgtctaaggtgggcgacgcgctcacccccgagcagctgtccgaggccgaggagctgggcctgctggtggaccgcgacgaccagggcgtgctgctccagatcttcaccaagccgctgggcgaccggcccaccgtgtttgtggagatcatccagcgcctgtgccacatccagcccagcgaggagacgctgcgcgccgcgtgcgccaccgcgcaggcctgccccctggccgccaacccggacgaggtgggcggctgcggcggattcggcaagggcaatttctcggagctgttcaagagcatcgaggtgtatgagaccgacctgggcatcaactga

SEQ ID NO: 596 - DNA, 663 bp, Chlorella protothecoides
  modified_base (217)..(226): a, c, t, g, unknown or other
atgggagcaggcggtgcttgcaacgccggggatgtgatggggagcccttgccagcttcagccacgacgacacatcttgagtatccagtgcctctcccacacactgctgactcgctcacgtcggcaggagcgccacctctgcgcttcggagcggtacctgccggcgcagtacctcgccatcaaggctgctgtcctggaggtccaagaaagccgtggcnnnnnnnnnnctgccggcgcagtacctcgccatcaaggcttccgtcctggaggtccaagaaaggcgtggtgttgtaaccccgggggacgtcaccgcgctccccttcaagctggagggctaggggtgggtgggagcccaggctcggccttgcctgccctgggagacttgcatgcaccctgtatgttgctgtgcaaataccctgctgttgctgatccattgtggccaggaacgaagcctatcagtgactcttcaacctgttaccaatcacaaagaccgcctcatgtgcccgtgccccgtgccctatctgcaggtggatgtgcagcgcatgctacgcctatacgatttcttcagcgggcagggttggatctgatcacaggctacgtagccatcgtgctcatgatccagctctcacctaagccgcaactttttaccgttccgactgactga

SEQ ID NO: 597 - DNA, 1272 bp, Chlorella protothecoides
  modified_base (436)..(445): a, c, t, g, unknown or other
atgcatcctgcccaaacctcaacaaccacactcgcccccccgacacacaaaacacacctcgaacaggatgcgcagcttggccttggtggtgggggagatgacgttggtgaacacgccctgctccttgacgatgatctggaagacgtcaggcaccatgccacccgtgtaccgcagggtgtactgctcctgcacgtagtgctgcaccagcttctggtactctgcgttgtcaaaggtggccctcaggttgccgggggagaagatcttgccctcctctgtggggctcttttgtatcaggtcactgacagcgagaagttcacccctcctgtatcggaaggtgctcgactcatccctggttcgatactctcgcgacggctcacctggtgcttacctggggagcccgtcccaccgatcatttccctccaccccatgcaatacnnnnnnnnnnctcctgtatcggaaggtgctcgactcatcctgactccccgtgcacccccacccccaccccaaactttaggactcaccaatgcgttccgtctccttgacgtgcagccacttgccgtcgtcctgcagcaggaactcctggcagccgggcgcctcagccagggcgatgcagtagacggtgcgggggccgtagatgcccatgcccgccgccgcctgctgccggccggtgatgtccttcagcttgtccccgggccacaccccaaagatggtgcccacggagaagttggtgtccacgatggaggagccatccaggggatcaaaggccacggagaagccctcaccacccacatccaggggctcggggttctcctccgagcaggcgtacttgcaggcgtgggagtagcgcagcgcctcgaacagcagcttgtccgccagcaggtccaccgccagctgctcgtcgccaaaggtgttgatgcaggcggtgctgctgcacgacgcggtgcgcacctggggtggggtggggaggggagcggtgcgtcgagtgtgcaacgcgcagccctccagacagctacactgcgcgccagcatgaaaacaagccacgcgcagcacgagagcagtgtcagcgcactgaaaaccaggcacgccttcccgggtctcaacaccccgacaccttgtactcctccagggagtcacccagctgcaagagggcgggagtggatgttgccagccccgagcatagatacgatccagcgggctgcacacccatcagcccagcacatgtgctgtcaagtgcttccccacaccattacccccaacccaccgccgatgtga

SEQ ID NO: 598 - DNA, 990 bp, Chlorella protothecoides
atgtcctccaaggaccccaaggtcaactcctacctggagttcaaggatgaggtcctgccccgcatccggtgtgttcctggaacggaacccaaggctgtgctgcaggcactgggggggggccttgctggcctggcggtcgcgagctcctcgacgctcgatcatgaggaggaggcactggggggggcccttgctggcctggcggtcgcgagctgctccacgcttgatcatgaggagggggtgcccgcccctccagtccttgagctttctattccctgcaccctgggcatccattccttccccctgcacctccatccccccctcccactccaccctcaaaccaggtcgctggggtacaacgccatccagatcatggccatccaggagcacgcctactacggctcctttggctaccacgtgaccaacttcttcggcgtgagcagccgcagcggcacccctgacgagctcaaggccatgatcgacgaggcccaccgtctgggcctggtggtgctcatggacatcgtgcactcccacgcctccaagaacacgcaggacggcatcaacatgtttgacggcaccgacggcatgtacttccacggcggcggccgcggcttccactggatgtgggactcgcgctgcttcaactacggcaactgggagacgatgcgcttcctgctctccaactcgcgctggtggatggacgagtacaagttcgacggctaccgcttcgacggcgtgacctccatgatgtaccaccaccacggcctgcaggtggccttcaccggcaactacgacgagtactttggcatggccaccgacgtcgacgctgtggtgtacctcatgctggtcaacaacacactgcacgacctcttccccactgccatcaccatcggggaggacgccctggcaggagggcggcgtcgggttcgactaccgcctcaacatggccatcgcagacaagtggatcgaggtgggggtggtgtgcgggagtga

SEQ ID NO: 599 - DNA, 576 bp, Chlorella protothecoides
atggggctggcgtccccgccgcgcagcccgcgcggcacgctgtccgtcctctcctccaccccctcccacgtgccctccctgctgggtgcgggcgagcgctggggctcccccgaccgcgacgcgccgggcgacacgctttcccgcgcggcctcccccgactgcgcctccccccgccccatgtcgcccgacggcttcggctctggggtttactcctccgtgttcatggacaccggcgtggagggcctgctgggctactcagcgccgcagggtgtcgaggcgcaggtcggcgcgcggcgcgggcgcgacgaccacgcgacaccggcgcccggcccgcggcgcagagcctccaccagcaccgacagcggtggccgggagggggcccaggcctggctggagcgcacgcccgcctccccgggcgcctccggcaccagcccggacccggcctcggcgctgagcccgccgaactcgccgcggcggcggcagaccacctttggcgccaccctggacttcatcgacgccctgtgcactgccagctctggcctcaccgccttcccacgtgagggggtggggagttga

SEQ ID NO: 600 - DNA, 741 bp, Chlorella protothecoides
atggcgccccagctcaagctcgcggggactcgcggggtggccatgccagtggcgccagtcgcaagaccccgcgccgtgccttgtagtgtcaagcattgtgggcgaggtgcggtgtcgggggccggcatggatcccacatcggactccccccactgcccggggcccacgacgtcaccctcagtacgccgctccccgaccaggctcccgctttgtgccggtgagtgccactccagagaatcagcaatctcccatcgacgtcgcgaggcgcgagaatgcggcactcaagcagtccatcaacaagaccgaggcctccggtgtgcatggggctcctggggcagagtcgatgcagggcctgctacttgctcgatcagctcaatcgactgtgtgcgctccacctacaagccgtcaacaagtttcattccggtctctttcattcatggtgcagtgaagaagctctcgggcaagctgtccgatgcaggagtggaagtgccgcccctcagcactgccacggtgggctccacccgtaccaatggcagcaatggcggcgccacggctgctaagacctccaatccagagccacaagatccagaggacttctggtctccagtcaagcatgtgcctgacggggttgcattccaggtgtggcgagaatggagggggctgggttgggttggggagaatgggtgcagtggtgagctgaagacgtcccaccgggcacactttgttgcgctcctcgagtag

SEQ ID NO: 601 - DNA, 588 bp, Chlorella protothecoides
atgctggaggagaaggtggtgcagcccctgctggtgacctcctctgcgctttccctggccacggagtgcgtgcgcatgatcctcaagatcgacgacattgtgcccaggagctgccaatcccccagcatctcggcccgatctacgccgccaggctcctcaactgtacagctggatgagctcgtcggagaccgccgcgggcgtgagcacgcccaggtcggtgaaaaggagggagatgtaggccggcggcgtgaagtcgcgcgaggggttgtccaccgccacctggggcggcagcagtgggccaaagtcgatctgcttgcgctccaggggcagggcgcgctgactcagcgggtacaggcgcgcgaacttgtacgactcggccgccacgtaaagagggacagagtgcgcccgcgctgcgatcgcaatctggtaggtgcccagcttgttgatcacgccgccgttctccaccactgcctcggcgcccaccagcaccatgtccaccctggcaaggaggaggaaagtggggaagctgggatgggggagtatgattgtgggataggagagggagcagggaagaggaagtgggggtaa

SEQ ID NO: 602 - DNA, 414 bp, Chlorella protothecoides
atgctcctcgcattcaacaaggtcgacgtggcgcggcacgactttgcggtggagtggatgcaggactttgagatcttccacgaggccctggcatctgatacgacctacgcagccagcctcagcagctttacatcggctcccctggcctcgccgagcactgcacaccttcactccatcctaccctcacaccttgagctcgccatcaggtccatgtccctcgtactggagaaattctacgagaatctgaaggcagtgggcgtctctgccatcactggagaggggatggacgatttcatggcggctgtggcggagtgccgtaaagagtacgaggcaggctacctcccggaactcaatcgcaggaaggcggtgagtcggggaaggggagagccattggatattgctgggctcgtgtga

SEQ ID NO: 603 - DNA, 354 bp, Chlorella protothecoides
atgaaggagtactccctgggtcccaatggcgccatcctcacctccctgaacctgtttgccacgcgcttcgaccaggtcatagacctgtgcaccaagccgcgggacccccctctagactttgtggtggcagacacccccggccagatcgagattttcacctggtcggcctccggggccatcatcaccgaggcgtttgcgacagtgctgcccaccgctgtggtctttgtggtggacacgccacgatgcaccgctccccagaccttcatgagcaacatgctgcaggtcagtgggccctggtggttccacggccagcgactcggaatatcacacgtcagacatacgagtggcgcttag

SEQ ID NO: 604 - DNA, 375 bp, Chlorella protothecoides
atgcgcaggcccgttgaagccagtcacacccccatcaccccgcaggcgtatggcttcgtggcagcggagcaccagtgggtgtcgcgcaaggacgagggcgacaaggtcattgtggtcgagcggggggacctcatcttcgtgttcaacttccaccccgtgtcgtccttcaccgactacaaggtcggcgcatacaagcccggcccatataaggagggcaactacgacaaccgcccacactccatgaaggtgtatgcgccgtcacgcacagtggtcgtctacgcacccgcagacaccaccgacgccaaggccgactccaagcccgagggcatccccgggctcggagtcaagggagttgggccctactttgccgtgtga

SEQ ID NO: 605 - DNA, 804 bp, Chlorella protothecoides
atggaacatgggcaacctcacacacaccatgaccaaccggcgctacgccgagccctgcgtggtgagctggctggcgctggggcaggggggctgttcggtctgaaattggtggcatccccggaagcagccccgtccagcatcctccgtccgcccacctcctcggtgcccctcgccctggcacaggggtatgcagagtcccacgaccaggcgctggtgggggacaagaccatcgccttctggctgatggacaaggacatgtacgagcgcatgtccctctccggacccaggcctgccgccctttggccctgtctgcttcataccaaggccccacgtagcgacgctgccaccccagggctctgtataggccacctgcctccgctgcgccaacgatcccacctcgacacctccccccataaatcccatccccccactcccaacccaaccagctctggcgcggtggaccgcggcatcgcgctgcacaagatgatccgcctgatcaccatgtgcctggggggcgagtcctacctcaacttcatgggcaacgagtttggccaccccgagtggatcgacttcccacgtgacgacacctacgacaccagcacgggcgcctttgtccccggcaacggcgggtccctggacaagtgccgccggcgctgggacctggccgacgaccccagcctgcgctacaagttcatggccgcctttgaccgcgccatgaaccacctggacaaggtgtgcgccggctggttgcctttcttgacggcgtttgttctcgggggctggggtaggaggcgtttgcggtga

SEQ ID NO: 606 - DNA, 960 bp, Chlorella protothecoides
atgcactcacatccacaaaccctatcatcatcaccattctgccaggcggatgaggagatactcctggtggagggcgtggagctgtatggcctggggaactgggaggcagtgggagagcacgtggggcgcgaccccggcgaggcccgcgcccactacatgtcggtgtacgtggagaccgcctgcttccccgacccgcagccctcgcccgccatggcgggtgttgacatccaggccttgatcgacgcccaccgcagcaccaccctaaacaagatggcctccgcccgcatcgccctggccagtccggcggccacgcccagggtcaagtcggagagcacgcccggcgcggccgcctgggacgccgccaacggcggtgcgatggggccaggccacagcgtggcgccagagaacctggcggccgccctactggccgccaaccccgagccccgccacgcgcccggggacggcgcggcgggggcgactgcgtccgggaggcccagccccggcagcacattgtcgaccgccgctgggcacgccttggccgggcgcagcccgcacgcccccgcgccgcacgacctggcgcagccgcagcgcgcggccgacagccgcgcgccctccagcgcggagcgggccccgctggaaagcgtgcgcaagctggagccggaggcgaacatcctccaggacccactgggggctggtgtggctgggaccccggcggcagcctcgcctgctgagatcggggccaaggtgtggcgggtggttttcctgcggaggctccggaggggaggccccacagggacgaggcccggggaggccgcagcgcccgcccacccagctcctgtgcaggggcatgcattcacatgggacgcgctcctacccaagcctgttctccgcccgcgcctcacaggtagcgctggcggaggctcagcagacggagtacaacctgaagcgaaacgagtttga

SEQ ID NO: 607 - DNA, 489 bp, Chlorella protothecoides
atgtctacacccgggcaggtgctggatgtgagatttgagaccgtccgcaaggagaccatcgagcagctgcgcaccctgaaccgggtcatcttcccgctgaactactcggacagggtgtacgccgacatcctcgcctgcggccccgtctcccagctggcctttgacagggatggcgagatggtgggggccatcgcctgccgcctggagaacacctcagagggcccggtgctgtacatcctgacgctgggggtcctggctccatatcggcgtctgggcgtgggtgctcgcctgctcggcaatgtgctgggcatcgtgactcgtgacctgccggaggtggtggccgccgtgctgcacgtgcaggtgggcaacggcgccgcgctggacctctaccggcacgcgggtttcagcgtggggcctgtggttccggggtactacccccgcctcaacccccccgacgccgtgctgctccgcaagcagctccgtgactga

SEQ ID NO: 608 - DNA, 543 bp, Chlorella protothecoides
atggagttcagggaggaggactcggaggaggtggtggcgcagaagctggagctgatcgccatctacaaccggcggctggacgagcgtgaccagcgccgggccttcatcctggaccggggcctgctcaacgtcaagcgccaggcgggtccgttgatgtcgtctgtgtcagcccccacccccaccgccaatgcatcctgctgcccccacaaagcttggtcccccgtcccgcaggccgtggaccggcggcgtagcgcagcagagcgcgccatggccggccagctgcgtgcctttgcacggtacctgccccaggcgcagtacgaggcgctggccgacggcatgctggtgggtgcgggggctgagtggagaggagggcgtgttgcgagtgccggtggcgcagggcacgaggcagctgcgcggagtcctgcacgatggattgcagccagctcttgggcggtggaggactctggcctggtcgccgcatgcttcccactgcccatgccatccctcccaccccaaagccacccatccatccttgcaggctga

SEQ ID NO: 609 - DNA, 309 bp, Chlorella protothecoides
atgacgagcccggacgaagcactgcagcgcctgaccttaaatgatgacactgccgcgccatctaccttgggagaaacagcccccacggtgctcctcatcataggatctgggaagaccacgttcgtgcagcgcctggcctcccacatctctgccactggcaagactggctacctcttgaacctggacccggccgtcgccaaggtgccatacaactctaacgtcgacatccgagacacggtgcgagatgggtcaagggagcagggacataggttcagagccataccagagctgtgctgcatgccactctaa

SEQ ID NO: 610 - DNA, 1038 bp, Chlorella protothecoides
atgcagctctttgtccggctgaatgaccatgagcatgtcgtgaatgcatgccctcgtagtgattcgaaggaggtcatctcgctcctctgcgccaccagcaatcctggaccgtcgtatgagggactggttgtccggcacaatggccgcagcttggagaccagcctggaggaggcaggggtgaagccatgggatgttctcgagatcctccctcgtctgcttggagggggcggggatggaggtgccaccggggccgagtcgcgatcttgctacctcgagatgtacctggggcgcaaaccagacaaggtgaatcctgaagaagagaggctagcacgttggaccacgtgtcacctgtctggcgagccactgagtcgccccattgtggcggatgagctggggaacctgttcaacaaagaggccttgctacaggccctgctctccaagtcgctgccgacaggtttgaagcacatccagggtctgaagcatgtcgtggaattgaagctggaagaggccggctcaaaagacggcagcgctcatttcgtctgtcctgtcacgggtctggactttaatggcaaggcccggttcctcatccacttcaagacggggctggtcgtgagcgagcgtggctggaaggaggtcccaaaggtagtggaggagctggccgcctccccgtgcactcctgagagctggatcccagtgaaccccaccggggaggaggccgccgccctggtctcggccctggctgcacggcgagaggcgcagcgcgccagcaagaaggagaagcgcgccgtgggagtggccgccagcaacggtggcacgggcgagaccgcggccgagccaggatccaagcgcgccggacccccgaccgccaccctgcccgccgccctggcgcccaagaagtccaaggtgtcggagctggcccctgccaacgccaacaagaagatctggaacagcatcttcacacatgccagtggcctgggtcctgccgccgacggctacatgctgcgtggcacagcgtcgcgtggcatgaagatggcctga

SEQ ID NO: 611 - DNA, 276 bp, Chlorella protothecoides
atggactctgctcgcgtgcaggaggagaccaacgacgccaagaacgcggtggaggcctacatctacggcctgcgcaacgcgctgcgcggttcgcacgcggcgttcgagacggaggcgcgcgtgacctccatcctggcggcgctggaggacgccgagaactggctgtacgaggagggggaggaggagagccgcggcgtgtacgtggccaagctggcggagctgcgcgcgctgggcgagggcgcggagcgccgcgcgcgcgaggccgcggaggccccc

SEQ ID NO: 612 - DNA, 387 bp, Chlorella protothecoides
atgatgcacctgcggggcatggcggtcgcccccgacatgcagcgcgcggtgcaccacctgggcgtggcggcgcggcgcgggcacatcctggccggctatgacctggccatgctgcacctgggagggcacacggggtcgcgggccgcctgccccgacgcggtggccctgctgaaggaggtggcggagcgcggctggcccacgctgcaggaggcgcatgaggagtggctgcgcggcgagcccgagtgggccctgctcaactacctgaaggccgcggagatggggtatgaggcggggcagagcaacgcggcctggatgctggcccgcggtcacggcggcgtggccgacgccggggccgccgacgcggcggcgctggccctgcaccggcgc

SEQ ID NO: 613 - DNA, 999 bp, Chlorella protothecoides
gcgctgcggctggccggcgcgacgggcggcgggggcgcccacccgcgccacgacccgggccaggaggtcctgcactaccagtggtttgcggactttgggcacgtggaggccgcgcgcgcggtggcgctggcgctcgcccgcggcggcgatgacgacatggtgcgcgccgtcggctacctgcgccagtcggcggaggcgggggacgcggaggcgcaggcgcacctgggccacgcctacgccggcggcgtcggggtggcccgtgacaacgccaccgcggcccactggggtggtgggtgcgggtgggcggcgtctaggggcgaggaaggagagattgatgtggcagtgggtgtgccacagggagtggtcgcctccggaaagtcacagaggaaggcacagcctgctgcgaaggaatgttcctctaaaagggtccgcgctggactggcggggcatgttcaccaccaccaccccccgttgggtcgcaaatctctccacacactcccccaccaaaaagcaggtcatccgagcgggtactttggtctggggtatatgcacctcgagggatcagtggagggcgcgtccctgcaaagggccttttcctacttcaggcaggcggctgacgcgggagggatggtgggccagtggcccgggcacgcagacgctcacttcttcctaggtgagaggattaaactttatcaaaaaggggttgtttctgtgaaagaattcaagtccatcgtgttaaccactccaccacagcagcgtggttgtcggggctggccctggaatccagggagcgcttttttgttgtgcctcaacagcagttcgctgccggcaggattcgaacctgcgcgggtttccccaatggatgcggctcgaatcacagagtggcgggaagctgtttttgtcccatatgacttcgcgttttgtgtgtgcggaatggcctggagtatctacgagatccttccatggaaaagggatggggccacaccgaccacgccttga

SEQ ID NO: 614 - DNA, 459 bp, Chlorella protothecoides
atgccagccgcccacacggccagcgcgatgcctagcatggcgcagggtttctcatccctccccatgccccgccccatgcgtgcctctgctgggaatgctcggcccctacagtctcggtctcacaggcggtgccgggcaacacccccaagagtcacagcctccggtcagaacgtgctgctcctcggctctggaggcagggaacacgcccttgcctggaagcttgcccagtcgcccgactgcggtcgcctgtttgtggcgcctgggaacgcagggacggccctggagcccaacatgaccaccgtctcggggctgaatccctccaaccacaagcaggttggtgcgagagagacaggggaaaagaaggagagggccgagaggagtatgacctctgtacaggatgtggccgggtgctcatgctgtgggttcacatgtaggccgcccctgccagtcatagagtga

SEQ ID NO: 615 - DNA, 954 bp, Chlorella protothecoides
atgcccgattgctcaggcacatctgtgcgccctgcgctgcgtgctgtcgggagccttgatgcccaccgggtacacacgcaagctgtcctgcgcctccatattaacacctggaccttggtcacacctgcgcccctccgtcacaacggccaacgtcgcatggatcgccaggccctcgagtacacccgagaacactacaacaagcactcgaaccagtacggcagcactcaggaggctctagccgcgcgagcatctgggcccggggctcccctcaagaagtttcacaactatatcaagcgccacctgataaacaggcatgctggatccagaccaggggacgatgatctcggactgtgcatgaacgataggatgtctcaaggccacaccttgtttgccctctgcagatttgccaagggagctcctcgccttctagatctagcatgcggccggggcggggacatctggaagtggattgatgccgggatcccatgtgtgaagggcatcgacctttccccccatgaaattgaggaggccagggccaggtgggaggggaaagagttgtgtttggtgattccatcaagggtactggcaagcaggctggcaagcaggctgatagatagagatgcatggctgtgcctgtgcctgtggctcaatcgtaccctgatgaggtgcagggagtcttgctcaatgccgaggttctcagaggcacaggctcgaaagtcggaactaagcctggactacagctttgaggcatcgccagagctgggcttgagcgagtggaaggagagcgagagatacgatgcagtgacatgcatgtttgccgtccactactttttcgttgcagagaaggccctcaagcaggtgggggaatgcttctggtcttggggggctggcagccctattgacctgtggcctagaccccatggactgcctggtggaggggtgccaaaatgctga

SEQ ID NO: 616 - DNA, 693 bp, Chlorella protothecoides
atgggtgatgacgagccagccatgctggctgccagcaaggtatggagtccatgccgtgtaccttgtagcactgctcaatgcctcatgtcggctaagagggaacattctgcactcttggccggttcctttctcgacgacacacaggcagtcctcatgccatctgaggacctaccctccgactctgtactcattcgtggcttcgagtttgggaaggaggcctgcaccctggacgcattgatgtcatccatgctttccaccggcctccaggctagcgccctgggtcaagccatcgtcgaggttaaccgcatggtgaggaagcgggatggggacttgaggatgctggtggtcggtgatgttgagtttgacagtcagggagctgagggactggactggagactctcggacgagcacgtgctcgacacagatgcagttgttgagccagctgagcgagcctctgtccgcgccaagctgttcctgggctacacctccaacctggtgtctgccggggtgcgggagcacatcaagttcctggtgcagcacaagctcgtggacgtactggtgacaacagccgggggcatcgaggaggacttcatcaaggtgggcttgctttcttatgaaccggccgggttggggaggagctgcgtggcgctgggcacacccaacctcctttttcatagttctggcaaagcatga

SEQ ID NO: 617 - DNA, 849 bp, Chlorella protothecoides
atggggaagggaagtgcgcagtacggaggggtgttgtggcgcaggaagccgtgggggaatggaatcatgccaacacataatctgcaggcactcacagcggctggcctgtcgccccggcgtgggcggcgtcaccattccacgccagtgcggcgcctccacggtgcccggccaggcctccaacacctgcggcatggacccctacctggtgctgccctcccgcgccgagtgcatcgaccagcagagcctgaagatgcaggaacggcccgaggacgtgcccacgggggacctaccccgcagcatgatgtgcctggtggaccggggcctggtgggttcggtgtcccccggcacgcgcgtcaccgcggtgggcatcctctccatctaccagagcaaggaagcggggaaggcgcgggacagggccggcggcgtggccatccgccagtcctacctccgcatcgtcggcttccaggaggatgtcatcaacggcgactcctcccggaaacctaccttctcgtaagggtattgtgtttctgtgggggggtggagaccacactgcccggcagggaggagttgcaattcaacataccaggaggccgcctcgttgcatgctcccctcacaccccaacaccaccgcgcagcctggaggaggagcaggagttcaaggagtttgccgcccagccgggggcaatggaccgcatctttgcgcgcatcgcgcccaacgtgagtgaatgcatggcgaggggcgcggcaggctgggtgggcgcgcgcgctccctgtctgtacatggtgatgttgtacggacaccgtgggatccggcgccaggccgtgtcagcaccacaagctgcctgctga

SEQ ID NO: 618 - DNA, 1368 bp, Chlorella protothecoides
  modified_base (875)..(884): a, c, t, g, unknown or other
  modified_base (1326)..(1335): a, c, t, g, unknown or other
atggccacgcggcgcttgatctgctcctccacacggtgcacctcggcgcgctgctcctcgctgaagaccagggtgtccatgagtccggacttgacggcgtccatggtggaggccttgaacagctccagcgcggcgcggacgtgggtctcgccggccaccgcctgcagccccatcttggccagcgcctccgacacgcgcacgatggcctccagctggcgcacggtgatggggatggcggggacgtcggcgccctcggcgctggcggcgcgctgcgcctcccctcgcaggtccacgtactcgttggccagcaggcgggcggccgagtcggtgatgcgcggcgagcacgaggcacgcacgtactcgatgtaccgcttcaggaactcctcctccttatgtgttgatacattggaggaaggggggggaaggttggggccaggcgagagggtgggcagccgtgcaccccccacccccgctccccatcctcctcgtgcgctcaaacccctgctgccccccccaacttcccttccacaaactcaccctgacctcctcctcatccacctccgggcgcccgcccgcggcgcggtgcacgcccagaacgtgctgcgcgatcatcttgtcgcgcgccatggagcgctcgtccttgacgatgaagatgaggtcgaagcgggagaggatggtggactgcaggtcgatgttctcctgcgccgacttcatgtcgtcataccggcccgacggcgggttggccgccgccagcacgctggtccggctgcgcagcatggtggtgatcccggccttggcaatggagatggtctgctgctccatggcctcgtggatggccacgcggtcctcgggccgcatcttgtcaaactcgtcannnnnnnnnnctgctgctccatggcctcgtggatggccacacgacctgatgacgctggccgtcaaccccgcggccgaggagcccttgccggaggtgtacacggcgatgggcgcggtcttggaggcaaacttgaggaactgggacttggcagtgctggggtcgcccaggagcaggacattgatatcgccgcggcgataggtgccgtcgggcatgcgcttgcgcgcgccgccgaagagcagggccgcgatggcgcgcttgatgtcggcgtgcccgaagatctgcggcgtttgaggcagcttgtggttctgacatggcctggcgccggatcccacggtgtccgtacaaaatcaccatgtacagacagggagcgtgcgcgcccacccaccctgccgcgcccctcgccacgcattcactcacgttgggcgcgatgcgcgcgaagatgcggtccatgnnnnnnnnnnagatctgcggcgtttgaggtgcaggtgatttga

SEQ ID NO: 619 - DNA, 663 bp, Chlorella protothecoides
atgcagggccgccccttccgcggcgtgctcttcgccgggttcatgatcgaggggtcgcaggtgaagctgctggagcacaacgtgcgcttcggagacccggagtgccagtcgctgatggtgcgcctgcgctccgacctgctctccacgctgcactccgtgatccagggggagcccatcaccctcgactgggatccacgccccagggctgtggggcggggccgggagcttctgcgcgtgcggtggaagggagcgaggccgaggcggcgcgcctggggacaggaagtgcgatggtctggcaccccattgctgcacgaccggacacagcttccccagagccacgactgccagcaccgcccagctccctccattctcccgcccctccgccccagcctgacggtggtcatggcggccaaggggtacccggggtcctaccgcaaggaccagcccatcacgggcttggacggcgtgactggggccaaggtgttccatgccggcacgcggctgctggaggacagacgagtggtgggtgcccaggggtgtcgctgtcgtggtgggagataccagcagtctggagtcggtgtctgccagggactcgtgcctgggtgggacgatggcatggctatggatgacctttgcatgctgccctgggatgcctcgggatga

SEQ ID NO: 620 - DNA, 873 bp, Chlorella protothecoides
atgcggcccgaggaccgcgtggccatccacgaggccatggagcagcagaccatctccattgccaaggccgggatcaccaccatgctgcgcagccggaccagcgtgctggcggcggccaacccgccgtcgggccggtatgacgacatgaagtcggcgcaggagaacatcgacctgcagtccaccatcctctcccgcttcgacctcatcttcatcgtcaaggacgagcgctccatggcgcgcgacaagatgatcgcgcagcacgttctgggcgtgcaccgcgccgcgggcgggcgcccggaggtggatgaggaggaggtcagggggtttgagcgcacgaggaggatggggagcgggggtggggggtgcacggctgcccaccctctcgcctgcctgccgctgcgccttcaccagccctcacacgacccagcacacctccaccctccctcctcctttccctgccggtacatcgagtacgtgcgtgcctcgtgctcgccgcgcatcaccgactcggccgcccgcctgctggccaacgagtacgtggacctgcgaggggaggcgcagcgcgccgccagcgccgagggcgccgacgtccccgccatccccatcaccgtgcgccagctggaggccatcgtgcgcgtgtcggaggcgctggccaagatggggctgcaggcggtggccggcgagacccacgtccgcgccgcgctggagctgttcaaggcctccaccatggacgccgtcaagtccggactcatggacaccctggtcttcagcgaggagcagcgcgccgaggtgcaccgtgtggaggagcagatcaagcgccgcgtggccatcggctcctttgtctccgagcgcaagctgctggacgagctcagc

SEQ ID NO: 621 - DNA, 1557 bp, Chlorella protothecoides
ggatgcgcaagctgcaggcgggcaagctgtccaagggcgaccgcctggcgcccgcggaccatgcgtccatcgcctacgcgcccttccgccgcaacttctaccgcgagccggaggccctggcgcggctgggcgaggaggaggtggcgcgcatgcgcgccgagctggacggcgtgcgggtgcggggccgcggcgcgccgcggccgctggccaactggcaccaggcggggctgagcgggcggctgtacgagctgctgcggcgcgacgggttcgaggcaccgctgcccatccaggcccaggccctgcccgccatcatgtcggggcgggacaccatcggcatcgccaagaccgggtcgggcaagacgctggcctacgtgctgcccctgctgcgccatgtcaaggaccagccgccgctggcgctgggcgacggcccgatcgcgctggtcatggcgcccacgcgggagctggtgtcccagatcacgcgcgaggtgcggcgcttcggcaagcccctgggcgtgcgcgccacggcggtgtacggcggttccggcgtggccaaccagatctcggagctgaagcgtgggtccgaggccgtggtgtgcacgcccgggcgcatgatcgacatcctggtgaccagcggcggcaagatcacaaacctgcgccgcgtgacctacctggtgctggacgaggcggaccgcatgttcgacatggggttcgaaccccagatcgcgcgcatcgtgaacaacatccgccccgaccgccagaccgtcatgttctcggccaccttcccacgccaggtggagggcctggcccgcgcgctgctggccgaccccgtggagatccaggtgggggggcggtcggtggtcaacgccgacatcgcgcagttcgtggagctgcgggccgaggaggaccgcctctggcgcctgctggagctgctgggcgagtggtacgagcgcggcaagctcctcgtcttcgtcgccagccaggagcggtgcgacaacctcttccgcgacctcctgcgccacggctacccctgcctctccctgcacggcggcaaggaccagagcgaccgcgagagcaccatctccgacttcaatcaacatcatgtaatcccatcccctcctcacgcccatccaacacacaccccaccccagtggcggcgcggggcctggacgtgaaggacctggtgctggtggtcaactacgatgtgcccaaccacctggaggactacgtgcaccgcgtggggcgcacggggcgcgcagggcgcgcgggcaccgccgtcaccttcatcgcgccggaggaggagcagcacgcgccggacgtggtgcgtgcgctgcgcgagtcgggggcagcggtgcccgccgacctcgccgccctggccgagtccttcgaggccaagcgcagggcgggcaccgccaagctgcacggctccgggttcggcgggtcgggcttcaagttctcctctgccgaggacaacctggtcaaggccctgcgcagggtggggccccggagagcggggagggaagggggtgcggggagggaagggggtgcggggaggaaagg

SEQ ID NO: 622 - DNA, 1341 bp, Chlorella protothecoides
ggccttgaccaggttgtcctcggcagaggagaacttgaagcccgacccgccgaacccggagccgtgcagcttggcggtgcccgccctgcgcttggcctcgaaggactcggccagggcggcgaggtcggcgggcaccgctgcccccgactcgcgcagcgcacgcaccacgtccggcgcgtgctgctcctcctccggcgcgatgaaggtgacggcggtgcccgcgcgccctgcgcgccccgtgcgccccacgcggtgcacgtagtcctccaggtggttgggcacatcgtagttgaccaccagcaccaggtccttcacgtccaggccccgcgccgccactggggtgggggagaggcaggggtagccgtggcgcaggaggtcgcggaagaggttgtcgcaccgctcctggctggcgacgaagacgaggagcttgccgcgctcgtaccactcgcccagcagctccagcaggcgccagaggcggtcctcctcggcccgcagctccacgaactgcgcgatgtcggcgttgaccaccgaccgcccccccacctggatctccacggggtcggccagcagcgcgcgggccaggccctccacctggcgtgggaaggtggccgagaacatgacggtctggcggtcggggcggatgttgttcacgatgcgcgcgatctggggttcgaaccccatgtcgaacatgcggtccgcctcgtccagcaccaggtaggtcacgcggcgcaggtttgtgatcttgccgccgctggtcaccaggatgtcgatcatgcgcccgggcgtgcacaccacggcctcggacccacgcttcagctccgagatctggttggccacgccggaaccgccgtacaccgccgtggcgcgcacgcccaggggcttgccgaagcgccgcacctcgcgcgtgatctgggacaccagctcccgcgtgggcgccatgaccagcgcgatcgggccgtcgcccagcgccagcggcggctggtccttgacatggcgcagcaggggcagcacgtaggccagcgtcttgcccgacccggtcttggcgatgccgatggtgtcccgccccgacatgatggcgggcagggcctgggcctggatgggcagcggtgcctcgaacccgtcgcgccgcagcagctcgtacagccgcccgctcagccccgcctggtgccagttggccagcggccgcggcgcgccgcggccccgcacccgcacgccgtccagctcggcgcgcatgcgcgccacctcctcctcgcccagccgcgccagggcctccggctcgcggtagaagttgcggcggaagggcgcgtaggcgatggacgcatggtccgcgggcgccaggcg

SEQ ID NO: 623 - DNA, 174 bp, Chlorella protothecoides
cccccccacccccccacccccgggcccccaggcatggactgggacgagctggagaaggaggctgcgagggaggacaaggcgcaccaccactcggaggacgaggacgacgaacggcctcgcaagaggaagggcgagggcggcgctgcggcaggctccaagcgtgggcgtcactga

SEQ ID NO: 624 - DNA, 1011 bp, Chlorella protothecoides
atgactgagggggtggagacccccgcggagtttgctgttgggtgcagcgtcagattgcgggtcgaaggcaaccaggaactgtctggggagatatttgcggtggatcccacatacaaggtcgtagtcctgaagacgctgggcgcggatgccgacctgcccgacatagcgatcctgaacatggattccgtcacagaaatagtcgaggccacccctaggaagactgctccctcagaggactcggaccagctcccggaggtggaccccaagcggggcatccagcgggaggctcgggccgtgcggcttgcccaacaggacgcacagaggataggagttggagtcagcaggaggggccaggcagtgtacgatgcgatatccaagaccctgccgtgccactgggatagcaagaccatcgtggtgctggatgaggtggccatctccgagccatatgaggttagcagctgccgaaatctccatgacagtgactcccccctcctcgaacgtgtccgattagtggtgagcggggcgggcctccagcagggagggggtctggtgtatggcctgcgaatgcagctcctaagccagccagtctggtggtacgatgatgaggctggagcgaggccaatgacatcggtgcatgggtgccaggtctcatcccgcagggcaatgctgcatgtcttgctgatgccccttgtgccccccgccccctttgccaccccccgtatggcccctcactgctctctcttgcacccacttgaagttttacacggctacaccgttgccgcccctgcatctgccgatgggtgtaaccccactccctcgctctgtatgggtggggacagctgcagggcgttcgggcccacacactcctctctcctgtctgcgggtggggcagggagggtgccggggtcgggcggcaggcaggcacccaggcatgtcagttctgtgagccccgaggaccacgctcccaggcagccgccccacctggttcgtagtagtcaccgtggtcattga

SEQ ID NO: 625 - DNA, 807 bp, Chlorella protothecoides
atgtgtgtcgtcttgtctgaagtctctacatttagcgcaagctgggcagggctccaggaaactgcatcaatcgtcagctgtcacgatgaggacagagtgaccgctatgtcgccggggctccaatggatacaggcctccacctgcagcatcaggcctctgggccattgcccgagcaacgttttccgctgcttcagattgcctatatatcgaaggggcgttgcgtggcgattgcctgcccggcaggagggcctgcagcccagcgtggtttggcccgagatccccctgtctcgcctagacgacgatggcgcgggcggggacggcgatgagagcgagttcgagcgccgtacagccctcgggatataccagacccaggaggagatcgacgaggacgagccggagcgccagcgctggcacaggcagctggccatcctggccaggagcgggaagtacaacaaggctgccgaggtgctggacgagatgctgcgcaacggtttgaccccgggcccccgtgcctgccacgccctcctcgtcgcccacgccagcgcgggggacgcccagggtgcctgcttggcgctggagctgatgcagctggcaggtgggtcaggacggcggcagtggtgtggtgctggccgagcatgggctgaggctggaggaattgaatggaacgggagaacttgcgtgctcaccccgagtccccgccatgcttcttcgcgctgcaggcctaacgcccctgcccgagagcctctgccttgtcattcagctctgcgtcgtggagggggagctgggcctcgccgcagaggtctttga

SEQ ID NO: 626 - DNA, 1044 bp, Chlorella protothecoides
atggtcgagcacctccagtctgtgtttagccgggtggtgtcggagctgacctttgctggcgtgcagccgaacaagaagttaatctcatacctggttgcgggccacctgcacttcaaggactgccgggcggcctggaaggagtttgagaagctggtcctgttcaggaaaccgtatctgaagcatctggatgacgaacagatatcggagctgctcaacatgctcagcgcgtccgtcaagtcccaagagatgctgtttgtgatgacactcatgctcgatgagggccgagtcctgacgggcgcagactttggaaaggacaatcagggtcgcagcgtctgcacgagctggctgcagcagcgcatccagaatctgaagacctttggtgagggtcgtgtggatggcagggtgcatcagcataatgaccttgctaaagagatgaagtgtgcagaagcccttcattcagctcaagacgcgcctcatattttacttaaagtttgtaacttgatccctacaacatgtcctgtctcactctgctcatcaggcgtggagtctgaggcggcgggcaaggagtggctgatcggggacggggtgatcatcgacgttgccaacgacagtgtcgtggacaaggagggcaatatgattgacattgctgccatgaacgtgcgggagctgaaagccgagctgctgcagcggaagctgcaggtgtccggcagcaagacggtgctggtgaagcggctggaaaaggcgaggcggggcggctttgacggcgcccagaaggccccggccgcagagcctgaaaagatcctcatcctggaaggccaggagttctggcgcaacggtaagctggtggaagtcacggtgcgtcaggccgaggcggacgacgccgacgccgacgaggaggacgacgacttcctgcccgacgccaccgagcgagatatcgacgacgtgagtgtgggggcacctggagcagcctactgggtgccccagtgggggtgcattaacaacacaacattcaggcagggttgcctggtggccaggggaggctaa

SEQ ID NO: 627 - DNA, 255 bp, Chlorella protothecoides
atgaagagcaccacgctgtatgtgggaaggatagcccccagcgtggaagacagcgtgctgcgggagctgctggaggcgtgtggtgaggtgtggaagcccaccctggaccccgacacctccaagttcaagggctttggcttctgcacctatgcggagccagagggggtgagcatcgccatccgcgtcctgaataacctgaatgtggatggccagcagctgatcgccaagaccaacaaggtgctcagaagggggtag

SEQ ID NO: 628 - DNA, 1470 bp, Chlorella protothecoides
atgagccgagaccagacgcagggcaccgtttgtttgccccgcggagcaccgtgccaaggtccaggtgactgctccccttcctcactacccctttcccctctgcgctccaggctgtactttggcgagtccaatgtggacggcatgctggacaccctgctccccctgcacgagatgatgaaggagaatgggccctccaccctccaggagattgcctttgtccaggtgcagagttcggggatgggcctggggcgtgtgcatgggggaggagatggatgggttgcttgctggcggtggagttcgggagtgctgcacagccctgttccactccagcccctccccgctacagacactcgggccccttcagcagcatcgtcccccccacctaaactcccccattgcacatcacaacaggcgtatgggcgcgagctggacgaggcgtacgagtggtgtcttaagttcaagcagtcgcggcgcgaggccgagctgcaccaggcctgggacctgtactaccacgtcttccgcaagatcaacaagcagctgccctccctcagcgtgctggagctgcagtacgtcgctcctgcgctggtccgggccaagggggtggggggacggagggcctttcgtagcgaggagaagcaaagctcgcctgcgtgccttcccagctgtgccctgggcgtgccggtctcgctgcccggtgttcctgctgcggtgtgccgcgatcgagcccaccccttgtcctcctctcctcccctcaccaagaacctggagctggcggtgccggggacgtacatcgtgggcgaggccatggtcaccatcggcagcttccgctcccagctccacgtcatcacctccaagcagcgcccgcgcaagctgaccatcctgggcagcgatggcgccgagtacatgttcctgctcaagggtcacgaggaccttcgccaggacgagcgcgtcatgcagctgtttggcctggtgaacaacatgctggccaacgaccgggtgaccgcggagcgcgacctgagcatcgcgcggtacgcggtcatccccctgtcccccaactcgggcctcatcggctgggtgcccaacaccgacacgctgcactcgctgatccgggagtaccgcgacgcgcgcaagatcccgctgaacgtggagcaccggctcatgctgggcatggccccggactacgaccacctgaccgtcatccagaaggtggaggtgttcgagcactccctcaactccacctcgggcgaggacctgcacaaggtgttgtggctcaagtcgcggagcagcgaggcctggctggacaagcgcaccaactacacgcgctccaccgcggtgatgagcatggtgggctacatcctgggcctgggggaccgccacccatccaacctcatgctcgacagatactcgggtgggtggggagtgtggggaggggtgggtcctggggaaggagggctgggaaagcagggctag

SEQ ID NO: 629 - DNA, 531 bp, Chlorella protothecoides
atgcggcggaggcggcggccgacgctcagcccagggcagccaagcctccacgctcggcgtgagtgggagaggtcggcgctgttcatggttgcatgcagacccaatcacgcggttgctggggtctgggagattcccatctcgcgcagcagtgaccatctccccgcgcccaagtgtctaccatatgagaggacaccctggccctctaccgcaccgtggcacaggcgtgagcctgtgaagacggttggcgtgagggagccggacgactttgtgtcggagcaggtgacagagcagatgcaggctctgttggaggagaaggccagactggcgcgggagaatgcgcgcctactgctggagaacgcgggcctcaagcactgggcgtcgtcctcgtcgccccctggcggagagctgagcgacctcgagcaatgccccctgcttggcctcatcatcccgaactggccatctggagttcaccaccagctccatgcttgggctgcaggagctgctggcgttcacccttgctcaccagactga

SEQ ID NO: 630 - DNA, 342 bp, Chlorella protothecoides
atggaaacccatcgacgggtccaaagcccactctctcctcgtctacaggccacccaggagtacctggactgggtggaacgagagaagcagcaccaaagggcgaccccgggagcagcagcagcagcgggcggcgagggaacccctgaccctaccgccctggagaatgccgcgctggagaaggtcatgggcatcctgagccagagggcaccccagcagctggccgagcagccggagcctggcgaggcggtggccgccgcttcagacttcctcgccggcctgcagtcgaccagcacgccgacagctcagcaggagcccccagggtgcgtggttagctacgggtga

SEQ ID NO: 631 - DNA, 1125 bp, Chlorella protothecoides
atgctcaagacccctgcctctccctcggcaggcaagctgctgcacatcgactttggcgactgcttcgaggccagcatgcagcgagaaaagtttcccgagcgcgtgcccttccgcctcacccgcatgatgatcaaggcctttgagatctccggcatcgagggcaacttcaggtgcgtggaggcggaggtcgagaccgagagggcgccgcgtgctcctgcccgatcagtgtgcggcccctgcgccgggtccacaccgggtcgccgggctcgtgacctcccggctgccgccgccccctcccctgcccaaacgatcaccgacccccaccctcaaaacagggccacgtgcaacgaggtgctgcgtgtactgcgcagcgagaaggactcggtgatggccatgctggaggccttcgtgcacgacccgctcatcaactggcgcctgctcaacgccaacgacggcgcggcgttcgaggcggcggccgcgcccgacggcgagctgccaccctcgccccccatgcgcgagtcctcgcgccaggaggccctggcctcggtgccgggggacgccgccgaggccctgaacgagcgtgcggtggtggtcatgaagcggctgtcggagaagctgacggggcgcgactcgggccaggacgaccgggacgccgacaccgtgtctcagcaggtgcagcgactgattgcgcaggccaccagcgccgagaacctgtcgaggagcgagaggcacaggggaaaagagggaggagggaggtccgcaggcaacagaggagggcatggcgatgggtgtcagatcttggagcccgtcacccttggaacacactcggccgctcagccgagtggggtgacggtcccttccgcgcgtcatgccggctcccctgggctctgcgccggtcccgcccgctcatggcagcacatcctcctcgctggggggctggaacgcggccatgcccaggcaggtggccagcgcctggcgcagctcctcccgctccttgggcagcggcacgccctcgatgacggcgtggaggtaggccgcgtcgtcgctgaagttggcggcggacagctgcggcgccaggcggtgcatcatgatggcccgcatcacgtccttgccgagcgcgcttag

SEQ ID NO: 632 - DNA, 855 bp, Chlorella protothecoides
atgatcaccgtcaacttcccgcacaaccccaccggcttcctgccgagccacgaggagtgggcacgggtggtggccgccgcgagcggcgtcggcgcctacctcttcgccgacgagatgtatcgggggctggaggcggaggcggcggaccgcctggtccccgccgccgacgcttacgagcgcggcatcagcctgggcgggctcagcaagtcggtgggcctgccgggcctgcgcatcggctggctggcctgccgggacccggagggtgaggcgctatcttggtggtgtgggaggggacttgggccgggtacgacctgccgtcgccagggctgggaagcagagccttcccctctcccgtccaggactcaaacaggcgccgtgcacgcacaccctcgcatcctccacccccgcaccccccgtccagtgatcaagcgcgcgctggaggtcaaggacttcaccaccatctgctccagcgcgccctccgagatcctggcgctcgcggcgctccggcgctgggacctgctcatgcaccgtcagctgggcatcctgcgtaccaacgcggccgcgctgtgccgcttcggcgagcgctgggcgcgcctgctcggggtgtacgccacgcgcggcgggaccatcgccttccccaaggtcctggtgccggggttgtcggtggacgcgctggccgacgggctgctggaggaggagggggcgctgatcatgccggggtcggtgtacgaggcgccgcagcacgcccagcgcctccgcctgggttttggcagggccaacttcccggagggcttggcggcgttcgacaggtacctggaacgccactacggcgagtatgccgtggtgtcggaatga

SEQ ID NO: 633 - DNA, 414 bp, Chlorella protothecoides
atgccgcaaccactccgccccttcggcctggagcggtacctggcaccccgggagttcaaatgcatacatccaatctgtgtgagcgacaccgagacctggaagttgtcggagctgctggaacatgctgacgcggacacccttgctcggtggaatgacctggggctgggctacaccaccacccagggcctggaggtgctgcgggaggagattgccgcccgccacttcaccaagacgggaaaggacgacatgctcctggacgcccctggcgatgccatgtacgtcgccatgcgggccctgctcaggcccggggaccacgtcatctgcaccttccccgggtaccaatcgctatacgagacggcgctgagcatcggctgcgaggtcacccactgggaggcgcaggagacgtgcgtatga

SEQ ID NO: 634 - DNA, 387 bp, Chlorella protothecoides
atgggtagcgaaccggttctggcaggtaccccgaccttgccagacacggtcggtccacccggcaccaataccccccaccaggctgcagcggaggacatcgaggaagcggagaacgagctgatgctggccgaggacgaggaagtgccttaccttgtgggggaatgcttctttcatctcgaaaaagaggtcgcagaggcccggctgcaagagggtgggtctcgaggggcaaagtggggcggggggctgctggctccggctctcggcacgatcgcccgggtggtgcgagaaggggtcatatctagacactgggtaagcaagcacactttcatcccctccccgcccagctgccaacgagggcacgagccagtgtgccgccttgtccgatga

SEQ ID NO: 635 - DNA, 765 bp, Chlorella protothecoides
atgatgtttaaccaccttattgggttccggaatgaattaaattgtgccagatggtggctgagcggccaagtgcatggaagcatcacccctaggccctctcaccgccatccactacacaggaaggattactacgacctgctccacgtctcccggcacgcggatgccgctgccatcaaacgtgcctatcgcaaggtcgcgctgaagtaccacccagacaaagtgcaggggactgaggaggagaagcaggcggcagccaagacctttgccgagattggccacggtgggtgggttggagggtgctgcttcgagcgtctgccaggcgtggctgatcaacaaatgtcacccctgatttcaaccgaccatgtagcttacgaggtgctcacggacgagaagaagcgccagatctatgatcagtatggggaggagggcctgaagcagatgggcaatagcggcggcggccatcacaaccccaatgatatctttgcgcagttcttcggcggctttggttttggaggccatgggcagcaggaggagccccagacgcccaagggcgatgatgtcgtgatcaacctggaggtctccctggaggacctctacctggggcgccagttcaagcatcatccccaacgccgccctcccacccgtcaggtgtgcgaggactgccccaacgtaaagatcgttcgggagcgtgaggaggtgaccgtgtccgtcgagcccggcaccccagacggccatcgcatcaccttttttgaagagggtgggtag

SEQ ID NO: 636 - DNA, 558 bp, Chlorella protothecoides
atgttggccagctccggcgactcccaccacgtggtgctgggcgactcacaaggcggggtcgaggtctgggatctcgtagaggctcgtcctcagccaatcagtgtgttgggagggacaaaccagtctgcgatccatgccctggacacatgcggcggctgcagcggcgaacccgggccgcctgaggtcgtgagcggggctgcagatgggcgtgtgctggtctgggacgctcgtcagccggagagaccggttgcgcagctgtgtgggggcacctcggctgctgcctgggcggtggctctcggtggtgcagggaccgagcaggatcgcagcgtgctggcaggtcggcaagacggcacgatcagtctctgggatctgcgggttggcaccctcctctggtctggcagcatggaggggcagggcgtctgtggactggcctttgatcgacgtggcatcgtcatgaacaaggcctatgccgctggcatgggagggcggcttgccacgatcaacctcagaccctgccaacccgaccacggccgcgccatggaggtgcagcaggtatga

SEQ ID NO: 637 - DNA, 621 bp, Chlorella protothecoides
atgggggggactgccttgcaagcgacctgtctaggccctacccacgccctcctattgccgctctcagcctgccttgcctcgaggatctcgcccatccatacatggtgcgcaggcgagccgcgcgtggatggcgagcatggggacctgatcatccagctggtcacgacgaagcaccccgtctttgagcggcggcagtcgggcctgctggccgagatgaacatcacgctgctggaggccctcaccggcttcacgcgcgaggtgggggccgggtgtggagtgggaggctcagagtgcgtgtgccgccgtattggaggtgaaagggtgccgagggccgtgccgggggtgagctgggctgcatgcagaggcaggaacgcacgagcccatcgctcgaacggccaccgctctgaagcccccttctcatgcgccctcagctcaagcacctggatgggcacacggtcgccgtggggtccaagacggtggtacgccccggcgagcagcgctggttcaagggcgaaggcatgcccatcatggacgaggtggggtggcgggcagggaggcaaagggggtgggaagagcggtgctggatgcttcaggggttatgcgaacccatcagcggggtga

SEQ ID NO: 638 - DNA, 288 bp, Chlorella protothecoides
atggactactgctttgaaacactgcttcatcataacttgggcaccgccgacgatggcttttacaacaccggaaacaaaaacatcggcgactacaactacgggaatggcaacactggcaatttcaacattggcaacaataacacaggaagccacatcgtctgcaataactgggccgcagattctccatgtcaggtcgagtacctcagaacatctgagacagtctacatacctggaacccctccaccctctcctccccctcccacccccccacctccgaacccgcccccg

SEQ ID NO: 639 - DNA, 624 bp, Chlorella protothecoides
atggtggcctggatcccccccgccccgggcaaccgcctgttctactccttcctggcgccgccgcgcctggtggtcaccgctgcgccccagctcggcagccgcctgctcaagtacagcgcgcacgtcgcgcgcgtcagctccctcatcgagcagcgcgtgcgcatggccttcaccaggaacattgtcttcccgggtgaggccgtccgccggcgggactgggaccagacgggaggggggcctggcgcagggggacctgcactgggggctgagtgggagggccggggtctggggagccacgcctgcgggcgccgcgccacccctgccccgcccgaggcgggcacacctcgccggaatgtttcgtcccgggaaacctcgcgccgcacggctggccctgtccgcctgcgcaccgcccactgcccctccaccctcctgcgcaggcggtggggacatcctgctgcctggtctactggggctggaggaccccggcgtggatgcctgcctgccgggcctggggccgctgggggcgggccgcggcgacacggcgcggggcgaggaaggcgtggggccgccaggcgccgggcccgaggagggcgggggagcggagggaggagcaggggccgatga

SEQ ID NO: 640 - DNA, 1041 bp, Chlorella protothecoides
  modified_base (174)..(183): a, c, t, g, unknown or other
  modified_base (932)..(941): a, c, t, g, unknown or other
cccccccctctgcagctggtcaaatatggcgtgatccgcgagtcggagctggagcgcgacctgacccagtggaacagcctctactgcgccggtcgcctgcagaagccggtcgcctgggtcaccgcccccccgcccgggctgcacgcggcggccgcccggaacctggccagcgcnnnnnnnnnnacgcctgcagaagccggtcgcctgggtcactgcccccccacccaggctgcgcgcggcggccgcccggaacctggccagcgccctgctggtctgccgcctcctcctgccgcccacctttggccagcccgacctgctgcatgcactgtgcgcgctgagctaccgcggcgacgtgcgcatgggctgggccgaggacggggccaagctggagcgcctcgtggcggggcaggggccggcgctgggcaggctgtacgcgccggcgctgcggcgagccatagaagaggagggcacgctgcgtgcgctgggccctggggtctggaccagcgagcggtgcgagcccctgggcgcccgccacctccaggccctgccagaggtcagggggcccggccggagggcggggggaggaatgatcatgcgtgcccttttgactgcatatgggctgtgtcgggccaatgctcgccagatggaattatggcatgcacacgggctgtggcgtggcaaacttgggtgcaccccccttccgtcatcgcaggcactcctgcagcgcctgcaggcggcggcggcaggccaccccagcccgcaagaaactgcggcccagctggcgaggcagctggaatccgcccctcaccttgccaggcacagcgtgcagagcgccctggccagcatcgtgcgggcctccagcctccgacagacggccctgggcctcttgagcgggggggtggtcaagtcggcgcggtatggactggccaaannnnnnnnnnccagacagcccttggcctcttgagcgggggggtcgtcaagtcggcgcggtatggactggccaaagtcagcaaggcatgggccagacggcaggccctgtga

SEQ ID NO: 641 - DNA, 720 bp, Chlorella protothecoides
atgtcggccgccgccctgggcgacgccggcgccaaccacctggggtactacaccggggtctggtcgccctgcggcagcgccgccgccgcccacgggtacaccgggtcgctgcatgtctggcggcgcgacggacaggcccctggggccgagggcccgtggcatcccgtccccgcgcccactggccatgtggcggcggtggtggacgcggcgtgggccggggactgcctgctcacggtctccgaggaccagacagcccgatgctgggcccgctgcgtcggggtggaaaacggggatggagctgcgcgtggaggaacgcgagaggctatggcgggaggacatcgctggcgggaggtcgcgcggccgcaggtccacggccacgacttctctggcctggccgtggttccggaagctgctgctgaggctagcacttctggggaggttgccggggagtcgagccgtgcgccgccctgctacgcgagctgcagcgaggagaaggtggtgcgcgtgttcaccgcgccgcggaccttcaccgccaccctggcggcgctgacggggcggggcagcggtgcaggcgccgaggctgaggcgagcctcgacgccgggcccgagcaggccctgggcgccgcgctgccggcgctgggcctgtccaacaaggcggtgtgggaggagggcgccgccgccggcgccgacgaggccggcgaggggcggggcggccgcgct

SEQ ID NO: 642 - DNA, 1053 bp, Chlorella protothecoides
atgaactggatgacgtgcaattgctttgcgcgagcctctgcaccgcaatgcctggcagtaggtcagtgtgccggcgcctcacctgggggtcgtacacaaggatggtgtgttgggcggcgtaggcgatcagacccgaccgtccccatgccagggcctgggatgcacgattgcacccggctgcatggtgctcctgctcgatactgtgatgtgccatcagcatgtatgtgccaggacatatgcctgcgagcatgggcgcccggacttgtagtacctcgccttcgggcgccctggtacctcgccctcgggcgccctgggtctgctgataaatcaacgaccagagagccgggacggatcaggggtcggactcgcatccgaaggccacacaggcttggacttcagtcacgagacatatctttgagccgtcgggcgtccgatctgagggcggacctcgagatgtcgacgggccagtggcctcccatgtaccccggcatggctggagggcccatgtaccaccatcccgccatggggtggaatgtgatgaacgcacagatggcaccccagatgccggccttccccccaggacatcccatgtacccgcccgctccccccggccaggcagcccctccctaccagcccgccacgaccagcggcgagctccgcaccgtattcatcacgggcttcccgcccgacatcaaggagcgggagctccccaacctcctccgcttcctgcccggctacgaggtgggtggtgggcggcatgatctggtggggatccttggcagttacaagggtatcatggagtggagtggctgctcccgggtcgcacgtgcggtgtttgctcgcgggcctgaggccgcgtcccaccaggggttgaagcttgcggttgcagcgcactcctggcgggttcacccctcgtcacgcctgccacaagaacccctgcacgcaggcctgccagctgcacacccgcgccggcgcgcccctcggcttcgcgctgttcagcagcacccacgcagcgcaggcggctgtcagggccctcagcgccctcgcctttga

SEQ ID NO: 643 - DNA, 786 bp, Chlorella protothecoides
  modified_base (381)..(390): a, c, t, g, unknown or other
atgaacgagagcggcgggccagggcgctgggcgggccagggcgccagcgccctagccggaaactcaagccccacgcgcgatcacccggcctgcaacacgctgtacatcggcaacctgggagacgctaccgaggagagggagctgaacgacctcttcgggcatgagcagcaccactgccagggccagcagagcgctccacgcgcagggcccaaaatgaatggtcattttaaactcatgggtgctgcattgtccctgaaaggcgtgcagcgatgtgctcgtggtctcaggcagcatccagccctccactcaccccccccccatctcaccaacccgacgcccgcagctcctatgctggcttccagcgcctgcgcctcctgcggnnnnnnnnnnggactcatgggtgctgcattgttcctgaaagacatgcagcaatgtgctcgtggtctcagacagcatccagccctccattcaacccccccaactcaccaacccgacgcccgcagctcctacgctggcttccagcgcctgcgcctcctgcggggctcccgcaccgtctctgcctttgtcgtgtttgaggacacggcgacggcctcggcagcccgagagggcgcgcagggctcctcggtgccctcctcggaccgtggcccgctgcgcatccagttctcgcgcaacccctcctctaacaagcgcgacgcagcgagcgcgcagctgccgcaggacggtggctggatcgcgggcagcgtgcagcggccgcggcagggcgactacgcggcagccggcgtatga

SEQ ID NO: 644 - DNA, 570 bp, Chlorella protothecoides
atggggcaccaggctgcccagtgcacgactggcaccatcaactggcggcaaatgtacggcgatgtcgccttccgcatccagcccacggtgttccagtccgacatcgacgccatcaagaaggccagggaggtggaccacgcaaagctggcggaggttgcagcagcttgggccaggagttttggaaacctgtacgctccagatggccttcatgctctgccacccgaccccgagcagaaacgacaagaggagctggagaacccccagcctgagcctgcacagcaggcccccagcgttgctggaggtgctgcaggggaaccctcggaagtgttcccacccactggcggccctgacgcagcagcccgccccggacccgcagcagccgcccaggcagtcgcacctgcggtcgccatcccgccgccagcgggacctccacccgccgccgaccccacccagggcctgccagagggctggggcgccacccgcgacggctccggcaaggtctactactggcacaaggtcaccaagaaggtgcagtgggatcggccgactcccgacacccccatcagctga

SEQ ID NO: 645 - DNA, 1680 bp, Chlorella protothecoides
  modified_base (266)..(275): a, c, t, g, unknown or other
atggagacaatctcagagccggcctccaccagcttggtgttgatggcgccgatcaaggtctcgcgcacgatctcgggccaggtgcctgcggcggggtgggcggggagggtgggctcgggtgggagggccattgagtggggcgtggatcagcagccgtcaccgcatgcactgcggtcgtcgaagggggttgctagaccgcccctccctgccctgcaggctcagccaactgcccatcctccatcgcacacactcctcaagtgcacagnnnnnnnnnnttcgaagggggttgccagactgcccctccctgccctgcaggctcagccaaatgcccattctccatcgcacacactcctcaagtgcacaggggacaggaggcgagctgctgcgaggcagactgagtaccgagaggatcacccaagacctccccttcttggtgtccttcatgctgacgggcttgtactgggactcgctgatctcgaacatgagcgaccagtagggcccctcggcggcctcgcccgaggcagggtcctcgccgttggccaggcacagcgtgggcagcttggaaccgccctccgggcagttcttggccgcgtagtgggagaagacggtggtgcggtagaaagggcagtcgtcctcggggaaatagagccagcacttgaggccgtgggggcacttgccgcggatgcctgcggagcagatttgggttcggagcgagtgtgggatgatggacggggggacgcagcagcggcccccacgcctgattgcggggcggcctccccaggggagcaggattcctcgtgccgaggttggcacctcatggacacatgctgggttccccccttgcagaggattgctccaaggattgctccagtgacggggaggcttctcacacacctgcccatgcctgcggcccccttccacccctccaaaggccccccccccacacacacagaatcagagacacaagcacgcccactcaccgatgcccacgatgtgggtggaggagtactgcaggcccttggccaggtcatcgcggcccagccagcccagggagatgtccagcgggatggtgctgatcagcgtgtcgtaggccagcttgcgcccgtcccggaaggtcaccgtcttggccgccttgtcgatgctggtcacggtctgggcgggaccgtagcgttgacgctccgcgggcaggagcgcggccacggccttccagatgccgcccgtgccgccctcggtggggaagcggaagacggcgttgggcccccaccccgcgtcctccttgttgtggatgacgttgttgatggcgcgctccacgtccaccgtggccacacgctcacccagccactcgcactgcatgagcgtggtgggcaccgcccagaccttgaagttgtaggggcgcatgaacaggtcggcgatgccggggcccatgacgcgcaggatccactcgtcgaagttggcgggcttgccctgggccaccgcgttggccaccttggcctccacgcagccagccaggcaccggatctggtcctccttgtccagggcggagatgttgttctggaaggggtaggccacccaccggttcttcagccagacgtaggacacgcgctccagtgtgttccaggcgtccttgccgctgcccacagctgggagaggggtggggggaaggcgggtgtgtgtgtgggg

SEQ ID NO: 646 - DNA, 546 bp, Chlorella protothecoides
atgggcaggtgtgtgggaggcgtcccccgtcactggagcaatcctctgcaaggggggaacccagcatgtgtccatgaggtgccaacctcggcacgaggaatcctgctcccctggggaggccgccccgcaatcaggcgtgggggccgctgctgcgtccccccgtccatcatcccacactcgctccgaacccaaatctgctccgcaggcatccgcggcaagtgcccccacggcctcaagtgctggctctatttccccgaggacgactgccctttctaccgcaccaccgtcttctcccactacgcggccaagaactgcccggagggcggttccaagctgcccacgctgtgcctggccaacggcgaggaccctgcctcgggcgaggccgccgaggggccctactggtcgctcatgttcgagatcagcgagtcccagtacaagcccgtcagcatgaaggacaccaagctgggcggcagcgcaggtgtggggagggggcgtgggtgtgaaagggggggagagatccccgtgacaaggggaggtcttgggtga

SEQ ID NO: 647 - DNA, 522 bp, Chlorella protothecoides
atggccctcccacccgagcccaccctccccgcccaccccgccgcaggcacctggcccgagatcgtgcgcgagaccttgatcggcgccatcaacaccaagctggtggaggccggctctgagattgtctccatctaccaccgcaggtgggcagggagcagcgcccatgctccccacagatggaaggcggcgctgcacccgaccgccgctgcagccctctgctggctcgtcacgggtctcctgccgaccacacatcctctcgcacacggcgcgctcccatccactgccaggctggagcacgggtaccccacgccctcggtgggccgcgacgcggtgctgaagcaggcgctgcccgagctcaaggccgcgggcatctggtcgcgcggccgctttggctcctacaagtacgaggtggccaaccaggaccactccctgatgctgggcgtggagtccgtggacaacatcctgtttggcacccaggagctgacgctggagtaccccaacatcgtcaacccccgcaagtga

SEQ ID NO: 648 - DNA, 672 bp, Chlorella protothecoides
ggcaaggacgcctggaacacactggagcgcgtgtcctacgtctggctgaagaaccggtgggtggcctaccccttccagaacaacatctccgccctggacaaggaggaccagatccggtgcctggctggctgcgtggaggccaaggtggccaacgcggtggcccagggcaagcccgccaacttcgacgagtggatcctgcgcgtcatgggccccggcatcgccgacctgttcatgcgcccctacaacttcaaggtctgggcggtgcccaccacgctcatgcagtgcgagtggctgggtgagcgtgtggccacggtggacgtggagcgcgccatcaacaacgtcatccacaacaaggaggacgcggggtgggggcccaacgccgtcttccgcttccccaccgagggcggcacgggcggcatctggaaggccgtggccgcgctcctgcccgcggagcgtcaacgctacggtcccgcccagaccgtgaccagcatcgacaaggcggccaagacggtgaccttccgggacgggcgcaagctggcctacgacacgctgatcagcaccatcccgctggacatctccctgggctggctgggccgcgatgacctggccaagggcctgcagtactcctccacccacatcgtgggcatcggtgagtgggcgtgcttgtgtctc

SEQ ID NO: 649 - DNA, 876 bp, Chlorella protothecoides
  modified_base (132)..(141): a, c, t, g, unknown or other
  modified_base (320)..(329): a, c, t, g, unknown or other
  modified_base (854)..(863): a, c, t, g, unknown or other
atgctgcgagccttccactcctggaggagcgaggcggcgcagtttgcgtccagcctgcagtcctacatcgcgctggaggtgatcgagcccgcctgggccgagttcggggcctgcctggggaaggcgcgggannnnnnnnnnagggcttgggttgtgaaaggcggtggggcacgcgacgggctgggtggtgggactgcacgaggggatgctggccaagctggtggagagcttctcaggtggtcttccactcctcccgctctgtcttgcgggtgtttcgctgttgggactcacgtccacagcccactcttgctggccaatgnnnnnnnnnncctggacgaggtggtgggactgcacgagggcatgctcgccaagctggtggaggtgaggggagtctggagcgggtcttgtgagggatgcggggggccctgtggggctggatgcgtgtggccggcgtcgcagagcttctcagatggtcttccactcctcccgctctgtcttgcgggtgtttcgcgagtgggactcacgtccacagctcactccagctggccaattctcgcgttgcaatgttcacccacacactcccgattcacacccactccagggcctgttcctgggaggcacgggcccaggcctgggcggcagctccctgggagggcagcagggggcatctgcggccccggacccgcacactggcctccgagcggcgctcatctctatggccgccctgctggtgaggagtgcgctgcgctgtccagtcaggcctgcagatgtcgcactgactgtgtggttgtctcggtgagagcctgtctggcggccggcacgatgcctgtgcctgcctgccgagacgagacccnnnnnnnnnngttgtctcggtga

SEQ ID NO: 650 - DNA, 378 bp, Chlorella protothecoides
  modified_base (355)..(364): a, c, t, g, unknown or other
atgcatccctgcttgccagcccgacatgaggcccgatcagtcatccattcattacccacgacccgccgccagggacacctggatgccgcgctgcgcgccagcaccgcctccagccaggacaccgacgtggcggaccggctgaccgtgcgcctggcgcgggcgctggagggcgactcgggctgggacgtgttttccctgcagtatgccgtcgacggcgcgctggcggcagtgctcgcccccagcgccatggcatgtgaggctgggggaggggattttgtgatgggggcgggttgtagggaagggtgtggcgtgtggctgggggttgggcagcctgggggaggaggcgagggtcgcnnnnnnnnnngccatggcatgtga

SEQ ID NO: 651 - DNA, 1038 bp, Chlorella protothecoides
  modified_base (179)..(264): a, c, t, g, unknown or other
cggccgcgtcgcggcccctcgccgcgcttgcatcgcgacgacggcaccgcggcagccggccaggctaacgccagcctcttcaccgtcctggtcaccgatgcgcccgtggagaagctgcacctcctacgcctgggcgtgtttgactttgcgcgcggcgcgccggcggcggcaggggcggnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtgccggcctacaccgccgcgcaggacgactttgcgctggcgctggacgtggggagggacggagggaggggccgggcggggcgggcgacggagtgtgttgggctcggggcggggcggggtcgggaaccgtgcgctggggcgagcgcagatggtggggcccctgttggccagcgctggagggcgccctgggattctcccggcgcccctcagagcgaccacgaggccttggcttccatccgacggcgcatgactgccgcccggcactttcgcagaggtggagaacggcttgtggacggggtccagccccagcacgcccgagccggaggaggcggcggagcggcggcggtggcgcgtggcgcgctggctccgccagctcctgcgccgggaccagaggtgggtgggacccgacaccgcaggccgcccgccgcgtggtgtgccggtcgcaggcgcgcctgcctcgtggcgccaggctggtggtgccgcctggggtctgtcgcgggcactgccatgcccagcctggtccccctttccacccgcagctacaccgactggcgtcgggatgtgcagtgggccatgttcaacaagcgcgtgcgagtggcaaccgagctcttcacggagctgtttggcgacgacttcgacgccatcatccctatctaccccaccaaggtgcgcgcagggggcagacgggggccggcacggcgtgtggcacttgggcctggggtgtctttttggtacttaagatctgggcctttcggcaaccaagcaatctga

SEQ ID NO: 652 - DNA, 2457 bp, Chlorella protothecoides
atgctggacaacagcagcgcggactccctctgcaggtcggagggatatagcaaggcgggttctacccaaacaaatactcttgacgcccttggtctctccgtcagcgccgtcaagatgagcccctttgaggctggacaaaaggcatgcgccgcggacagggacggcaacattggcaccgggaacaaagggaaatacaatttcggcgacaacgtgggcgacagcaacattggtaactcaaacaagggagacctgaactggggattcaacaacaagggcaccaacctacggtgcaacaacgcggtgggaacccgaaaaggtcccaacatgtgcgatctgaaggatcttcgcaagtctgtagtgagagactttagcccaccgccgcctccaccgtccaaaagggcgaccccaccgcctccaaagcagacgactcccccacctcctaagaagccatctccaccacctcccaacaaggcatccccaccacctcccaagaaggcatccccaccacctcccaagaaggcatccccaccacctccagtgaagacctcacccccacctccagcgaagacctcacccccacctccagcgaagagacccaccccacctccagtgaagacctcacccccacctccagcaaaagaaccacccccacctccagcaaaaaattcacccccacctccagtgaagagatcacccccttcaccatcgcctgcgcagcccttcaccctgtctcctcctccaccctctcccatttacccctccccttaccccttttctcctccgccctccccccctccaccttctccttccccacctccatctcctcctcctccatctccacctcctcctccccccgtcttgccggttcccgtcttcaccctcacgataaacgacaataacacatacacttttggtatcactgcatcggtcgccttcactcgcttcttcattgttaagaatggaaagactgtatggcttgacaacatcgaccctcctgccaccagcttcattgacagtcctgtgcaggcgattgcagtgctctgtgaaggcaacgccagtcgcggccaccctccccccgtacctgttgtggcgccagaccttgtgatattggcctgtctccagcagagcctgctgcccggcaccctgcctatgcagatgacccaggtccatccctggtctgcaacgacactgcccctagtcctttctcgcgctcatcaccctgacttgtgtaaggcaagcatccaccggcagccacagcatacttgccagggcactgtgcaggagcggacagcacccactcgacgaattgttgctgtccacctctcctcacccatatcttccttgactctctgccacctgttggcacacagcgccctccagacaccttcttgggacgatggcacccaatcccaaggggactttgaaggcgcttgcactcgatgcactccagatcgtgttgcggaagtccacaccctgcaatgccacacggccctccccagcagcagggctgggaagatgactgatcacatgtggtacgaagcggtctacgtccccacggtggagcagagatggtctctggtcccaagggctgtggtggtctcccagtccccaagggctccctcctcgataaaacggaacccatctggtggttgcactcccctcaccaccaagatggggtgcacaccgagcctcggacgctgtggtaaggctggagtgcgcgatgaaggacagggtaggccggagtacaactgtgtcgccagacgtcgagcagctcagcaaatgccacatgggtcggctgcggaggtgctccacctgtccatcgatgtaattgttttctgcacggattctgcagtatcaaattggatagagctaagatctgggcgagctgctctcttatatcaaggccgccccccatcaggcgaacacatcgggaataaagactcaaaagattaccaggatgatgctctcggttctctcccgtccagcgcccgtggcggtgggaccccgtccccagcagaggaggacgacccgggtgcatgccgctcagtccgagcgtaccctctggctgccaggtgcgcattccatgtgcatgttgcagctcactttgtgaagacatccaatcttggcacatggcatgcatcgtcctcgggggttccccatgaggtgggggtgggtcacggcatgacgcctccgaaatggacacgaaatgccagagtatctttgtcacaggtgcgggatctccccctcatctggacggctcccttcctggcggtgagttttctcgactgccatggaattgaggttggtttcagccgaagtcgtccccaggcacaggtgttggatgtaaaaccctacataccggggaacatgacaactaccccctactccccccccagactttggcttcgaccccctgaacctgggcaacagccccgaccgcctcaagtggtttgctga

SEQ ID NO: 653 - DNA, 1488 bp, Chlorella protothecoides
atgagtgacacaagtcgcaaagcggttccctcgggacaggaaaagcacactgtctcgagccccatccctcccgaggactcatctgtcatcccagccggagattgggtgctcggcatggacgacgggcgagcctcccagcggctcgcggttctgactcggcatatcgcgcagggtcagggagcaccatgtggccacatcccggcagattcagaagccctgggatcctgtaatgccttgccgaatgccgagctgggctcgcgggctgtcatctgcccctcgccgaccagcagctatgagcgcatgcatggacggggatcacgggctcctgcggcatggacctccatccccatggtggccggcgtgcagctgaaggagactctgtacaagaaggcagatggagagggcatcgccagggtgagtgtgccgagcctggcgcgctgggcgacaggggtggcggcatgggaaggaggcgagggactgcatggagtagcggcttcatgggaggaccgcgtgaatctgattgtgcccactctgcaacgagggccaaacatgcccggtgccttcaacttctttccccgcagatcagcatcaaccgccccaagcggcgcaatgccttcacgcccctcacaggtgtgctggggtgcgtgcattgatgcacacttcccagtctggctgcatgcctcccagttcagtaccatgacaaatggcactgctcctcagtcccagcatacgccttcaccctcctcccatgaccctcgcacagtgcacgagatggggctgtgcctccgtgacgcacaggacgatccagctgtcggcgtcatcatcctcaccggtgggaaccgggcggcggctggcaccctgtatcccttttccgatgccctggtcgccgcatggagggtatcgctcacatgccatcccgtcggcctcgcccgctcagccggccactgccagtgtgtccctcgccgcccgtcctccatcctcactgcctctgagcacgcctgccgccatccatctctccccccccccccctctttgcaacacaacgacgcaggcgagggcgacgccgccttctgcagcggcggcgaccaggcgcaccgcggcgacggcggctatgtcggtgccgacggcgtgccgcgcctgaacgtgctggacctgcagattgcgctgcggcgctgcccaaaacccgtggtggcctctgtggcgggctatgcggtaggcggcggccacgtcctccacctcctctgcgacctcagcatcgccgccgacaacgcggtctttggccagaccgggcccaaggtgggctcctttgacgccgggtacggtgtctcccatctggcccgcgtggtgggccagaagcgcgcgcgtgaggtctggctgctggcgcgcctctacccggcgcagacagcgctggagtggggcctggtcaacgccgtggtgcccctggaccagctggaggccgagaccctggcctggtgcggcaggggttga

SEQ ID NO: 654 - DNA, 333 bp, Chlorella protothecoides
atgagaggggcaggagaactcccaaggcggtgggtggggtgtgcccgtagtaggaggcgcatgccacggccatggagtggccgccgtggacctcacacgaccccaaacgcgatgcacccatccccaacccggagcaggtgccgggagatcatggccaacagcccgaccgcgctgcgcgtgctcaagtcggggctgaacgccgacgaggacggcgcggcggggatggcgcagatggcgggggacgccacgctgctcttctaccagaccaaggaggccaaggaggtggggggaggtgtggaggagcagggctgggtgcaaggggtggtgaaatga

SEQ ID NO: 655 - DNA, 612 bp, Chlorella protothecoides
atggagcttgccttgctcctgggcgcccccccacccgcgcaaatcctcattcccgcgcagctcatgggaaagagcaaggtgctggtcaaggtcaaccccgacggcaagtacgtggtggaccttgacaaggagatcgaccccactaccatcacgcctggggcgcgcgtggcgctgcgcaacgacgcctacacgctgcacgtgctgctgccctccaaggtggaccccctggtcagcctgatgaaggtggaaaaggtgcccgacagcacctacgacatggtaggggggctggaccagcagatcaaggagatcaaggaggtcctcgctctccactccttcctatccacctcgctgatcccaacccaatccctgacccctcaacaggtgatagagctgccgctgaaacacccggagctgttcgaggcgctgggcatcgcccagcccaagggcgtcctgctctggggcccgccgggcaccggcaagacgctgctggcgcgggcggtggcgcaccacaccgactgcaccttcatccgcgtgtcgggcggcgagctggtgcagaagtacattggggaggggtcacgtatggtgcgcgagctctttgtcatggccaggtga

SEQ ID NO: 656 - DNA, 225 bp, Chlorella protothecoides
atggtgaagccgacaggggaaggccttcgggcctactacacgtccaagatagaggacctggagatcgagatcagggacaggcaacatgcactacagaggatgcaggcgcagcggaacgacctcaacaccaaagttagactgctccgggaggagctgcagctgctgcaggagccgggatcctacgtgggggaagtgatcaaggtgcaggccgggtgtcagcgctga

SEQ ID NO: 657 - DNA, 294 bp, Chlorella protothecoides
atgctgggcggcaccatcctcggggagctgcgcaccttcctcacggagccgggccggatctggtcggcgctgggctcggccatccccgccgcctccaacttcttcatcaactatatctcgtaccgcgcctttgtcatggccttcttccgcctgttctaccccagccaggccgtggtgacgagcatcgggcgcctgatcaggctcatcccggttaatgagggaaaggcagatggaccggcttatgaggaaggagggcagcttctctcaggaagggaggcgcctgacgctggatga

SEQ ID NO: 658 - DNA, 612 bp, Chlorella protothecoides
atggcctcccaggccgtcactttcaccgtgctggagaggctcgcgaagcggtacggacagcagtacaccgaacagaatgtggccatgagcggcacgcatacccactccggtccctcggggtacctgcagtacctgatatacggcatatcgtccctgggcttttacaccccctcctttgacgccctggtcgacggcatcgtggaggccatcgagtcggcgcacgagtctgtggggcccgcctccctgcacgtggccgtgggcgaggtgctgggcgccaacatcaatcgctccccaaccgcctacctgcacaacccggcgggggagcgcgcgaggtaccgccacaacatcgacaaggagatgacggtgctggcggcgcgcggatcgggggcggacgccgccgccaccgcgcagccgcgcgccgtcttctcctggtttccggtgcacggaacctcggtcaacaacaccaacacgctggtcaacggcgacaacaagggcctggccgcgcagctgctggagcggcgggcgccgggcacggtggccgccttctgccaggccaacgtgggggacaccagccccaacacgctgggaccgcgctgtcgcgacacggggtga

SEQ ID NO: 659 - DNA, 768 bp, Chlorella protothecoides
atgcgcacgctgcctcctctccctgacggtctgcagctccacacactctcggatggcaggcagctggcgtaccagatcctgggcgcggagcccggcccctccaccctcacggccatgtaccaccacggcacgccctcctgctacatggagggccttgcgctggaggaggcagcccgtgccgccggcatccgcctggtcgccatggaccggtgcggcatcggggcttccacccgccgctcccgctccagcctggccaccgtggcgggggacaccctggccctcatggacgccttggccatcccccgggccatccagataggcaactccgggggcggcccctacgccgccgcctgcgccgcgctgcaccccgaccgcacctccgcgctggtcctcatggccgcgctggcctccacctccggccccgaccgcggcctgctgcgctcgctgggcatgatggacaagaccaccttctggatggccaagctgcccctgggcgggctctgggccgtgaactggggcctcaagtacatggccaccaaccacgcggagacgctgatcaagcacgcgcccgaggggctggccaaggtggatggggagctgatgcagaccgacccccgcgtcaaggagatgttcgcgggcgtgctcacggtgaggcgttgggatcgagggggcgggggatcgggccatggaactgggagagggcgggggaagagggagacggggaggggaggaagaggaagagggtgggcaagcgcatgcgcagggtag

SEQ ID NO: 660 - DNA, 369 bp, Chlorella protothecoides
atggcacagggccttggacgcgacggtctgttcaacaccctcagttccctcatcccctcaccacctccctgcgcaggggcctttgcccagctgaccatagcgctgtgcggcaaccccgcagccggcacggcctcggccggctcagacctgtggatctgtggggagacgggtttccctgcgctgctgcgcaatctaattacctcgctggggccctcgatcctgctcagcatctacaacatggtcatcctgccggtcatcatctactaccttgcccaggtgggggggtgggctgattgggtgggtgagggtgaggggcttgatgggatcgaggggttgggggccgtcatggggaaggagcatgggcattga

SEQ ID NO: 661 - DNA, 1326 bp, Chlorella protothecoides
atgcctcctttctactgcttctggttctcgtggtccacacgcgcgtttgaacttcatccctccacaccctcatcaccccaccgttcacctcacccacccagcccccaacactgcccacccccgcagtccctgctgaagaccaccacggaggcgctgcgctccaacatcccgcgcgtttaccacgagatcgcgcacgccccccctccctcacctcccggctccccttccaccccctccacccccggcgggcacctggtgaagaccgaggcgctgaccacgctggtgcccagcagcgaggccacgcccatcgccgccgacctggagatcgagcgcatcaccggcgcagagcaggcgacgctgagctccgtccagaacgaggtgctgctgccgctgcaggcctggctggacgccttcacccgcctgcacgcgcagaagaaggaggtggaggcggtgcgcctggaggtggactcccgccgccgcacggtggctgacctgacagtcaaggaggcctccaagcaggccgcagtgcagcgaaaccaggacgccaagcacacggcggcgctggaggaggccaccgccctgctcaagcacaagaccgacaagctgaacgcgacggcggcgcggttcaacgaggctgaggcctcgctgcacgctgagctcaccgccctgatccaggacacggtgcacctgcgcaactacgcggccaacgcgctgcgcatcctgggcgagggcctggtcaatctggcccagctggtgtcaggctctgtgggcgatgtccccatcacgccccccgccgccgccgtggagagctccccggcgccggcggtggccggcaccgtgcccgcacccgccgtggtgggttccgccgacgacaacacgccgcgctccgccggcgccggcgtggagccgctgggccacctgaccgaggagggtgggctgtcggcgggcgagtcctccggctacgccgtcggcggcaccagcgagggcaccgagggcagctacgcggccggcaactacgcggccggcggtgccgcgccgcgcttctttggcgagggcaagcagcacggcgacgggtgcgaggcgctgtccggcggttcccacgtgaccacgcccgaccacacgggggcgcaggcgctgtcccacatccctggcgtggaggggccggtgaggcatgagcactcgggccgcgaggctgcgcccgagtccgcgggtgccagggtgctggactgcatcccgggcggcaccgaggaggcggtgcgccacacggggcaggaggagtatgtctcgcagggtgtgaagggtctgtccctcaacatccccgcctag

SEQ ID NO: 662 - DNA, 660 bp, Chlorella protothecoides
atggccagcctgcgcgtgctgcgcacgctgcgcacccagcccatcagcgggcgcgagctgcagcgcgcgcagcgcacgctggccgcgcggcacgagactgacctcaaggacaacggctactggctggggctgatggccaacctgcaggccccgggcgtccccctgaagaccctggactgtctgcgcgacctgcgcgccatgtacgacaccgccaccgtcgacgacctgtacgacatgcaccagaaggcgagctttggttgcatgggatggagtgggggcatggagaggagtgagaggggcggctcgagccagggcggtgcctcgcggtacagtgcccatgctgacgagcggctccaatcccccatcacacctgtacaaggttccaaactcctgccacaaaaccctcacctttacttgatgcttaacatcccacagttcaactttgacgacgatgccatcttctcctgcatcggggtgagcgggcgggaggccggcgcggtcaaggatcacccactcctggcggcgctgccggcgcagcgggaggacggcgcgggcgaggccgtggtggacgtcaaggacgcagacgccttcttctcggcggtcaaagtgttcatgcagcagatggggtctgctgggccggggggcccgcccaagccctga

SEQ ID NO: 663 - DNA, 1386 bp, Chlorella protothecoides
atgtctttccccagcgaccgaccagaggactgtgccacccgaatcggcatgggtgtagcctcaggagcggtgacaggcgccttcctgggcgccgtggcgtccaactggggagacatcccactggtgctgcgtaacaagcccctgcccgccctgctccggacggggaacgtcatggtgaactacggcgccaccctggctgtagtgggcctcacgtacagcgctgtcgacgtaaggaggggaggcgtgtgccaccctatgctgtgggagacttgtgacaggggaggggcttggttattcatccccagctgtattgtgccctccgccaaagtcactggggccgtacgacccattcatccatcccctttgcaaacccagtgcgtggctgagagccttcgtggcaagcaggactgggtaaatggatctctcgcgggccttgctactggtggagtcctgggaatccgaagtgagtcagcggacgagatgctgttgccttgtagatatgtggtctgtccactctggttgggttccgttgggcgatgggtacctgttaccaggtgcttgttcctccgccatggtacccgtcttattgacatcctcctgactccaggcaaacacactcctgtcacacaaagctacggtctgatgggtatgtggacgatggcgccaccacagggcgcacagtgtacccctatgatgcctaaggtgtccgccaaggtcaatgttgacctgtgtgagagcagtagaatcagaccaaacaggtgccacaaggaggtgttgagaacacattgttatcaaggggttggagtcaacaccaaaacgaatgtcaggactcgaaaatgcaatgaagagtggtctgcaaggccgacaaaagaacagaacaacaagaatggggcaccacacagtccatgggagctcggttttgggcgaagtctgttggctcgtgctctcctttccagttcacgactcgcttcggatttacagcctgcacccagaccgcaatattgggccaagggaagaggtcgcgtggctgctgatgagggtcctctctgggctcggaacctcgaccagctcacgatgcctggtcatcgctccacaaaggtgctcatcgctctttgcattgtcattgttaaaagtactcccataatgtgcatccatcccagcgctgatagctccctcatcaaccccggcctcaggagcttgcactgccgccaccacattctccctcgcctcgtccacggcgccaaggcccgggatgaccgtgattcattcgacgagttcttctccagtgaagacatacgagaagtatcgcaatatatgcccgaccccgaccagcagctgttcggcgatggtgggcaaggggggggggcggggggacaggcttgctga

SEQ ID NO: 664 - DNA, 2016 bp, Chlorella protothecoides
  modified_base (206)..(215): a, c, t, g, unknown or other
atggaagtttctggctgggcacgggacgctgcccgccacagaccctctctgcctggttgttgcctcttcttcactgcatgccagaggtcgcaggaaagtgcaggcttcgatcatccctgcctccctgtcccgcaacgtgcatcgacacccacactcgcatgcacacaaaaacaaacaccgcagggttctgtatgtagacatcgacnnnnnnnnnnccaccacggcgacggcgtggaggaggccttctacaccaccgaccgcgtcatgaccgtctccttccacaagtacggcgacttcttccccggcaccggcgccgtgggcgacatcgggcacgacggtggcaagctctacgcggtgaacgtgccgctgggcgacggcatggatgacgagtcgtacaagagcgtgtttgagcccatcatggccaagggcagtctgaggagggagttgcatgcccggcatacaagctactacgagctgctcatgttgcagcctgagctgtctctgaccagggtggagcgcctgaccctcctggaccggtctccctggccaggcaccccaactctgcaccctgaagctgcaaccgtgatctctcaggccctgcccccatcctcgccccaggtcatggagatgtaccagcccagcgcgattgtggtctgcggcggcgcagactcgctgtccggggacaagctgggctgcttcaacctgtccatgcaggtgtggggtgctggggttttgagatcgagtctgggcttgggctcagagggccctgaggagcacaccgagaacatggccacctgtgtgttttgggctcacattccgtgtgtctcagcagcacagcttccattgccgcaacctcatccctgcccccaccctgcatgccccgtcacctctccccgccccatcagggccattccaactgcattgagttcctggcgcggtacaacgtcccgctcatggtactgggcggcggcggctacaccatgcgcaacgtggcgcgctgctggtgcttcgagaccggccagctgctgggcgtcgagctggatgacgagtgagcgttggggattggggggattgggcggcacgagagtagctcaagatcgaaaaaacgggacagctgctcttggtcggcgatgtgtccagtgggaggggctgcaaggcatccagcagctcacatcgcgccgcttggccccaacctggtcccacattttcgggattctgcacagcctcatgcctaccctttgccctccttacagcccccccctccccatccaaacagcatccccgagcccgcgctgggggagtacgactactacatggacacgcacaagctgcgcattgcaggtggggcgcaagccacacgctgtgcatactgcgggtgttcctgtgtgtggctggcgcgagcagggtgctcactcctgccccacagggcaccctccaccgccctccacctcttccccaccgatgttgcgtagtgagcaacatgaagaacaccaacacgcgcgaggcgctggagcgcatcaaggtgcaggttctggccaacctggccttgctcccgcccgtgccctcggcccagatggccccccgcccgcccaagaccgagctgggagtgacgggccaggcgtgcaatttgcagccgacggacgcgccgtcgtcagtgcatcgtccccccccccctcgtcccaccctccctttcctccccagcccgacatgccagaggtggacatggacgcgaggggtgggggccaggcgtacgatgacaagcgcgtggcgcacgataacgattacgcctcgggtcagtactgtgctttgtatctggatggaggggcctggaaggagagacttcagtctactagccggcacagcggatgctgttcacagcaagggaacatgcaacacatgtaccatgtccccatcaacctgatcccacctgcaaccccccctgccaaaccaggtgatgaggatgtgcagccggcccgagacctgcctgtgaggcccaaggaggtaaggggattgtaa

SEQ ID NO: 665 - DNA, 777 bp, Chlorella protothecoides
atggcgactgtgaagcggcgcgagtgcgtctacttttacgatgaggagatgaccaactacaactacggggggggcaaccctatgcggccgcatcgcgtcaagctcaccacacagctggtgaatgggtatggtcttacggatcaaatgcagattctgcgaccggtggagcgtacccgtgaggagatcatgctgttccatgctgacggtacgccggggggtgtcggcgagcgggaggcctgcagcccgtgcgcgagttatctacatccaccccccctctcggccccccggggccctccagattatgtggacttcctcaactcggtcacgccggacaaccaggaggagttcatgatgcagatgcggcgcttcaacctcggccccgtgggcgaggccgactgccctgtgttcgacggcatgtttgagtacttcagggtgcgctcaggctcggcacacagtgccctcttgttcttcagacggggaaccctgtcaggtgcctgcctgttacttttgaccgccctctgttctgttcactactacacaccaatcccaagcacggccaacacacttgaactctcctcctcccctcctttctcattccagatgtacagcgggggctcggtgggcggggcggccatgatcaacgacggccaggccaacctggtgatgaactggtcggggggcatgcaccatgccaagaagggcgaggcctctggcttctgctacatcaacgacatcgtcctgggcatcctggagctcctcaagacgcaccagaggtaa

SEQ ID NO: 666 - DNA, 693 bp, Chlorella protothecoides
atgggcgcgtggccctgtagtcagcacacacctcgctcgcgagactcgccgcaggtcacggtcgtgggcgtggtgcggcacggcgagcgagccggccagtttgtccctcccaacgacctggaggcctgcacctggtactacgttaacaccgctgagctggcgcaggctgcggggcgggacgccgacacgccgctcgtggaggccatcctgggtgagggtggtcggcgcggcgcggggctatctgctgtggggtccgggcgcgtgggggaggggccagcagggggcggggtcgaagtgcggactgctccagcacgtcgccctgttgggatgaggagtgcgagcgagagcagccattcactcacacctcggcggtaccatgcctgtgcgcccctccctccagtccccgcccgacccctccgacacggttgcgcgccgccctcccaacccccgacagccgcagacgcgcccaccgtggtcaagccgccctcggccatggaggtgctggggggcagggccaggagcttgccggccgtgcccgatgtcgtgcccctgcccaagaccctggacgagctgtgctccttctccgtcatgccgcgcgaccacaccaactacgccgcgacgtggctgaccctgtcggccgccacggccgcgctggcggtcaaggccgtgcgcggcacgatgcgccgggcctga

SEQ ID NO: 667 - DNA, 279 bp, Chlorella protothecoides
atgatcgggtacctggaggcgcacttctcccccaagaaggcggagccgggggccagcctggccatccagggcgggtcgcagggcgcgcgcctcacccactcgcatgaacgtcagtacacatacgtcctgcagagcctgacgctgtggcgcgagatctcccacgagatgggagagggctgggagggggtgagcttgttcgcgggcaccgggagaaggggcagtgagagacattccagggattcaagatcgtggcatgcccccaaggtcgtggccccatag

SEQ ID NO: 668 - DNA, 702 bp, Chlorella protothecoides
atgtccttcatggtgctccggactatgcgactgccgggtctggcagcccgatgcgagcaggggatcacctcagggaccctcaaggctgcgactagggctttagaagaagctgtcgctgccttgggactgcgtgcgactcagggaactcctcgccctcccccaatcagctcaagggcattcgccagccagcctcacagcgtccctgcgccccgatcaggaggcgtggccgctcgcagcgggtcggggtccaggaggaccccctggtcagcggccctgctgggcatccccagcctcttggcggcctacctgggcaactggcagctggagcggcggcagtggaagatgaggctgctggaggagaggagggagcagctgctggcggagcccatcgacctgtttgcggtcgatgagctgccgcccgagtactcccgggtgaccctcacgggcacgtacgatcacgccaaggcggcctttgtgggaccgcggggccggccctccagtgcgggggtgacggagcaggtgggggttgcggcgggttgtcctatggctggggtgcgccgggagtgtggccgctgcctgcttcacggccaggcacggccatctccttgcgagctttacccgtactcccccccaaaacgccgcagagctacctggtcgtcacgccgctcaccagcgcagacggcaagcgcacggcgctggtga

SEQ ID NO: 669 - DNA, 1026 bp, Chlorella protothecoides
atggccgaagagcgggctggtggggatctggtgggtgccgtcaccctgcacctggcctggccggatgcggtgctacccgccccccttccccccctgcgccagctccgggcctgcatctgcaacctggccgtagcgccccggtcaagtcatcgccctgagggaggggggaatgttcctccgcgcgatgagccacatgatgcagcagggcctgctcttctcaaaaaccaccccggctccaatgctcctcccaggaggcgaggcgtggcgaggctgctcctccagcgctgcgaggaggctgcgaggtggtggggtcaggactcggtctggctgcaggccgacccgtggaacgaggcggcgctggacctgtaccacacttccgggtacgccactgtcgaggacgtgccctggcatcgccccttccgggtggtcatgaggaaggaactgcctgggaggcgggccgctggacctggcgagcccgacctcctgcctggcaatggagcgggggtgttcatctggaaggcggtcttgtttccttgtggaactctcggacacatcgccactgtagagcatggctggcttctagcagagtctgtttgccagctttacacctgtgccaggatctctatacactccaccccagggtgtcatgcactgcaggcactttgccgcttgtatgcatgcgatcacaatttgccccgtacaatcactccagatcgatcagcgctgcctgtgtattgttttaggaccatggtaggtcctgtactcctcctcccttttgagggtcttcagccttgtacaaaggtgtggtcaacacccatcccacgcatgtggccctcctgcccaggacatagcagcactcccgtacttcactgttacacctcaccagaccgtatcacacacaggcacagggcagtgtcagccacgaaggatcacacaagaaaaatgccccagcagcctaccagccgcggggttgccaggccaggtcccccacgatgtcgtcgatctccttcttcacgtcgtccgtga

SEQ ID NO: 670 - DNA, 954 bp, Chlorella protothecoides
cccccccctcgctcccctttctctctgctcagtctcccccgacgcgcccaccaatcccgtcctcttctggatggggcacgtcagcgcggatgggctcaagttcgagctggagagcgcgcgaggccccttccgcctggacctgggcgacgtgctctatgcgcccaacgtgctgcaggaccgggaggggcgctggctgctctggggctggctgcaggagaagcggcgcgtcggctcctacgactacgcgggctgcctgacgctgccgcgcgagcttcacgccacgcccgacggtcgcctggtccaggcgcctctgccggaggtggggcgcctgcgccagggcggcggccacgccgtgcgcgacgtggtgctgccccccaccaaggccacgccgctggagggggtggagggcgactgcctcgacatcgtgctcacgttggagaggtgggtgggattttctgggggggaggggcctgggtggaggcgggtcaagggagatgggggatggggaggttaggggaaggaaggaatgagggagggaaagggcaggaaggtctagggagccatgcttgcgctctccaggccatcgctgaatatcagcaatcgcgcccccccccccactcttcaccacgcaggggcggcgcgtacgcggcgggcctgctgttcaagtcgtacgaggccggggacgaaaacggggctgccctgctgtacgactgggagacggggcggctggaggtggtgtttggcgtgcccccccactgggccaccacccacctgccgggcctggcgacgcagggcccgacgcccacctctgcggcgggcggcggcgccgaccagcgcttcgcgccggcctgggagcacgtcgaccctgccctgctgctcaccacgccgcgcctgggctcggccagcggcgccgcgacgcccggcttcttctcgcccgggcgcgacgacgccggc

SEQ ID NO: 671 - DNA, 495 bp, Chlorella protothecoides
atggcaattgacaaagagtcagaggggaaggactacgaggtaagccccgcgccccagcagccgggacaactctccctagcgtgcagacgtataagcaatgtaatccgcatcgccacccaaacctccttccacctcccaaccggctcctctgaagatttcggaggccccgatttcctcgctacttggaggcgggagctggagaatgcgggccttaccatcgtcgaagccaagctaggggtagacttggaaaaggtccgctacgtggtttgcttcaaccctcccgatggactgctggcccaatgcccaaacttgagactgatccactccatgggcgcggggatcacgcaccgcatgctgcgggacgaggtatgccctacgcatgtgcccatggtgagggtggtggaccccctgatggcacagcgcatggccaccttctgcatgtgggcggtcatcaacgtccagcgcaaatggtcaggctggggtggaggggtttga

SEQ ID NO: 672 - DNA, 447 bp, Chlorella protothecoides
atgcagcacctcctcccccccaagatcctggccaaggcggagttcctgaaccctggcggctcggtcaaggaccgggtggccgcccagatcctggaggaggccctcgccagcggtgcgctgcgccccggcggcaccgtcacggagggcaccgccggctccacaggcgtgtccctggcgctgtgcgcccgggccgcgggctgcagcgccttcgtggccatgccagatgacgcggcgcgggagaaggcggacacgctgcgcacgctgggggctgaggtgcgacggatgcgccccgtgtccatcgcccaccccgaccactttgtgaatgtggcgcggcgcgccgctgcggagcgggagggggcggtgtttgcgaatcagtttgagaacctggccaacttcagggcacacctccggaccggtgagggggggaccagggctgtgtgggattga

SEQ ID NO: 673 - DNA, 660 bp, Chlorella protothecoides
atgcccgcagtcccgagtgatatcaagcccctgttggagaagaaagcgaccttcgagcaaggtgtagaacgcttgaaggatctactacccacctcgggcggatcggtggtcgatgatccggcctattcagtgctccttgcacgcgtccacaccctcctccagagccggtacaactccaccgctttctgggcgcgggcacagactctttaccgcgccgcgctcgcgtcggacaggagtgggaacctcgccacccagctgagggggtacctggcgtcctgtgctgcgcacctggaggacgaaccggccacagcgacactggctgcggcgcccccgccattttccttccagggcttgctgtcacatgccgagcctgcagcagggccggaatcaagtccacagagtgcagcggcgctcgaggctctaatggcgcacctgcagcagatgcagaatggggccctgggcgccaccctggagggcccggagccacacctcttggatgcggacctcctgcaggccctggaggacagcatggctgacgtgccgcgcggcgcgccccctgccagcgcgactgtggtgcagtccctgcccaaggaggtcctgacgccatcacgcttggccgagctgggcggcgccggcacccgttgccctgtgtgcatgtga

SEQ ID NO: 674 - DNA, 429 bp, Chlorella protothecoides
atgttcacacgcgaggaggcggaggggcggcggctgcgccaccccgccgacaccatcaccgagggcatcgggatcaaccgccagacggccaactttggccgtgccctcgtagacggcgcttttcagggctctgacatggaagccgtggagatggcagcctacctcctgcgcaacgacggcctcttcgtcggctcctccgccgccatgaactgcgtgggcgcggtcaaggccgcgcgcctgctgggcccgggagcaacgatcgtgaccgtgctgtgcgacggcggggcgcgccacctgtcgcgcttccacaacgccgggtttctcgccgagcaaggcctggcgccggtagccacaggcacggggctggccttcgtgagcgatgggccgtaccgccccgcgatcggtcaagtcttgcccacacacacttga

SEQ ID NO: 675 - DNA, 657 bp, Chlorella protothecoides
atgatgcaaaaccaaattcctccctgcagtgacgcatacttagaagcccaaaaagactgccgttgggacaagagtgtcgagaattttaccattcgggacaatagcagcgtgcgcgttggcattcttggcctcggcaaccttggagccgccacggccaccctcctcctggcggctgggtaccccgtctccgcctggacgcgaagtgcacgagccaatgaccagaaaaacgcgcgcatatcctactaccatgaccgagaaggcctttttgagctggcccgagaggctcagattctcatctgcctgctcccgctcacggacgagacggccggccttctggacgcccgcctgttcgccaccctgcctccgggggccgcgatcatcaacgtcgcccgcggggggcacgtggtggacgtcgacctgattcaagccctggattcagggcatctgtccgccgcggtcttagatgtcttccacgaggagcctctgccgaagacctcgcccctgtggacccacccccgagtccgcgtgttcccccatgtctcctccgtgacccagcgccaggaggcggtccggcaaatgaaggagaacttcgactcaatggatgctggcaccgacattcctcgcgacaggttcattgtgcgatcgcgcgggtactga

SEQ ID NO: 676 - DNA, 2061 bp, Chlorella protothecoides
  modified_base (20)..(29): a, c, t, g, unknown or other
  modified_base (1031)..(1040): a, c, t, g, unknown or other
atggtccccccaggtttgannnnnnnnnnctctccacaatccctgatggcgtcccctgcaacctccatcatcaatattgttgatcacaatgacttggtctttccaaagctcctacaaggcagcgctgaagcacaagaacgcaacaatgcagacgcaggatgtctttgtgagctgcggcctcaccttgcgatcagctgccttgggagtgtgcatagactcaagtttgcagtcctggatttcccctgtgcaagtgtaattgttggggagcccagaccaatggagcgcaatgactggtgtccctcaaatccgtcgtgcttggcaaggcgtccttcgggattgcagaagaatggtccctccagatttggggaggtcaacacagcttgtgccacgtcggcaaccctctctaccccggctccatcgactctcatggcagaatggtgttggggcatgccagcaaccccaagggacccggaggcccgcgcacaccacagcccgtgtgctgtgcactgccaccccgcccgtgaaccgcggcggtgggaggtgagtcgatatgaatttctttcctggacttcacagggttgggatggggctgacgggtgccttcttgcgggccgatcggtctcgacgcaccagggcgaggccagccacccaccagggttctccctgcgcccgatccgcaggcccgagccttcccgacccaccactgccacctccgccgttgccgggtatgccaaaggcatttccctgtccccctccttggcgtctcagcagctggacgacgagcatggggagtactccctgaacgcgcccccccggaagaccaagacggtatgcaccatcggccccacctcctgcgaccgggaggcgtttttccgcctcgccgactccggcatgaatgtcgtgcgcctcaacatgtcccacggcgaccacgcctcccaccaggtttgttggggagaggtgtgggaggggaaggcagaccctcccatgcatacctatctccccccgtccccgcccccgcccccttgcccctnnnnnnnnnngcgaccacgcctcccaccaggtttgttgggagaggtgtgggagggaaaggcagacccgcccgtgcatgcttctgggccccgccccccttgcccccgatctcgctcaccgctcgctcaccgcagcaagtcatcgatctggtgcgggagtacaacgcgatgggccggcgcaacctggccatcatgctggacaccaaggggcccgaggtgcgctccggtgacgtcacccagcccctggagctgcgggccggggagacggtcaccttcaccatcgtcgccggcgcagacggcaccaacaatcgcatcggaggtgtgggtggggctggatggggaggaggaggggagcggcggggccccaatgggggccctgatcgcatgtgggaccggtccctccctccccaccacaaagcttcttgaccccaggaacatcccccccctaaacgcaacagtgaactacgacggcttcatcgacgacgtggagctgggcgacatcctgctggtggacggcggcatcatgagcgctgtggtgcgctccaaaaccgacaccgacgtggtcaccgagatcgtggacggggggagcatgaagtcgcggcgccacctgaacatccgcggcaagtcggccaacctgcccgccatcaccgaccgcgactgggccgacatccggttcgggctggagcagggcgtggactactacgcactgtccttcgttcgcaccgccgacgtcatctacgagctcaaggactggctggcgcgggcgggggccactggcacctccgccatcggcgtgctggccaagatcgagtccgccgactccgtggccaacctggacgccatcctggacgcggtggatggcgccatggtggcacgcggggacctgggcgccgagctgccggtggaggaggtgccctactggcagtccaagatcgtgagggggtgccgcaagcgcggcaagcccgtcatcgtcgccacaaacatgctagagtccatgatcaaatgccccacgcctacccggtgggtttgggtg

SEQ ID NO: 677 - DNA, 210 bp, Chlorella protothecoides
atgacccccttccctctgcgccgcgcgtccgagcagattgaggggctgggcgcgggtttcatcccgcgagtcctggacttcagcctgctggacgaggtactgcgcgtgcgcacgcaggaggccgtggcggttgcgcgaaagctggcccaggaggagggcatcctgtgcggcatctcctcgggcgcagccgtgcacgccgcgtacaagtga

SEQ ID NO: 678 - DNA, 246 bp, Chlorella protothecoides
atgcagcgcccaaaatccccaccctcctggacttggatctatggcccatcgggggtggcgcagcgtccggagaatgcgggcaagcgcatagtggtggtgctgccctcctttggcgagcgctacctgtcctccgtcctgtacagccagctgtggacccaggacgcgacggaggaggacgagatgccggccgagtggcgcatgcacaatgggctgtacgtggccgaccgcgacccgcccaagctgtga

SEQ ID NO: 679 - DNA, 1383 bp, Chlorella protothecoides
atgttggccttgcatcttcctgccaagcagcagcaggtggactcaaaacctggggccagagggacagggggcaggcagcgagaggagcgctcggaggtacaagcagggagggctgcctgcatcgggccgcagcgcaacgcagcgactggaggtcaagtgttcgtcgactgggcgccgagggattggcaggcgcgtgccccgtttcacgccttggccggctcgggagcagacccctcgccggcctgcgcccggcaccctcccgcacggagcgctgggcggcccagcgcacccgcgccccgctcacttctggatggcctgcaccaggctggcggccagctcggccatggcgtccaggccctctgtggggctggcggcctcgcccagcgcccgcacaagggccgagccgacgatgacgccctccgcgccccagcccgccagctggcgcgcctggtcggggcgggagacgccgaagccgaccgcgacgggcttgtcggtctggcgctgcagctcggcgatgaggccctccacgcgcgcctccatggcctccttgacccccgtgaccccggtgatggacacgaggtagacgaagccggaggagcgacgggcgatggcctgcatgcgctcggggggggtcgtgggcgtggtcagcaggaccagctccaggccgtgcgccgccgccacgtcggccacggccgacgcctcctccagggggatgtcggggaccaggaggccttggatgagggagacagagaggggcgactgagaggactggaatgggccgagcacatgcccatactgctcgaggggcacggcggagagacatggcacggtgcggagcggggggtctgccgaggccatgcggatgcatgcccacactccctacagacccgtctcacccttggcccccgcggcaattgcctgcgtgcagaacttctccaggccccgggtgaggatggggttgaagtagacgaagagcaggatgggggccttgatggtgggcgccacctcggccaccaggcccagcacgtcgtccagggtggtgccgtgggccaggccacgcgtggcagcggcctggatgacgggtccgtccgccacagggtcgcaatagggcacccccagctcgatgacagaggcgcccagggcatccagccggcggatggcctccaccgtggtgtcccggtccgggtcgcaggccaccaggaaggggatgaatgccactctgtggggtgcagattgtgcatgagggtggcaattccaatgcccatgcctcgccttgctcccggcacccgcccgcggccctgctcaccggccctcccgtttcagggcctgcatggtgtcggtgatgctggcaccacgcgcctgagcgccctccagggcagctga

SEQ ID NO: 680 - DNA, 615 bp, Chlorella protothecoides
atgtacgatccccaggatgctcctcggcttgtgttcgtaactctcaaggatgcgccccatcgccgaagggtagccatccccctgcccgaaaacgccgcttgggacaagttcaccgcctccgtggcagccaagctcaagctgggggcagtggacggcgtgttcctggccagcaccggggaggtcatcacgcgactggatcagttgcaggacatcgacgaccttgttgtgacggaggactatggcggtgccatggtccatcgctccccacagggcatggctgtctcttcctgcacccaatccactggccatagtagctcgctccaatttcaatctccaaccctgtgctcgacgcaacaggctcccgctcagctggcaacgtccacctccggggtggcgcccgctgcagtccagcgaacctcatcgacgcccttccgtggtctcgggggagggtctgagcctgcagtgagccccctgcaggtggaacctgccgtccatgacgaggacggcgacagcaagtatcagaagcgccattcggcgctgcagcgcacgctgcagccgctcttcccgggcctcttttcgtccagtaatggccgattgccagtgaccaccaagtag

SEQ ID NO: 681 - DNA, 294 bp, Chlorella protothecoides
atggtggcagccattgagaaggcagagtccattgtggcgaccacccccggcgcgtacatgctgcagcagtttgacaaccccgccaacccagaggtgtgccgtgggggtgggttgtaccggggcctgcctgcgcacgagcgtccccatggctgcaggcatgacggtgagggcgatcgtcctgatgcacagcgtgtgcggcagcgctccattcccgccctgccggccaggtggcccggggtagtcctccccaatccccgccgccacgctccccaaccctttccaggcccactatga

SEQ ID NO: 682 - DNA, 288 bp, Chlorella protothecoides
gtcgggggtcccggcgccgcgcccgagggccgcgcggtggccggcgcgtcctccgcgcacgcgccgcccagcgacaaggtcctgctcagcatgaagatgctcatctccgccggcaccgtctgcctcttccacgtcggcggcgggctggagccgggggaggaggacggcgtgggcgcgccgcgctgggacttcttcatgggcgacgcgccgcacgcggcctcgcggcgcacgcgccagcccatcgcccagctggccgagatcgagaagcacgccgcgtcgggtgtgtga

SEQ ID NO: 683 - DNA, 1878 bp, Chlorella protothecoides
atggagcacaggcgcgcagaccgtggcccctttgttcctttggggaagcgaacggggggacgtaccggctgtgcattccgctggtctggtggtcgctccgtcgacgacctgctccctcctgctcgacaccgacacaaacctgacgcaccaccaggcgagaccgtgctgtcggacgaggcggccctcctgctgcgcacgaaatgctcgttggagcggctggacgagggcacgcaccggctggtggcgccggggtccgacccggtcatgcccctggacgacgagggcgagcccacggcctgctacgcgccggtgcagtccacgcccagcgcggacgccgccgcgctggcatacctgccccccatgcagcgcattcgggcgctgcaggtgggcgggcggtgtgatgcagagggagggggtgccaccatcaggataccacaggggctgggctgcactgtgcaggagggaggggcggctctcagctgcatgggcacagtgcgaatgtgctgcgcccctgggattgatgtgctctgcagggcccaggtcctggacgactcgtcgcagaacaggcccggggtccgtacgtccagcaccccgacccgtacatcctggattgcctgccacataccccacccccaccccttgcagatcatgcgcatgcacgtccccccagaacgtgcggcagcgggtggaggcggggcacatcgactacatcaacgagacgcggctctgcaccgtgctcttcctcggcttcccgggcctgtccaagccgctgccggtgtcgttggcacgctcgccggggctggcgcaggggcaggggtcgggagaaagggcgccggggagctccatggagcaggggtcctcgccgtcggccggccacccggcgtcccgttgccggtgtcgttggcacgctcgccggagctggcgcaggggcaggggttgggaggaagggcgccggggagctccatggagcagggctcctcgccgtcggccggccacctggcggcgtcggtagacatgcagccaaacggcgccgcgccgcgcccgagcagccgcggcgcggaaacagcgccgtacgaccccgaggacaaccccagcacacgcagcgacgcgcggggcggggacggcggcagcggcagcgcatcggaggccctccagcgggagggcggcgagaggggcgcgtcggccggcggcgacgcatcggccggtggagacgcgtcggccggtggagacgcgtcggccaccaccgccagcggcaacgcgtcggccacgaccgccagcggcagtgccagcgcaggcggctcgggcggcacaaacgacaggcctgcagacgtcggcgcagcatcgaggtgccccgccgcggccgcctcccgcgtggccacgcccccccccctgagcgaggaggaggagatcgcgtgcgtgcagcgcaccctggaggtggtccagcggcgcatgcgccagtacgacggctgcctgctgcagatgcggtgcgacgagaagggcttcctggccatctgcgcctttggcctgccgggcaactcgcacgaggaccgtgcggtgcggggcgtgcaggccgcgctttccatcgcggcggggctgcgccgccacggcttggccacgcacatcggcgtcacctccggccagctcttctccacgctggtgggcagccagcggcgctcggagtacaccctcttcggcgactccataaacctgtcggcgcggctcatccagcgccgcgcggagtacaccctcttcggcgactccatcaacctgtcggcgcggctcatgtgccgcgcacgcgacggcctgggcgaggtgctggtggaccgccccacgcgcgcatgcgcgtcgccttccgcgagctggcccccatctttgtga

SEQ ID NO: 684 - DNA, 405 bp, Chlorella protothecoides
atggcaggctgcagagggcccggcgctgcctctgctcgtgctctggctcgggttgacgtgtcaggtggcgccctcacgggagacccaaccgtgcaccctggcctacctcgcaccagtcaagtaaccagcaaccccccaactcacccacacaagcatccccccatccccccccgccaggcgtgccacgagcaggttccccccgacgtgttggagccagcggtgcggcagctggtcgaccagtttgtgcacgaccgtgcgcggccagaggtcatcaccgtcggcctcaagacggtccgcgagatctgcacccgctgcccgctggtcatgacccccgagctcctacaggtggaaggggtggtggacggggtggtggggaggcttctggcgggtgtcgaaggggtttga

SEQ ID NO: 685 - DNA, 1272 bp, Chlorella protothecoides
  modified_base (51)..(106): a, c, t, g, unknown or other
atgagaacatcagtcctcccctgcactcggccacccttccccctccccccnnnnnnnnnnnnnnnnnnnnnnnnnnnnnnnnnnnnnnnnnnnnnnnnnnnnnnnnacctgacctcgtacaagaaaacacgggacaaggcggtgtcctcggcggctcggggcctcatcggtctgttcagggagctggcgccctccatgctggagaagcgggaccgcgggcgcggcgccgacctggcggcggcgccgctgcagttcgggcagaccaccatcgccgacggcatcgacggcctggacctgctgcgccgggccgaggcggagggtcggttcaacagcgacggcgagctcgtgtctgacgaggatgatgatgatgatgtgcagggcgggacctcgtcctcggagggtgaggaggagctggaggagggtgaggaggcgtcctctgacgaagaggcctcggtttcgggggcagatgaggatgatgatgacgacgaggaggagatggcctcggggtctgaggcctcggggtcggacgccgagctcgagatggggagcggcgaggaggccggcagcggcagcgagctcgacgaggacagcgaggaggaggaggaggctgcaccgcccgccaaggcgaggcggacgccgcagaccggcagcctgacacagatgaagaagcggctgcaggccaccaaggcggcggcggccgccgtggcggccgaggccacggagccgtgggccgaccgcatcctcacgtccgaggactttgagaagatccggcagctgcagcacaagcgtctggtggaccatgccatgcaggtgagagctcgggggtcagggtggccaggtcgtgtgaaaacaagccgagggcgtgtgcgatcgatgcttcccttcccccgatgcggctcggccaaggggcttgaccataccatcgtctgcgaacattcagtggaggtcctcccctttgacgcaagcagtgtgtcctcacatccatgcatgcctctcatcgctcctcaccaaattttgcacccatccacagaagcacggcctcaagtcggccagcaagcgcgagaaggccatggcagcggcagaggacgccgcggaggagaccatggccctgcgcgagcagctgggcagcatgcacgacagccgcgtggcgccggacgacctgctgggcatgcacaagtacaggaaggacaagatggagcgcatggcgacggtgctcaagggtgcgcacaggaatggcagcgggtgcttgggggtgtggattcgaggatctag

SEQ ID NO: 686 - DNA, 462 bp, Chlorella protothecoides
atggtgggcatggaccagcctcccgcccccggcgagcaagggcaggagcacacctggtccgcgacgctgagggaggtcaaacaccagttttgcctgtacgccagcttcgagcagcgggaggaggggggctgggtggacctggatcccgccgagacggctgcggcctcggacccccacgggagctccctctggccccagcaccaatggcacgccgcctttgagatcctgtttgcgctgccccccgacgccgccgcccccaagcgcgacgacatgctcttctttgtctaccttccctggctgcaccgcaaggacccagtcctcgtgcggaggaggggaaaagagcttcctgctgatctgagcttggggggtgcgctggcgggggacatcgactggcgggccagtgccctcctcagcctggtcatgcacacgcgatacaccctcacggtcatggtcagcgggtga

SEQ ID NO: 687 - DNA, 792 bp, Chlorella protothecoides
atgccccctcccaacgtgaccggcaagcttcacatgggccacgccatgtttgtcacgctgcaggatgtcctggcgcggtacaaccgtctgaggggccgccccgtcctgtggctgccggggacagaccacgccggcatcgccacgcagatggcggtagagaagcaactggcggcggaggggctgacacgggaggggctggggcgtgccgagtttgagcggcgcgtctgggcctggaaggcagcctgcggcggcgacatcacgcgccagcttcggcgcctgggcgcgtcctgcgactggggccgcgagcgttttaccctggacgagggcctgagcgaggcggtggtggaggcctttgcccggctgcacgagcgcggcctggtctaccgcggcgcctacatggtcaattggtcaccgggccttcgcaccgccgtcagcgacctggaggtggagtacgccgaggaggcagggacgctgtactacttcaagaaagcagggcgcgctgtcgtgatccaacccaaccccccatctcactctccaagacgcaccgaccactccccaggcggtgcagagggcgagtacctgcccatcgccaccacccgccccgagaccatcctgggggacactgctgtggcggtgcatcccaaggacgagcggtaccgccacctcatcggcaggcaggcccaggtgccgctcactgaccgccgcatccccatcatcgccgacgagtatgtcgacccggagtttggcaccggggccctgaagatcacgccaggttggaggagattgccatga

SEQ ID NO: 688 - DNA, 324 bp, Chlorella protothecoides
atgcagcatgccaccgcattgctgcgcagtgcaccatgcatatcactgagggcctttacgagcgccaagagaccgggtagccgcgccgggctgcacgtccgtgcggcggtggccagcaagactgccacgccccgcctggtgctcaagggaggcaaggtccacctcttctcccgccatcgcaacccggttgtatacgggggcgccgtggataatatcaaggggccggcccccgcccttggcgacgctgtgctggtgtgcgatggagcaggcgccgcgtttgcatggggcttctacaacccccactccatgtaccgcgtgcggtaa

SEQ ID NO: 689 - DNA, 645 bp, Chlorella protothecoides
atgtctcatgcactccctccgcgcacgcctcatccagggcatgacgtgaacgattatgagattggcaagcgccacaagctggccatcatcaacatcatggacgacgatgggcgcctgaacgccgccgcaggcgcgtttgccggcgtggaccgctttgaggcccgcacccaagtctggcaggggctggaggtgcgcactcgtgtgggagagcaaatcgggggggccttgtggggaggattgtgtgaactacaggctgccggcggaccctgccaagggaaccacctcacttgcgaccaactgcatcctgcgagaatgtttccacccccatactcccgtcgccaggctgccgggctggcgctgaggacggaggcgcacacctcccgggtcccccgcgcccagcgaggcggcgaggtcgtggagccgctggtccgggagcagtggtttatcaagatggagggcctcgctggacctgctctaaaggtgatcctgtgtggagagggggatgggcattcctggagggtcctcgctctgcggcattgggctgtgcaatcaggcacccagcccaggcagcgaccatgcccaaccccacctccccccacaggccctggacgaggggaagctgagcatcgtgccggagcgctttga

SEQ ID NO: 690 - DNA, 879 bp, Chlorella protothecoides
atgatctcggagccccgggagcagagcaccggctcggccagcatctcggagcgacagccaaagatagatcagaagggtgtgacgtacaccgccctcgagggcaatgcatttgtgttggagttccgcaagactgggacgcgggtcctcgtggacccatggctgatcgggcccctggactttgggggcgggtcccacctcctgtaccagggcacgaaacgggcgctgcgcttcacggaggccagtgcgatagagctggccaggagctgcgaccttatcctcatcacccagtccatcaacgaccactgccataaacccacgctggcggtgctgccccgcgacatacctgtggtggccgctccgggggcggccactatagtccagggcatgggttacacatcggtgcagacctgtgaccatggccagtctgtggaggctgccggggggaggctgagcatcaaggcctcgcagggtgcgctgaccgggccgccctgggcaaaaagacagaatgggtaccgcctggtggagaacaccgagcaaggagcgcgcgtctactatgagccccatgccgatttcgttcaggactcggtgtcagagctgggcaaggtggatgtggtcatcacgccgcccaccaccatctccctcgtggggtaccgggtacacggcggcagcccccagaacctgaagctgctgaccatgctggcgccagacgcagtgatcgcgctgaagaatgccgactttgaggagaaggggcccctggcgtcctacacgaagcagggggatgtggcctctatgcgggtggacatggccaagatcggggcgctggccgacacccagctgtacgagccagagccggggcagccaatacatgtcatgctctag

SEQ ID NO: 691 - DNA, 306 bp, Chlorella protothecoides
atggccagccgagctgcccgagcaccctgcatcgccagtgcaccaaccttccagcaaccgcccacccctttcccccgctgcaggatcatgcagatgctgtcgagccctgagcaaaaggcgcccagcgacatccaggccctccttcgcgccaagattcaggccgcctgggagctgcggcgggccctggacctccccagccaggacactgatgtctaccgcctcgtcaacaggtgtgttaggttgcttggattcctgttgcagctggacctgggcaccacggacggcgtcacgcgaggccatcgttga

SEQ ID NO: 692 - DNA, 888 bp, Chlorella protothecoides
atgcggtaccgcgcggagatcacccgcgcgctgaccgaggtcctccagcagcagggtaccgcaggcggggccgagcctgtcatcgtgtggcagcctgccgtcaccatgttgacgcgcgaggagggctggacctttgatgaccccggtgcggcgggggtccagggagtggcgacgaacggggctcgcagcagggccgcctctggcgaggactctggcgaggaggaggagggcgacgcaggggaggacgcagggacggacatcgcggcctctcccgcctcgcccgccgacccgccgctgatcatccgggagcatgggctgcggtacagcctggacgccgagggccccaaccagaagacgggcttctacgctgaccagcgcgacagccgcctcgtcctgcgccagctcagcaaaggaaagcgcgtcctggacctgtgttgctacacgggcggcttcgcgttgaacgcggccgccggcggcgcgacccatgtgctgggcctggacagctcccaccgcgccgtgcacgctgcggcggccaacgccgcgctgaatgggctggaccaggtcctgacctttgagcgtcaggacatgaaggcctggggtcgcggcagccagccgccgccgggcggctgggacctggtggtcctggacccgcccaagctggcgccggggaagaaggccatggtgcgtgccacgcggcagtacaccgcctacaacgcggcggccatgcgcctggtggccccaggggggctcctcatgacctgctcctgctcgggggccatgacccaaagcgacggcttcctgcccatgctccaggtgggcttgtgtgtgaggggtgtgtgtttgttcgtggttcctttttgttcggaggtggcctgggcggggaggtga

SEQ ID NO: 693 - DNA, 1065 bp, Chlorella protothecoides
atgccggctctgctccacgaatcacccgtaagttcagttccctctcccctccatccctgcctgcaggtgctgtccgtggcccggctcttcgagagcgagcctcagtacgtgacggaccagccgcgctttcttaattctgccgcgctggttcgcaccgcccagaccccgctgcagctgctggacagcctgaaggccatcgaagggcggctgggccgcgacttccgcggcctgcgcaacggtccccgccccatcgaccttgacattgtgttttacgaggacgccgtgctttccagcgagcgtctgaccctgccccacccccgctggcgggagcgggcctttgtgaaggctcctttggccgacctggcgccgcaatgtccacccgatgcagagacccacgccacctcagccggcctgcccgcctcgctggcggaggtggccgctgcgtggcggcgtgcgggcggcgagcgccagctgggcggcgcggcggcggggctggccccctggatcccgctgccccgaccagggcaggacccaggcccgcgcggcctggcctggggcggggagctcccgccccgcgtcatgggcatcctcaacgtgaccccagactccttcagcgatggcggacggagctttggcgacgtggcgcgcgcgcttcgcaatgctcgggccatggtgcaggacggcgccgacctcctcgacgtcggcgggcagtccacgcgcccgggggcggaccccgtgtccgaggaggaggaggaggcgcgtgtgattcccgtcatccgggtttgcgccttgactcggcgccgccgcgagcgagggcggcgcggccctcggggcgaggccgcttcacggcttcactcagacttacccatccctcaaccatcccagcgcgctgcgggagtgcgaggacctgagggagatcccgctgtccatcgacacgttctacagcggcgtggcggagcgggcggtgctggcgggcgccgacatagtgaacgacgtctccggcggccgccacgatccggccatgtttgctgcggtgaggcgggcgggggctgtctgcgcctttga

SEQ ID NO: 694 - DNA, 861 bp, Chlorella protothecoides
atgctctgccctaatgaagcacacgcctgtcagtcggtgccagtggcttgtaataccctggcagcatggtttcgacgcttcctttcctccagtaatgtcgttcatgcgtctgctttccctggaccaccgcttggacgagttgaatcccctcgaatgcccgacggactgtctgaggacagcgacgaccagccgctgccccctggggcagagagggtgaacctggaggcctggccctccacgtcccgcttcccaatcgacgtggacgggaatctggccaaggggtcgcagaaccccatcccaacatacccagatatatgcttcgaggtgtcaacctttgacaccgtcttcaagtcccagatcctgagggacgggaacacttgctacagcgtcctcctgcatgccagggtcgaggagtggcggtgtcagaaggcgctcgccgctcccgcctcccacccaggcggcccaccacacccgcctcccggtcccaagcccaaggtctgcgccttctccggcttcgtgacgcaggcccgcatggtggaggcgggggttatgggaggcccgctctcggtgctgggcccccggcgggcccagcgtgtgctcatgaatgggcccgggggggaaggccgcgccgaggtggcggtgctgcgcatgctgccgccgggccaggcccgggaggcggaccgagggaagggccccctccagaagctgacacggagcctgggccaggtggtgcgccaggtggcgagtgaggtgggcgccggaaagggcggcggcggtgggcccctggagctgcagtgctccctcatcctgctcagcctgcccgtgcagagcctgacccgcagcatcctggatgccctctga

SEQ ID NO: 695 - DNA, 1356 bp, Chlorella protothecoides
  modified_base (226)..(235): a, c, t, g, unknown or other
  modified_base (312)..(321): a, c, t, g, unknown or other
  modified_base (581)..(590): a, c, t, g, unknown or other
atgagcacgtatgtatggactgctgtggagcctacccgcttgcctctggttgttgtgtcgatgacaaaccacccctccccgccctcacaactggtccaggatcccgacgcgtacttctcgcacccggtggggttcatcagctacgatcgcgacatcccccagtctctgctggacgccgccgcaaaggtgaggaggattcgatcccgtcccttgttccatatagtannnnnnnnnncgggagcggatgctttgggagggcgatggataagtgattgcattggtgaaggtcatgagatggcatgtcatacacannnnnnnnnntctctgctggacgccgccgcaaaggtgagggggattcgatcccgtcccttgttgcatatgtttgttcatcggcaatgggggccggcgcaaggacatcgcttccacgctgccccacttcgacctggtcaaccaccagctgtcccagctgcggacgcaattgatcctggcggaggagctggggggtgcggccgccatcctgccctccatggtggcagggatggactcttcatacaaggcgcacaatgggactgtgccgggtnnnnnnnnnnggccgccatcctgccctccatggtggcaggaatggactcttcgtacaaggcgcacaatgggaccgtgccggggtcacggctgcgcctgccctaccccgccccctccgaccagatcatcgatatgcgggagatggaggagcgaatgcctggccgctggcgggagggctcttttctgctcaaaccccgcgccacgtcggtcaacgcctcggtgctggtgctgaccgtgtgcgaggcggggtcagatgtcactgaatgtgctgccggtgacgccaaggcggtgccggagcacgatcagatcaggatattaccaaatcggtccctggcgcagctgcggacggcgctctctggggtgttcagcaagtacaagaacccccccccaccaccatccacacccaatgcagagactgcatgtgaagggcggcatacagcgcctgatggtgctgacgcccaaagagttggagggctacagcaggaagctcaaccccctcatgtccagccactgctgcgtggaaggcagcccgggccacatagggtgtgtggagagaggatggtggtgggtggagtgctaggcaatggacttgaggctggttctcttgagccaatctggcgtctggaacccccccctcccctgacccatcttttcatcagcgttctttttcaatccaacaccgatgcaggtatgacctcttctgggacctgcctggccaccgagaccgccatggccaggtggtgccggggccatggaagccagtgcctgtggaaatga

SEQ ID NO: 696 - DNA, 1749 bp, Chlorella protothecoides
  modified_base (1270)..(1279): a, c, t, g, unknown or other
atgccaatgctgggcgccgggccgaagccggccgggaatctcttggccggtggttttctgtctgagcaggataatctggatccaagatctaaacagcataggacggcagctgtgagcagaggcctcgccaggcttgcggggcggatgatggcctccctaatgggcgggcggctcggagctcggcgcatgcccgggcctcaggcccgggtcctcttctgcatcgcggtggccgttgtcgtcatgtacacggcgagctccaggtttaacttggccagggccggaatcaacgtggccagcgtgccgacgcctctacgcggtgaggggtgggaggggctgctggaactggcgcttgcgcagctggggtggctcggctggtccgaaggcctccccatgcagtgctcaacatctcgcccaggatcttcagaggaccctgtactgatactcaatagtacttttgcacctagccatgaccataccaaaggtgccacccaagctgcggggcatgcagggcgcgacacatcgcccagtgcttcaggccttgccggcagaacattcaatcactcgctgaatcctacacatgaactcacaaaagtacactcacaagtgcgaacaatcatgcctcactccattcccaatcacccagggagctacttgccttggtggcggttgataagcacgtcatactcacacttgcaaactggaacaggatgtgcgtggtggaggatatgggcgagtttcatttgcggcctgcctcatcatgcatgcatttggggctgggactgctgccccgctgaagctccaagtgggatgtgctcactatcagatacctatcaaaatcttcacatttgctcttgcagcgacttcatcgagaactgggtgcactacatgcaagcaacaggctgcaaggcgtacctcgtcggtgagaatgagcggaattggcgctcgacttcatcgagaactgggtgcactacatgcaagcaacaggctgcaaggcatacctcgtcggtgagaatgagcggaagtggcgctttgtgtgtcgctttcttgcgtgattgggcatctgataataagacgctggactggttggtggagcgtgagattcctgccttctatgttcatgctgggtcgcagtccacggagatgtggcaatgcttgcaaggtgcatgcagtcgacatgcgccaagaataacacgagcccaagtggatgctggtgatagtgattcatgctgcattgcatgtgctcattcccctgacatatcctcaccccccnnnnnnnnnngatccaaggcttttcttggactgatgacggcgcgcattgctgtggacctgaagattctgcagtttggctacagcgtcctctccacggatgctgatgtggtgtggatgagggaccctctttccttcatgctcaaggggcagtgcaggtcctttaagcatgctgaacatctgtcgaagatcaggggcccccagcgtgctgcgtctggctgttccgttgccaaccccacccccttcccctataccatgcccccacagtatccggaagccgacatactgatgagcaacgaccagctcatcaccaccgcggaaggggaggagttggagcactggccggcatctgggtggtctgcaaacgccggcttcaagctgttcagacccagggcggcgcagtttgtcaaggtgggctatggtactgcttttcaggatgcccactgcttttcaggcaccccgagtccgcagccttgggtctga

SEQ ID NO: 697 - DNA, 1827 bp, Chlorella protothecoides
  modified_base (660)..(669): a, c, t, g, unknown or other
  modified_base (810)..(819): a, c, t, g, unknown or other
  modified_base (1160)..(1249): a, c, t, g, unknown or other
atggaccgcgtgaacatgagcatcgccatcctgcccatggcagagcagtatggctggtcctccatgaccacgggcctcgtccagtcctccttcttctgcgtgcatcagtcaagcatcacggggttcccccaatgcactccaaaccatcctcgcggcaggggctacctgctgacccaggtggcaggcggcgtgtgggctgacaagtacggcggcaagctggtgctgggcctgggggtgctgtggtggagcttggccacggcgctgacccccgtggcagcgcacatgggcctgccggccctcctcctggcccgcgcctgcatgggtgtgggggagggcgtggccatgcccgccatgaacaccctgctctcacgctgggttcccgtggcggagcgctcgcgctcgctggccctggtctattccggtatgtacaccgggtcggtgctggggctcgccgccacgccccacctcatccacaccgtgggctggcccaccgtgttctacgcctttggcctgctgggtgtggtgtgggcggtggtctggagggcgcgcgccgcctcatccccgggccaggaccccttcatctccgacgccgagcgcgagttcatctcgggcggcgtcgccgagcaggcgagcgggcgggaggatgcacgcaaatgggcnnnnnnnnnngcgcactgcgggaccaggaatgggactcgtgtgcgtgtttgtcattgcaggcatgcaaaccggaggggcacgggaggtggtcgcacccttcaacaacctccctcatacacacacatatggcctgaccgtcccctcaatcgnnnnnnnnnnggtggtcgcacccttcaacaacctccctcacacacacatggccagaccgtcccctcaatcaccccacctccataccgaatgcagagggtggctggcatcccctggcggcgcctgctcagcgagcgcagcgtctgggcgctcatcgtttgccacttctgccacaactggggtacattcatcctgctcacctggatgcccagctactacaaccaggttggtgtgtgtgtgtgttgggggggaggggggggagagacgaagaggaaagggatggggagaatggggttcttcatgggcgctgtcccctcaggatgcacgcaagcagccacattgcttcagcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgacccccgccctctcttccccctccatcactgctcacatgacgttccgccctcccatcccgacccgttctgccctcctccccaggtgctgggccttgatctgcgtgcctcgggcttcttctccgtcctgccctggatcaccatggccatctcggccaacatcggcggctggctggccgacacgctgatcgcgcggggggtgtcggtcaccacggtgcgcaaggtcatgcagaccatcggcttcctgggccccgctttcttcctgacccagctgggccgcgtgcacaccgtgcgcggcgccgtggcctgcatgatggccagccagggcctggacgccttctcgcagtcagggctgtacagcaaccacgccgacatcgggccgcgctacgccggcgtgctgctgggcctgagcaacacggcgggggtgctggcgggggtgctgggcaccgccgccacgggggccatcctgcagagcacgggcagctgggaccaggtgtggggtgtggcggtgggcctgtacctcatcggcaccgtggtctggaacctggcctccacgggggagcgcgtgttcgactga

SEQ ID NO: 698 - DNA, 321 bp, Chlorella protothecoides
atggcgcacctgaagaagggggagcatgatcaggtgctctttgaccgcctcatcttcagcaacgcagaggtcatccctagcagatcagatcatctgttcaggggctttgacaggaagctgatcatcggctccctgcccgtctccctcttctgctcgggccagacctacaaggagcgcatgcctcaaaacatgggcctgaaaccctacgctgtccatgctaccttccaggcctgcacccaggcaaagatcaatcgcctgcgggagtatgatctctggaaggtgggcgggagcggatgctttgggagggcgatggagaagtga

SEQ ID NO: 699 - DNA, 384 bp, Chlorella protothecoides
atgcacatgggcacggccgtgccgcgcgcctgcgaggacgcgagcctggacccagacaactccccgcctcgcagccgcctcttcctggtggtgcccaagtccgcggacggttcggccatcgaggcggccatgtctgccttccccgacctgcagtattgcaagaccgacctggtggcctccaagggcatcgtcttcgtcaagtacgcgcgctccagctctgccgccgccgccatggaggcggtgcaggcctctggccaggtggccggataccgcgtcaagatcatgctggcggagcccaaggtccggcgctcgccctccgccagctcggcggcgggcatgctgggcggcggcggcgccgccgcgggccacgcgcgtgccgccgcg

SEQ ID NO: 700 - DNA, 486 bp, Chlorella protothecoides
atgaggctcgaatcaggcaagccgggagtggagattggctggtttggagaggggctgctgggtgcagggctgcttgaggccattgtggggtgctcgcctgtatttctgcccctactatgtgcgacaaggggtcccactctcatattatcggcgctgtttgagagggccacccacctccacctcccagccaagaagatgaagttccttttcaagcggtggctggactttgagaaggcgcagggcaatgcggagggggtggagcatgtgaagaagagtgccatggcctttgtggaaatgaagcagggtgcggggcagcaacagtgctccatgacttcagtttgtcgacaacctgaaccgactgcagcgaggtgtgacggtttctgtacatctcgttgcctcgctggacgtgtgcgggctgccggcacctggagcaggagcatacctgtgagctcctcccccccaatatcgagctcaaagagagaatga

SEQ ID NO: 701 - DNA, 1152 bp, Chlorella protothecoides
atggccgcagcgaagaaggccaaagtctcacatgacgctaccctggcacccctttccaagcaacaaaaggttttgaagcctcagttagacacagagaccggatgggaggagctagagacgggcccaagcccagatgaattggtggcaggcgaggaggagactgcaaaggtaaagctgagcaagcaccagaagctgcagcggcgtaaagcagaggagacggcgattcgtgaggcagagctgaggcgattgcaggtacgagaaggtccaccctccccgtcggcacttcagggagatgcagcgcccaccagtgcggccgagtacgaggcgctcctcctttcctcagcagacagctcctttgtgtggatcaagtacatggccttcctcatctccctgggtgacatcgagcaggctcgagccgtcgcccagcgggccttcagcgctataaactacaggtgggctggtggccctgcccggtcacctggggaggacgccgagaagttcaatgtgtgggtggcgctgctgaacctggaaaacacgtacggcgatgagaccaccacgctgagcacgctggggcgcgcgctgcagcacacagacgcccgccggatgtacctggcggccacagacatctttcagcgcagcgagaggaccagtctgctggagcagtgctgcaaggccatgtcccggaagttcagtgcctccacagagcatcatatcgcagcatgcgccccaacatcacaaggcaaagcctgtaccgctcacctccaagtgactcactccccatccccttccctccaaatcaccgcattccctacagatctggctcaggatcgtcaggctgaggctggaccaaggagacgaggaggctgcaagtgccactctggcgcgatcgctgcagtccctgcccaagtcggagcatgtgcacatgatctcccacaccgccctcctcgagttcaagcatggggacgcaggttggtagatttggggggggtggggagggggaggcttttgcaccaagcgatcagcagcgtgggtgcttcaacttccagtacctgccaaggtggacacatagccttcggtttccatttgtcaacacatcagagaggggaaggagcatctttgagggcatcctccggaactaccccaagcgattag

SEQ ID NO: 702 - DNA, 1041 bp, Chlorella protothecoides
atgctgggtagattgaagctacacgaacacccacttgatatctccctcacagctgggcatgtcgttgtcgggcaagctctttcggtatggaccagaggtagcacacacggccttcatctctggtatgcagagcaaatccattgcctgtggcacatactgcgtgccatgatggtgcaggcactgatgccctcacctccccctccccctgccaccccaggctccggccggcggcatgccatcctggtgggaggcttgtcggacggcatgctcttcactgcatactgtacgcccctggcccggaggctgaatgcagcggggtgggcatgcgtgcagcccctcctctcctcctcgctgtcggggtggggcctggcgagcctcgaccaggatgcagcggagctccatctgctggctgcagccctggggagggagcacggggccgagggcgtcgccatcctgggtcactccacggggtgccaggacgccgtgcgctacgcgagcctgtatgccggtggaaaggacggcgcgccgcccctgatgggcctggtcctccaggcccccgtcagcgaccgcgagttcctgggcaagcagcaaagcaccgccgccctggcccagcgtgcacagcgcatggtggaggaggggcggggcgaggacctgctgggcagggctgatgcgctgggcgggacccccatcaccgcccggcgctttgtggcgctggcgtgcgggggtggcgacgacgacatgttcagctcggatctgagcgacgcacagcttcgggtgaggggcatgttggttgaggatggtgagcagtgtcttgaaggtggcctccctgcacggcatccattccaacttagggtcactatgtccacgaggcttcgggaggctgatccgctggacaattcgtttgatagtcactgtgcacctcgaatcctcctccccttacacatcaccctcccaggagctcttgaagggcgctgcctcggtgccatcgctcttcctcctgggcgctcaggacgaatgctacccggctggttgcgacgttga

SEQ ID NO: 703 - DNA, 687 bp, Chlorella protothecoides
atggcgacaggcctagcactgctgttggagctgccaggcctccccatctcgtccatcttccgagtccatgtcccgctggcgccgggctcatcctgcatgaccgatgccgagaaggatgctcgggctagaggagcccttacagccatcaaggctctgagctcgaccgctgttccctttctggctcgcattgcagatgcctggaatctggagctggtctgctccaaggcgaggctggaaggggagggggaactcctccccctgcccttcatagtagatgttcccactggtacatccattgccatgccccaccccgacaacctactgataccaatgcaggcccacgtcggcgccatctacaagctcctgctggcccagcaggcaggcctgggcatcgccatgtcgagggatgtgcgcgcccacgtgcaggtgggcgcccttgctggcgcgcaggcggccaccgtcgcgcggtgggtggcggagagcgcgctggagcgcgctgggtggtggcgcgtggcgcaggaacacctgctcagcgcctgcctcctggaggcagcgacaggagaacgcctcgggcagtgcctcaggctgggagtcgaagcggttgactgcgtgtcaccgaccgcgctgcgggttttcctgcgcacaggtgggatgagaatggtcccagagtgggtggaccgagaatag

SEQ ID NO: 704 - DNA, 669 bp, Chlorella protothecoides
atggctgggaaccctgcgctggacgtgctgctagacccggaccagggcatcctaggggtcattgccaggggtttgattcctctgtccggcagccagatgaacacttcccacagccgacattctccccccccccatccgggacccctaggcctggcatcctcctcgggccgacccaggcaggcccacaccctgcgattccagccgccggtgcactcgctggccaggttccggggtcaagccgcagcctgccctgtcccgagctgccaccccgccacctggcagaccctgcagcaggcactggacatggaggccatccgcagggcggaggcagggcgcttggacgccggggacaagggaagtgcgaggagcgacgcggtcgctgcctcccgggaggatactccgccggggctgggccctggccccacacgacccgtggtgcccctgaccctggccgaacgactccagctcgccaagacggcgccgtctgctgccctcaaaccccagcggagcatgagttggctggatggcctcaaggaaaggaagcgtcccatgggacgacagacggtgggaggaaaggacggcgccgctccccattcggtgctctactgcttccacgaggggtacaccaacgccgtccggcgccccgtccgcatggctgacctgctgtga

SEQ ID NO: 705 - DNA, 720 bp, Chlorella protothecoides
atgcaggggaagccgacatgtgtttgcctcaaccctcccgcccccgggaccccccaccagccgccggccgccattgctgggagggcgtctgaggcacctgcagcgcgacagtctcgcctgctaaccctgctgcaagattttggggagcacgatctggtcctcaggggcaccggcagccccactcccccaagcctgccccgaccctttaaccctggctctctccaatcttcgcacagtggcgtgcacgagaacctcctgtccctccgctactttgacctggcatgctccagaaccgcctgggccctatttgccctctgcgacgctgacaggctcctgggcagctgctatgcttccggtagctggggcgcagcccggtatgtgcctgctgccctcctctccgccgcaggggaggtgaccagcgttgagaggtgggtgctgggatgggagtcattggagaggcctggaaaggcctgccatggtgtggccaaagagcggagcggatgcaaggcggaagcaggcggggcaggcggcgctgctcagagcctggcggtgtgccatgtcgccgctgggtgccgcctgccatgccccccgaagcctggtcctggtgagtcaaagctggcgggtatcgaccaggccttcagctgcgtcgcagccaaggcactgtcagcagctgccgactgccacagcagagcactgcaggggccttctgacctggattag

SEQ ID NO: 706 - DNA, 243 bp, Chlorella protothecoides
atgcagacggagaggctggcccagcgccttgcctacctctgcgcctgcgagggcctgcggtgcgagaagagcacgctgcgcacgctggccgagatggcggagtgcgacgtgcgctcgtgcctgaatacgctgcaggtggccccggagagggggtgggggaaaggaagtggtgggaaggcaaagggaatgcgcctgcagcatcctcacgcacagccggacaaaacaagaacaggcggcttctga

SEQ ID NO: 707 - DNA, 825 bp, Chlorella protothecoides
atgggctccgcactcgccttcaccccctccccctccccccttgtaccattgcaggcctccatttcgggggcccgcaccctaaatgccccacagcagacccgcgccaaggtggcaaagccagttatcagctgctccgccctgccctcccggcaggcctgtgtgggacccgctgctgccgcggccctggccctggccctcggtttgggggcggtggagccagcacaggctgacgtggcagggctcaccccctgctcccagagcaaggcttttgccaagagggagaagaatgagatcaagaatctgaaccgtcgcctgaagaacgggccggtctcacacgccggccgcccctgtgcgaccatgctgcgcgtccctccactgccaatccctcaccctccctcgcacacacatcgcatcgcgcagtacgacgagggcaccgcgccggcgatcgccctgcaggccaacatcaagaacgtggagcggcgcttcgccgcgtacggccgcggcaacctgctgtgcggcaacgacggcctgccgcacctgatcgcggacccgggcctggccctgcgctacaaccacgcgggggaggtgctggtccccaccatcggcttcatctactttgcgggctggatcgggtacgccggcagcaagtacctgcaggagaccaagctggcggccaagcctttcaaccgcgagatcatcatcgacgtccccgccgcctggcgcaacctgtgggagggcttcctctggcccgtgcgggcggtggcggactggaggaccggcaacctgctggccgacgatgacaagatcaccgtctcgccgcgctag

SEQ ID NO: 708 - DNA, 573 bp, Chlorella protothecoides
atggggccggccgccgcgcccgaccctctgggccgcccgcagcacaagatcatcctgctggctggccccccggggctgggcaagaccacgctggcccacgtggcggcggtgcactgcggctaccggccgctggagatcaacgccagcgacgaccggagcgcgggggcgctggggccgcgcgtcgcggcggccgccaccatgcgctcgggcgcgggcgcgatcgccgccctgctgcgcatagtgcaggccccgcccgtcgcgcgggcggggcggggactcgtccccggggcgggggcggcggggtccaggtcgagccacgaggccgccgacgcggcgtccagcgacggcgagagtgacggggaggagcacccagcgcctgcggggccggagaagcggcccaaggggcgcgggaaggccccggggcccctgctgcggcccatcatcgccatctgtaacgacctgtactgccccgcgctgcgcccattacgcgacgtcgcccgagtcttccacttccgcaagcccacggtgcgtgtgggagcgtgggtggctggatgtggatttgcatggcggtga

SEQ ID NO: 709 - DNA, 855 bp, Chlorella protothecoides
gtgctcctgcgcggcgacgaccgcgtggcgctgtttgacgtcgcgcggcgcgcggtggtggcggagctggccgcccccggcgtgcgctacgtggcgtggtcggaggacggcacgcgcgtggcgctgctggccaagcactgcgtgaccctggcgggcgggcgcgacctggccgacccggccagcgtgcacgagacgctgcgcgtcaagtcggcggcctgggacgggtcgcgcgtgctggtgtactccacgctcaaccacctcaagtacgcgctgccggggggcgacggcggcacgctgcgcacgctgcccgacccggtgtacctggtgcgcgcggagggcggcgccgtgcactgcctggaccgcgaggcgcggccgcgcgcgctgcgcgtggacacctcggaggtcgagttcaagctggcgctggccgcgcggcgctacgacgcggtgctggcgctgatccggcgcggtgcgctggcggggcaggccatcatcgcctacctgcaggagaaggggtaccccgaggtggccctgcactttgtgcgcgacgagcgcatccgcttcggcctggcggtggagtgcgggaacgtggaggtggccctggcctccgcccaggccctggacgaccgcgacacctggtaccgcctgggcgtggaggcgctgcgcgcgggcaacgctgccatcgcggagtttgcgtaccagaagacccactcctacgaccgcctggccttcctctacctcgtcaccggcgcggccgacaagctggccaagatggccaagatcgcggagcggcgcggcgacgcgcgcgcgcgcctgcaggccgccctctacctgggcgacgcgggcgagcaggcgcgc

SEQ ID NO: 710 - DNA, 816 bp, Chlorella protothecoides
atgccaaaccctccacatgtaggtggctggacgataagaagcaccggtccttcgacatcctcgccctctacgtcggcaacgacccagagtggtcttgtcccgagtgcgtggcggtctatcgccgccatggcttctcctggcagctgctgcgccaggtttcccagacctctgtgtggccgcgggtcaccgatcgctacacccacatcatggtcgcggacgacgacctcatcatgtccacgcgaggtgccacggctgccgggctgggctgggcttgcgatcaccagcccctgccggcctgccgactgctgtgcgggactcggcgagccacgactgactcaccgcaatccacccctgccccccgtcccagccatcaacgtcgcgttcgatgtcgccagccagtatcggctggccctcagccagccctctgtctgccggcacccagacagctacaccttctggacccaggtgtaccaggacccagagaaggtgctgcggtacacggcattcgtggaactcatggcacccatctttgacatgccgacggtcacctctgtcctgctccccaacctggatgaagacaccgccacaggctacggtgagggggtggtgtggtgtggggagaatgacaaggtggcgcagatggaaagctgtgcctccctggcagcgcagcacgggccgtcgcccccttctctggaccctctgcaacctgacacacacccgcccatcgcccctctcgcccagcgctggactttgtgtggcccctcctcctcgactacccgagggacaggatcggggtggtggatgcagcctgcatga

SEQ ID NO: 711 - DNA, 1344 bp, Chlorella protothecoides
atggctgcgagacgccccacaccctgccccttctccggcagggatctggtggaactgcatgccagcagcaaccacctggtcgtcacctggtccgactgggacaaccgcgactttgtgaggaattgggtgtaccatctacacaaggcgggctgctctgccctgctggtgggggccacagacactcagctccttgagtggctctttgaggctggcatcccagccttctttatcgagcaaaaggtgccgagtgtggtatctcagcaaggggcaaaagggaaggggagggttgaagctgtgcaccctatgcgtgtgcacgtgccaatctgcagccatgtggatccccaccagctccagcctcatctccgcctatcctgctcaatctggcagagtcccgccagagtgtcactcctgcgggccttttctgagctggggacaaacgtcattctgagcgatgtggacgcggtctggctgcgagaccccattccgttcatgcagatgtacccggatgccgacatcttggcatctagtgatgccatggagcatggcagtccctcggagaagctggaaagctctaccaatctcgagggccccgccagtcttgccgtcctttttatgaggccatctgctcgtaaattcatcatgcttggtgtgcaaggaggtggacatggcctaggagcaagtggatatcctgagggtccctgtttgtgtctccgtctgatggagtggaggccattcacgagcaccttgccatctcgtcaagagtgggagtctgccctcccttctgatgggagatccggggagcgggcggccttcaacgacctcttccaccgtgagcttgtgcagctgacccggcgcaacgacaacctggccaggtgggcggcggggtgcagcccctgggctggttgcggggagctgacccacgacgcatgtcatccgctacgtcgcaagagcgcccagtgtgcctctcaaactactgccccccctttcggcagtgtattccgagggacgctgctgggaggcatcctctccacctccgccttttgttcgggccaggcctacagggcaggcctgcaacaaaggatccatgtcagaccattcgtcgtgcacaccccacacccggggcccggcgcggctgcggaaaaatttgtgctgagggagctgggcctgtggcgggtgaggcgaggctgcggggcatgctgcgaaaaagtttgtgctgagggagctgggcctgtggcgggtgaggcgaggctgcgggacatggttcacacctgtgcatgggatggttttacggctgcagcagcacaccctgagccccagcgaatcgagcgagccgactctcactga

SEQ ID NO: 712 - DNA, 1116 bp, Chlorella protothecoides
atgagccggtggacatggtgttcacctcggtggcgggccaccttctgcagctggacttcacacccccccattcctcctggcaagggtgctcgccccaggacctattttccgcccctgttcaaaaacaagtcccaaaggtgcctgaatggctttcaagtggccgattgctgggccattggagcaaattggggctgcgatccgacacctgagcacttgacacatgcggacactcatgattcgtgtgctcgacgtacctcaccccctacggcttcccagggtgagcaggaaaagatcctgcgcaatctgcagacccaggcccgctcctgtcagcagctggttctctggctggattgcgatagggaaggggagaacatcgcgtttgaggtaggcgcacaggcacggccatcatcagtggtccattcaagtcagcagcaagccccccaaggttccctcctaactcatctcccactcccaggtcatccaagtatgtttgaaggccaacccacgtcttcaagtaaagcgcgctcggttctcaggtgggtgagggtggtgcccttgagcattggtacttgcccaggagtccagcatattgtttttgaaaggggaagctctggtggcatgccatcggcagtgagatactcgactgtggtggcggcttctgtcctgcaacagacctcatcccgcagccacactctccttgcatctccagccttcagaccctccccctttcccctcgcagcgctggtggcctcggacatcatgcgagccgtcaactcgctgggaccccccaacgagcgcgacgccatggccgtggacgcccggcaggagatcgacctgcgtattggcgcggccttcacccgcctgcagaccctgctcctgcagaacaagtttgactggagcgggctcctgcccgccggccgcgagcgcatgctactcagctacgggccttgccagtttcccaccctgggcctgatcgtgcagcgcctgtggtgggtggagggagcgggttcaggcgcctggggtgacaggagttgcaggggtcctgcagcctgccagggaggctgcaccctagtaagagggcatgggcaccggacggtcgttggcacagatggctaa

SEQ ID NO: 713 - DNA, 804 bp, Chlorella protothecoides
atggagcagcacggcattggtaccgatgccactgtggcagaccacatccagaaacaggtgtcggggggggggggccctgatgggcaacttccctctttccatccttgggctgaggcagcaggggctgagggaggggcgctgaaggatgcccccgcagggggcatgtctgcacccctcaccatggggtgcggggccatccgggcagcatgtccctccgtcctcacccatccgacagcccactcaccgccaacacctccctccaaccgttcgctcaattcacagttggagcgggggtacgcggtcaaggacgaggcgggtcagtcccagaccttctcgcccacgcccctgggcgaggccctgatctccgcctacagtgccatggggctgaccaacctctggcagccccagctgcgcggcgccattgaggggaacatcctggcggtggcccagggcgcccgcaccaaggcgagtcgggtggcgcggcccgccgctgcggcccgagcgcacttcctcaccgaagctccccgacgcaccccccatcctttgcaggagagcgtgctggcggaggccatcctcgctttccagaccgactttgggtctgccatggctcaggcccacgtgctggaggcggaggttcgcgaggttgtgtttggcagcgtggcgcggggtgctggtgccggggctggagccaggcgcctggatgcaggggagcgtcagggagagccgggcggccctggcctggccccgggatcccaggcgttcggtgggtgcagctgcggcgggcagctggtgctgtccaggtga

SEQ ID NO: 714 - DNA, 237 bp, Chlorella protothecoides
atgccgggtgagcgcatcatgcggtatgcggaggagctgtaccaggccggcgccatctcctacccccgaaccgagacagacatgtttgacaagcagtacgacctcagggtgagggcgctgggatctgagcgacacggagggaggactcgtgggtgctgctcctcaagggacgtgtgcctggtgttgctgggggattggtacaagatccaggaccctgggcaggccgggccaggctga

SEQ ID NO: 715 - DNA, 441 bp, Chlorella protothecoides
atgacagagaaggaggaagcggctacgcctccggccggcgagctgctcgtctgcggagccacagattactgggccatcggacgcaccaaagatgtccgcgcggacgtctaccctaacctacagctgccgcacaagttcaaggcgatgcaggtgtgggtgctggtgtgggagtggaagggggctgcgctccgttcggtcctgctaccgggactggatctgaagcaggcgcccctccttactcatcacgaactacgcagggcatccgcgtgttacacctggggaaggaacgacaaggggcagcttgggctgggggacaccgtaacccgcaacgtacccacactggtgcccggcctgaagggcaagaaggtggtgggaggtggctgtggacggcatcacaccgtcgtcttcaccgatgatggtgcgcgtgggtttgcgctttga

SEQ ID NO: 716 - DNA, 1296 bp, Chlorella protothecoides
atggccttcctggaacagcatgtgccacaacctgtcactgtgctgggagccagcctgggcggagcagtagccgtggattttgcggcccggtacccgcatgctgtgaatgggctggtgctgctggatgcccaggtggggttcacggcaaccacatggcagggaggaacaggagggccagcaagcagccgctccacatgtttgcctctacagatgcaggcggccgctttccaagttcataggtctacggctgtcggcaccggaccacccacaacatcccccccttccccgctttctacaggtgatgaaggatggcatcggcatgctgagcagcctgccccagatcgcggcgcggctgggcgtgagggcgctgcgctcgcgctggctgcgccggagcgcctgcgacatgtcgtgccacgcccaggatgcggctgcggtggaggacatgaccgagatcgggcggctgcacacgcacgccgcagactgggaggcctgcatgctggccttcatgcgctcagggggctaccacgtgcgcggcaggctggcgcagctggcggcgcccagcctggtcctgtggggcaggcaggaccgggtgctgccgggggcgaagaacgcacggcagctggtggaggcgctgccgggcgcgcggctggtgtgggtggaggactgcgggcacctggcgcatgtggagcacccggacgtggttgcctcccatgtgctggagtttgtaggtgcgagggcccaggatgcgcgtgcacggcatgctggggacgattctgttccaggcaatggcttcaggtccgcggagggggtgcgcagggctgccaatggcttggatcgcctgcagtgagctccggacgcagctttggtagcatagattctcaggaggaaagcgagaatgcgggacagcggggaagagcagatctcaagctgctctcggccaagggctgggcccgaatccagggtcaaacgaatctgctcggagttcgcaacctcgctggagccgcagtcgggctacttctagggtacgtatcgtgtctagatcggtcgtcttcggatctgcggcaacatcgccgggaaatcacccgggcgaacacaagcctcgacaggtggggcgaggggcgagccagcgagtttcacgatcagcaggggagaagtattgtgtgctcagcacagcaggacgtatcgaatcgaatcgccgctcctcgtccacagggtatatcggagctgcgtcctgaggagccatggtgcaggctggtcacatacacctacagtccccccccgagctttccatcctag

SEQ ID NO: 717 - DNA, 423 bp, Chlorella protothecoides
atgcgcctgccgcacgcggcctggaccgcgctgccccccggcgccgagacggcgcgcggcggcgccgacgccgcgctggtcttcgacggactgcaggccgcgctgcgctacgcggaggaccagtacgtgtccaccgcggtgcggtacgggctgtgccgcccgcccctggcgcgcctgaccctggccgacctcgtccgcgcgcacctggacaagctgccggtggtggccccgggcgcggccgacgacgtggctgccacactggtgcagtacctggacagcagggtgctgcagtacggggaggtgctgtggaggctggacgcacccgcgcagcagatgttcatcgtggagaaggggtcgctcagggtgagcggcggttgtgggtgttgcggggcggcgctcgcccctcctggtgccgggatctga

SEQ ID NO: 718 - DNA, 540 bp, Chlorella protothecoides
atggggccaccaaacgcgaaggcgcgacgccgaaagcatcatcatccgcataggatgccaacatgcaaggtcggtgagggcgttgcgagtgtggatgggccaccggcccctgcagctggggtcgtgccccaggagcatgtggcagccatcagggatcccactgcacatgcgcttttggccagggtgcagcgggtggtggttagccacccccgcctaggccccatcaacactgcatttgtgggcccgcgccagccggaccccagccgaccccaggtgctgctcctgcacggcttcgacagcagctgcctggagttcaggcggctcctgcccctgctcgaaggccacgtggatgtctacgcgatggacgcggtggggtgcgggttcacaggctcatccggactccccctgctgcaccccaccaccctcggtgagcagtgtagaggaacaacactacgtttgctgctttctgaggagcccagtggcctgtcaaccgaggtggctagtgccgaggagtgcctctccaggacgctgactgtgtga

SEQ ID NO: 719 - DNA, 1302 bp, Chlorella protothecoides
cccccccgcgccgcaactgccactaggaagctgctgcgtcgtgccctggtggatacgatccaggcgtcccccgcccccgacctggacgtgcagtgcgcctgtgacctctgtcccggggccctgccgcacgcggaggtgctggcgcgcatgcgcgactcccgcttctgcctggtgctggccggtgataagccctccagccggcgcggcagcgaggcagccctctccggctgcgtccccgtgctcgttggcccgccctggcacacagtggccctggccgacgacatcgaccacggcgcctccagcgtcttcatttccgttcgtcgtgcggactgggtggtggccaatgcctcgctgggcgtcccggacaaccaccccgatgtgctgaattcctggtacctggatgctcacctggtgccgagcagcgtgatccaggtggacagcctggccgaggttctgggggtgctgcgtggcatgccgcccgaggtgctggccgccaagcaggccgcgctggcgcggcaggcctaccggcagtactggctgccgcctccgggggagaccaggtcgcagctgggggagatcgtggtgaagaggctgtgcgaccatgcccagatgctcaaagacaagggcccattgtccaggatgcctgctgccaaccctgttatattgaactcgtgctcatggaatacagcgagacctcccaggccagtatgtgttgttgataatggagtccatcgcctgaggctgtcggagtgtcccaggggtggattgcctgtgcccaccatcataagggagggtcaggatggcaccttatcccgccccaccttaatcgagattgtagcagggaaagtgtgttgcgtggccgtgaccagcaccgagagaatcagggtccccggtcacgagggcaaatggccagaacaagcacaggaacctgtttcacaacgttctttgagagctaaacaccactgcgaatgctggataagcttgctctcatttcagtcctcagtattgtctggagaccctctagactttgatatcccgacggcaactagggctggacctgaagagtcttgcggaatctctccaggcagcacaaacgtgcgcttgcaggtgggaactcgccatgtgatatggtaccgtgatgtcgggggaggtgacccaccctggttacgccccgtcgattcgggtgggattgggccggggttagggcttcctcgcgatcccgtccatgaggccccaacccgatgtcgtcaggccttcaccgcctgcggcacacatcctttgcagatatgggtcgttttatga

SEQ ID NO: 720 - DNA, 900 bp, Chlorella protothecoides
atggccctgcccgcagccctcctcagcagcagagcatctccagccaacctggcagtccacactgcactgcccccctttcccccctggcccccggcgcttccccctgggctctgctcttgcaccggggtgcgcctgccatacttcaaccccccttcccatgcctcgtgccagccacctcacacgctccccctccccacacacacacaaccacgcagcaagatccagcggcgggcggtggtgcaggccctgaccgccctgaacaagccggacctggacctgtcctgcgcctgcgacatctgccctggcgccctcgaccacgacgagaccctgagacgcatgctgcgctccaccttctgccccgtgctggcgggggacgcgcagaccagccggcgccaggtggaggtgatcctgtccggctgcgtccccgtgtacgtcggccccggctggcacaccctacccctggccgacgccatcgaccacgccgccttcagcgtgttcgtgcacgtgaagggaacggtgccctggatcgtcaccgacccggccaagcgcacggcgctcaacggccccacccttgagcgggagtggtacatggacgcggagctggggccggggcaggtgctggaggtggagagcgtggcggggatcgaggccgcgctgcgcgcgctgccgccagaggtgctggccgccaagcaggccgcgctgcgcgaggcgtacggccagttctcctaccgccccgcgccgggggagatccagtccggcgcagggcgcatcatcgtggagaacatctgcaggcgcgcgcgcgcggtcaagcgccggaggcagctggacaatgcggcggcgctggcggccgaggcggcaaaggtcgaggcggcggcgaaagcggagcctgcgaaaccctag

SEQ ID NO: 721 - DNA, 222 bp, Chlorella protothecoides
atgccggtgtggcccttcaaggcgggcaagcgcgacccccccaccttcttcgccaccgacgcgtggctcggcatcctcacagccatggtgatgggcctgcagcacgccatggcaatggtcggcggactcatcacgtcccacgcccagactgcctctggcctgcgtgcagcctggcggcctgaccagccaaaaaccaacccggaagactccaacacaccctaa

SEQ ID NO: 722 - DNA, 495 bp, Chlorella protothecoides
atggcccccgccaccaagttgatccgaaccgttctcgtctgtgtggccgcctcgggtcacagcttgcccaccaactgcacccagtttctagccagctcattgccctctcctccaccacctcatcctcaccccatccccctgtcatctcctccagccttcctcctctgggtcgggagggccctcctttgcaacgaggatctggccctgccgcgcgtcgcgcccagccctcaagcgcagatcacaggcacgccggactccgatgcctcgtgctccatctacgtcctggacccggtgcaggatctgggcctgccccggtgcaactttgcagaccccgccgtctggccctttgccgccccaaacaacaagctgcaggcctccgggccgctgcaacactgggagcagcagcacgccgtcaactactgggtggcacaggccatcgcaatgagcgggtaccagaccaacgaccgacatggcgctgacatggtgcgaggttag

SEQ ID NO: 723 - DNA, 474 bp, Chlorella protothecoides
atgaccaccttcctcttcgccaacgtcatcgcctcggggatcaagatcatgatcagccagcacttcacgcgccgcaaccgcttcgtcatcgcctgcgccctggcactgggcatcggggtcaccctggtgcccaactgggcccagaacaacctgtggaacaacccaaacctgagcgagggggtgcagggcgtgcgcgacgcgctcatcctcatcctggagaccggattcacgctgggagctctgacggccatcgtcctcaacctcctgctccccgacgagaaggggcttaccgtgccggagcccgacacccccgacctctccgtccagggggccgagccgtcggtgcgctactccagcaaaccccagggcaaggacccgctgcagagccaggacaccagcatgcacatgaccaaggactacagcaccgacatgcagaaggtgtgtgtgtgcgaggggcttggtcagtcgttttga

SEQ ID NO: 724 - DNA, 1659 bp, Chlorella protothecoides
  modified_base (1228)..(1237): a, c, t, g, unknown or other
atgtgtcgcgcgcggaatagtgccgtagcatgcacttcgactaggaggcgagacggacccaagcgaccaacacacacttgcatgcagagagcagacaatcttaggaagagaactttgctcgccttgcaagggggccggcggtgggaagagaactttactcgccttgcacggggtctggcggcgggtatcggttcagttgatggtggggcaagtcccctcttccggaagggctcctatcacaacgctctccctttgagaccgcgcgcgatgggaagcaacaggaaacccacacccgcggcatccgtgagtaactctgaagtgataccgccagctcaaatgccagctgcaggaggccagcgggcacgagagggcacagctaaaccgcaccagccgtccaactcgactgagaagaagcgaaaacgccaggggacgggaggggagccagctgctgcccctgcacccttgcacgcaaaggcaatagatggagacagcaacgagatagacgacctctttgggaagctgaagtccaagcagagtgcccatcccaaggcgccatcctgcagtcctacatgctttggccacaattcgcaggggtcacaggcgcccaaggcgacggctgacgcggccactgcacccaccaccagtacttccatgcccagtgtcaccgtgaagggcagcaaggatgacctgtttgggacagaacctggtcaaggaaggaagaggacggaggagggctacgccgtgtacaccgaggaggagctgggatggggagccggccaggcggcagggtacctgggtggcccatggcgctccatcatcatccctactttccgcatggtgacccacctcctttgcgcacaccgagtgttcgattacacaccatcccaacttgcgactggagaggattcgattccctccaagaggggactcgagcaacggcaaatcaaggggaaggcagtgcaaggccggtctctcccaggccgtggaaacaagggatcttctggggacaaagcatggtgtgcctgcaccgtgcaaaacgctggaaaaggggactcggaagcagctgggagtggaggatcggggagggggcgagccaggaggcggtccttttgtaatgggcgccgggacgatggaggcagtgggacgcagtcagccaaaagccagtcccgccatcgccccaagggctccaggcccgtgcttgtgcaaacacatgacgtgagcctgggcnnnnnnnnnnaagcagctgggagtggaggatcggggagggcgcgagccagcaggcggtccttttgcaatgggcgccgggacgatggaggccgtgggatgcagtcagccgcaagccagtcccgccatcgccccaagggctccaggctcgtgcttgtgcagacacatgacgtgggcccgggtgcctgccaggccgtcccagtgctgagggggggccaggcctggctcgctccgcccccacacaccagccccgtcccgcgtcgccgctcagcacaggaaggggatgatgaggtactggaggtagaacagcttccacacgtccatgtagcaggcggtgagggaggggacggaagccaggtccacctggcgcgcgcggcgcacgagccaggccgcggccgccgcctggctggcggcggccgcgaggcgcaggccacg

SEQ ID NO: 725 - DNA, 1509 bp, Chlorella protothecoides
  modified_base (171)..(180): a, c, t, g, unknown or other
atgcaatacgacatcatcaatccgcaggatggctggaagggggcgatcgctggtcatgcctgcctggatgacgtcgggggccttcacagcaccgggtgggtcaagtggcaagcaaggccgccaagcccagcacgctgcattgagggagacggaggcagagacgcgagccgnnnnnnnnnngttgtagccctggacgatgacagccaggcccagcacgctgcactgagggagacggaggcagagacgcgagccgtcctctccgggtccaagcgtgggcatggggaggtcgacgccgcgcccgagtcccaaccggtccccaagacggaggccgattacaggacggccgtgaagcaggcagcagcagcgctcgagaagtcggcagggtcagtagctccagagccagaggctccccagcgtggcgccggcgactggcagcactaccagccccccagcgctgtgctacaggccgtcaaggaggccaagaccgcccgcgctctcccccctgcgctggccgctcggctggcggcccgcggcatcgtgcagcggaaggatgacacagggggccccgccacgagcagcaccgcgcctgccgccgccgcaggtgcagcaggagccgcgccgggcggcgggccggtgtcgagcctgccgccgggctggtacagcgccgtggacgccacttacaacaccgtctactactacaacccgggcacgggggagcgcagctgggagaggccggcggtccggccccggctgccgccggggtgggaggagacgcgcgaccccacctccggaaaggtgtactacttcaatgctgcggcggggctgacgcagtgggagcacccaggcaaggcgggagcagtggcacaggcgagcggcggcgcaggcccgcagcaggtgccggcggctcaggcaggccccggtgctcaggctggcacaacggtacaggcgggccctgcagtacaggcgggccctgcagtacaggcgggccccgcagcgcaggccgcccccgcattccagcccgcggaggcgtttgcaggcgcaaggccgggggccgtcttcaagcttgggccgatgggcctcgggtactatgccgacgcccccgccccggcgcatgccctcggtgaggactgggcgtgcgttggatgggcttcctgctgtgcgaagcagccgggaccactgcagaggagaatcaatgccctgcacaacatacctcaacgcaccctcatgccagggcaagggtgtgcgcaggcgcctggccaggcttcgaggggcgtcccgcctgccgagggaggagggcagcctggagctggcagggggagcggcgctcgcgcttcgggccgcgatcgcggcccgaagcgcgaagccctcgacccaatggatccggtgagcggcggggaggtgttcaggtggagccggggcggtgttgaggagagtcatgcacgcagtctggtctgcgcctttttaggcaggcctggctgtgcttttatcggcgacgggccacatccttga

SEQ ID NO: 726 - DNA, 1812 bp, Chlorella protothecoides
  modified_base (1016)..(1025): a, c, t, g, unknown or other
  modified_base (1290)..(1299): a, c, t, g, unknown or other
  modified_base (1782)..(1791): a, c, t, g, unknown or other
atgctgcgccaggcttcttgggccctgcagcgcgcctgccggcagggccgtgtggctgccgggacctgttgggccgcgccccgctccttcaccgaggctgcggtgcagagcagcgctccgggggatacccaggacgccatagagttcagggaatcggtgcgcagctttgcacaggaggtgatcgcccctcatgcagccgagatcgatgctagcaactcattccccaagggcgtgaacctgtggaaagcgatgggcgacatgggcctgcatggaatcacggtgcccgtggaggatggcgggctggggctggggtatctgtaccactgcatagccatggaggagctgagccgcgcctctggtgagctggagcctgcccgcttgtcccgaacgaatcatgactcatccctccccccccctgcctggcatgagggacacatatcccagcccccccacctccctccacccgtttccctccgccgtccaggcgcggtggcgctgtcctacggtgcgcacagcaacctgtgcatcaaccagctggtgcgcaacgcctcccccgcccagaaggcgcggtatctgcccgatcttatcgccggcgacgccatcggctcgctggcgatgtcggagcccggggcggggtcggatgtggtgtccatgcgcctgcgcgccgaccgccagcccgacggcgccttcttgctcaacggctccaagatgtggatcaccaacggcccctccgcctccacgctcatcgtgtacgccaagaccgacgccgaggcggggccccagggcatcactgccttcatcgtggagcgtggcatgcccggcttcaccaccgcgcagaagctggacaagcttggcatgcgcggatctgacacctgcgagctcctgtttgagaattgccggggggcccctgcacctcggggtgtggaggaggggatcgaggctggatgccgaccaatcggaggatgcctacccgcacgagcccgcggccgtcctttcctcccttccatcaacgatcnnnnnnnnnnaggggccctgcaccttggggtgtggaggaggggatcgaagctggttgccgaccaatcggaggatgcgtacccgcacgagcccgccgccgtcctttcctcccttccatcaacgatccctcccaacaccgaccatcatcacccagggcgtgtatgtgctgatgagcgggctggatctggagcgactggtcctctctgctggacccctgggactcatgcaggtggggcaagcatggtctggcaatgctttggaggttggagggacccnnnnnnnnnncgtgctgatgagcgggctggatctggagcgcctggttctttctgccggacccctgggactcatgcaggcagggcaagcatggtgtggctttggttgctgcacgcacacggggatgcggggggcccgagggaggactggatgcctgtgcaggcctggcaatgctttggaggttggagggaccctgcgcctcggatggtcatgtggagtgacatcagccgcttgccttcccaccccttcccaggcatgtctggacaccgtcctgccctacgtccgcgaaaggaagcagtttggaaaggccatcggggagttccaggtgtgtggggtgtgggcagagcagttagagtgactcgtggatgctggcctcaggcatctaggcctgaatctcaggtctgcgcgtcggccagggatcgctcggtgcaggactcgacgggcatggtgcagcagggctcggtcctgccttgggcctccgtccaacccccaccnnnnnnnnnngggtgtgggcagagcagctag

SEQ ID NO: 727 - DNA, 453 bp, Chlorella protothecoides
atgtacgccacctcccgtgccacccgcgccttcatctacgccacggcggccgccgcggacgcgggacacgtcagccgcaaggactgtgcggcggttatcctgtatgccgcggaggcggccacgcgtatggcgctggatggcatccagatcctgggcgggaacgggtatgtgaatgagtatcccacggggcgcctgctgcgggatgccaagctgtacgagatcggggcggggacctccgagatccggcgcatgctcatcggacgggagcttttcaaagacagcgcggccccagtcccggagcctcgctcagcaccccttgccaggagagcaggggaggtcgctggccatgaaacaaagtatacaaaaatgcacaccctgtgcctgctgtggtgccctgcagcaccgcagcgatcagacacaggcgggcttgctcaatgttgcatggacttttga

SEQ ID NO: 728 - DNA, 1929 bp, Chlorella protothecoides
  modified_base (577)..(586): a, c, t, g, unknown or other
  modified_base (769)..(778): a, c, t, g, unknown or other
  modified_base (1061)..(1070): a, c, t, g, unknown or other
  modified_base (1537)..(1546): a, c, t, g, unknown or other
atgttcactggagtcttgcgcgagcagaactttcagattccagtggccgggactgtccggccatcgcacgtttcaagattaacacaggtccgggtcagcctctgccacccacgcgtccaccggaccagtgctccggatgccgtaccgcgaccaggcagaacgtgcatcaagctctttgtaaacgcgtaccaaggtttatcaaggagcgaacacatcaatgcccttcttggaatcccaatttattacgaatctgggtgcatgctcaccctggaatcgcatagggcgatgacttcccggaacgtgccgaaggctgttggccacttagtgctggccgccacactcgcgctcttgtggagtgaaggggccttggcggtgagtgttgaggagatcatgggtgctaccctgtgggattgcatcccaccatatatctcctcagatcgagtgattttgcatgttacttgcgaatctctcgtgaacggtgcactgtgtgtgtggtcagcagggatattgtctgtcagtatcgttgctcactcggattcttcaccacccccctgcagtgtgagacatggtgcatgcnnnnnnnnnnatctccttccccagtactatgtgagtttgggtcaggtgcagacagcgccgatagcttctgcaggtgtgaaagccgggatgcagcgcagggaaaggatgcctagccgctgctctggagttgcacaaggggtccaaaaggctggagggattcattggcgccggatctgttcgcacctcctccctnnnnnnnnnngcccacccaaccgtcccatcaacaggatggagggattcactggcgccggatctgttcgcacctcctccctgaccgccaccggcctgtcggtcggcgtggtgcggctcggcttgctggaggtggactcgtctcccgatgccgaggtcctggtggcagtggagtgcttgtcagctggacagtcggcgtgtgtggctgacgaggacggcaacatcggcgctggaaatcagggcaggcgcaactttggccgcaacaaccagggagacgataacattgggaccggctnnnnnnnnnntattggtgagagggcgaggacgctttgctggcaaagcacagcactgagaggtaacttgtccatcccttccatcagggaccggctatcaacaaaacatctcacactccatggtgcaggaaactccaaccagggctcagtcaattggggagacagctgtgtcggcgacaacttgcgctgcactcatgtggcccagagcagcgtgcctgcgaaggaggccacccatcggtccatcacccagcatgccttggccaggggcagggaggcagctcccttcagcaggcggctgctgcaagccgcaagcgggcaagagcaagctgtgaggctgacgaaggccacccccccatcgcccaagaaggcctcaccatctccagccaagaggatgccacccccatctgtgaagaagcagccgccgccatcccccaaaaagcagccgccaccttcccccaagaagcagccgccgccttccnnnnnnnnnnccaactggggagacagctgcgtcggcgacaacatgcgctgcagtcatgtggcgcatagcagcgtgcctgcggaggtggccacccatcgccaagaggatgccacccccatccgtgaagaagcaaccgccttcccccaagaagcagccgccgccgtctcccaagaagcagccgccgccttcccccaagaagcagccgccgtcttcccccaagaagcagccgccgccatcccccaagaagcagccgccgccgtctcccaagaagcagccgccgcctccccctccgcgcatgcagtcacctcctcctccgactgcagtgtcgcccccccctccgtccacccagtcgccaccttcacccatcacattgccgcctccaccacccagtga

SEQ ID NO: 729 - DNA, 474 bp, Chlorella protothecoides
atgtcgcctcccacgcccccagtctccctcatcctccactccaccgacaggtcccaggatgcgcatgcgctggtgcgggagtcggtggtggcccagctgcgccgccagccggggatgtaccaggagtatgtgccgcaggagtaccgcgggtactgcgatgacatggcccagccccaggcctggggcgaccatgtgaccctgcaggccgccgccgactgcctgggcctgcgcatcgcactggtcacttccttcccggacaccgcctttcttgagatcgcgccgcggggggttttgaggagctcgcgcgtgctgtggctcagcttctgggcggaggtgcactacaacagcatctaccccaagggggaggcccccgcgctgttcatgggccccagtgctatgccgatgtcccagccaggaaggtcacaggcaaagttcctgggcagcaagaggctccaccacctgctgataggctga

SEQ ID NO: 730 - DNA, 597 bp, Chlorella protothecoides
atgttgcccctgctggagcgcctgctgcatcgaagccgccgcctggccgccatgtacgtcctggtgctgactccggtgcgagagctggcggtgcagatccactccatgacgcagaagctggcgcagttcaccgacattcgcgccgcgctggtggtgggggggctgtcgctccaggctcaggccgccagcctgaggaccagccccgagattgtggtggggacgccggtttcagggttgacaaggagggcatcgagaggagatgacggggaagggaggagaacgtggggtgtccaccgtggaggtgcagggtgggttctgccctgtgctcgccctggaatgctccccatgggttctgaagtggaaacaggggaagccaaagcccgatccggccagcaccccatgcccatcacttcgcgccgctggtcccagggccgggtgatcgatcacgtgcgaaacacccagtccgtgggcctggaggacctccaggcgctgattctggatgaggccgaccgcctgctggagatggggtttgccgatgaggtgaggcccaagcctgtgctgcacgagcaacttttgcgtgtcatcctgcattgttga

SEQ ID NO: 731 - DNA, 852 bp, Chlorella protothecoides
atgacggaggaggtgaagaagctggtggcggtgtccctgaaccgccctgtgcgcctggccgccgatgccacggcagccgcgcccaaggagttgacgcaggagatcctgcggctcaagggcgccgaggcgagccagaaggaggcagtgctgctcgcgctgtgctcgcgcacctttgcctcggggcgcaccatcgtcttcttctccacgaagcagcgcgcacaccgcatgaagatcctgtttggcctgggcgggctggcctccgccgccgagctgcacggtgacatgacccaggcggcgcgcctgcagagcctggaggcctttcgccgtggcgaggccgctttcctgctggccaccgacgtcgcctcgcgcgggctggacattctcggcgtggagaccgtgatcaactttgacgcgcccaagcagctccccgcctacctgcacagggtggggcgcaccgcccgggcgggggcgctggggcggtcggtgacctttgtggaggacgaggaccgcgcgctgctcaaggccgtggtgaagggcacgggggtgcagctgcagcagcgccaggtgccggccgccgccgtggcggcctggcaggaccgcgtggagcgcatgagcgacgacgtgcgctccgtcatcttcgaggagcgcgacgagcggcacctgcgccgggcggagatggagacgcagaaggtgagggggttagggggtgggggcaagggagggttggggattctcagggggagaaatgcgcatgctgaattgaagaaagttgggcaagcatctctgtggtgcgctggcgagcgggcgatgcacctggccacccttcccccccccgatgtgccggtcctttga

SEQ ID NO: 732 - DNA, 672 bp, Chlorella protothecoides
atggaagggaggaaaggacggccgcgggctcgtgcgggtaggcatcctccgattggtcggcatccagcctcgatcccctcctccacaccccgaggtgcaggggccccctgcatccaaaccatcccactcgctcaccttgttcacctcccccatcacgttctcggcagacacccggcaattctcaaacaggagctcgcaggtgtcagatccgcgcatgccaagcttgtccagcttctgcgcggtggtgaagccgggcatgccacgctccacgatgaaggcagtgatgccctggggccccgcctcggcgtcggtcttggcgtacacgatgagcgtggaggcggaggggccgttggtgatccacatcttggagccgttgagcaagaaggcgccgtcgggctggcggtcggcgcgcaggcgcatggacaccacatccgaccccgccccgggctccgacatcgccagcgagccgatggcgtcgccggcgataagatcgggcagataccgcgccttctgggcgggggaggcgttgcgcaccagctggttgatgcacaggttgctgtgcgcaccgtaggacagcgccaccgcgcctggacggcggagggaaacgggtggagggaggtgggggggctgggatatgtgtccctcatgccaggcagggggggggagggatga

SEQ ID NO: 733 - DNA, 201 bp, Chlorella protothecoides
atgtgggcagacgatgggctcaagctcgttccccaaatcaacagctaccagcccggccagggcaggcagcccctcgaccccacctctgctgggaggcacaggctgcagctccgcctcgacctgtttggcctctctgagcgccctgtggtgggcgacggcgcctgccagttcagggccctcgcagaccagttgtacgggtga

SEQ ID NO: 734 - DNA, 552 bp, Chlorella protothecoides
atgcacctggccaccctttcaccccctgatgtgccggccgccaacctgatcgagcacgagtccgagatcttctcgcgcccagcgcgcacctggttccagtcggaaaaggagaagcggtcggcggcggaggcggcgcgggtggcggacacgccgctgaccggcaaacagcagaagaaccgcgacaagtaccagaagaaggtggacatgaaggcgcgcgcggcggcggaggcggcggagcgcaagcagggtaaccgactgatggaagagacggagggcctgagccggaccatccgcgccatcaagtccagggagaagaccctgcgcatgaccggcattggcggggccaagacggggaagatggcggccggcatggtgaccggggtcaagaagaagcagggcaagaagaaggtgagaggggactcgggtggacggaggagaaagggtgagggggcttcattgtccgtgggtatactcggtggcatgtggtggcggggtggccaagaagttggtgctccttggtgccaattgttagcggccatcaggaagctctga

SEQ ID NO: 735 - DNA, 1626 bp, Chlorella protothecoides
atgcaaaaggccattttggtgccacatcctccctttaaagtgaggaaatctttcaacacaacaaacaatcagtaccatcccaacttgctgctgcctgtctggcccgaatgtgtcagctatgccattctacaccagcaaggctatggcaggagtctctcaggggagtactggcgacttgaaagggatgcagtttcggaggcacggatccctcttttgaagaattacggtcccagtaagcgcctctcccatacatatatccaaatgttcacagaattagaccgctacctcccaagaagcgttgatgaggaaagctcgcgcgcgtcgggcaggtcaccccggatttggcaaaccgcagagaggagtgctgcgctttaccgaggggacctggcagcaaacgtcagaaatggcaactcgaaggatgacggctcatcacagactggcattcgctttcctgttgtatgggcttcttttatgtaccatcacttcggcggtgaggacaacatgtgcagcgtatacgcgtattgtggcgaaccctcctcaaccccacttgagcccgaaggccctccctcccacccgttctgcaggaatcatgttcctccaagttcatctctctccccagtgccatgtaggcagtcaaacgtattgtggggtgtgaattacttcatccacggtatccgggcagggacaggatttccgcgggggccgtccggacagactggtcgctgtctgtcggctagttgcacattgacagcgcagagaagttttgcaggtgtgatgagtgaagcgagcatgggcagtgcagcttcaccgacaaaaggcttcagcaaatctggcggactgaggacgacgaccctcgacaccatgggtgtttccatgagcgctgtgcggttgaattccctgaacatcctgtcaacccgctccacagaaatgattgtggccgtggaatgcctgactgcaggtcagacggcttgcacagcggacgcaaatggcaacataggcaccagcaacaagggcaagcgtaattttggcaccaggaacactggagatgacaacgtcggcaacaacaacactggcacatccaactggggggataacaacagagggaagggcaatcgctgctttgacaaggtggcagaccggaaggtcgtgaacgactgcaatatcttggagttctgggagcgagccatcgacctatactacccaccaccgcctaaagcatccagcccacccccaccaacaaagagaagccctccgccccctgcaaaaaagagcccaccaccgctgccgcccaaaaaacccttaccactgccgcccaccaagagcccaccgccatctcccaggaagagcctttcacctcccccttctactaagaaaacgccaccaccaccatctcccaggaggagcccacccaccccgactccaggcaagagttcgccacccccaacctcaccaaaacgttccccgccccctccagtgcgattcccaccaccggggtcggcgaggcctccccctccatccccaatgctcccagcaccgcctcccgctgcccgttctccgcccccaagcccagctcgcaggcctccgcctcctgtaaaagcgttcccccctcccccagctgtcaggcca

SEQ ID NO: 736 - DNA, 822 bp, Chlorella protothecoides
  modified_base (91)..(143): a, c, t, g, unknown or other
atggctgatatcaaggggcgtgctgtagcactgcacacctgcatgcatgtagcgactcccggggaggagcgcacgagcgagaacgagtgcnnnnnnnnnnnnnnnnnnnnnnnnnnnnnnnnnnnnnnnnnnnnnnnnnnnnnctcccgggtaaagcggtaccaccgccgactcgatgccggggatacacctccggtagggcacaggctcaaccctctttcagcgcagtgcgtgtgtggacaagaacctgcaaccatgggtgaggagggaagcgagctgtgggagggcggtgccaggcgtggggcagcgaccgtccgttctgccggacgcacgggatcgtttcacgagggtgttattgcggattctacatccatgaaattgcaatcgttgcttggctgcatggtgggcagtagcgacgctgcgtgggggaagggccgacccccgatggctgggggtgctcgaagccggacgaccatcccctctcaatgcttacaggacttcaagaagtcccacctgggctccgagtggaagaagccctttgctggtgcctctcacgccaagggcatcgtgctggagaagatcggcattgaggccaagcagcccaactccgccatccggaagtgcgcccgtgtgcagctgatcaagaacggcaagaagatcgctgccttcgtgcccaacgatggctgcctgaacttcatcgaggagaacgtgagcggggcggggcacctgtcattctgccattgggccaggcgcctggatcgacgagcatggcgtgacgccaaacctcccaaccccatgccctcccgcaggacgaggtgctga

SEQ ID NO: 737 - DNA, 1887 bp, Chlorella protothecoides
  modified_base (20)..(29): a, c, t, g, unknown or other
  modified_base (1503)..(1512): a, c, t, g, unknown or other
atgttaggaacgtgctcggnnnnnnnnnnaagggagtttccagatctcggccagatccaccctaaccctagggctgcggagggcacgctccgcacacgcgcgcggcgggacgtgcgccatgtcccggatgatgttaggaaacgtgctcgtcgtttcacagactgcagcaaaccaaaatatcctaacaccgtttgcgtggttgtttgtgatacaccttgccatatgagggtgctcctgttcgccgccctggccttggcaggcttcgccgcgccggcctctgcagcagaggctgtgcccctgccagaggactacaccacggcttgctccagagatgtgatgtggaacataacatcttccgaccacacatgctccgagacgttgaccaattatctggatcccgttccatcttgctgcgagacgttggccacctactacggcccgaagtcgacccttccgtcccggaattgctggtgtgtcccggagtactttgccgagcagctcgccctcagcgtcgtccactatatctccgtgcccacctacctagcgggttgcgacacacgtttgccctgctcacccgtctcccaacgtcaccgcagaaagctgggctatcccatctactactaccaggagggtgcggggccgtgtgcgggagtgtctgcagccgatggcgcggccaccactggggccgcatctgcaccggtcgaaggcctcccaatgcggtcctttggtgcatgggttcgtgggctcgcgcagtacaagtggggggccgtcatgttcaccgtcgccattctggcaggtggggagaaggtgatgagccctccagcctcgtgggcactgccgctcacagggcatgcaatgtctgcatgggatcgtgcgcaacatccgacatggggggcgctgccctgcagggttgccctgcgccgcagggctgccgtgcactgcgggtgtgcctctcgtgcggggcactggctgaccgcgtggacgcctgctcctcctgaccccactctcctgtcaaacctgtgcagccattggcttctccctcatggcatgggccttcatcttcgatgccgccatcctgttgagcaagagcgtgatgcggtgttgacatgtccaaatgcgggtctcgattgctcgccgagaggcggcttcctgcacagggcccatgcttggcatgcagtggcaagcacagggcaggaggaatggctaaatggctgctggctgtcctcgctggcgcccccgtctcatgctgcattgggaacaagtcagccagcacaccggcccctctgctggtcctctagaatatgcgtggatgcctgtcccatgagcgaaggctcaatatttcgatggctccaccggccgcaccctgccacgccccggcccttgcgcggaaatctggagtttcagtgcttctccttccagactgctcccactgtcactttccagcccgtcagggtggtctcaaaccttggcgtactccctcccatcaacagcaacaggcctcgnnnnnnnnnncagactgctcccactgtcactttccagcccatcagcgtggtctcaaaccttggcatactccctcccattaaacagcaacaggcccctcttgatctcgacacctctggctgtgtgcagggagatcttgtttacagacagcctagttacgtggcttctccttcttgccacggaacagggccagcagggacacaccagccaccttcaccacctgcaaggatggccatggagggagctgatgagcagtctggcaatcgcgcggtgggcccctggtggcgacacaccgtctgcgccgccagcatgcaaatgacgaggcacgaagaggtcctgcgcggcacacccaccgcacgcccctcctcctcccaccacaaaccttga

SEQ ID NO: 738 - DNA, 186 bp, Chlorella protothecoides
atgtccctcaccgtggacatggctgagctcttcctgccgccgctggcggtcacggcgcgcgcgcggcggcacgaggcggccgtcgtggccgccaccctgctctgcgcggacgcggcgccgcagctgcgcgatgcggcccgcgcctcgcgcgtcatcgtcctgggtgggttgagatgtggagggtga

SEQ ID NO: 739 - DNA, 288 bp, Chlorella protothecoides
atgctcaacatcctgtcctacaccacggggcacagcgtggagaagctggacaaggtgcagtggggtggcaggttgcagcggagtggtggcatggccagccgtgccctgggctgttcacccgctctgctcctcggccccagtgacctgcagcgcccgctgtacatgcagcccaaggatgccatcgcgtatggggtgtgcgatggcatcgtcaccccggagcgcaagatcgtggacgacgtgaagaagccagaggagtgggaccgggaggcgggcctggtgcagcgatag

SEQ ID NO: 740 - DNA, 915 bp, Chlorella protothecoides
  modified_base (469)..(478): a, c, t, g, unknown or other
atgctgagcggggcggtggccgccgcggcgtgcaaccccacggacctggtgaaaacccgcatgcagacggcgggggcgcgccagggcgtggcgcaggtcgtgcgctgcgtggtggccgccgagggctgggcgggcctgtggcgagcactggctcaccctgctctcactccccaccccctccatccaaactgccaggcccgagcggcgctgctcacggcggggcagtgcgcgacgtacgatgaggtgaagctcctcttcactcgcgacctggggtgggaggacacgctgggcacacactttgcggtcagcggcgtcaccggcctggtcaccacgacgctcatctccccggtggacatggtcaagacgagcatgtttgtgggcgagcgcatgcgaccctgggcctgcgccaagggggtcgtggagcgacacggcttgcgggggcttttcagaggggtgttctcagcaccannnnnnnnnnaggggtggcgtgtgtgggtgtttgtgggtgaagtaaatggtgatttggtgggttgccagggtgttctcagcaccagcgccaggccatgccggggcgtgatacggtgggaaggggatgtgtgttgttacatgtcgcggttgggcgctggcaccatgtcacgcatccgcaccacaccagcctgcacccgcagtcggcacgcggaagggcagatgtgtcatccctgtgggatcgggattgaaaggatgctacctgattcgtatgcctgcaagttgtgcattctgccttgggtatctgtttccctggaggacagagtcccttctcacgctcctcacggtgcccgcgcgcgcggtagcagtcctcgctccaagtcccgcacatcaacatctacgaatcatcgttgccatgcacaatgcgctgatgatgctcgcgccacataa

SEQ ID NO: 741 - DNA, 1755 bp, Chlorella protothecoides
  modified_base (311)..(320): a, c, t, g, unknown or other
  modified_base (1652)..(1661): a, c, t, g, unknown or other
atgcagaggaaggatgcaggtccagggttacagaacggagcccagatcctgcaggacgaggagagcgaagtgtacgacttggagcgtcccatggaggatgcagggaagttcatcgacacaaagggagcaggactgtccctcttcagccctgggtggctgacgcagctaggccggctctggggcggctcctctgtaggcctcggaggtgtggtttatgaaaccgcaaatcctgttgggttacacattgaacatcctgctccatctcaccccgcaggatacaccggttgcggcggcaaagccagcagacatcnnnnnnnnnntatgatgactcattttccagcacaacattgcccgcgtgagggctattctggatattgcttgttgccagtgtggtttaatgaaaccgcaaatcctgtcgggccacacattgaacatcctgctccagctcacccccgcaggatacgccggttgcggcggcaaagccagcagacatccaggacctgctcggtggcgcactgttccgtgccctctacaagtggatggaggagagtgggccggtgtacctgctgccgacagggcatacctgagaacgtcgcattggcatgcacagtattgagcaaaagaacgtctgtcacagctcttcctatacctgtggagaccggccattcccacctgcctcacaccctccttgccctccgcccaggccctgcctccagcttcctggtgatctccgacccgcaagccgccaagcacgtcctgcgggccacggacaacccggcccgccccctgtacgagaagggcctggtggcggaggtctcccgcttcctcttcggcgacgggtttgccatctctggcggcgacgcctggcgcgtgcggcgccgcgccgtcagcccctccctacacaaggcctacctgtcggccatgctggacgcggtgttcggcccctccgcgcagcacatgacgcagaagctggaggtaggtgtcaggggccatgggctcccacctcgccatgcatgccccgcgccagcccagccctcacatcccgtcatcacacccaccccctgctgtcgttcaggaggcggcgcgcaccggcgccttcctggacatggaggcctgcttctcccagctcaccctggacgtcatcggcaaggcggtgttcaactacgacttcgaggcgctgacgcgcagctcccccctcatccaggccgtgtacacgagcctgaaggagacggagtcgcgcgccaccgacctggtccccatctggaagctgccgctggcgggcctcgtggtgccccgccagcgccgcgcggcggccgccgtgaagctgatccgggacaccacggagcggctgatcgcgcagtgcaagcgcatcgtggacgaggaggaggcgcgggggctggagacggggggggaggaggggctgctgcccgtcaagggcgacccctccgtcctgcgcttcctcatcgcctcgcgcgaggaggtcaccagcacccagacgacgggctcggcgctgacgtggacgctgcacctgctggtccagaacccagacacgctggccagggtggggaccgagggtgcgggcatgggatgggacggccattgacccagcgagacccgatgtccagccgcaggattggggatctcgatcggcnnnnnnnnnnacgagcagcaggcggctcgacttcttcctgtgaggggcccgtcagggcgctgtgccctccagtcccctcgctggctggccctcccccgacctga

SEQ ID NO: 742 - DNA, 333 bp, Chlorella protothecoides
  modified_base (33)..(42): a, c, t, g, unknown or other
atgcagctgagggacgacctgctgagcatgctnnnnnnnnnnagctcaaccgcaggcctggagcacggagtggtctcgcctgagtcccttttcccgccctcccccacccctgcacaggcccaggaggagatcgaccgggtgctgggggcctcgccctacccagacctcgcgcagtaccagcagctgcagtacctgcagcgctgcgtcgcggagagcatgcggctctacccccacccgccggtgctgctgaggagggccctcgtcccggatgagctcccaggcacgtggttggcaggggagtgtggggcgagcgacgtctccagggcgggttga

SEQ ID NO: 743 - DNA, 372 bp, Chlorella protothecoides
atgccgagtgaagtcctcatagtggagcatcaccgcggaatggacggcatgtccgacagtgacgtcctgcaggcgtccgacatcgagccactgatccggaacgggatacaggccaccgtccatggcgattggaacgaggaggaggccctggtctggcaggaggggatcggtaccgcctgcctgaagctgctcgcgggcctagcccggccctacaagtttgccgtcaccacccacctcagccagcgagcgggggcggggctctgctctgccacggcagcccactggaaccccaacacagacggacacatcgctgtgatctggacctcggacaccgtctttgtttgcgtgacggtcttctggtcggctgtgtga

SEQ ID NO: 744 - DNA, 249 bp, Chlorella protothecoides
atgccctgcgccccagtaccagcctcgcacctgtgcctacaccacctacccactccccactccaccacgcccagggcgtccgggggggatctggtggacggcgcgcgggcggtgctggcccacgccctcaagcaccgcaccaaggatgacgtcagcatcgtgctggcccgggtgctccccgaggcagagtgggaggcacgcagcccgccgcgttcgttctcctcggggcccatcttcggcgacccgtga

SEQ ID NO: 745 - DNA, 456 bp, Chlorella protothecoides
atgggcgcggggctgcccgactatgtcatcttcaacgtggggcccgtccccctgcccccggacatggaggtcagcctgcagaccctctgcagcgcccgcatcatcaacccctcaggccgggaagcgcggctgcccctcaaggacgggtcaatcctcgctggcccgagaagtggtaccattcaggtgcttgcccccctccaatcctccgaacatcagatcctcggaaatgggaaattgacggagccgaggacataccgcgcggcggccttcagcgagtctgcacgtgccagcattgaggcggctgggggccaggccatcatcgagccgcagaagaccaagtggaggcggggggcggccgcctgggccaaggcggccggcgaggcggccggcacggcgcccaagcagaggaagtcgcgggcagtgaagaagaaggaggccaaggccggcgcaagctag

SEQ ID NO: 746 - DNA, 558 bp, Chlorella protothecoides
atgctgcccggggcaggaccatgcccacagcgatggctcccacctcggggggccttacaaccctgccctgctccgctcgccactcacgccaggtggatcctggaggccgacccggacgccggcctgcagatgttcaccagcctgcccgtcgaccccggcgcactcctgcccatcctcaactcgcacgcccccgccctcgccggtgggtggcggggcggtttggccggctttgttccttgcacaggacgtgctgatgcggcgctgctgccacgcccctgccccatgcctgccttcgcacccatgccaaagccgctaccatgccgtggccgcgcccttgactgccccgcgccctccctcccacctccttggcaggttcctacctggaggagggccgcgcccgccgtgtaccagcagcagctggcggcgctgtaccttcgccacgtggttcagcatgccagcgaggaccccggcgacccggaggcgcggggcctggcggagaccgccaagctgaagcagctggtggggtgggggggattcttgggtgggggagatgaatag

SEQ ID NO: 747 - DNA, 315 bp, Chlorella protothecoides
atggacgtggaggcggtgctggcgctgaagctggacgtgctggcggggccgtgtcgcgacgcgtcctacgtcaccgaggacgacacgctggaggtgacggtggggcgcacgcccggcaactcgctggccttgcgcgacggggaggtgtcggggcgccacctggcggtcacctggagctccctggaccgctgctggcaggccgcagacctgggcagcctcaacggcacgctgctcaacggcgagcccatcagcgtgggcgcccgccagcgcgggcctgactaccgcctcagctccgacgacatcctgcaggtttga

SEQ ID NO: 748 - DNA, 978 bp, Chlorella protothecoides
atgggctcacacctggagcttgctgccgccgtggtgcctcgctgcagagggcccggttcttcaagcgccccctcccgtgcgccccgttccagggagtactgctgcattgccccggcccagagcggcgtggcccacctcgcccagcacgccagcgccagcccctgcgtgaccccggtctccgcctcccaggtcctgctcagcctgggggccgagagtgggctgttccggctgcctgatgggccccgcccgccccaccagaccgcgtcgctggcctggtcctcgccgccggcgtcggtggccgtcgcggcgccctttgcgctgggtgcgctgggccccgacgcggtcgaggcgcgccccatccaggctctctccggcgccgccctggtgcagaccctggccctggagggcggggcagggggcgcggagcctgccggcgccgacgctggcaaggaaacgagcgccgcctccgagggcacgagcggcccggccctgctctgcccctggccgttggcggacggctcctgcctggtcgcgcgcgccggcggacggctggtgcgcctgtcccagcgccccgcgctggcgcaggccgcggcgctgctggagctgggcgagtatgaggagtgcctggccgtggcggccgccgccccagcagcggacctggaggcacggcggcggctggaggacgtcgcgcacctgcgctacgcggccgcgctgttctgggcgggggagttcgaggggagcatgctgcactttggcgccagcggcgccgcaagcacgctggccctcctccgcctcctcccctcgctggccagccccggccacctggaggccctggcagcgcaggcgggggaggagctgggcgctccaggtggggcgcggtgggggtggggtgagtggagtgcgcagctggcagcttgtggtcacacgggagtggggaggctgagctgccgtcgttccagtgccaggcgcaatcgctga

SEQ ID NO: 749 - DNA, 597 bp, Chlorella protothecoides
atgtccgcaggcttgaagaacggggatctgcagattctaaagccagaggagcatgctgcggccttgacggcagcgggtttcaccacccagaccaggcggggcctgaccagcggccccgtgctgcagctgcagaccgacgagacacggtccatgctgttctgcatggggaagcagggggtgcgcgtatacaggctgccccgcctgctgctgaaggccgaggtcgccgggaccaggggctgccgggcctttgcctggcactccgagaccaggaccctggcaacagcctacaggaagaggtggggaggaggggaggtcgggaacggctggggtgggggagcgtcttggtgcgggaggggatcttggttgcaactgctgcgttatgtgtgcctggcccagcacccttccttcccctccccagccttccccggtgtcccttccctgcccagggtctacttcttcacctacgagggcctggaggtctacttcttcacctacgaggggctggagtttgtaccaagcagggaggtgcccatgagcgacaccgtggtctgcctcgcctttgtgggcgcccagctcgtcgtgggcctcagcgggtag

SEQ ID NO: 750 - DNA, 426 bp, Chlorella protothecoides
atggggcctgtgctctggccccaaggcgaggagtttgcgcgtgccgtggcggtggtgctgccgcacctgctgagccagcgcaaccgcgaggccggcgcctcgcccggcggcgtgcccagccccgccgccgtcgcggtcgacacggccgtgctccgggcgctgctggccctgcccgacagcggcgcgctcctgcacttcatccagcggcccaaccatgtggacctggaggaagggcgagccgccctgcgcgctgccggacgctactccgagctcgtcgcgctctaccaggtgtgtgttgggggggttgccctggtgaggaccgcggggctgggggccatagccggcgtgatcaggggttcatgccgtgctttacagctcgatagcagcctggcaggggtgcctgccgtcgaattcatggtcaattga

SEQ ID NO: 751 - DNA, 534 bp, Chlorella protothecoides
atgcccgccccgcagcgccgtgcatcgcgggaggactgccaccagttgtggctttctggggtcgtgcggcgagccagggcaggcccggcctgtcctgccgcggccttgcctcatagcggggctgcatcaggtcccatgcttgcgcaacttcctctgcaacccagcctcacccccctcaatacggaaaaggacgtggcgtgtgcgcagtgcccgctgccggaccctggccgcctgggcgaggcctccgtctccctcttctgcgtcttcgatgggcactgcgggcgcggcgcggcagaggccgcggcggtggcactcccggaggagatcggcgtgcggctccccgcctgcgaggcggacatgctggagcagcgtggcgctgtgtcggccctgcgtcccgccttcctggccaccgacgcacggatccgggccgaggaggggtgcaccgccacggccgtgctggcctggtcgccgcgcaagggcaccgtctgcctccaggtggctggagggcagtgggggtttgtttgtttgcagtga

SEQ ID NO: 752 - DNA, 285 bp, Chlorella protothecoides
atggcaaccgcttcggaatggcccgaggagagcatgggagagcgcctgcggctgcataacctgtccccccagcctggatccaggaaggcccggaacaggaagggccgaggctacggtgctggtcagggagggtcggctgggttcggcatgcgtggccagaagtccaggtctggaagcggcatgaggcccggcttcgagggtgggcagacccccctgtaccgcaggctgccaaagctgaagggcatcgcaggaggtgagggcagccggcatgtgttgtggctgtga

SEQ ID NO: 753 - DNA, 3660 bp, Chlorella protothecoides
atgcatggcgtggtgcagtacgacacgctgacgggaaagcagaagaagggttctggcgggccgcagagctacaccaactactttgccgacgcgctggtggcggaggccaagcgcgacgcgcgcgtgctgggcatccacgctgccatgggcggtggcacgggcatgaaccgcttcgaggccgcattcccggaccgcgtcttcgacacgggcatcgcggagcagcacgcggtgacctttgccgcggggctggccaccgaggggctagtgccctttgtggccatctactccaccttcctccagcgcgggtacgaccagatcgtgcacgacgtgtcgctgcagagcctgccggtgcgcttcgcgctggaccgcgcggggaacgtgggcgccgacggcgcgacccacgccggcgcctttgacgtcacctacctggcctgcctgcccaacatggtggtcatggcgcccagcaacgaggcggagctggtccacgctgtggccaccgccgccgccatcgacgaccggcccagcgccttccgcttcccgcgcggcaacggcctcggcgtggacctggccgccgcgggggtgagcgacgacctcaagggccagccgatggaggtcgggcgcggcgtcgtgcgccgcggcggcgccgacgtcgcgttgctgggctacggcacctgcgtcaacgcctgcctggccgccgcggacctgctggcggcccagggggtcagcgccacggtcgtggacgcgcgcttctgcaagccgctggacaccgcgctggtgcgccgcatggccgccgagcacccggtcatgatcacggtggaggagggctccattggtgggtttgccgcccacgtcatgcaggtggggtttttgtgtgtgtgtggggggggggtaaagtgtgaccaatccatatctttctcgaggtgtgtagagggccgaggcccggttcctggcgctggaggggctgctggacggcaagctcaagttccggcccatgacgctgccggaccgctacatcgagcacgggacgcaggcggagcagatggcggaggcggggctcaccgcctcccacatcgcgggcaccgcgctgagcgtgatgggcgtgaagcgcgacgcgccctccatcttctccacctgaagaggtgtcagatgaggtcctggcgctgtgccgatgggtgtggcgaggagtgcacccttcgcccccgcccgatcgtcggcctggcgcaaagcagcaaaagccaggcccccacgatcgcccttatcgcaagcaagcacgcatgcatggggcaccgcctgcgttgcgtatccaccggtggagctccccgtcgggagcccttcccctttctctgtctgcaccgagcatgtgtaacaccacgctggcgctgtgaagggcagtggtgtagggttgtcgtgcgtgcaggccgaatacagcatcgcagtctgcccgcgtcgagcgtcttcacagcaggtttggtgaggagtctggcttttcaggcagggaaggggaaatgtcgatgtaagcagtgcgcagggaaacttgtgcaagggatcgcagtcatgtatgcgcgcatgggtcgtcggttacccttgactgagccccgagcacggtctgaggtcaagcctgggggtctagtaaccccggtggtgtgtggcggtgagagggggcagcatggtgctgacgaggcgctggttgcgtggaaagggcgtcatggcgcacagggacccggagaagtagaggctcgccagcagggcagcaaagacgaccatgacgctgcgcgggggtggaagctgcgcggccagtgcaatgtccgacgcccagcacctgatgacgacggtggtgttgacgcgggaggagtccacctcccggttgcaggtgcaagagtccgatggcgtctgttagtctgcagggttgaagaggcagggcaaagggttgggcactttgcacaggtgccgtcaccatgggccgtcagcgcatggccagcaacacaggcgccccaccagacggcctcgcgtacctgggcggaggcagacgccgcgagggagatggcgagaaataacaggactgctggggctgcccgcagcagacgcatccttgcagcctcgggggagtgctccggcaagtgctcaggtggctacgctctggcgcaagtggtggtggtcggggtgcaggcctacgcagacaatgcaaagctattgccagcagtccaactccaggaactgaaattaagtaaggaactgaaaggcagacgcctagggttgcgctcaaatactttgcgcagacagcttaaattaggtatagtaccgttcactgctgatgatcattggagtactctgagacgcgtcgcgggttgggtagcttccaaaactttacaaatgtccgacctgcgtcacccttccaagatttttggaagcgcgaggagcagctttcgccagccggtgcacttgcacctgcagcctcgactttcacctttcaataaatttgccgagagagcactcgcatctagaaatttcatcccggtcgagcctggccggtcacaggaagaggatcgggaagcggaaagcagcggagaggttgtgcatacagcccttctcctatgctgcacccccggccttgcagatactgggcccatgcggcgggggttggaggtgcacaacactgctccagtcacagttccttcatcagaatcaggggacgcctccccagcacgctacatccccatccccaggcaccttcggatacggccttcctgggccgaacccctgcctgtggcgttcggaggtccgcctcctagccacttttgcggggctgatgcagggcttcctgccctgagccgcccagcacccatccaggcgcccagagtgctcacagcagccccgggtctcccaacattgccgaagcatctgcagccgcatgcgcatgggccgaggaggggacccctcgcaggggattctgtgcgtgagtcatccagtgactccgtatattctcgccgcgacggcgttgggcctccaccggccaccttaccaggcacaaatgcgcagcctgcggcatgcagggaccgtggtgcattggacatccctgtggggccgctggcacgggcggcacatggccagcctccaagccttcccctctcgggaggggcattcaaggttcagggtggggtagcacgcaacgaggcccggcaggattcagccaagtgccctgtcggagggccggcggagaggcagtccctgcgtgcaagcatcctggctctgccgcaggtgccagcccgatgggcacctccagctagggtcccccagcttaaagacaggctactgcgtgctgccaccactctggatcctggttcgaccgctgattgggtgggtccacagcagacctgcgacctggcctcacatgctgctgctgtggagggtcggcgcttggcgagagaggcagaaatttggcaggcagctcttgttacgagccagaagaatcaggaacggagggatgcgccgccaccagaggagcagcgagcatcctctatcatcgctgggaggcccgttgctcttgtcccttgcgaggaaccgggtctgtcacagcaagcagtgtcccggccgccatcagcccacatgctgcccaggccgccacaggctccagccatgccaccaccaccgccaccgccgccg

SEQ ID NO: 754 - DNA, 384 bp, Chlorella protothecoides
atgcctgcgactcacccctgtgttccccagcacctccctccaagcacacattctgacacaccctccaacataaaatacaccacccaccaggccaaccgccagctgcgcgagctgcgcgagattgccaagggcgtcaccaagcagctgcccgacgtcatccagaacgccacggccaagatcgacgagtacgcgcgcggcatgatctctggcaccggcagcaccctgttcgaggagctgggcttctactacatcggccccgtggacgggcacaacatgcaggacctggtggacgtgctgtcgggtgggtttgaagacgggttgaagggaaggaaagggcagagtcggaaaggaagtgtccacccaatgctgtgcggtgtggtgtga

SEQ ID NO: 755 - DNA, 636 bp, Chlorella protothecoides
  modified_base (475)..(539): a, c, t, g, unknown or other
gagggcgccgacgtggagcgccagctgggcgcgctgcagctgagcctggaggccaaggagcgtgcggcgctggcgctggccgggcacgccgcgctgcgcgacgcgctctcctcccagctggcggggctggccgcggagcgcgacggcctggcgcgcgagcgcgcggtgctgctggccgagctggagaggctggcgcatgcgggggaggaggagcgcgcgcgcctggcggacgactacaggcgccggctggcggcgctggaccgccagctggcggcgctgcgccagaaagagcgccgcgtgcgggagctggagcgcctcaaggcgcgggcggaggagacgtgtgcgcggctggagcgcgacatcgccgggatcaagaccgccaaggccgcgctgcagcgccggggggaggccgcggcgcgggagcacctggagtggcagcgcgcgcgggagcgcgaggtggcgacgctgcgcaagnnnnnnnnnnnnnnnnnnnnnnnnnnnnnnnnnnnnnnnnnnnnnnnnnnnnnnnnnnnnnnnnngcccagcctgcaccgcctgcaggcgctaagcgccaagcagcaggccgtgctgcggcgcaagacggaggaggcggaggccgcgcggcgcaggctcaag

SEQ ID NO: 756 - DNA, 1413 bp, Chlorella protothecoides
atgggtgatgtaatcaggaacaacaggatgtgcgacgacctgggcgacgagatccccgcagtgatcggccctgggcttgtgtcgaggatggatcactttgtgcccaccgcagcatgcccctcacacagcccgtcatctcgaccgagctttatctccatcccaccacggcaatgcctccagcggccacgcacagaccgcgcaacggtagttttatattctttttggagcaaactataccgccatgcagctggtatcttcgttcaccgggcggggcttcatcttcggcgtggcgccatccccgccccggctccaggcctctcgccaggtcacatgcatggccaagaagaagggcacccgcatcattgtcactctagagtgcacagaagctcggggagagggcaagacgccctcccggtacaccacgcaaaaggttcgaagggggctctggggtggcgtgggggaatacaagccagtcaggctcaatgtgcccggtcaagtcttgcgcgggtaaacatgctgagcagtagtctcgcaccctcttcccggcagaataagcgcaacacccccgagcggctggagatcatgaagtacaaccggttcctgcggcggcacacccttcacaaagaggggggggaggaaaaggtgagaggactacaaggttggtgcgtcacgcacagggttggtatctggagttgccaagtcgtgcgatgtctgcttccacgtgctctgcctccagaaattggcccagcgatcaagaaggggtgtgatgaaagggtggccatgtgggaacgcagggggagggaggagcatccggtccgcagtcgtcctccacgccggcgggcagcacggccacggctcatcgacgccccgcgctggagtgggcctccctcgctcctctccccatcgccgcccccacccgccgcacacgccccgctcgccccaaaccatccaccttcaaacgcccttctgcttgaggatgagcttgtcgcccagggacagcgcgatgccctgggtcttggaccggatgcggacgaagccggcgaggcgaccgtccgcgccccgctccagcgcgacgttgaccagcgcgtcctcaccaaacacggagcgcgcgtacaggtttgcggccaggaacccggcgtcgccgcgccgcgcggaggccggggtcaggcaccgcatgttggtggcggccaacacgtggtccaggtaggccgcctcgtcggtgagggaggtggccaccgccaccttgttctcccactcgaactcggcccacatggcgcggaaggccgcgtcggtgcaggccgccggcacgatgtagtcgaggatgtcgatgtggatgtcgttcagcaccaccacgctggggtggggcatggagtgggtcgtgatggtcgatggaggggaagagggcgccactga

SEQ ID NO: 757 - DNA, 903 bp, Chlorella protothecoides
atgtacctgctggcacggcgcatcaaggccctgggcatcaaggtcgtcctctccggcgagggcgccgacgaggtcttcggcggctacctctacttccacaaggcccccaacccggccgagttccaggcggagacggtgcgcctgctgtgccgcctgcaccagtgggacgtgctgcgcgccaacaaggcgcccttctcctttggcgtggagacgcgcgtgcccttcctggacaagcgcctcctggaggtggccatggagctcgaccccagcgccaagatgtgcgacctggcggaccgccccgacggcgttcacccgcgcttggagaagtatgtcctgcgcaaggcctttgacacgccggaccgcccctacctccctgacgccgtgctgttccggcagaaggagcagttctccgacggcgttggctacgactgggtggacgggctgaagggccatgccgaggccgtggtctccaacgctgactgggctgcgcgacacaagcgcttcccggagcacacgccgcgcagccgggagtactacctcctccgcaccatcttcgaccgccacttcacccacccctctgcctttgacaccgtacccaaggggtgtacaacacatggggaggataggagggtacatgagtgccctgctgcctcgccccagcaggccaggccagtgccgtccctgccccatcctgatcctcatcaaggatgctccaccctatcccccgcccataccacgcaggggctgagcatcgcgtgctccacgcccgaggccctggcctgggaccccagctgggagaactcgcacgagatcagcgggcgcgccatcacccacgtccatgccgccgggcacggcttcacctaccagaagccggaggtggtcaacggcttcatccacggatga

SEQ ID NO: 758 - DNA, 783 bp, Chlorella protothecoides
atgaggaagggcccggtaggttgcgccttccagggcttgcagccccggggcttggcgcccgtttccaaagacccgccgcgtcctggtaagccagaccaggctcgccttctcaccccccagcacacacgatcacctgacggcaacggaggcgacgagggaggagtcaagcccgccggagaggaggatgcccaggggcgcgtcggacatcaggcgcttcaccacggcatcggtgaaggtctggcgcaggaggtcgaggtccacgggggcgctgggcacgcggccctcctccatccaccgcgggttgtagtatcgctccagcttcccggcacacccctgtgcagggggatcagggcatgtggaggctggagcaggacccctcacctcccaaggtacactcgccgcccgcccaccaccctccccaaccacctctcagctcaccggggggaagatgtccagggtttcgaggtgctgcagggccttcatctccgaggcggcccagatggagccgtccttgtccttgccccagtacagggagcagatgcccagggggtcccgcgcgatggtgaactcgcaggtggcctcgtcccacaccacgcatgcgaagatgccgtccagcgagttccacagctcgttggtgtcgccatgggcctgcaccaggtacccgatgatggcggagtcggactgggaggggatgtggacgccaggcagctgctccgccaccacctgctggaagttgtagatctcgctgttcctgcaggcgtgcagggagatggtggggcgtga

SEQ ID NO: 759 - DNA, 1338 bp, Chlorella protothecoides
atgcagtcaggctgctcttctggctttgcgactctcatccccccccccctcaacccaccacgtaccccgacagggaggcaacggggcgctacatggagtcaggctgatcttctggctttgcgactctcatcccccactccctcaacccaccacgcaccccgacagggaggcaacggggcgtacgggctgaagctggacgagcggctgcgcatcactgacagcatcaagctgcgtgccgccgtgggcaggctgctcaccaagatgggcacccactacgagcccggcacggcggtggcggccgacctgaagctgcgcaacccggccgacgacagcgcacgggtgtgtggagggaggggaagggggccagagaagaggggggaaagggactcgtccttgcctcatgcgcatcacacagcaaggaatgtggctggcgcctccctcccttcgtggaggaaagtcatgcatgctgggaacgaccacagtttttgttcaggtgtctgtgccccttcttgcatcagtgactcactgggacgcacccaacacatcacacagctgctcctgggcggctccgcccagtggcagggccgcgacaagcgcgccgccaagcagtccctggtcatgggcgggaacatcgcgggcgaggtgcggctgcccaagatggacgggacggggatgaagtccgacacccaggtctccgccaatgcgcagtacaccacccggggccaaggtaccctggccctgcgcatcaactcgcacgacgtgccccagctggcggcgatcatgctcgtccccgtcctgcgggccgcctgggacaagtgctttgcgcgggaggtacagcggccagcccctgtcgcttggtcaccccttgagcgttcaggcccgctgcaatgcaccatacccatgccagtctgggccgcccctgttggaactcccttgttgctgcacgagctaaatccttctcctgccgtgcgccggaccttccttcctcgcaccgaagtcgtcgaggacggatgccagcgcaggtcaaccagcccaagtgaccacagaggtcttggttggggcagagtgcgaggaaagtcgtgcgaccgcgatggctgctccatgttggagttcccatttcaggagaacggtgaatggcaatcatacctaccaccgctgtgcctcatccttccgtatcgctgtgccattcaatgttacaagcttatattagttgacttacagcacgaaaactactgtaggcaagttctgcgcggtcgttggagtgcagagcagcaaggtgatcgcaagagtcggggtgcgctgaggaggggaactgttccagtctcaggagccccctaa

SEQ ID NO: 760 - DNA, 1542 bp, Chlorella protothecoides
  modified_base (569)..(578): a, c, t, g, unknown or other
atggagctccccactgcgtcaatcgacggactggggtcgaaccgcgcgcgccttttctcatgtgtttgggctgatgggcattccgagggtgatctttgccccgaggctcctctagcgctcctcccagggcccaacttcacctaccatcatggtcagccaggacctcgtactggatcgggatgtccgggactgggtgctgatccccctgaccgtcagtgtgatcctcatgaagctcctgcagcagtacgcagtgaagctcatggccgcacccaagcccagcgagccaccaaagccggaggacgtgcagcagaagaacactctggcccgcagcggcctcctccgtgccaaccacggcttcatctcggaggcgggattccgccagcgccgagcttatttttctggcaaggtgtgggaatatgtgctgcgggaacagcgtccaggaagacaggatgtggattcagagacactcatcgctctggagtgctcagtgtgtgcgccacccatctggggtccaccaaccaagcagtgccctactcgccacaggagggggtcctgcagcaaaccttccnnnnnnnnnntgccacccatctggggtccatcaaccacgctgtgccctactcgtcacaggagggggtcctgcagcaaaccttccccgccaagggtctgaacgacatgatggggaatccagacgctatgcaaggcatgctcaagcagcagatggggggccttgtgccacaggtgggttttgagaatgctttctgttgttcctggctacttcatggaggggcatgctgccaggggcagctccttggatgcatactgctcctcgatgcgtggagtgccctgcctcagaccagagcaggcggccgatgtcttgacctcacctgcaagtgcctgcttgccagatgcgccggtcccattctccctttctcccaagttccggcccatgcttcagcgcggcatcgacctgcccgccctggacccctcctacttcacctccctgtccttctacatcatggccctgttcgggctggggggcgtgttccgcctcatgtttgcggaggacgcgatcaacgacgccgcgcagatggcccagatgcagatgggcgggatgggcggcggcggcccgcccaccctggacccggccaaggcttacgaggccgagcggcaagcgctggacgtggtgaggatcctgggggcgagggaccaggggagaggggacaggatacttgtgtgtgtgcacgctggcctacagtggttgggtgcttccattgtatactgcggctatcaccaggatcaagtgttcaaccctggcgccacatttcaccaagcgctgcctgtatgcaacacctccaaacgcaaagaagatggggagggaaggaattgctcgactgcagaaaggcacctgagagacctcggagcctcccctgtcagtatatctcgatttgcccctgctcaatgatgctttcaacaactattttagccttgcagcagcctagtcaatgtaatcgttgtccaccacagagaacagatgctgggtga

SEQ ID NO: 761 - DNA, 3225 bp, Chlorella protothecoides
  modified_base (81)..(144): a, c, t, g, unknown or other
  modified_base (780)..(789): a, c, t, g, unknown or other
  modified_base (2417)..(2426): a, c, t, g, unknown or other
  modified_base (3097)..(3106): a, c, t, g, unknown or other
gccgccgcggcgcgcgccgccgacgtcagcgggtatcccgcgggcacgcaccccgcgaccctggacgccgcgctttctgcnnnnnnnnnnnnnnnnnnnnnnnnnnnnnnnnnnnnnnnnnnnnnnnnnnnnnnnnnnnnnnnnggctgggacgctggcggcgggccccggcgcgccgtcgcccctcacctgggtgcggcgtgtggagacgctgctggcgcgcagcgagccgggcgccctgctctcctccacggcgccggccgcggagtgcgcgctgctgggtacctacgcgccgctggacgcctgggcgtccgggggcgccagcctgcgcacccccggcgcggccatgagcctgttcggggtggtgctgggcgagcacgacctgccacccacctccccggggcctacccaggtcgcagccgccgcgctgttgggcgaggagggcgaggaggcgggcggcagccctggcgctggcgaggaggaggaggcggcagtggggctggctgctggccaccccctgcttgccatgtcggaagaagagcggatgctgcacctccaagcccaggtgagaatgttgaggggagtgggcaagagccactcctaggtcatgggggaggtcaggcagatgctgggccacactgtgcacccggacgagccgctgatggtggcgggcctggattcacgtggtggcatggagctcaggaggtccctggcggacgccatcggtctgcaggtgaggagcggtgtgtgtgtctgcactgtgctggtgtctttgcatannnnnnnnnncggtctgcaggtgaggagcggtgtgtgtgtatgtgtactgtgctggtgtctttgcatggtcccatgccccacagcattccctccatcctgacacgacctcttccctctgtactccattcgcctcatccagagacacatctgcacacaaagacacccctcccaaacaaccccgacgcagttgcctgtgacgctgctgtacgactaccagtccatcaacgccatcgtggactacctcaacacggcggtgtccaccgcccccgaggaggccccggaggagggctccagcgtggacagcgaggaggagggccggggctccgccgggtcgggcagcccccgcgggccgccccgcgccgcgccgcccaagcgcggcggcgcgggggccggcgccgctgccgccgagaagccgtcggacctgctcaagctcctgcgcggcccgcccgcgcagcgcccgctcttcctggccgcgcccggcgtggccaacgcgcaggccgcctacttctccttctcgcagtacctggcctggagcacccagcccatctacgtgctggacaaggacaacgacctcaccgtggccgacctggcgcggcgcaacgccgccgacatcgtgcgcgtgcagcccgaggggccctacctgctgggcgggcactcctacggcggctgcgtggccatggagatcgccatggtgctggagagctggggcctggaggtcggcctcgtcctggtgggtgtcggaaggggcataggggtggatttgggaagtggtggattggtgtcccttgggaagggggcggattggtctgcattgaagtgtcggattggtctggatggacgtggcgggttggtctgccagggtcaggccggattggtctgcaggcatcactgggatgtgatggacacgcccatgcggcagcagatccgggccgcgcagcccgacgtccctgtcgccactcaggaggacacgctggagctggtggagatgatcctgggcgcgcttgggcaggacgcggtgggcatcggcgcctccatggcgcacccgcgcgagagcgagcagtggaagggcatggacttcgaccagaagatcgagttcttcgcgcccatctggcgcgtcatgcgcgacgcgccgctctcggtggaggaagtcaaggagcaggtgcagcacgtggccctggtcaccaagcaggccagcaacatctccgacctgcgccaccactaccacatggcgccgcgcaccaaggcacccctggtctacttccgggccaaggaccgcggcatgtgcacctacatggacgacgggcggctgggcgcccacccgcacggcctctgctggtacgacctgtgcgaggacatcgaggtgatcgacctgcccggcgaccacttctccgtcctgcgccaggacgaccgcgacatgaacctgatcgtcacggcgctcaaagtcaagctggcgcccttcggctggaccgagatcctgaaccgcggcgggcgcagggccgctgcgtccagcctggacatccccgacatcgacgcctacctgcagaagatgggggtgaaggaccccgccctgcgcaagcgcgtggaggcccagctccctggcctggacgaggaggcggtgacggcggccatggaggctnnnnnnnnnncctgcgcaagcgcgtggaggcccagctccccggtctggatgaggaggcggtgacggcggccatggaggccgtggccgccgagcacgaggtcgcgccgctgaacgcgggcgcgcgcgcgctgacgctgaccgacggcgcctggggcgccgcgcccgtgctcgtggtctgcgccgacgccaacggcggcaccgccgggctggagcccgtgctggccgcgctggagatgccggccttcgtggtcaagctgccgcaggacagcgcgctgctggagtcgccaagcgtgcccgagctggcgcgcctgtgcaccaaggccctgcgcgcccacgtccccgcctcgcgccgcctggtgctggcgggggtcggcttcggcgcggtggtcgcgcacgagctggcgctgcaggcggccgccgcatcggaccgcgtgctgggcctggtgctgctggagggccggcaggcggtgcgcgcctcggccctggcctggctgccgcccgcgcgcgccgcggaggtgggccaggtcgccagcctgctgtaccccaccgtgcaggccgccgccgaggagggcggcgcggcggggggggcgccgggggtggaggcctttgccacgcgcctgggctcaatccagggctttgacggccagctggactacatcgcactcttccggccacaccatnnnnnnnnnnggagggcggcgcggcggggggggcgccgggtgtggaggcctttgccacgcgcctgggctccatccagggctttgacgggcagctggactacatcgcactgttccggccacaccacgtga

SEQ ID NO: 762 - DNA, 1368 bp, Chlorella protothecoides
atgatccctcccccctaccccaacccctcccctctgggcacacaggagaagaccaaggactgggacgagcgcatcaacgccctgctctcccgcctggcctacttctcgtccatctgcgccgagtaccgcccctcggacgtgttcctgggccagaccctggcggtgacctgcggggcccccgcgcccatcggcaccgtgcacgccgcctgggagagcatcgccttcctggtgcagccgctggagagcgcgagcctgggcgccggcgcccgctccggcgtgtcccccggcaccgccctggccaccgagctgcagggcctgctgtgggacgtggtgcgccgcgcggaggagcgcgcggcgcaggcctcggagacggcgcagacgccgtcggcctccaccgcgcgcgtgtcgcgccgcatctccgtcggcgcggccagcgaggcgctgccgggcggggacgggccggtggacacgtacaccttggtcctcccactcaaccgcctctgccccgagcggcgctacatcctgcgccgcgccacggcgctgcacagcgggacgcccgccgcgctggccgccgcgccgctgacccgcatcccgctctgggtgctgcacggcgagcgcggcgacctgagctccgcgcagaaggagctggcggcgctgctccccctccccgtctacggcctggccatgggcccagacgccgacgcctgcgccacgctggccgagctggccgcgcggtacgcggccgcgctgcgcgtgctgcagcccgcggggccctacctcctcctcggctccagcgtcggcggcgtgctgctcgcgcacgcgctggcctgcgcgctgcgcgccgagggcgccgctgtggccttggtgctcgtcgacggctgcgtcggcgcgcccgccctccccctgcacgacgtctcctggtatgcgctcttctacctcctgcgcgagatcgggggcctgcgcggatccatgggcgagttcgtggatgtggtgcgcggcgccgggtcccccgccgcgcagctcaagctgctcaacagcttccggccgcccgagctggccgacgcggaggaggcctgggacgcggcggtgtacaccaccctggaccgcgcaggactgctcaagcgactgtcgcgcgggcccgccgcgacgccgcccggcgtcttcgacgggccggtggccacgctgctgccggaggaccgcatcggggcgctgttcctggccgccaccacgccgcactgcgacgtggaccgcgtgctcagcctgggcctgacatcgcggcacaccgagtgcctgctgacggaccgggcgaggcgcgagactgccgccgccgtcgtggcggcgctcaagagcctgctgccccagctttag

SEQ ID NO: 763 - DNA, 363 bp, Chlorella protothecoides
atgttcgtcctgtgcacattggaggacaaagtgcgactagcacccaaggatctccgcctggacacagcagatgcggtcactgccgtcctcgagaagacgtacctcgaccgcgtcatcccagacctgggcctggtggtgacgctgtacgacctactggagattggcgatggctacgtgttccagtcagatgggggagtgcaccacgataccaccttccgtgtcgtcgccttccgcccgtcccaagaagaagtgctggtgggagaggtgatctcccaggacgagaggtggggtcgcttggcgtggggtttgtgtgaggtgtaccgattgtgcacttacatggccgcttccccccatcgttggtga

SEQ ID NO: 764 - DNA, 603 bp, Chlorella protothecoides
gtggcggcgcggccgacgaggccgcgctgcgcgaggcggaggaggccgaggcggcgggcgagccgctggactttggtgccgtggtcctggtcatcggcctgcgtggcacgggcaagagcgccaccatcgacagcctgctgggccggtcgggtgatggtggtgccggcgccggcggcgcagcggcctccggcggcggctacgtgcccaccaggcgcgtgagcctggagcgcggggaggtggcgggcctgcgcctgaccttcatcgacacgcccgggctggaggccagcgcgggcgcggcgtcgcgcaacgccgccaccctgcgcgccattcgtcgcgcgttcgacgcgcacaagccgcacgccgtgctctacgtcgacaggctggacgcctcgcgccgcgacgcctcggagctgcatgccctgcacgccgtgtccgacacgctgggcgccgacgcctggttctccacgctgctctgcgtgacccacgccctggccccgccgcccgacggcgcctcgggccagcccctgggccaggacgcctacctgcagaaccgccagcagcagctggtccaggtcatgcgcgccgtggcgggggacagcaggt

SEQ ID NO: 765 - DNA, 906 bp, Chlorella protothecoides
atgatgaaccccgtggcgctggtggagaactcgcccgcctgcgcgcgtggcgcgggcggcgagcccgtgctgcccaacggcgtggcctggcgccgccacctgctcatgctctgcgccaccacgcgcgtgctgaacgaggccagcaccctgctcaagcccgggcggggggccaaatcccccccgggcggcgcacgggcccctcccggctttggcggcggctccatgaaggtcccgcccatggcctggctgctggccaagctggtggagttccgcgcgccgcgcaagttccccgaggacgagcgcgagctgatgcgcgacgacgagatcgcggggctgccacccgcgcagcgcgagttccagctgcgccggcgccgcgtctacctgcgccagcgcgccgacgaggcacggggcgaggagaacgcggtgcccatcctggcccccgagcccgcactggggccctccttcgaccccgaggtgaacaaccaccgctaccgcgtgctggagagccccaaggccctgctcacgcgccccgtcatcggcgagggcggcgtggaccacgaggacggcatcgactcggtgcaggtggagaagtcggccatcctgcgcaagcgcacccagttcctggggggggtgcccaccctgtcctgggtccaggtgcagaaggacaagaacagcctgaccttccaaggcgagtcggacgccgcgctgtaccactccacctactgggtcagctacgcctcggtcaatgcgcagtcgctccagcgcgacgtgctctacaccggccggttggagagccgggtgcgcagcaagggcaagcgccagaagttcaccgtcggcctgctggccagcaagctgggcgaggacttcaccctgccgcccatcaaggtaggggtatgtgttgcttga

SEQ ID NO: 766 - DNA, 1215 bp, Chlorella protothecoides
  modified_base (421)..(476): a, c, t, g, unknown or other
atgggttttcaccctcatcctcctcatcccacctaccaacctgccaccactcgatgcagggagttcctggaccctgccgcagtctctcagttcaacgtggagggcaccctggagttctccggcctgctatacatcccaggtggggccaggagatgtagcccgtggctgacgcggtgcatcgagcctgacaaggctcgatgcaccagctgttctttgccagcaggggctgagctccgatctccaatccttttcccccgagggtgttcatctccggtgcgtggatgggttcagcctggggtggatgacttctgcaggaaggcagcctggagagcggcgtgtgcatgccatcgactgctgacagggggagttatcgcagtccctcccaaaaaagacacctccctcctcaaccagcccccccccnnnnnnnnnnnnnnnnnnnnnnnnnnnnnnnnnnnnnnnnnnnnnnnnnnnnnnnnagacgagtttgacgaggacctgctgccgcgctgggcgggcttcgtcaagggcgtggtggactcctcagacctgcccctcaacatctcgcgtgagatccttcaggagaaccgcatcgtgcgcgccatccgcaagcagctcgtcaagcgcacgctcgacatgctcaacgggcttgccgagaaggaggacaaggaggtggggtggggcaggggggttggtaggctgcgtggacaagggacagtgctcgacctgggatgccttggcaaagctgctgcggtgagaggggacagtgaggtcgattggagggaaagtgcgaacaggccagctcgctggtctgagctgcaagggagtgaaggtcgtccagaggcggtgaagtggcctcgctgtcggttcctggacccgccaatcaccgattccgtgcgcgagcggccccccccccccccccccccaatcaggttcaagtcttccaacagcgaggaggggctcacctccattgcagactacgtctccaggatgaaggagggccagaagaacatctacttcctcattggtgagctaggatgtgtggaagggtgggatgctgatggaagacttgccctagccttgcttgtgaatatgctgggaagtgtcaggttcccgatgtgctccacccaaccggcatgcatggtgcttgggcatccacctcagcaatgtgtctccatctccccaatccctccccctccttgcagcttccagccctga

SEQ ID NO: 767 - DNA, 585 bp, Chlorella protothecoides
atgcagagtattcaccaggcaaaggaggaagagctgcgatgggactgtggcactcccagatgggagcagggaaggcacctcctcatcacctgcacaacctgtggctcgccgtggttactaactcagtgcgctgccgtgccacaggagtttgagggaaagacattcaccgatgtgacccgcgaggatctggagattgacgagagcgaggaggggaagaaggagagcgccgacgtcgaggccgagctcaaggacttgacctcttacgtcaagaaggtgatggggcgcagggtcgctggctggcatcgcaggcatgggcagctaccaagcgcctgtcctgggcgacaaggtggagaaggtggtgccctccaagcgcctcaccgactcccccgccatcgtcgtgctctccaagtttggctggtccaccaacatggagcggatcgcacgcgcacaggtgagccgccacaccctctgttgtgtggtgatgacgtcttgggagccagggcggcggcggcgcctgtggccgcagagcggaccgcaagcttgtactcctgcgccagaccccctgcacaggcctcgcaggactga

SEQ ID NO: 768 - DNA, 399 bp, Chlorella protothecoides
atgggcgatgcgcagcaggcagagtacatgcgcggacggcggatcctggagatcaaccccaatcaccccatcatccagtcgctgaaggagaaggattctcgtggacctggcgaccttgatatgattcacccaatcacaggtggcacagcccatgttcaccctcccttcccacctttggcaggctgcgttggggtgatctactatgccaggggaactcatctatccatcagatcccatcactcatgtctggctcgagctcacccccccaccccccgcatggccctggttctcccaggcggctatgacatcgactcgcccaaggactttgcggaccggatctacagcatgctggctggcaaggccggaacagcgcagaaagtggaggccgaggttgtctga

SEQ ID NO: 769 - DNA, 702 bp, Chlorella protothecoides
atgggcaagaattgttccccactgcacctctgcaggggaatcgtggggtgcttggtggcggactggctgagttcctgctcacgatctgtatccccgcccctcacccaggagttcaaccccgactgccacctggtgaagcttggcaccatgggcgaatatggtacccccaacatcgacatcggtaagtgtgtttggctggacaggggagaaggggtctggcaggcggcgggtacaagtaatgctgctatgcacccacccttggctgcaggacattggtggaagcattctgtgctctgcagtggccgctggtggtctgatggcgtggtcttatctccatcccagtctctcaaatgccccccctcgtgccctgcagaggagggcttcctcaccgtcacccacaacggccggacagacacgctgccttacccaaagcaggtgggtgaaaaagaggaagaccagtgctgggagtgtccagtgagaggttggcacggcacggccggccattccgacctgtacgctgcatcccaagcccagggccctcggtgcctcatcagcgccttggccccctcgaccctcctgccgcagggaggctccttctaccacctgtccaaagtgcacgactcccacaacatccattttgccaccaaggcctggaagctggcagccacagacctcaaccaggcgagttggtgcaggcgatga

SEQ ID NO: 770 - DNA, 621 bp, Chlorella protothecoides
atgggtccagaatctgagtacgctgggagggctgaccagctcccacatgggaccgtggatggccctggtgatcagccgcattgctgctcccccccacctccctcaccacctcctccaacaggcggcgacgggtactgcggttgggccacggcactgcacctgtcggcgcgcggctacagtgtgtgcattgtcgacaacctggtgcgccgtacctacgacctgcagctgggactggacacgctgacgcccatcgcctccatccacgaccgcgtgaggaagtgggcggaggtgtctggcaagcacatcgacctgcaggtcggggacctctgtgactttgagttcttctccgagaccttcaaggtgctggttttgtcgtgtgagggggatggttggcaatcgctgtgccctgccctctcctgtgtccacctgtacaacaacaagcactttgcccctcaaaatccgcagtccttcaaccccgaggccgtggtgcactttggcgagcagcgctccgcgccctactccatgattgaccgccagcatgcggtgtacacccagcacaacaacgtgatcggcaccatcaacctgatgtatgccatcaaggtgcggcctgggtgggagtga

SEQ ID NO: 771 - DNA, 1695 bp, Chlorella protothecoides
atggtcgaggggagggaaggagggcctgggccgcgcggcaggccaggatgcaaaggtcagcatggctgggccgtctggaattgtgcatgctcgtctgacatctcctggtggcattccagggcccctggaggaatccttcgagccgcaagcttcctggtgaccaccccatcttccccccttgattccaaaccctcgccatcacccggccacgcagattgccacgacccggtggaggacgcgcgtgctgcgctggacctggccctgctcaagttctcgcgcggcccagacttcggcctgcccgcgtccccggacgcgcgccgggcgcggctggccgacgcgctgcacgctgcaggcagggcctgcacctttgtggacgcgggcgccagcctgaggcagttcatgggcgccgctggcgccggcgtcgacgccagcgacgacggcgaggcggcgcggcggctggcgcgcgaggcgggcaagcccggcgtgccgcactttcttttcggccagctgcgtgggctgcacgcgtcgcaggtcgccgcggcacgccgcgcagcgggcgacgcccggggcggggactgcgcacgtgccctacgcctgcgcctgcgccgcgttggggaggggtgggtgggcgatgcgccggaggcaacggcagacggtgggcaaggattcacggcagacggtgcgccggaggcggtggcagacggtgggcgaggagccgcggcagacggtgcaccggcgtcggcaacagagccggcaacagcggagtccgagccgccgtcactcgccgaagctccatcgccgctggcaccgcacgacgagcgcgccgcgctggagggcgtcgtacgcgccgtgcgcagcgtgcactccgcgctgatccccggcgcgttgctcctggtggtggcgccgcagggcaacacggctctgagcgccgcgctggtgggcgcgcggcgggaggcgcagcgcggggcgggggacgtggcggcctggacgccggagtccgaggagcgggcgtacaaggggacagcccgctgtaaaactgggcgccggcaccgtccgggacagtacagcatctggggccgcgggccctgcaagttccacacgtggccagttttgaaaaggggaatctggcgcgacgccctgatccggtgggacgcccaagcatcttgggcgacaaggcatagccctggtcggcccagggcagagtggacccagtctccaatcttaaccagtgcatcacacgatggcaagcctaaacgtcccaggtatggcgcgcaccggctcgtgcccgtgctcgtttgccggatcacatgctggaaagtccctgaattccgtcccccattcggcaggtgcctgcggcgtggtccggagcaatggcgcatctgcttctgtgagatcatgcgtccaaggtgggggtatgaagggtgggtgcgcgatgccgcccttgcctgctgcccactccccagcaccaacccggcatccaatccgcgtcctggtcctcccgcccctccgcagccccagggctgcgctccctgcagagtgccaaggcgacatttggctgccgcgtcgcgcagcgtggatttgggctgcgtgcagccgccccacgggctcgctgcccacagatctcggccatcgcggccgaggctccccccccctccaaggtccatgagggaaacggcgccggcacccgcgtcatga

SEQ ID NO: 772 - DNA, 831 bp, Chlorella protothecoides
atgcaacccctgcttcccaggctgactgcgctgcagaaccaggacgagtacaagtctggggctgacctggagatcaggatcaaggtcgacaaggaggctggcaccctcaccatcgagtgcgttgggaacctggtgggggtggaggggaggccaggtgttatcgcatcgtgcccctccccttttggcacgatgtctcacagctggatttctcacagctggatgcactgtccccttgcgccttcgttccctcccaaagtcctcttcaactaccccaccccatgcagggactccggcattggcatgacccgcgaggagctgctgtcgtccctgggaaccatcgcccgctccgggaccaagaagttcatggaggcgatgcaggacaagcaggacgccaacctgattggccaggtacgacaggaggccaacggtggcgagggtctcgcatccgccccgccgcacgtcgccgtgcagtttggcgtcggcttctactcggccttcctggtggccgacaaggtgaccgtgcagaccaagagcaacgccagcgaggaccagtggacctgggagggcgctgccggcgcccacagctacaaggtccgtagggacgctgaggtggacttgaagagggggacgcggatcacgcttcacctgaaggaggacgccaaggagtttgcggatgccgccaagatcgaaggtcaggaggtgatgggccagacagggtgcgaatggtcgggtgtggccccctgtggtgtgctacctcggtcgagacaaggctgttcttgtgcaaacgagtcgtgcactgcactgcctcgaggtgccaaagggcagggatga

SEQ ID NO: 773 - DNA, 435 bp, Chlorella protothecoides
atgttgcattcgatcgttcgtgcaagcagtgggaggcctgaagatttccattccgctcctgccccccaggcctccccccgcctggcgggagcccagtgctgccgggtacgcccctccgctgcccttcccgcccccttttccagcctggtggctggaccctcccgatcccgggcatgcggtgcggttctgggccggtccttgcaccagggcgtgggagtgagggccgcagccacaccctctgctgttgagcctgccgaggagaccttctcctaccagaccgagacggaccggatcatggacatgatcgttaactccctctactccaaccgcgacgtgtttgtgcgtgagctggtgtccaacgcctcggacgccctggacaagatgaggtgcgccccggtgtggcgctgtgtgccgcctgggcctgatgatcgatga

SEQ ID NO: 774 - DNA, 690 bp, Chlorella protothecoides
atgccgtatgcgggcgcaagtacacaagaaatgatgattacatatgactaccatatgagatcgcgaataccgagcacttacacgtcaatggacactcgcaccgtgctggccttctcagccggaacctgcataggtgcaggggcgtgctggtgggcggtacggcatggtctaccgagcaagcgcactacagagtatggtagtggatgcaggccaccactgccgcctcttccgcaccccggtgagggtcccttcgatttctccaagttcgaggaggacgaggtggtggctgagcacctcaccaggaatgtccagttcttcggcctgccctcccagaagcgaatagccgagtcctttgtcgtggtcgtgggtcttggagtgagtgattatcaggatgtggtggggggctgtctaatccagggcggagggaaggggctggtgagggatgccatgcatccctggaccacctggctgagcactgcttcttcaggcagtcagtgccgtgaagcccggggagtgattatggcacctgtgcgggcggccagagtctgcatcctttacgatctaataaccctcatccccgctctcttttcgtgcagggagtgggcagccatgcagcacaccttctgctccgctccggggtgggccgtctacgcctcgttgactttgaccaggtgtcgctttcgtccctga

SEQ ID NO: 775 - DNA, 1386 bp, Chlorella protothecoides
atgatctcattcaccggtggagtgatattggagagctcccgcaataatgccctccgagcgcggaccttccgtgagcgtccccagggctcttcaggtgcggttctcccttcttacgtgaagctttccgacgcaatccatacacacatcggattggtgctgccctctgctcatcggaccgaggctgcggtgaccccttgccccctcgaggaagttcccagtcccgcacaataaatcgtgggatggtgctggaccggggtgcctgcacctccatcacactggtttacaaaccttgttcataccacgcaggcgccctcccccacccctgtcttcgggtcatcttccacattcgggacggggaccggctttggtggattcacgggagtgaaggcgggggaggcgaccaccggtgatcaggagggtgacgacggcgaggaggccggcgaggaggactgctctgccgagttcaagcccatcgtgcagctagatgaggtggaggttagcacaggagaggaggacgagaccgctctcttcgacgccaagtccaagctgtaccgcttcgatgccgacgccaacgagtggaaggagcggggtattggccaggctcgcgtgctgcagcacaaagccaaccagcgcatccggttcctgttcaggcaggagaagacgctgaaggtgcgcagcaaccacatcatcatgcccgggaccaaggtccaggagcacaccgggagcgagaagtccatggtctggtcctgtgtcgactttgccagcgaggagcagcgaatggagctgttctgcatacgctttgcctcagcggagcgggcgcaggagttcaaggctgcctatgataaggctgccgaggacatgggggccctgcttggggacgccccacaggtgcgcggggcggatggctggacgccaaatccccacgactctcccaagaatctctcgcgcatgccagtgggccctcttgggccgggagcgttgagggcctgcgcatttggttttgggggggaaggggggaggagtggcccacacgctagggccacactccgtcaacaacgcctgtcctgccgctgcatccccctccacctgcataatgttggcaggagccgactccctgtccactggcccctccaccacaggcggaggagggtgcggaggaggcggagccctccgaggctgacaagctggccgccgagccgggcagggcgtgtggggcggttgggggcgcgcgtgcagcagcttatgttgggatacaagtggcgtagagcggcgaatcttgggagcgcgggtcccgtgcgcgctcgtagcaatcctctgagccgcgtgggcaggctccgagaccgccccggatggaggctgggagagatgctgcgcccgcctggatga

SEQ ID NO: 776 - DNA, 1647 bp, Chlorella protothecoides
  modified_base (44)..(53): a, c, t, g, unknown or other
  modified_base (468)..(477): a, c, t, g, unknown or other
  modified_base (864)..(873): a, c, t, g, unknown or other
  modified_base (984)..(1141): a, c, t, g, unknown or other
  modified_base (1324)..(1333): a, c, t, g, unknown or other
atgccatcgttcctcagggacaccacgcacgtgatcgtggccannnnnnnnnnccggcgtgtgcccgtcccacccctcacatacccccctcccctccctacaccccttcccatgccatcattcgtcagggacaccacgcacgtgatcgtggccaccgatgcccgtggcgtggtggcgacacgggtgatgaagctttgtcaggcgctggcggtggggtgctggatcctggcgccggcgtggctggaggcctgcatggaggcgggggcctgggtgcccgagcaggcattcgaggtcaaggcgagtgcccgcatcagagtccatgctgttgctggaaaggggtggctgcgccaagacatggtacaccttcttttggttcgccacaccactcccccggcccccctcccaacaccaccaccaccaccacccgccttgcgacgtgatctaccctacgctgcacacagggggatnnnnnnnnnnaaaaggggtggctgcgccaagacatggtgcaccttgctttgggcacgcaagcgtgcggacaggggctgccccggcctgtttgcggggcgcaccttccgcatcgtcggcaaaggtggtgtgaagggggtgggcaggcacagcgctcctcaccctgcacccatgccgccgggaagagcccctatcccggggccccgtccaaacaaaggcgtcctccagaggcctcactcatggactctcttgcctccccaccccccgagcgcaggtcctttgcatgctgccgggctgaccaaggccatagagctagcgggagggtccatcgtcacccgcagcctccccggggcgtgcctcgtctcgctccagaacgacctggagttcctcagcaaagcnnnnnnnnnngccccgcacccatgccgccggggagagcccctatccctgggccccgcccaaacaagagcgtcctccagaggcctcactcgtggactctcttgcctccccaccccccgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggtgtgcggtgccgggatggcgcggcgatgacgctggccgccctgcgctcgcatgtcttgtacctctcgcgctgagctcctcctgtttcaacgccttggatgtccatgacgaggggcactctcgctgccgagagcccagcggcccaagtaccagccatgcccttcctcccctttcacagnnnnnnnnnnatgggtgtgcggcgctgggatggcgcggcgatgacgctggccgccatgcgctcgcatgtcttgtacctcttgcgctgggctcctcctgttttgacgccttggatctccatgacgaggggcgctctcgctgccaagagcccagcggctccaccaccagccatgcccttcctcccctttcacagaagtcgtggggcgtccagccggtgaccagcagctggatcctggaccatctttcgaggcaggaggagttagagccagtccagcaggacccacaggaaggtagcgccctgtccatcgatcccttgagcgtctga

SEQ ID NO: 777 - DNA, 588 bp, Chlorella protothecoides
atggcgccgctccgcggcgccgctccgcactgtgtcttcagggcgctgaggttacccccagagcacatggaaggcccgaacccaaagtccaccctccctgccaggatcggtacggggctgggtgcggcatggtccgtggcgccgctccgcggcgccgttccgcactgtgtcttgagggcgctgaggttacccccaggagcacttggaaggcccgaccccatagtccaccctccctgccaggtggaggccctggtgcgggagtactggcgcggccgcagcgcacggcaggcggtgggctccaacgacaagggcctggggcgcagcatcgggcacctggcgctgacgcgctgggacgcgggccgccccgcctcgcccggcaacctggtgctgctgacacaggaggaggccgacgcgcacgacgcgctggcacaagggagccagggcagcgtgcacgacgcgctggcacaagggagccagggcagcgtgcacgacgcgctggcgctgcaggcgctgcgggcgcgggagcccgccttctgcgcacgggtggaggccgtgctgggccgtgtgcgcgcacagtttgggtgctga

SEQ ID NO: 778 - DNA, 1866 bp, Chlorella protothecoides
  modified_base (1405)..(1414): a, c, t, g, unknown or other
atggctgcaaacggtgcagcgccccgacagaagcgacgaaaatgggacgttgaggaacctcaagcctcacaaccggtcgacgttgcgcgctccattcaggagagcgcagcggctgccgctcgcatcatcgctcagcaggtcgagactggtctcccatacgcttcttcctgccaggccttgaaccgcctggggccctccaatccagcgccgagcgcagggacccctgcacctagccctgaggcctctgccgctcacccatcggccagcttcaccgacatcagcatcaatgcaagtgagccccaccatcgggctcacctctccaagcgtagcaccctcgactcgatagagcagcggtggggcgtgagcgtggtagccaaggggcggtactacccgccgggtgtggtgccgcccacaggcagcgatccccccatctttctccgaatcgcccccggcacagaacttgccaagaaggtgcgtgatccatgcacagggggatggcgaatgtgttccatcccagagtccgtgccgcaggacagtacaggagacgtcgcatcccgcctgtctgcctgcgccgctgccgcggcagacatcgaggccctgctgcgcggaaagcctctccccggcgcccctcccacgctgccacactcctcccagccccatgtgtcaacggctcccttgccagcccaagacgcctcgccctatccgatatctggccccggcttccactgcttgtacctgggcatccccgcctcctgccccgcctcctgggacctggcgggtcgcgtgcgaggccccgacaacgcctacctgggtcacatcgccggcgcctgcgcctgcgtcgcggcgctgcgcggcgccggctccgccactgtgccggagacgcgcgagccgctgcacgtcttcctggcggcgggggacggggcggcgctggagaaggcgcgtgggctgactaccagcctgattgacaccgtgcgcgccgacttcgtcacggccttcccgggcctgccgcggccgccgggctcggggagttacctgccgcccctgcccccgccgccagtgccgatgccggtgtctgtgccgaccggggtggtgggtgggcctcctcggccccagcaaggccaccgcagagctgtgccgcccccgccgtatgggactgtgccgcccccgcagtatgccgcggtgccgcctccgccgtatgggactgggccgcctccgcagtatgacgcggtgccgcctccgcagtatgccgctgtgccgcctccgcagtacgcagctgtgccgcctccgcaatacgcagcggtgccgcccccgcaatacgcagcggtgccgcccccgcagtacgcagcggtgccgccgccgcagtacgccgtagggccgcctctacaccctgctgctgggccgcctnnnnnnnnnnctgtgccgcccccgccgtatgggactgtgctgcctccgcagtatgccgctgtgccgcccccgcaatacgcagcggtgccaccgccgcagtacgcagcggtgccgccgccgcagtacgcagcggtgccgccgccgcagtacgcagcggtgccgcctccacaccatgctgctgggccgcccgcaggtgccaacctgccacgctcacaccaacagacatcccagtgtgcatctgcgcacccgcctgtcgcttgcacggcccccccagctgtccgggatacacacctagacacggggcacatagctgcgcccgccgcccggaagcggaggttcagcgaggcacccgcgccagactcgagagcgcctcaggtgagagtggccggtggagtagggcaccgcgtgcaggactacgaggctccacaagtctggcatgctacaccattgcttgtcacatag

SEQ ID NO: 779 - DNA, 2043 bp, Chlorella protothecoides
  modified_base (361)..(459): a, c, t, g, unknown or other
  modified_base (1240)..(1249): a, c, t, g, unknown or other
  modified_base (1715)..(1724): a, c, t, g, unknown or other
atgcgcccctcccccgacgaggcgagggcggccacctacaacagcgcctgcgcgctgacggcgctcggccggtaccaggaggctctggcgcagctggagagcgcggtgacagtgcacgacctggccctgcgggtggcggagcgcgaccccgacctggcggccctgcgccttgcccccggctggcccgcgctgcgctcccgcctggaggccgcgcgcggcgcccagtccagcaccgcgctgcgggccgaggcgcgcagccccttccgtacgctgcgcctgctgggcctgggcggcgtgacgctgggcgccgggctgggcgccgcggtgctggcggcacgcctggcggggttcctggggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacctggcggtgacaggggtggccggcttcctgctggcccgggactgggcggcggggcgacgtggcgtggcacaggcggcgcgggaggaggcgctgggcgagctgcgcttccttcccccggcgcggggcgaggcgggcgtgccacgtgcgctgcgcacgctgcgcggcagccgccggcccctggtcctcgccgggcgccgcagcttcacggcggccgccctcgcctcggcgcggccgcacgccgccgcgctggcgcagcgtggcatctgcgtcctgccggtggtgctgcaggaggacagcgagacggcggagtggctggaggggctgaggcgggagtttgcggccgggaagggggccgcaggcggggaggggtttgccgcggggccctcgcccagggcgccggcgcagatgcacctttggatcaccagagcctccctcctcatcatgccacacacgcagagcgctccacgctggcagctggagcccgcagaccccgaccagtggaaggcgtgggccacggagagcgggctgctggggtccccttcggccccatccaccgcccccgagaccgggtacatcgtgctggacctggacggctgcatctcggggtctgggccggggcttcccgactggccagcgctgctggccgccacacccaccctcaagctcaaggagagtgcagcaaagaagaggggggcctgagggactcgaccttgtctggagatgtttgctctattttttcccttcgaaggctttccactgctggactctggcacattnnnnnnnnnnctcgaccttgtctggagatcgcaggagcaagggaggaaggggggcagactcaaaatctgtgcacggtggtgcatgcacatttaaataaccatgggaggagtgaagcaggtgcaagaaacaccagagagcaccaggcatcatcgaacggcacccgaaggcaccatggccctggacctcggcgctgtgcctgggccggccgtgagcgccggcaggttgaggtcccgcggccgaccgtggggtcccagcaggtggatgccgcggttggcctgatccgccacgatgctcacgttcctaaactccttgggcttggcggcctccagctggttgggctccgcgggggggcctgcgagccgggtgtgcttgaaccggcactgggggggaaggaggacgggcgcgactcaagaggcaaaccaccactatggtgccactcgactgtcgaatcccttcaaaaacttgaatgctcccnnnnnnnnnnaaaccaccactatggtgccactcgactgtcaaatctcttcaaaaacttgaatgctcctgccccctcaagaccaacataccgctgggccgtagatacagaatccgagcttgtacatgttgcactccttgatctcctccatgctgtgcttgtaggggcagtccacatccttgcacaccccattcttcagcaggttccggcacaccggcatgcgggctgggtcaaactggtgcaggaaaccacaggcatcgcctttcatgcagagtcctcgcagccagtatgtgcacacggtctgcatggacggacagggatggtgagttag

SEQ ID NO: 780 - DNA, 750 bp, Chlorella protothecoides
atgtggatccaacacttcacaaggcatccgaagaatgtatgggtcattcccagaaccgcccatgcacatgcaccacaaggacacagattccatttccagcatctcccttgccccctccttcaggaagaagctgagaaggaacggcaggaccgggaacaggaggctgcacgccacgcgcgtgaggcggccactgctgcagccgaggaggaggaagctttcaagcggcgccagatgggctaccagaaagaacttgagcggctcgcaaaggccaatgctgcccgagccgagaccgatcgcatcctcgccgagcaggaggctgcgattgcggcgcggcgcgaggcaatccagcagcgagaggcccaaagggaggcggccaaggtgacccatagggagctggggtcagggggtgggcgcgtagggttgctccgctgtagcttcaggcgaccatcctgttcccctgaacttccctccccaggcggcgctgatcgaggagagggcagcagcaaacgcactgcagcagcgactggcggaggctcgcatcgccaccaccctggagagcaatcgccagaagatggaggagaagatcaaggcggcccaggatcgctgggaggcggcagaggctcgttccaggtcggcgtgatgtggctattattatctgtgggagggaggtgtgttgctcagcggatggaagtggtggaatacagcttccatcctgatggcaggatacctccctgcactctgcgaggatga

SEQ ID NO: 781 - DNA, 759 bp, Chlorella protothecoides
atgaccatgccatgttctgctgcatgtaaggctcccaggactctctccaccttgaatctaccgcctggtccctcctcaagcagggccttggaggctgcacgtcaggccgaggacgaggagaagcgccgacgtgaccgggagaaggaggagcagcgcagggccacatacgaggacgcgcggcggcaggaggcggagcgcgtggcggaggtgctgcgccgcgccgccgacaaggacgccgacctggcggcgctggcgagggagagggaggccgaggcggcgcgcaaggccctggagcggcgcctgcagctcaagcacaaggccgaggcggtagagcagatgaagcgccgcgacgccttcgaacgtgctgaggcgctgaagcgcattgaggaggaaacctcgcacgcacaggccctgctggcgcagaggagcgcgctccaggtgtgtgatggtgcaacgatgaggggccggattgtgtcacggtgggccgctgatgggtgtcacggcgcacacctaggtgcttcatccagggtttggcaggcttgcaaactgccagtgacgctggcaagtgctcccaatggcttttttgcaacaacgccgtcaggccaacctggatctgtcggtccagaggcagcgtgtggcggagagcatgtccaagctgctgagcagcggcggctgggaaagggccctggcccaggggctggatgtctcgtccctgctgcgcaagtagtcgcagccgccagcgtgcaattttgcagttga

SEQ ID NO: 782 - DNA, 2202 bp, Chlorella protothecoides
  modified_base (56)..(68): a, c, t, g, unknown or other
  modified_base (359)..(368): a, c, t, g, unknown or other
  modified_base (1152)..(1161): a, c, t, g, unknown or other
  modified_base (1747)..(1756): a, c, t, g, unknown or other
atggtgtgtggaaatcgctcagaaagcccttgtctaggtcaggagggagccgttcnnnnnnnnnnnnncactctcctcccccggcctggtctcacgactcacgctttcctcacgcccataccctctccagagcgctcgctgctggtcaagctgaagacggagtgcgggtaccagttcacctccaagctggagtccatgttcaccgacgtcaagaccagccgcgacatgatggccgaattccgggcgcaccccgccgcctgcgccggcaacctggagctggacctctccgtccaggtatccaagggtgtcggctgggtgtcaggacagggggtccggggctgctgtggggcattcgtggnnnnnnnnnnagggtgtcggctgggtgtcaggacaggggggttggggctactgtggggctttcgttcgggtcggggagccggccttggagcggcatcatcctgctgtctgaccctgcgtcgcggaccgcgcacagccccgacgccaattccacccttcccccccactccttcaggtgctcacgactgggtcgtggcccgcgcaaaacagtcaggccgtgcactgcgtgctgccgcgcgaggtggaagccgccaccgacgccttccgccagttttacacctccgcgcactcagggcatgctgccctgcactcacggagaaggggactgctggcagtgtgggtggtggcaggcagggcacagcctcccaagggccggccgcgtgtgcgtttggccatcccagccaacccccctccgtcccccctttcccaccaggccgcaagctgacgtggcagccgggcatgggcacagcagagatcaaggccaacttcggagggaagcggcacgagctcagctgcaacacgcaccagatggtggtgctcatgctcttcaacgacagtgaccggctcaccacccgggagatcctggccgccacccaggtgccggacgccgagctccggcgagtgctgcagagcctggcctgtgtcaagcatgggcgccccagactggaggagacctcttgcctcggctgcacaccctgcccgccaatcgagcgcacaccgctttgcccctcctgccaactggcgcctgctcgactgtctcacggggcacccctctccaggggaagaacgtcctcnnnnnnnnnngctgcagagcctggcctgtgtcaaggtgcgaggcagggggtagggtggcacgggtgtccatgtgcgagttgtgtttttgcggacggactggagttcggatgcagcatggacgccccagactggaggagacctcttgcctgggctgcacacccagcccgccaatcaagcgcacaccgctttgcccctccttccaactggcgcttgcccgactgtcgcacgtggcacccctctccaggggaaaaacgtccttcgcaaggagccaatgagcaaggagattggggacgaggacgtgttctccgtcaacgactccttccaatcgcgcctgtacaaggtcaagatcggcatggtggtggcccagatcaagcatggcacccagatctctgtgagctctttggggcgacgagcccccgccctaccgcccactggccctgtgccccacctgaccagcccttccaaccaatggcaatgcagcgtgagagcgacgaggggaaggaggagacacgggagcgcgtggaggaggaccgcaagccgcagatcgaggccgccattgtgcgcatcatgaaggcgactcttgcttccgttgttnnnnnnnnnnccgcaaaccgcagatcgaggccgccattgcgactgttgcttccgttgtcgcacgcgtggcaggctgtgtcgcccgcatctgaccacccctatcgtcccacacttcctcaggctcgcaaacagttgtcgcacaacagcattgtgagcgaagtgacgcgacagctggctgtgcgcttcatccccaaccagcagacggaagtggtttccttgcacacctcgcgtcttccccccgagctcttgtattggcgagggcagcaccagctgaaaacatgcaacgccgagccccctgccccctccttcacaggtgatcaagaagcggatcgagagcctcatcgagagagacttcatggagcgggacgcgacagacaggacgctgtaccgctacatagcctaggcaggagggtgcttggatgcagggtatctcggccaggcgctcccccaccctga

SEQ ID NO: 783 - DNA, 354 bp, Chlorella protothecoides
  modified_base (36)..(45): a, c, t, g, unknown or other
atgagtgacagagaccctctgctccccagtcccccnnnnnnnnnntggggggcttgtcggtggcgtccccatcagagccctcctgatgtaccccaccacaaccccctgcccaccaccactcctggacaggggaccagcgaggaggagctggagtcggccctggacaaggccatcctgctgttcaggttcctgcaggagaaggacgtgtttgagcgctactacaagcagcacctggccaagcgcctgctgcagggccgcatctcctccgacgacgcaggcatggcggggaagaggtcgtgtgtgagaggaaaggggcgatggtgtgtcgaagtcgctctgactgcccttgtctag

SEQ ID NO: 784 - DNA, 300 bp, Chlorella protothecoides
atggacatggtggagagggaggccaagcgcctggaggtcctgcgccggcggcaggagcgggagctgcagcagatggtggcgcacgaggtggctcgccgggagcaggagcaaaaggccaaggccaagggaagccacagcaccatcccccctaatcgtgcccccttgcatcagatcgaggcgctggagcggaggacggaggagcagaggaaggctcgggaagcggctgcggaggagtggagtcggcagcagagggaccgtgcccttgccaagaagcaggtgtggtttcgtggctctctttga

SEQ ID NO: 785 - DNA, 786 bp, Chlorella protothecoides
atgaaatacccccttcccatccctctgactgcagccttggtgcccgcacggcacaccctgtttcggggccagaagccggttcaggagtggctcaaggagctggagcgcgtcaaggtgcgcctgactggtttgggcgacctggcggaacaatgccaccttcgccctggatactgggtgctgtgcccacctccacactgcggccacaggtcaagcatccaccacgacgcattatcacctctcgaagtcttggtctccacctcccaccgacaggaggacgcgctggcgcaccccagcaaaccgaggctcacgcttcaggatgtcgccgaccgcgccatggactcttcgttccgcggccggctggtgcccaccagtccccgctccattgacgcctgcctgcggctgggcatagaccctgccagcctgaggcacatccctctggaggcctatgccaaatgggagagggacccggagctggcgcggctggcgtatgattcggaggagtcgctgcgccaggcaagaatgacagtgtatggcagcgaggccgagggagggaccctgttggccctgggaagagacacccacgtcgagatcagcttcaagccatgtgttgcccctgcccaccgagcagactcgagtgaagaacctgttggaagaaagggcgcggctggaggaacagggcctgagcggccagcgtcgcgccaagggcccctcccagcccgggagcccaggtcccggaggcggggcgcttggacaaggtggggcgtggggggtgtgcagggcgcatga

SEQ ID NO: 786 - DNA, 537 bp, Chlorella protothecoides
atgggaggcaaggctttcactgcagcgctggctgtccttctaggggcggtctgcctgtgcggcgtccatgccgcagttgtcgtcaacacgcacaatggcatgacgttcttttacaatgatccgcacaagaccgtgcctcgtacggccaccgtggctagtctagagacggcggaggagtgcatctgttccgatgccgatcctcgctcggacgacaccctgacggtgacttacaactgctaccatcaggccctgtttggaaactgcgaggctgaattcatgaagggtgccctggaggagctggtggagagtgacggtgaggtggtacggggattctgggtgtatgtgccctatgctgtgcatgttaccatagctcgattccttccctccccatcctcaccgccctctccatgcgaccggccacctccaggtttctgccagatgagctgcaacaactgcacctgctgcgactcgccctacaacgtgatcgagaagaccgggaacacccgtttcctacaggttacttggactggtggctga

SEQ ID NO: 787 - DNA, 363 bp, Chlorella protothecoides
atgccggtgtgccggaacctgctgaagaatggggtgtgcaaggatgtggactgcccctacaagcacagcatggaggagatcaaggagtgcaacatgtacaagctcggattctgtatctacggcccagcgtgccggttcaagcacacccggctcgcaggcccccccgcggagcccaaccagctggaggccgccaagcccaaggagtttaggaacgtgagcatcgtggcggatcaggccaaccgcggcatccacctgctgggaccccacggtcggccgcgggacctcaacctgccggcgctcacggccggcccaggcacagcgccgaggtccagggccatggtgccttcgggtgccgttcgatga

SEQ ID NO: 788 - DNA, 810 bp, Chlorella protothecoides
atgcatggcgctgtcgaggctatgccgggaagcacgctcatgccccgcgcgcataccctccttcccaatgcagtcgcgaggttgatcgccttccgggacaagtacaggccggtgggctggggctggcagtacgccttccgcacctggaacgtgaggtttgaagaggggagggggccccgaggattcgcaaagagttgtggggcggccgcgcacatggcggtccggtgtgtgatcggcacaaccctgttcccatgcccacgccccccccaccacgcagtgtcccacgcgcgcaaacaacagcgacagcgagtgcgatccctgcggccgcgagtggtggggggcaatgatcgcatccctggggagggctgggtcactaacatccatttctccctgacgggggcggaggggacccctccccgggacctgtgtggattcgtgcatgccaaggagtgggacttcaaggtgtgcaacctcaacggcaccctgcccacctacctcggaggcgacggctcctgcatgccgctgctggaggaatgggacttctcccgcaatcacatggaaggtcccatcccggagtccgtggggaccatcgagaggctggtacgcttcaagatgcagggcaacaagctgactgggccaatcccagccaactttggggacctgaaggcactggagtggatccgcgtctttggtgagttggtgggactggagaataggaccgtcctcgaccatttcatgggcctccatggtctcaaacagcccatcggcaaagcgtccatggggaggcagcgacagtgcctggtcccctga

SEQ ID NO: 789 - DNA, 678 bp, Chlorella protothecoides
atgggggatggtgggggcacagtgggtggtggtgtgaccttgagcgctgggcacagaggacagaacacaaaagaggggcccggggcattgtacagcgcgcacctgcccctgaccgtcccacacaagtcttcagacacacatggtccagtcgacaaacacaccaaacaccaacacctcccgcaggtggctgacgagagccccgtggtcctcaacggcttcggcaccgtggtgaacgcgctgggcacccgtgccaagccctacctgccccagatcgcgggcgtgatcaaatggcggctgaacaacaagtcggccaagatccggcagcaggccgccgacctgatcgcgcgctgcgcgcccgtcatgaagcgctgcgaccaggagggcctgctggcccacctgggcgtggtgctgtacgagaacctgggggaggagtaccccgacgtgctggggtcggtgctgggcgcgctcaaggccatcgtcaacgtcatcggcatgacgcgcatgacgccgcccatcaaggacctgctcccgcgcctgacccccatcctgaagaaccggcacgagaaggtgcaggagaactgcatcgacctggtggggcgcatcgccgaccgcggcgcagagttcgtccccgcccgcgagtggatgcgcatctgcttcgagctcctcgacatgctcagg

SEQ ID NO: 790 - DNA, 1128 bp, Chlorella protothecoides
  modified_base (61)..(131): a, c, t, g, unknown or other
acggcgcaatcgctgggacgccacgcccgtcgacgaggcggcgggaggaaagcgcagccgnnnnnnnnnnnnnnnnnnnnnnnnnnnnnnnnnnnnnnnnnnnnnnnnnnnnnnnnnnnnnnnnnnnnnnngcccgccgcggtggcgggcggggttacacccgcctacggcgccacccccggctacggcacgggcgccaccccccttggcgcggcggggctggagacgcccgcctggggcggggagggggcgcccggggcgggcgcgggcgtgccaatgaccccggagctgtaccacgcgctcaaggtggagcgcgagacggaggcgcgcaaccgcccgctgagcgacgccgacctggacgcgctgctgcccggcgccggcgacgggtaccgtgtgctggaggcgccgcccgggtacgagcctatccgcaccccggcgcgcaagctggcggcgacccccacgccctacggcggcaccccgctctatggcattcccgaggaggaccggggccaggcctttgacgtgcccatcgccctggagggcctgcccgacctcaagcccgaggaccagcagtactttggcaagctgctgcaggaggtggacgacggcgagctgagcgtggaggaggccaaggagcggcgcatcatgaagctcctgctcaaggtcaagaacgggacgccgccgcagcgcaagtcggcgctgcgggcgctgaccgacaaggcgcgcgactttggcgcgggcgcgctgttcaaccagatcctgcccctgctcatgtcgcccacgctggaggaccaggagcgccacctgctggtcaaagtcatcgaccgcgtgctgttcaagctggacgacctggtgcgcccctttgtgcacaagatcctggtggtcatcgagccgcttctgatcgacgaggactactacgcgcgcgtggaggggcgcgagatcatcgccaacctggccaaagctgcggggctggcctccatgatcgccgccatgcgccccgacatcgacaacgtggacgagtacgtgcgcaacaccaccgcccgcgccttctccgtcgtcgccagcgccctggggatacccacgctgttgcctttcttgaaggccgtctgccagagtgaggaaatttga

SEQ ID NO: 791 - DNA, 2058 bp, Chlorella protothecoides
atgaatgttcgcactgctgccataccccagtttgtcagcaatcagcagtgcattgatgtgttaaggggtcttcaagaggagccacatcgagccatgagccccctccagaccataaccaaggagcctcacttctgtctatttacgggtgtgcgctcgataatgtccatccaggcagacgggggtcctttcaccgggcagttgaagacgtcctggcttattccggtagcgcaggcggaggtgataggtacagtaatgtccccgccctcgaggaccgctcacatggatcctgtagtagatacgccgggtgaagaaatcttcaaagtcttggcgaatgggtgcataccctttgaacgaggccttgccccgacgattccggacaaagtcccgcaaaaggccaaatatgtacagcgaggagggcgtgcttcagagtcggggccagggttcccgttcccattctggaatagtgatctaggtgcttccctcgtttctcaaacggccgccatgcccgtgcgctcgtcgtcgttcagctgcacagcgcagctccggcgagggttgcgtacaagccgctgctgcctggctgcgcctggagagatgggacacccagcagaggctctactcgatacgtacacgccccctgtcggcctgatcttttacgctacagtgcagtgcccggtggctgagagtatccttgctattggctctgcgcgcaagagaaaatttagatttgcatacggcttgcggaagaaaggacgatccgtcctgctggagatctgccaatccccgagaccccaaagcgcgcagcagccttgcccacatctatctgcttctcaaggcgcaggtaaacgcaatcctcagcctgttgaacatgtaacgatgacatctgcttgtatgatcgaggcttctgatctgggggcagggctgccagataaggagacctcagtgatccgtgtcgtgagcatgggcattcggattgtacatgtcacgggcgctgcgggatgtggggctcaggatacaggtgaggggtctggctttggtgtgttttgcatgccagttttctttgctgcagccccagtgagatgtcgctcgcccaacccgcaggaggtgcaggccgatggcaactgcttcttcaggagcctcagcgttcagctgcatgtgagtcagcagccttggctgcctggttcgggccacgaggacgagcatgctgagctgcgctcccaggtggtgcagcatctccgtgacaaccaggaggtgtacgagcctttcataggtgcgggctgtgcagggttgggattcatttcgctgctctccctgttgggccacccccccgccatattcgtccccacccttcatcctcgcacagaggacgaggaggcctgggtcgattactgcgagcgcatgtcgcaggacgccgagtgggcgggacacccagagctgcacgccgcctccaaggtcctgcggcggaacatccgggtctaccaggccgagcagcccgcctggcagctgaccacctggggtgagggtgaggccagcggccccgccctgcgcctctcctaccatgacggcaaccactacaacagcgtgacggacggcgatcaggttgggagcggtgcagcagagcccgaggcagcagcggacaattctgaacacgatgaggccgtggggccctgtgtggctggatcggcgggcgatctgcacggcgccaccagtgccaagccggctcctgtgccaaggggccgcaaggccaagaagcaggccaaggcaaggcccttgcagggtgggaggcatgcacgtctctcaccaggtggggccggccgggagggcactgtgcgcattgccctggaggtaggcgatggcgacgggcgcgtgaagctgaggctgatgtggaccgaagacagtggcgcggtgccgatcggcaaggcagcccgcgtgggctgcccctgtggcagcggcaagaagggcaaggcatgctgcagagggcgggtgcagcccccgcgcattgtggcctcccgggatttcaacgagaacctacaccatgcgctgcaaacgctggaaatctga

SEQ ID NO: 792 - DNA, 609 bp, Chlorella protothecoides
atgcatcgcctgcataatttgcgtgcagatcgaaggactggagaaggccacctcgctgacgtggcacgtggcgtaaaagcaaatcttgggatggggtcgttggccaagcattcatcaagcgatcgaatacctggaagcaaacaattcccacttggcgagaatgtcgagcagtcgaacctcgggcgtgatgaggacttcaacaaggcagcggaggaggccaagacccttccagaggccactaccaatgatgagaagctcatcctctatgccctgttcaagcaaggcaccgtgggcgacgtcaacacttcccgccccggcgtgtttgacctgaaggggaaggcgaagtgggacgcctgggacaagcagaaaggcaaggacaaggagactgcccagaaggactacattgcaaaggtgagggggaaccccgttgccatggtggatgtacatcatggttgcggagctcaaggccaagtatgcctagtggaacttacatgtgtgcacgcagagagagacaactcggggctattcaggcatgtgtgcacacagaattcacgcaagggtcgtttggctcagcaacaggaaggtgtggagatatgcctttctgtttaa

SEQ ID NO: 793 - DNA, 750 bp, Chlorella protothecoides
atgctacgggcagcggtggggtccctggcccgcaaggtgtccaggtcccatctcagccacagcgctgcctgtcggatctccaccacctcatcgtgccaaaaggatgtggattacatggattttcccggcggtaaggtcccctttacggaagacctcgcctggttggggccgggcttcaccccgcgccccaccattccctgctaccgagcgctagacagccagggggcccccctcccgggcaccagcctgccccacgacatcgaccaggccctggccacgcgcatgtacgagaccatgatctcactccaggccgtggacaccatcttctacgaggcccagcggcagccgtctatccgcagcccttgttcccgtctgacaccacccatcaccccacccacaggggcgcttctcattctacatgacgagcacgggggaggagtcgaccgccgtcgcgtctgcggccgcgctgaaccccgacgacgtcgtcttcacgcagtaccgcgagcagggcgtgctgatgtggcgcgggtacaccccgctggacatggccaatcaggtgtgtgggcgatgcctgcgaattttgtgaaggggcccattgtctgcgaacccatgccccggcggggaggggccctgctgccgcacggtgcttgcgcttcgtgcctgagggacccacccccagccaagttggacaacctcagaactcccgtcccacaaacaaataacccccctgcgaccacactctccccctaa

SEQ ID NO: 794 - DNA, 612 bp, Chlorella protothecoides
atgggcgctgccaactcggacgccacgctgtacgacgaggagatccaggccctggccaaggcccacccagaccagttccgcgtggactacgcgctgtcgcgcgagcagaagaactccaagggcggcaagatgtacatccaggacaagatcgaggagtatgctgacgaggtgttcgacctgctgtcctccggcgcccacatctacttctgcggcctcaagggcatgctgccgggcatcctggaaatgttggagcgggtggcggggaccaagggcatcgactggcccgagttccagcagaagctgaagcacgccgggcagctgcacatcgagtgtcaagaaaaggggaggaaggggcggctggctgggcccagcgtgcgtctgggaccagtctggcaaggcatcatgtgcgggtgcgagtctggggagccgctggacgctcgctggagtcccatgtggcgtggggcacctcgaacatactgcatcccgcccctgagcggccgggagcaccccttctctggaacgtgtccccttactttgtcttactgtcacctctctgaatggagggcgggcgatcgccgggacaccccccctgcgccccctacggcgccctga

SEQ ID NO: 795 - DNA, 1494 bp, Chlorella protothecoides
atggcgcgtggacgggtgcacacaccggatcaaacttcctctcagctggaagggcgctcgcgccctcgtcagaaagtgatcaggaacttggggtgctcgatcgaggtcatcgtgcaaaggggaccgggagcaatcagaggtacccgaagcgcacctagaaccgaaaatagaggtactggatggtttgggatgcaacgcagcgcccaatcgaccacaacccatgcggtgttcccaagacggagtgctgccctgaccccattacaacttcgtgcgatctcctcgtcgccaaatgaaaatcgtaccaggccaagagctggattacgtgcagcatcgagcggtgaacccggcttgcgccccccatctgagcccctccagctgagtgcccatgtggtcgactccatcgaggagatcagccggacagaatggaatgcctgcgcccgagggacggaagagctcaacccttttgttcagtgggacttcctgcactgcctggaggcctctaaatctgttgtgagtctgtgcatgaccatgaacatcctggggcaaagatcgaattactgttcggcactgctgaccaatagaccaagtctctcagcttcagccgtgactccccatgaaaccgtaaaccagattccctccaagggctggatgccacagcaccttgtgcttcgtgatgctgcccaggcagactctgtagtggcctgctgtcccctctacctcaagggccattcatatggccagaagcaacagcgctacagcacaatctctgcatctattatttctcttgctgcagagagtctgcctcccttcccaatgtgccatctccaaggtcatatccctctcctcctccctgccctccgcagagttgcgtacccttcacgcccgtgccaggcccacgattgctggtcaaaccggggccctacaaggaaaacatcaccagggcactcatgcaaactctgtaccaggtactgttatgggcctggatggcctcgtgtggatacgtgggaggtgtcaccgcgtgcacaaagtactgcattgggaacgaagagcccagtggcagagggcatgaacgtctcctccctgcacctcacattctgcacccaggtgggtaccgaggtggcagagggtttgacaaagagagagagaccagcccctgcccaagaagctgcgtgtacatgtgaagatccaaattatcaacctacccctacacacacacatgctccaccaccctgtgaatggcaggaggaaagcatgtgcatggcgggaagagcaggcggacagtacctgcaccggacagggatccagtaccatttccaaaacaagggctacagcacctttgaggcgtacctggccgacctccggcagtccaaacgcaaggcagtgcggcaggcaaggccggggtggttagtggaagtttttgctggagggatcgcagctgggagctgggtggcagtgcgcaccgaatcctccttacagtacaccatcacgacctga

SEQ ID NO: 796 - DNA, 3090 bp, Chlorella protothecoides
  modified_base (1162)..(1171): a, c, t, g, unknown or other
  modified_base (1848)..(1857): a, c, t, g, unknown or other
atgccagtggagggaatttcgatgccgctatcagcatgtactacggtgagtcggtatgctgtggtcgcgaggtgtgaccagcagggcccgggaaatgtaagaagtgaagttgagctcccaacacccactctggaactccccccatctcccgcagatcaagtgacgagccggccccaacagggcgctgcccacggtccggcccctggagggaccatggggccgccggtgccgctcctgctgaggctcgtcggcgctgcgctgcagctcccctttgctgcgctgagcaccgtactgcacgccgcctttgtcatcgcacgcacagggtccaggggggcggcagccgtcctcccaccccgcctggtgcacgctgtttccagtgagttccctgttccgcgacacagtgaggggacaccatggtttgggactgggactcgcggtctgcgctgcatgtatgactttcctcagctgtggaacaccgaaaggggttcaggggctagcatgaacgtcctccctgcctgcactgggctaccgcccatcctaacattccccagcccatggcctgtgcagcccgcgcctcagccctgtccacccgcctgtcgggtcctggcgaggcaaccccggcggctgcggcggcccggctcgctcgcgagctacaaacagcgtttggcagcgccatcgactggcaggcgtgtggctggcaagaggcggcgggccttgcggcagccgagggccgcttcctctttgtgtacctccatgccccacgccaccaggtgtggccctgggccggggccccatggcgtcggctgcatggagttggggactgtccctcaagccagggagcccggtgtgggaccggctggtgggttgttttcagaacgacgcacgcagatgccattgcgttgtccgctgaacgcttccaccgtgccgggtggcgatgggtgtccatttttcttcgttccaggacacgccgcgctttctgtcggacacgctgggcgaccccagcgtgacgacctacatctcccagcatttcttggcctgggcggggagtgtgcaggcgcgggaaggacacgcgctggctcacagcctgggggccgcccgcttcccctgcacagccctcctggctggctccggcgccaggacacgccgcgctttctgtcggacnnnnnnnnnnctccgggggcgagtgaggagggcagaggagcgggttctagccagtcctgcgagctttccttgtccagtgagggtgtcgttgcccatgggaaaccgggtgctgcatcaggaagcaagactcagctgcttgcatgcaccgagggcttctgcagtgccgatgagctgatgaccaccctccagccgtgcgttgcagctcatgctaccgtctcatgcatcagatctcggcatgccatcctccgatcgcaggctgctcgtgatcgcagcgagcacatgctctggcgtgagcgcgctctcagacaagagcgggtgagccaggggggtgtcttgagtgggaagggtggtagggtgcatgccatcgagcacccttcgtgctgggtgggatgtctgttcggcgcggcatggcagacccctgacctgagccggcgcctgagggaggagcaggatgcagagttcaatagcagtctggaagctgacagatgccgaagccgcggcagccaggcaggcggcagaggagcaaagaaagggggaggaggccctagcagcaaggtcggtctcgggggacaagaagtagggaccgcccaggctgtgcccctccagcctttcaggcctcgcgggacccaaaccgggcaccccactcccctcctccgtgccatctgcacaggcgcgccgaaagtgagnnnnnnnnnncagcgcgccgaaagtgaggcggccgcagcgcgggcggctgcagaggaggagctcaggagcaggcgagaggccaagtgcgccgcgctgccgaccgagcccgagtcgtcggcgccgcacgtcgcgacgctgcgcatcagactgccggacggcgggatgcaccagcgccgcttccgggagtcggatgacctgcaggtgtggggattgcctctttcaggaagctatgcaggacggctgcggggcctgggtgtttgggcagttgaaagttgcagcgcggccaccctgccctcacacagtcatgccatcataactccgtcacaggttgtgtacgactttgtggactcgctggactcagaggctgtcaggcatgtcatcatccttgacacattttcaacggctgtgcgcctgctgatgatcgcaagcggtgctccattgatggtcgcgcccagacatccggctcgcggcattcccacgagccacgccttcagttcagcacagatgcggcaaagtcaacagggaatactgcaacctaaatgcgctgaaaaagtagtgaaaagtaatggcatcgcatggcggtcatcggtagcaggcatggcccgcactgagggtacgggcttgaggagggtgctgcagtcgctgcaagcccgcatcctcagccctgagcgtactgcatggtacagcacttctcttgccgatgacatagtccctgctgaggcgctgcctcgattggctgaaagaatcaaggcacgtgttgcacgttggctgccaaacgtcgcatgtaatccccgcatgcagaagaatgcagcatacggccgctccagcatggtcgccgccgatctggaggtttacctggccagaggcggcgaaatcaagcccgccatcctctccgccctgttcaacatgtatgcccggctgcgctcgcctgagaagggcgatgccctgtacgcccgtgtgcagtcgcaccgccagggccccatgaccccggcaaactacgcctccctgctcaatgtctatgccaaggctgagcacccgccgtacggggtgcctcgccgttgggcgattcgggctgcccagggcgctcatgcagcaggcacatggagggccatgcgtgctgcactgcattcccaggaagctgggtccatgtctgtcgctgtggctggcactgacccccctcccggaatgagtttgttggatcaggccatgatcaccctcctcatcccccggcacaccgattga

SEQ ID NO: 797 - DNA, 1014 bp, Chlorella protothecoides
atggggctgttttcgaagatcaaatcattctcagcaaggacgggggggattcaaatccgctcatcatcgtccttggacaccggactgtcggcgacggccgctggccggaatctacagctgcaaagacccacctggaagcatgcgcggcatgaggcagaccgaagcaacccgcgagaccatccagaccggagcaccatgccgcgccccgtcctgtatgccgacatgctgagccagccatgccgagccgtggtggtcctctgtcaacagaacggcatagatgtcgagatcaagccaatcagtatcggtcggggtgagcatcgcagtgcggacttcaaggccgtcaaccccctgtgcaagcttccctaccttgtggacggcgacgtgcacgttggcgacagccttgccattctgatctacctctgcactgtcaacagggtgcctgataactggtacccaggtaaggacgctggcttgctcctgagggtggccaccaatcacagacatgtccgtgcacgcctctccgatccagtgaagcaggccagagtcaacaccgtgcttggctggcatgggtcgacgctccgcaccggcagcaccgtcaccattttcaacagggttctggctcccctgcggggtacaccaagcaatgagccgctggtcaaggatttcgggctgcccaccctgcagaccgccctgcagaaccccaatttgcctccaccccagacgatcaacgacgtgtggctcgccaatgatgacttcgtggcaggctcagacgtcagcatcgcagacctgctgttggccacggaggtcgacatggcacagctgctcgatgctgcacgcgagggtccagcactggaggagctgctagcacctgtgcccaaggtccggtcctggctgaaccggctgtcgcagcgatgcgccccacactacgaagatgccaaggagcagctgggaaaggcgcgcatcaggttcattcaggtcctgggtggatccgatgaggacaaggcgaagctgtga

SEQ ID NO: 798 - DNA, 1122 bp, Chlorella protothecoides
  modified_base (640)..(649): a, c, t, g, unknown or other
atgtcgaaacccgtcatctattattacttcttgagtccgccgagccgggccgtcaagatcttcgtggacgctgcaggtatcgatgccgaagttaaaaccatttccatcatgaagggcgaacatcgtggcgaggcgtacctggcggtgaacagcacgggaaagctccccttcctcaaggagggcgacttcgctttgccggaagccggggccatccttgcctacctcgccgacacccagcccggcattcccgagcactggtaccccaggcctcacccattcccactttgtgcccacccaccgccagaggatgcgagggcacgtgcgcgggtgaactccgcactgacgtggcacgggtctacgctgcgcaatggcagcgtgacgctgctgtccacccacgtcctcgaaccggtgatgggcgcccctgcccgtgaggaggtcacccagcagcacgccctgcccaccctcaaggcggcactcaaggacctggagacctactggctggctgccacagactacgtggcgggggggcaggtgtccatcgccgacctcctgctggccacggaggtcgaggagctgcggctccaggactttggtggaaaggtccattgggtgagcaccaccccgccagctgtcatccacnnnnnnnnnncgctcccacttgggaagcatgctttccgagccttggaagaaggtctcactcctcaacctatgcactctgctccatcacgaccctgcgtgcaggaacccggctatgagtcccttttggccgattatccgaaagtgagggcgtggctggcgcggcttgccagtgagctggggagtgcctacactcgtctgcacgatgccatccccgtggctggggcaaagatcctgaaggccatcaaggacaagaaccaaccccttgatgttgacgccatcgactctattgtgaatgaagcactgctgtacggcgctcgtgctctcactttgcaaccagagactcgaggtcgctgggatccatacctggcaactgcttggactttgcgtcttgtagtgatcattgtgtgtgacaagcgcctgaatggagatggaagtgcagcagaattcccagcccagaggaggagagaagatgtgaaggcgtga

SEQ ID NO: 799 - DNA, 783 bp, Chlorella protothecoides
atgggccttcatggtggtgcccgcgcggcatcgatgtgtcggatcctgtggccgctccctccgcaccggctcacccggagcacgttgcaccctggcacgcaggttgcagtgcggagggcgcccgcctaccggcctcgtcagtttccccgtatgcagatcagcgccaccgccaccgtgggcaagatcaatatcaccgacgtgagcagggcggtgtcctccaagcagaaggtcccggctgaggagttggagaagatcggcctgcccatgaacacattcaacatcaagaagcccttcaaggccaaggtcatctccgtggagcgcatcgtgggccccaaggccacaggcgagacctgccacatcgttctggagaccgggggcgagatcccctttgcggagggtcagtcgtatggcgtgatccctcccggcacaaagattaacagcaagggcaaggagtcgtatggcgtgatcccccccggcaccaagattaacagcaagggcaaggaggtgccccacggcacccgcctctactccatcgcctccactcgctacggcgacaacttcgatggcaagaccgcctcgctctgcgtgcgccgcgccacctactgggacgaggagaagggggcggaggatcccgcgaagaagggcatctgctccaacttcctctgcgacgccaagcccggcaccgaggtcaccatgaccggtgaggggctacgaatggagggggcccaagcttgtcgaatcacagatggcgcagcttggagcaggaggccactcgggcggtga

SEQ ID NO: 800 - DNA, 453 bp, Chlorella protothecoides
atgcgtgtgcaggtcgaggtggagggtgaggtcttcagcgggtccacccccacagccccctttgctaagtgggctctggcgcgaggacacgtggatgtcgtcagcgggctcatggcttttgggttgttggaccccttcctccaggctgtgctccgagctgctgcgggcctgaggggcccaccccctgggctttcgcccctggggcccgtgccatccattgcgccgtccctggccaactggctcccattctctgccagaagtggcgctgcgatgggcacccgccagctgtctgaggacctgatgcgtggcaatccctttgctgacaaagccagaactccgctctgggtggacaccagacctgcaatcgtggccgaagcgaggccgctggcctccatgccggcaccagagaccaccaacagaggtgcgacctgcctttgcgagttgcatcgctga

SEQ ID NO: 801 - DNA, 537 bp, Chlorella protothecoides
atgggaggagcctgcctcgggctctggcgtccctggtgggggtcagcgcagccgccgtcggtccctccccttggcggtgggcaagtctggcaggggctggactgccttcaccgcatatggcatggagatgcgcgatgctgtccgggcagacaacccgcgggccactgccacggagatcgagaaggggttgggcatgctgcggaggagggtggtcacgcccgtgagtttgcgataggcctctgggccccgtgctcctctggacccgagtctcctttccacagtttgcctcgcctgcactcgcagctcgtgggccagcgctgggcacagctgagcagcgaggagaggcagcactacgtcgacatggcggctcgcgtgcgcaaatcgatgcgtgcctcccaggcagaggaggaggaggaggcgggtgcgaagcgggctcgctcggacaccgcccacctagcagacgcgggaacggagcggccacagcgcaccctgaggccaccttcccgctacacgagtgcagacctgggtgtgtgttga

SEQ ID NO: 802 - DNA, 687 bp, Chlorella protothecoides
  modified_base (370)..(379): a, c, t, g, unknown or other
atggaggtggtgggggctggagatgcagggatggaggtggctggggctggagatgcagggatggaggtggctggggctggagatgcaggggtggaggtggctggggctggagaggcaggggtggaggtggctggggctggagatgcaggggtggaggtggctggggctggagatgcagggatggaggtggcgggggccggagaggcaggggtggaggtggcgggggctggagaggcaggggtggaggtggctggggctggagaggcaggggtggaggtggctggggctggagaagcaggggtggcggtggcggggcccggagaggcaggggtggaggtggcaagatatgggtacggggttgctggggacnnnnnnnnnngtggaggcggcgggggccggagaggcagggttggaggcggcaagatatgggtacggggttgctggggatgcgagggtgggagtggctggagccgaggactcggaggacgacaggctcttgggagtttccgccagactgttctcgcccttggagcaggaagcaggtgtctgcgtgaagtgcagcgatggaggatcagggacgacccatgggcggtgtcgcggagagccgggtggctcgctaacaacgagggcaacggacagcacccaccctgcaactcaccgaggcattggaggacgcgttggagctag

SEQ ID NO: 803 - DNA, 1539 bp, Chlorella protothecoides
atgcctagtcgacaatcattgcaaggggggttcagctttcgatgcgccgcaagcacatcatcacgaccgtgccagctcatcgctctatctaggccacggtgttcgccctgggcagcacagccctcacgatgtgcccgcactggtcgccagcgctgcagctcgacgtccttcccacacgagcatccgcaagtcagccccgatgcggtgatacagcctgtgttcgtggacagcgcgaagggcattcaccatgctgcaccctccctcccacctgaggacgggggcagtccctacaaggaccgcgcatcgctcctcagagcagccatcaaggcgcccatgtattctgtgggcatcatgccgatcctggtgagcgccagggctgatcatggggagggtctccgatctctttcccccccacacacaaggattggtgcttcatcacatgtgcactgcactacctcgcacaactcaccacgccctccctcccgtccatccaacccccaaccccaccatcgacaggtcagcgcagctgccgtgtttgcaacgacggggcaggctgacatgctgcgcaccctgggcctctgcctctcttccatccttatcatcgcctggctcaatctgtccaacgactactttgactccctcaccggggtggacacccacaagtacgagtcctgggtcaacatcacccgctcccccaggaccatcttcgtgactgcgcacgcctccctcctggccggcgcaggcctgctcttctggctcctgtctcaggtgaggtgctcctcgctgaatgcacggagggggtgtagtggccagcaaggcgcagccagaagtctctggggtgcacagagtgggagaccccgagggcggcctcttgagatcacgtggccgccgcgcctacggggtgtttcaggcaactctttgttttatggacgctccaaccccacttttccccccctgccattcctgccaacccacagtcccctgccattgccagcaagatgctatatgccgcgatatgctgcggctacctgtaccagggcccgcccttccgcctctcgtatcaaggtcttggcgaggccctctgctttgtggcattcgggccgctggctgtcaacgcattttatcttgcacaggtcagaccttgccgccgccaagtggggatggggcgtggcggcaggcatcccatggagcgctgcagtcatcagccgggtgcctgccagccagccatcgctccctgctcgcagcagggcccctgtcgagccaccaacccaatcacctcccccctccccttcaccacgcgtctgcagggggccccagccctcagcacccagtcctgcatcctatcggtcctggtgggtgtctccaccagcgccatcctcttctgctcccacttccaccaagtcaagggcgatctggcggcgggcaagcgctcccccattgtacgcctcggcaccgagaccggcgcgcaggtgcctggggagcagacggcagcaagggggggaggggtccgaatggctgcgtcgccatgccgtactctga

SEQ ID NO: 804 - DNA, 876 bp, Chlorella protothecoides
  modified_base (620)..(629): a, c, t, g, unknown or other
atgatctctcatacatcccctgcctcccatgcctgctttcccacgccactgcccactccacagtctaacacacgggtggcagacctggaggccgccctgaagctggagttggatgcggaggagtacgccgccgcctccgccaccctgctcctgctgaagcaggcgcggctggagagcgcggcggcgcgcgaggcggcggagggcgccatgcgccgcacgctgcgctggggcgcttacgcgcacggcgtcggcgcggtggtcacgcaccgtcgctatgggtaccgcggcgtggtggcgggcatggaccccacctgcctcgcctcccctgcctggatggcggccatgcgggtggacgcgctgtcgcagggcaggttccagcccttctaccatgtcctcgtggatgagcgggatcggccggggggggtgaccacctacgtcgccgaggtgggtcgtgctggcggggcggtgggttgggggtgggaagtgtgccgggaatttccgcccattcatgccagggggtctgggaggagcgctttacagaattgtgctgtgcctcacaacgcttgcagacaccctccagtcacacccaccactccgggcactctgtattctttggaccnnnnnnnnnncagaattgtgctgtgcctcacaacgcttgctgacaccctccagtcacacccaccgctcggggcactctgtattctttggactgcaggagaacctggtggcccctcggggggtcaggccgatcctgcaccccctcatggacgagctcttcctcggcatgtccaaagaaggggtgtacaaccccagcatgaagctgcacctcctcttcaggaagaggctaggaccacagtgacctgcctcagattctga

SEQ ID NO: 805 - DNA, 771 bp, Chlorella protothecoides
atgtcatccaccccctgccaggtgaccaaggcgatggacatcagcgtcacgcgctcccctggcgccctcctcccccgcatcgccttcaaggaccggctgtcctacacccagtccaggacggacgagtacgacgcggaggccatgcggtacctttcctacgcgctgtaccccctgatcctggggtacgcggtctatgcgctggtctaccagacgcacaagtcctggtactcgtgggtgctcaactcgctggtgggcgcggtgtacacctttggcttcattctcatgtgcccgcagctgtacctgaactataagctcaagtccgtggcccacctgccctgggtcatgggggcctctgggcctgcaggtgccagccgggatcagtcgtgcatcagagggatgacactacatcctggcgctgcgttgtcacatgtgatcatggtgggagcatcccagaggcagcgtcaaatgtcatacaaattcctgaacaccatcatcgatgacctctttgcctttgtgatcaagatgcccctcctgcaccggctatcaggtgctggtcgggcctgtgcagggagaggtttggtttgctggcatggcgcgatccctgccatgctggtcgggccttgtgcagttttcaaggctggacactgcgggctgcaagcaacttccgacacacctcaccccccatcctgcagtgttccgagacgatgtggtgttcctggtgtacctctaccagcgctggatctaccgggtggacaagaagcgtgcaaatga

SEQ ID NO: 806 - DNA, 690 bp, Chlorella protothecoides
  modified_base (368)..(377): a, c, t, g, unknown or other
atgtcaaccaaggaggctgcaagtgagtttcccggtgtgatggcatctgtggaagagcagaagtgggtattcagggacccctccgtcttttcatcgttcctcgatggccaagagtcgctcaccaatgctcctcccaacgctgatacccaccacaggggcaagtttgacttcctgggcaagtttgatttcctgtaccttcccgtcgacttccgcaacgcctgcaacctgggatatgccttcatgaacttcctgtctgtcgaagccatggtacagttttaccagacatatcatggcgaacggtggagggccgaggaaagctcgaccaagggctgtctttccttgaaagttgaccgtggggaggaaaggcnnnnnnnnnncgagactgggcagttgacgggacaggatggatgcaatgggtcggcaccggactgtttgtgttgggtgtgtgagatcacgtatgccagggtgcaaggatttgaggccctggtttctcacttcaaagctgccaagttccctgtgggcgatgcgtcggcgctacccctcgtattcgccaaggttgagaatggtgtggccagctgccccctccccatcaaccagtacattgacacgagtggtggtgaggaggaggcaccctctgttgagggcaccagcgagtgtggcgagtctgatgtcctgggcacttctccataa

SEQ ID NO: 807 - DNA, 1053 bp, Chlorella protothecoides
  modified_base (324)..(333): a, c, t, g, unknown or other
  modified_base (818)..(827): a, c, t, g, unknown or other
atgaggggctgtgcgctagccatgattcccaagctgatggattatcaagatgaagtgcaggagaacggcaggacgggaggggctgtctccccactcatgcttcccgccattctcgcgcccagttggggggttttcgaacgtggatacgagaaaatggcagcgagttggtggctccctgagtcagcagccccttcagagttacttctgatcgatgcaaacgcttgcattgggaataatcacaagacacgaaggggagccttgcacaattctgaagtgagacaagcactccggcttttcgaccgcgaggatgagcacaaactaccnnnnnnnnnnacagccccttcaaatgagacaaacactcccggcctttcgaccgcgaggatgagcacaaactaccttcgatccttcatagaaagtgggtccctgccctttctgcctggcttcttggctttcgggagtggagatgcgcatcgttgcgcagcatcatcttgtagtttcctcactagaccttccaccaaattttctctcccaggtgtgtctgatgtgcctgcagaactggagcgatggttccggggcatgcgggagctggacgagcgggcccatggcctccaggttcagctggaggcggactgccagcagcagctgaggctggccgccgagcaacagcagcatgggaacaagcgaaccaagggcgctggcgacatggacgctgggcccacacctccctctcagcccggcaacgagccagttgatctagaccagcgcatcgaggacacaacagcagagttactgaagctgtcggctgagaaggtcaggcnnnnnnnnnncgggaacaagcgagccaaagccactggcgacatggattctgggcccacacttcccactcagcccggcaacgagccagtcgatctagaccagcgcattgaggacacaacagcagagctactgaagctgtcggctgagaaggtcaggcgttcctgctgtcgttatctggaggtctatggcggcggtgccctgcctcgcagcgctgtactttgtcgagctctcccctga

SEQ ID NO: 808 - DNA, 513 bp, Chlorella protothecoides
  modified_base (196)..(205): a, c, t, g, unknown or other
atggaggaagtgagtctacattgcctaagtggacatgttggtgggccaggctggggtgctgatgggcttgctgagatgttgaatggcacagagagagttgcttgcgccactgcgaggcatgctggctgccgcaccacttccattgattctccgcccccctccccgatagctccccatgtgatgacatcggaggagnnnnnnnnnnatgcttgcgccactgcgaggcacgctggctgccgcaccacttccactgattctccgccccccctcccaatagctccccatgtgatgacatcggaggagctgtaccaggcagcccttgcagcggcagatgcctccgagccaacatactgctactgcaagcgtatatcttttggggagatgatagcctgcgagcacccggagtgtctgatcgagtggttccattttgagtgtgtcggcctcacggccgagaaccggccaaaggggaagtggtactgcaaggaatgccgcaagttaatgggcaagaaatag

SEQ ID NO: 809 - DNA, 1530 bp, Chlorella protothecoides
atggcggagaagacgcaccgcaagaaacagtcaggcaccaaggcgcagaagaggaagaaggccgtgaacaagaagaagggggtcgatgacaaggaacgcaagaagaatcccaaggcctttgtttttgcctctcggggccgggcaaagatccagcaggcccgcacagccgaccgagaccagaagcgcatgcatggtgaggagccgctatatgtgcaaagagaatcatgtgcagaaggaacagatgatatttataccctcaggcgtgcaacagggagcagcatatcaaaatctgacccaaaacctcgtgcagtgcctgctgtggagaagaccccatctgagcctcctcccttcactgtgctcgtacatgggccccctgggggtctgtatgatctcagtggcatgagccaacctcaaacttattacctttctgcaatcacaccaggtgggcaagaccaccctcatcaaggccctcatcaagcactggacgcggcaggatgtcaaggacgtcaagggacccatcactttggtggctgggaaagccaggaggtgggtcctgggaagcgctgggtaccagagtgctgcacacccggccgaccagccccacctcatccctcattctccctggctgctccccacaggctgaccttcatcgagtgcccacaggacctgtcggccaccattgatgcatccaagtacgctgacctggtcctcctgctggtcgatggcgcctttggctttgagatggagacctttgagttcctcaacatgctccaggtgggccctgagcagagagtacatgggcagatattgcattgcaggcagggaaccagtttatatggagcgccgagctcccaggcctcaggcccgctgggcaaccccgctggtcatgggggtgctgacgcacctggatggctacaaggacaccaaggccctgaagaagacaaagaagtccctcaagcaccgcttctggtcggagatctaccaaggcatgcagagcggatgtgtggcagctgggccggcccactgcggagctgcaaagggctgtactgcacgatgtacctgaggggattggaggactctcggtgtccaaccgattgtcctttgcacttgatgcctgctgcccagggccaagctcttctatctgtcggggatgaggcatggcaagtacctgaagagggagatcctcaacctggcgcgcttcatctcggtgatgaagttccggcccctgtcctggcgaatggagcaccccttcctcgtggccgacaggtgagcacagcatgtgttttggcagcggctgaggaggcgggggccaaaaagggtggcagaaactggtttgaggacgtgacagatcccgccagcatcaaggcggatcccaaagcagacagggacgtcaccctgtatggctacgtccgcggcacaaattggagggccgggagccgggtgcacctggcaggcgtgggcgactatcaggcaagccatgagaagggaaggggagggaaatggcagggctgtgttcccagcctggcatga

SEQ ID NO: 810 - DNA, 2880 bp, Chlorella protothecoides
  modified_base (2279)..(2288): a, c, t, g, unknown or other
  modified_base (2866)..(2875): a, c, t, g, unknown or other
atgctgagcgacccagccctctcctgcactccttcccattgcagagttgtcatgggcttggcagacgttctgcagcaccgcctgcgtcgaagcagaccagaggtgtcccttccggtgttcccgacccagaacacacgcacagccgcccgaaagcggcggaaactgctgcgcgagcagaaggctgctggcctcgcagtcccccagaaagtgcggcaggagtctgatgacgatgaagaggagggggttgccctggacgccgacgacatcggcggggcgtacaagaccctggtatctcttttagcagacgacgatagcgagagcgatgtggggcccagctcgcaagaggacgacagcgaggagcctgcatccgacgaggagctggactctgacactgatgccacgagtgaagaggatcttgccgccgaagccagtcgtgagaagctcaccaatggttcggtcgcaagatccaagggtgttacgacggaagcccttgatgacgacacagctgagccagcagatgcgcagacctccgccagcgaggacgagcgcgaggatggggcggcggaggagtcaccagctcccgacccagactcgaggactgcgaatgagaagcgggatggaggttctacgttcgagactttggctaccgacacggtccagctccaccttgagaggtgtggatgtgtggtggcctgtcaggggatgcagggcctggaaatagaccgtccatcctgggcactccacgccaggtggaggtttgaggatggacccagagccagcgtgcaccttgcctccgagtcacgcatcatcacatgcacatgcctttgtgaaaccagggtcctgaccgaggatgaggtggcgtcgctggcaccggggtctcggcccctgcaccctgcccccaaggccgtgcagtccgaggtcggccgcatttggcccgaggcgcagctgctcgcgagcgacgacgtacggctcccggccttccctccctcgaccagcctggcgagctacggcatcaaggagcggctggtgacccgctggcgcacggtgcagggcgcgacagccggtgccgagctggccagcgggtgccaggcgggcctcttcgccctcctctcctcccaggcagacattctgcacacggcccgcccctacccgacctcagccgacccaggtaccggcagggggttagtcccttgccttgcggtgcctgggatgcatccaccagtgcatgcagagactccagtccgctgcgagaccatcacccctcgagcccctcaatcccctcttccccctgcagctgtgccggacccggagctggacgcgatcctgctgcacatcctgcaacactgcgcctctaacgccgaccgcatccggaagaataatgagcgcctgaagaccaatcctgagctggaccctccccgggatcaaggcttcacacgtcccacggtgtgcaggggtggggtgggtgtcctggcaggtattccagcttacccgcccggtgtgttggttgtgtatactcttcggcgggttgtatcatgtggcaggccttctggagcatacggacataacgagtatgctgctcatgggtacatcacctggctgcactcacgggtcttgtccctgcaccccaccccgagtctcactccccttgttaaaccccaccccacaccaacccacccacaaaaacctccaggtgctgctgctgctgcccatgcgcaacatggcgctgcgggcggtgcagcgcttggccgagctggcgctggcgggggcgccgacagacagcgtgcagcaccgcgcgcgcctgctggaggagttcgaggtggaggagggtttcgccgcgccgcaggcggcggcgctggcgcgcaagccgccggagcaccgcgcgctcttctccggcaataccgacgaccacttccgcctgggcgtccggcttatgcgcgggacggtgaagctgtacgccgacttccacaccgccgacgtgatcgtggccagccccctggcgctggccaccaagctgaccgacccggcagacagggagggcgccgacttcctctcctccctggagctggtggtcatggaccgtgccgacgtggtgctcatgcagaactgggagcacgccgtcacaggagttgtctccccgagacgtataccgcctggcacattgtgtcggtctcagcacctcaaccaccttcctgccacctgcacccgcctcccttggtgctccctcctcatcgccgtccctcatccactctttcctccacacacacgcagtcttcaaggcnnnnnnnnnngtcaccgtcccccatccactttttcctccacacacacgcagtcttcaaggcgctgaatgcggcgcccaggcaacagcacgacgtggacattatgcgggtgcgggagtggcagctggcggggcgcgcgcggcactaccgccagaccgtagtgctgagcagccttgccgcgccggagatgggggcgctgatgcggcgctgcgccgcctgccacgcaggcgcgctgcgcctggaggcgcggggggcgggcggggtgctggcccgtgttctgccacagctgcgccaggagtttgagcgcctgccgcgctgcgcgccggccgaggagccggacctgcgcttccagcacttcaaggagtcggtgtggccgcgcgtcaaggagaatgggcggggcggggggcagctcatctacgtgcccgcctactttgactttgtcaggtgtgggagctgtgtgtatactggggcagaggggaaggggtggggcggttttcaagtggtctgcaaggggggagtgacgaaaaactatgtgaaggacgtcatatgggcattgcccactgttcgcccgataccaagcaccctcctgnnnnnnnnnngttga

SEQ ID NO: 811 - DNA, 948 bp, Chlorella protothecoides
atgggcattgcctactgttcgcccgataccaagcaccctcctgggctcgtgcctcctccaaacctcgacgcaccccactccccactccccactccccaaattcatccatcgctgctcagggtgcgcaactttttgcgttctgaggacgcctcccttttgctcctgtcagaatacaccgacagcggggatgcggcgcgcgcccgcgcctacttcaggcagggccggcgtaagatcctgctctacactgagcgagcccagttctacaaccgggggaggacacccggcatccaggtgagggtggtagtggaggggggcatggtacctcgatgcggtgttctaccagctgcccacccacccccagttctacgaggagatcttgaaccaggtgcaggagagcgaggtgggcggcctgcccaccatcaccgtcctcttctctacgctggacgcactgcgtctcgagcgcgtcgtcggcaggcaacgggcggcacgcatgctgaagccctcttcaaactctaccttcctgttctgttaaaatgggtggggcaccgaaaccggacaccggcaaacatcaaggggccatacgggatttgtagagggtacacggtgaatctcgcatgggcaccgaccacggttgaaacgtattgtgcacgatacacgaggggcgcttcacaaaaactgctggctgcctgggatggagaatgggctggggcaggagccacaggtcaagcacgctcaagtctcatagtgtggtgtggtttgaccgtaccacaatactggggtcctccatcactccaggtccctcagtcgctgtacatcatctttcgagaggcttttgggggcatccagatcctctggtgcaacatcatcggggctgtctggctttgggacgtctgggcgagggtgctcctgcgcgaccagggaagaagagaggtgcacacagcaggctga

SEQ ID NO: 812 - DNA, 516 bp, Chlorella protothecoides
atgccggatgtcgagaacctgcactacgacgacctctccgccgtggccaccctagtgaccaccgagcgataccagtgcatcttggaggccactcgccaggccctggctgatgatgaggccgggaccagcgagcagcaggcctggtccggccccaccgaggacgaccccacctacaagttgctggtccagtgcaaccagctgtcggtggacgtggacgcggagatcgcggcggtgtacaacttcctgcgggaccactaccgccccaagttcccggagctcgagtccctggtgcaaaacccgctggactacgcggcggtggtggcggccatcgggaacgagctggacgtcaccgccgtggacctcgacgcactgctgccccccgccaccgtcatggtggtcaccgtcaccgccaccaccacggcaggcaaagcgctgagcgaggaggagctcaggtggggaaaaggggaatgctgtgatgcttcgcgggaagattgtttgggtgtgagtgtgtggtag

SEQ ID NO: 813 - DNA, 633 bp, Chlorella protothecoides
atgtatttgctcgaatgtccctggctcccatcgagccccaggaccgctgctgtgtgcgctccgcctctcgctccatgcctggcctgccagccatgccctcacctcagcagtgctgcacaaccctggccatcccactcccactccattcaccccccccctgcatcccatcccttccaccacctcccctccaggtttgatgcggtgggcggggtgtctgtggaggccaacaacgacagcgtggcggagctgacggggatcgacccgggcgacatcctcctggcggagtggagcaactccacctaccgcccatgccactatgtggccgtggaccgcgccaaccgctgcctcgtgctgagcatccggtgcgggtgtggggttggtggtgggtggggcttgagtggaggtctgaagcatcaagtgcatgcgaaggtggcacaccttgcatccatgcacggcaggggcttgcaaatgtcgaggaggtgtccatgtgcgcagcaggtgtccatcatccactctcctcttgtacagagggtccttggaggtgggggacctgctctcggacatggccgcgcatcccatggaggccagcctgggcggccgcagcggctgggtgcacgaagtgggtctgtgtag

SEQ ID NO: 814 - DNA, 849 bp, Chlorella protothecoides
atgaagaccttcttcggcggccagaagagcacccccatcccctccgccacgcctggctccacagatctacctgccctgccagcagaaacactcccccgcctggcacgcagcacccctgtggatgtgcacgtctacatctcggaggcaaatgactggcaggccagtgccaagcaggggccccccctctggtccgccaccgagttcgagctgggcacgggctctacgcaagccaccgccctggtgtacgccccctcccatgccgtgcagaacaacgggagcgtcttcttccacgctgtgttcactcccagtggagcgtcgcctgaccctgccgacggcttccatgacgcagcgcttacgtttgccaagtcccagccgctcaacgtctacctgaagaagcccagggtgggtcgggcagaacgtccagggagggtgggatattgcatgaggatctggacatcatggggaaggctgcagatccgagtagatcatcctcaggccggggccgggaccggaatcaacctgctgactggcaagaactcgacgggcaacgaggctgccccagaggacgtgcacaccggcaacgacacggtgatagtgtcgttcctgcgccccaacgtcaccatcgccgtcgtcgacgacttcaagaagtaccagctgcgtcagatccccccgcagtacaagggctttgtggacatggacgaggtgaccctcacctatgcaccctttgtctggtacaacaacttttggctgctgcgggactacctgtgggcatgtgtgatgggtggggccgctgggaatgatggacagaccctggacatcggtgctcgagagcagacaaatgacccataa

SEQ ID NO: 815 - DNA, 324 bp, Chlorella protothecoides
atggcggggctgcagaaagtcaggccgtatcagctgcagctcttcttcagcaacaagtatgcctacgcgcaaatctggaaggtatcaggagacaagcacaccgtggctgcggctgcctccaccatcgagaaggggctgcaggagggactggagtccacctctgacaaaggagcctgcgcaagggtcgcgcaaaccctggcggagcgggcccaggctgccggcatcgataccgtgagctggcaacgcaagccccgccaacgattccacggcaaggtcgcagccttggtcaccggcctcaaggaagcagggatcaagatgatgtag

SEQ ID NO: 816 - DNA, 1191 bp, Chlorella protothecoides
atggcaggaccatgcatttgtttcgcccagccagtctcctaccatctcaccccccccaccctcgccacctccgcccagatcctgcgccacacagcctttgtgtctggcatgttcaacagcgagctggaggcggccaaattcgagggcgcgggcatccgcacgggcgccaaggacggcaccttccgcgccaccttcgaggacaagccactgctgagcgacatgatcttcctcagggcctgggtggcggtggacatcccgcgcttcttcaaccccatcaccaacctgctggagccgcgcgcagcgccggcgccgcgcgcgcccaagcccagcaagaaccgcaagcgggaggaggagcccgagcgggaggccgccgcgatgctgccgcaggggtcgcggggcggcgaggtcgcggccagggaccacggccgcttcgaggcctgcatggccttcaagggcgcccgcccgggcatggtcttcaagctggggtccagaggcatggggtactaccaggacggcgacgtcgaggcggccgcagccggggccgaggctccggccgagggggccgagggggcgagcacgggcgcgggccagggggccgcggaaccaggctcgtgggtggggatgaggacggtggcggacctgcgcagggagcagggggtgggtgcgccgcgggagtcggactccctgtaccgggccatcgagcgcaagccgcgcgtgttcaaccccctcaagatacccaaaaacctccaggtgcgaggttgtgaagagaggaggggggtggcgttggattgtttgctgtggaataatgggctgcgaggcagggagggtgtcaaggtcgtggtggaggggagtgcgtcggattgccatgcacactatgccgccctgccattcaagagcaagcccaagacggaggcggcgcgcaagcgcaagagcctagagcagcgtcgggcggtggtgctggagccggaggagaagcgggctgcgacgctgctgaaccagctgaatgccatccggaacgccaaggcgggggtgcgcagggaggcgcggcagaagcagctcaagcagctggccaagcgcagggaggccgaggaggcgtggcgcgcgcagttcaacaaggaggagcggaagaagcggtacgtggaacagggccagcaggagaaacgggcggcgaagaaggcacgcgcaaactag

SEQ ID NO: 817 - DNA, 921 bp, Chlorella protothecoides
atgtcgggttggaggaaaaggggccgccgatgcgcggagagcctggccagaccatcggtggcccccgggaatgcggcccaggccggcccaaagccctccgccttcccagcaatcgggccagactcccacgatccggcggccgaggagagcctgccgcccgccgcgcgcctccttttcgacgtgagcggagtggccgttggcctcgcccccgcggccgccgatgtctggccggaggaggacgggccggcgatgcgcggcccgccggaccccgacgcccacggcctgacactgcgcgaggcgtgcaggctgtgccgcagcagcagcatgccccagcgcgtggccgcgctgcgcacgctgcgcaacggtccccaactgacgcgggacgcggcggcgctgctggctgccgaaggcctggagccgcccagtcagacacagctgggccgggagctgctgagcggcgccagggccaccaccgtcctgcgccgggccctggacgagacggtgccagccgtggtggctgccgccgccggggcggtgctggccctcgtggatctgtcgcccccaggacaatcgccgaagtttcccagactcctcccctcctcagagcatgcggtgctggaggccagcgacgcgtacccgctgtcaggctgcccgagcctgggcattcgccacgcccagcgcccctccctgggagctgcatgggtgacggcgcccctcgctgacgaccccaagacaggcaccccagagaccatggatggcgagcacgaggaggagcccacagactgggagctgctgggccaggccgaccccctgtcggccctgctggggatgggcctgctggatagggtggcgtacctcctccgcgaggcggccacgttctcgggagcaacaacgtccctgcttgccctgctcgtgcggtga

SEQ ID NO: 818 - DNA, 576 bp, Chlorella protothecoides
atggtgcgacaggctctgcgtgaaggcgtccaccagcccctgctgcaccgcacgcacatggacaaggaggacgactccctgccgggggccgtggacctgtaccacaccctgttccgggacagtacccgcagcgataaccccgacaggaacaccagggtctggctgcacatcgatgagcatggcataccctccgacgtcgaggcgcgtgccgggttaagccaggggagcaaaatgtcagagccggcaggggagtttcctgccgcccagccccggccagagacgctcttgatctggactggcaattcctttcattactcacaaacacaggtggacaagcacgttctggtgtatgagctgggggtgaggtaccgcgacctgctcaccctggaccccaccctccccctgcccttccccgccgccatcctcatccgcaaccgcgcgctcatcatcaacctggagaccgtgcgcatgatcatctgcgccaaccagtgctacgtcctgagtgtgccagacgtgagagcggcgcgatggtttttgcgtcggggtgcaagccaatgcccgtggggtgcggcatga

SEQ ID NO: 819 - DNA, 396 bp, Chlorella protothecoides
atgcctcgtccctcttccgcaccccagaggcgtgatgtctccctgccccccacccaggtgctggggaacgccaagggcgtggtggccgtcgtcacctccgtcctctacttccagaaccccgtgaacgccatgagcgcgctgggctacaccatcaccgtggctggggtcgtggcctactctcagagaggtgccgccatgggcggctttgaggggcggtgtcgttggatggcggcattacacaatccccctcacacactcccagagggcaatccctcaccctttgttcccctcacctggacaggccaagaagcgcacacggaaggtggcgtccgtgccaaagcatgccgcgcaggagcatgcggtgcagatcaagatcgacgtgcatgcggagtctga

SEQ ID NO: 820 - DNA, 474 bp, Chlorella protothecoides
atgaattccctggtgggttctgtcgtggagcgggaggtggcaggccccaccccgccccccacgtgctcgagcactgtcagtgctccagcctttcctgctgcagcccacagaggccccggggcctcacgcttttccagggctcgacgggacccaggaccgactggtgcgggggcttcctcgccggccatcaagggccctgaagccgccctggagccgggcagcgtcgaggaggcgagcgcggcgctgctgtcagggatgagcctggcggagcgggaggaggcgcggcaggatctggagtccaggttgaagcccgagacgctggcattcctgaaggccaggggcgcgcgtcgacagatgcagggtcccgctgctgccgaggggaagaggagtgtggaagcagggatggcaggccctgtgcacgacgataaatccagacccacggcggctggcggcaaggccgtcaggagagcctag

SEQ ID NO: 821 - DNA, 648 bp, Chlorella protothecoides
atggtggcctgcagcctgctgggcggcgcactggccgccagccgcctcatccccgtgcagcccatcgcctcccggccccagatggcgaagatcacgctgctggccgccatcttctgcttcaccgtcgtgctgggcaacgtcagcctgaaaaccatccctgtgtccttcaaccaggccatcggcgcgaccacgcccgctttcaccgctgcgctgagcgtgctcatgctgagtcagcgtgagccgcgcgcggtctacctctccctcgtcccggtggtggtgggcatcgtgatcgcgtcgggcgcggagccaagctttgagatcgtgggcttcctggcctgcgtcgccgccaccgccggccgcgcgctcaagtcggtgctgcagagcatcatgctggacgaccccgccgaccgcatggactccatgagcctcctactgtacatggcccccatcgccgtcgtgctcctcgtccccgtcacggccacggcagaggcgggagccctgcaggcagcgcttgtcatgggcaggcagccaggcttctggatgctgctcatcctgaacagcgggatggcgtactttgtcaacctcaccaacttcctggtcacaaagtacacctcggcgctcacgcttcaggtggggggtgaagggtga

SEQ ID NO: 822 - DNA, 1338 bp, Chlorella protothecoides
atgtcgcgcccgctggcagacgcctgccggccccacgtgacctccgtcatcctggcggccgacatcatcccccacctcagctacgcgtccgtggagaccctgctcctggagctgaaccagtccagcctgctgccccgcgcggccaagggcctgggcaagaagctgagctctgtgctgggattgggcaaggactctggcgacacaaaggtcagcgaggcggtggccaagcgccgctcggaggggaaaacccaggcgcagggggagtggaagagcgtgcggcgggcggcggggtcgtcgccgcgccggcctgccgatgaacgtgggtggggccctgctttactttttgggaggggggacgaggaggcgctggctgccgcggccgaggccacctcccacacgctggagcaaacagcgagggagggaggggcgagccaggcgcagggatctggggcggacacggccgtgtcccctcgaccctcgccgcgactcattccggtgatcgagatgtccgaccccgacgctccacctcaagccggcggggaagggtcacaggtcgaggacagcgacgctgcagaccaggagccctcgtccgccaccgacctcctgccctacctgggagggatggaggacgggggcggcgcgaccagcgccatcgcctctgcaggggtgcgcgacaaggagatgggcacctcccctcggagcgtctcgcagcccgcacacctttacccccccggtgagcctgctgtgtcgggcgtgctctggattggttcgaggggtctgtggcatgggtcagatggagggtgttggcaggtgtcttctgaggaactccccaaacatcagcatgcatacccactcatcgtgcgcgtgcgagagtaccgtgatcccagcctcgcccgtgtgagacaccccgcccgtcatcgctgtgcaggtcgcatcatctggatcttccccgcagacgaggacaagagctcgctggatggcagcactgccggggaggagcaggggccccctgctcatgccggtgagcaggacaccggaggtgaagctccaaggaaggagcctgaagccccggaaccatcacccagcaatggtgacggggctgcgcaggtctccatggaggaggcagtggaggaggtggaggccaagggccagggcccctcctccaaggaggtcgccgctgccgcaagggagagcggggaccctcgtgcctcgcggggcaaggcggtgcccgtggccgtggaagccaaggcgacgagctttgagcgcctcctcctcctgcccgactgcttcaacgaccacctgcccgatcgctacatcgaggtcctccagcagctctga

SEQ ID NO: 823 - DNA, 1194 bp, Chlorella protothecoides
atgaaaggtcacggcaccccgccgtttgtacaccccaccaaccctccacccacccatccatctatttcacacccccagattgaggagttgactccgctgccagacccctgcccgctcccagcgacctcccagtccggcaagcgcaggagcctgagcgagaaggatcgtctgctgtatgcccctatgagcgacgtcggcgggctgctgtatgatgccgatgcaatgtacatcgatattcctgactggaaggtccagtacagtgccgctggggctgccaacggccgggcagatggcgagaccatgatcagggagctggcttccacgcgccacggcatcgacgagcagcttcagggggctgaaatccaggtgttcaagggcgccaagccgctgccggccgacggcgcagcctccagcgatgaggaggaaagcgaggacgagtctgcggacgagtctggagacaaggatgcctccacagggggcagtggcagcagcgatgacgagagtgagggtggcagtgacagcgacgaggagggcgagcctcgccagcgggactccctgccaggccaggaggcggtgctggctgcagatgggcgccacaggcgccgcgccgtctttagcacgaccctggagccccgggctgggtcaggggaggactcaagcgatgagaattccgggagtgacagcgacgacgagcccgggacggcgccgaggagcagaggtgctttggaggacgaccaagagggctccgactcggagtctggctccgaggcgacctccgacgaggagggcggcggcgaggacgacgatggcgtcgaggacgaggaggggctgggcgcggctgcgcgctggaaggcggccatgctggagcgggcggccgccctgttcagccaccgcgccgccgacctgcaggccgcggtgtacggcgagcgggcggtgtgcccgccggcttcccagcagcttccgcgtgctgagcccaaggcgcccagcagcgatggagacgaggacgatgatggcgatttgttccgaccgcgggaggctgcgcggggcatgcagggccctccctcgggcctggaggactgcagccgcgcctgggccgcctgggacgcgacgatcgccgcctggggcgacgacgcggctgtggagggcctgcgcgaccgcttcgtgacgggagcgctccgccgcccggccccgtga

SEQ ID NO: 824 - DNA, 645 bp, Chlorella protothecoides
atgatcagccggctggcggcggacaaggcgctgatgctgcgcctggtgcagctgcgcatggaccgcatcgcgcccaacctgtcggcggcggtgggcaccgagatcgcggcgcagtgcatgggcctggccgggggcctgctggccctggccgccatgcccgcctgcaacctgctggtcctgggggccaagcgccgcacgctggccgggttctcctccaccgccgccgcgtcgcaccagggcttcgtccacggctccgcgctggtgcagggcacgccgcccgcgctgcgaccccgcgccgcgcgcctcgtggccgcaaagtgcgcgctgctggcgcgcatggacgcgtacgggcaggacccgtcgggggcgcggggacgcgcggcacgcgaggacatggccaagaagatcgagaagtggcaggagccgccgcccgccaagcagaccaaggtgctgcccgcgccggacgccaacgagcagcggcggcggcgcggcgggaagcggtaccgcaaggagaaggcttatttaggtacgaatgtcggagggtctgaagggcgcggggagctggacagggcgatgtcgcgctctgtgcgcctcattggcatgcccttggggccggtggaggccccggcatgcagtttggcctga

SEQ ID NO: 825 - DNA, 606 bp, Chlorella protothecoides
atggacggctaccttatctccctcaaccaacaactcacccctgtgcaggactggtgccgggccaacaacgccgagtgtttggccgtgcagccgccggggcgcaacctgcgcagcaagcacgcctttgcagacagcgcggcgagtctggcgaaagaattgctacctgtggtcgcgtctcgcctggccagcaccccctacgtcatcgtggggcacagtctcggcacctggctggccttcgaactgctgtcggccgccagggacgcgggcctgcccctgcccctgcacgcctccctctccgcgctgtgcgcccccgacatccctttcgaccagcggccctggcgccagcagcggacccttggcgaggaggacttcaaggcgcgcgggagtgggctgcgtgaggagtgccgcggctggagtgtgagcgagatcctgttcacgcctgcgctctggccgacataccagcccatcatgcgagcagacttccgactgtttgacgagtacgagtttaccagagcgggggaggcgccctttgacttccccatccacgcctactggggcaccggcgacctcaggatcaagcagtggatgggggaggtgagggagtga

SEQ ID NO: 826 - DNA, 4530 bp, Chlorella protothecoides
  modified_base (941)..(950): a, c, t, g, unknown or other
  modified_base (1014)..(1023): a, c, t, g, unknown or other
  modified_base (1094)..(1103): a, c, t, g, unknown or other
  modified_base (3001)..(3010): a, c, t, g, unknown or other
  modified_base (3508)..(3643): a, c, t, g, unknown or other
  modified_base (3759)..(3768): a, c, t, g, unknown or other
  modified_base (4240)..(4249): a, c, t, g, unknown or other
atgcctggaaggcggaggcggtgtcctgcggcttcaaccataccatggccatcgtggccttctgagcgacctggcgagggcgcggggggatcatcatcatccggcactccgatcccttccagtatcccatgcataggtcggggcggtcccggcaccccactggcaggaaaccctgcggactcaaaccccaccgacagtctgcctggagcggtgggtgcggggaaccgtggtagagaccgggtgatcaccctcgcggctgcccatggtccgccccgcagcggccgccctctgggtgagcaccctcctgaagctgaccttggtgacttttgcgggcctgtggccgatacgagatcggctgtggcacctgaaacggtaccggagcgtagtgaatctgtacaccctgcccgactccaacctcgatgtcctggccctggcctggctgcacaccggggtgctgctggtgctgctggcccacatcatgacgccccagaatcctccacggggctacatgaggcggtcgccacccttcaccagggcggtcgccacccttcaccagggtggggcagggtggtgggggtgttgtgtgtgggggcggtgactcatgaagctgtgccagccaggtggacccttccgctttcctgggcacacatgcctggtgccacagcatgccaagaatctccagcgcccaccccgacccacccctcccgccccacccacttgacaatggcaggtgcggctgggcatccgcgtactgggccccctggtccaactcctgctgctggccaaggcggtggcggtggcggtgtggggtcgcggcggcgcggtcgctggcgagcagctggcggcggcgctggcggcggcgcacgggcgccacccgctccggcgccgccgcgcccctgctgggcggcgaggcactgccccccgacgacgacgaaaacgannnnnnnnnncggcgccgccgcgcccctgctgggcggcgacgcactgccccccgacgacgacgacgaaaacgcnnnnnnnnnngggccaggccctgatcccctactacacgggtcgcatcatcgacgcggcgagtatcgaccccgaccccgctnnnnnnnnnnctcagagagccacaagggcgcgcacggcgacacccccactgtgtccacgctggtgcgcatggcgtccagcgacacgcccatcctggcgctggcctttgccgccggcgcggcggccgcgctgggccaggccctgatcccctactacacggggcgcatcatcgacgcggccagcatcgaccccgaccccgcggcgctgcgccgcttcacgctgcgcctgctgggcgtggccggcgcctgcgcggccgccacgggcctccgcggcggcctcttcaccgtggccatgacgcggctgaacgtgcgcctgcgcgccgcgctcttcgcctcgctgctggcccaggaggcggggttctacgacgccacgcgcacgggggacatcacctcccgcctctccgccgacaccaccaccgtgtcggaccaggtctgcctcaacctgaacatcatgctgcgctccctcacccaggcggcggtggtgctggccttcatgtttgacgcctcctggcgcctcaccgtcgtcacctttgtcatggtccccctcgtcctcgccatctgcaagagacacgcccagaacacacgcgtacaaccttcccccttcaacacacacaccccaatcccaggtgtacggttcttactaccgcaagctgagcaagcgcgtgcagtcggagctggcggaggccaacagcgtggcggaggaggcgctgtcctccatgaccacggtcaaggcgcacgcggccgaggactccacgcgcgcggcctacgcggccaagctggcgcgcttctactcgctccagctgcgcgaggcggcggcctacgcgctctacatggccaccaacaccttcctgggcgccagcgtggtggcgggcgtgctcttctacggcgggcgcctggtgctggcggggtccatgtccgccggcgcgctggtctccttcatgctctaccagcagagcctgtccggcgccttccaggccctgggcgacgtcttctccgcgctggccgccgccgtgggcgcggccgacaaggtggtggagctgatgctgaggccgccacgcgtgccgccggcggggcgcgccgcgccgccgcgcctggcggggcgcctggccctgcgcgacgtgcgcttcgcctaccccgcccgccccgctcaccctgtgctgacggggctcagcctgtcggtggagccgggggaggtggtggccctggtgggcccctccggcggcggcaagtccagcgtggtgaagctggtggagcggctctacctcccctccgcgggggcggtcacgctggatggcctggatgtgggcgcctacgacgccaagtggctcaagcgccgcgtggccctggtcagccaggagccggtgctctacgcgcgctccgtcgcgcgcaacatcgcctacggcctggagccggaggacgacgtgccgcaggaggaggtgcccaccctcgccgacatccacgccgcggccaggtggggaggagaggcggttgggaggggctggccaatgcgcacgacttcatcctggcgctgccggacgggtacgacacggagtgcggcgaccgcggggtgcagctgtcgggcgggcagaagcagcgcatcgcgctggcgcgggcgctggtccgcaagcccgccgtgttgctgctggatgaagccacctcggccctggatgccgactccgaggtgctgaggggtgggcacgatgcgttggcgtgtcatgcctgtgtggtgcggacgaggcagggtggcgagacgggagtctgggcggtggatggagtgtggagcgcgccgcagcgcccgccggtggggtgtctccccctccggtctgtcgcgcacggggtccggcccatgcagggccgaggagcatccacgttccctcctccccacccgaccacgccccccctccctccgnnnnnnnnnngcgcgccgcagcgcccgccggtggggtgtccccccctccggtctgtcgcgcacggggtcgggcctatgcagggccgaggagcatctacgttccctcctcctcacccgaccacgccccccctccctccctgctgcacaggcgctggtgcaggaggcgctggacgcgacgatgcgcggccgcacggtgctggtcatcgctcaccggctgtccacggtgcgcaacgcggaccgcatcctggtgatccagggcggggccgtggtggagagcgggtcgcacgacgcgctgctgggcgcaggcggcgtctacgccgcgctggtgcggcgccagctggcgcgtgccgacgtggcgggcgggcccagctccgccagcctggcgggggacgccgaggcgggggaggtcgaggaggcgcggcgccggcgcggcgccgccgccgccggccaggcgtcgccgggggcggggccggagcttccccacgttccgcaggtgcagtgagcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacctccccgcgcctccggcttttcatcgcgcctgcagcgcttgccaaccaggctgcgccgagacatgccagcgtatcgcactgctgcctgccgcacctgtgtgtgctgcatctnnnnnnnnnngcgattggcggcgagcagggccagagcgatcggcggcgagcgccagagcgatcggcggcgagcagggcccggccctgcttcgagcggccccgggccgtcccagatttcccgctccacccgctgcgcgccggaccccggagcgcacctccccgcgcctccggcttttcatcgtgcctgcagcgcttgccgaccaggctgcgccgagacacgccagcgtatcgcactgctgcctgccgtacctgtgtgtgctgcatccgggggaaactctccgcaggctgcccccccaaacccctgttgccctgcggcgttgttccaactcccaattgtacagcagcttcttgcccaagtcctgcgatgcactgcgccgtcagagcgacggtgctccccagcgccagtgctcccctgagtcgcctggctcacgttatgcctgtccagaacacagcagcgagccatgcgtgcagggcagggatcnnnnnnnnnnacggtgctccccagcgccagtgctcccctgcgtcgcctggctcacgtaatgcccgtccagaacacagcagtgagccatgcgtgcagggcagggatgagcgcacttgcccagcaccctgtaacatgcgcccgcagattctgaaagggggcccggcggcgttcctgttggaatcgccagaggcacagggagtgctattccaaaggtctggcgtcgtgcgatgcggccgacccttgtcctccatccgcagcaccagcaactggagcggccacggccggccctaa

SEQ ID NO: 827 - DNA, 1467 bp, Chlorella protothecoides
  modified_base (838)..(847): a, c, t, g, unknown or other
atgcggctggactctgggatggaagagatgcctagggtccaagtgccgggcttagagatcacttctggtcataaaggaaagggtgcaatgagtccatttaccaccatctcaagctcttcaccgcaactacattattctgaaagtggctatgaatcgcaatatagcggtcgcgaggacttgggggttgggcaaacgtcgggactggccgacaacatgtacctcatgcggacagggagtcagcctgccgcgcttgagcgcccgcactgccttgcccctgccgggatgttcaatcccgagatgatgcgcatggcgcaggagatgatgagccgtatgacgccagagcaggtgctcggggggtgtcgtgccaggatggctgagatgcagcgtcaggccgccagcatgtccccagacatgatgcagcaggccatgcgggcggcgcagggggcatcccccgaggacattcgtcgtgcgcaggccgcggccgccgcacagacgcccgagagcctgctgcaacaggcacagaccgcgatcccccagctctccgcgcgcgagaagatggtgctgagcgcgtcggagaccctgaagcaggacggcaacgccctgcaccgagctgggaagtacgaagcggcggccgagaagtatgcccgcgcggtgaacaatctcactggtgagtacctgctgcggggatacttttgcgaaggtctggcaatcagtggtgggaagagcctttgggccaactgcccagcgctggccccacctgggggattgctgcaatcaacagtacgacaccaggcccctgcacccactgatgctgccctccatcctccacccattccannnnnnnnnnccagtggtgggaagagcctttgggacaactgcccagcgctggccccacctgggagattgctgcaatcaagagtccgacaccaggcccctgcacccacagatgctgccctccatcctccacccattccaaactttcctctcgcaggcaggaccgatgctgcggccgtcagcctgcgactggggtgccagaataatctgggcagctgccacctggcgctggggcgatggagcgaggcgcgcgccgactgcgacgccgtgctggccgccgaccccgccaaccgcaaggccctgtaccgccggggtcaagccctgctggccctggagctccccgagctggcggtgcgggacctggcggccgcgctgggccttgcggagggcgatgaccgggacgtgatcgccgccaagctggcggaggcgcggaagctggcggaggataaggcgccggcggcgcaggcgccgcgagggggggtggaggtggaggacgctcccccgaccgagctgcgcggcgtcgaggccgggcagccgcggaaggttggggacgtggtcattgaggaggtgacggcggaggatgtgccaggggttgatgagcccacagcagaagcacgagggccggccgcggcc

SEQ ID NO: 828 - DNA, 620 bp, Chlorella protothecoides
atggcgctgatgttgcgccatggtctgtccagcatcaggaagttgacccagaggcttgctggccctgttggtatacccaagactgcaggactccctgcacctttggcccacgaatctcgacgctggtcatggagtcgcaggaacatccatgcaagcatggcgagagcgcagccctgcacccccctccctgccaggaccgagtaccagtactttggaaatcggaggccggtgctgagcctgtccaaccccaatgccctgcgggtgctggcggggctgggtggcggcggactagtggtgtatgtggtggcccagcaggaggtgccctacaccgagcggcggcacgccatcctgatctcccaggccgcagagcgcgagctgggcaggcagacctaccgccaggtactggaggaggccagggcggagggcagtctggtgcccagccaccacccggccaccaagcgggtacagcgcgtgggctcccagatcgctgcggcggtgaaccggggtcagggcggcggcttccaggagcacatgcagggcctggagtggcagtttgccgtcatcgactccccacaagtcaatgcattcgtggtgccgggagggaaggtggtggtgtacac

SEQ ID NO: 829 - DNA, 507 bp, Chlorella protothecoides
atgacaggatctggaaagagcagtggctggccgccttcttccacaaaccgtgcaaccacgagctctttgtcctgcagtcgctcaacatggaaggtgggatcaagtagtagggatttaccatgtgttgctcatcccccaacagcgacacgatcacgttgcacagcaccctcaacatggctctctccttccatatcgacagaggccatcaaactggcaagaaaggatgacatggactggatcttacacgtcgacaccgacgagctgatgtaccctgctggatctccaggcttctccctgcaagaggtcctgggggcggtcccaagccatgtggactcccttgtcttcccaaactatgaggccctgccggagagggaggatgtactcaaccccttcttggaggtcacccttttcaagaaaaattttcagcacatcgtctcgggtgaggcggtgggggctgaagcgctggcctcctgtaacttaccgctgtgcatcgccgtgtcatggtga

SEQ ID NO: 830 - DNA, 753 bp, Chlorella protothecoides
  modified_base (505)..(514): a, c, t, g, unknown or other
atgcttgctccgtcttggtctccatgctcgtgggtgtgtcagggacaaattcctgacagaaccctgaaccccccccccctgcacttccccaaggctgctactactggcatggagcgtgcactgggcaccatcctcggaggcttttccgggttcctcgtcttccagattggggagcttttctggaatgagcaaacggatggcatggtgctcacggttggggcttgcgttgtgtcctttgtggccattctcgtaggccacaaactgaagctggacacatctgcgcgactctacatcatcacattccttctcgtcatctttggtgctgaccgtggttcaggcgttgtcctcatcctcattctgtccatcctggtcttccctaaatccgccagcatagaatgcatccggaacgttgaaactgccctggagtcactcaaggagctaaacagcttggcttggacaagctacatcctgggtcctgagctgggagaggcctctgttgtcgccnnnnnnnnnngggaagtgccaggcaacgatgtcgtgttgattgctgctggtatggtgaagggtctgtgttctttgcacaggttgtcgccagaagcaacccccacttccaggtcaaacaaggggtacatgtccattggcgctgaggatgtggaggcgcaggtcccggggtctgctgcggccgctgctgctcgtgcggccgccgaggacgcctttgagtccaaggtcgagaaggtgcggtcagcacgttga

SEQ ID NO: 831 - DNA, 1908 bp, Chlorella protothecoides
  modified_base (614)..(651): a, c, t, g, unknown or other
  modified_base (1504)..(1513): a, c, t, g, unknown or other
  modified_base (1816)..(1825): a, c, t, g, unknown or other
atggaggccaggttgcacaccgccgtctcctccggcgaggagtactccacgatctctgcgggccaggaaccaggggtggacggggggatgcctcaagctgctggacgctgcgccatgacaagggctggtcatggtgactcccaccctcccatcctcgtcacactctgtgccacaaaaaccaagcacacactcccccctcccatcaccctcacccgtgcacaggttgctgctcttgatggtgcccaggttctgctggttgctcttagagttgcacgagtccttgtacagcatgaaggggttccccgtctccacctgcgcctccatgatagcaaaccagagctgctgcgccttgatcacgcggcgcggcctgcagagggatgggatgctgggggcttagcaacagcacgagggagacatcctggtcaacaaagaaggccaacctgtgtggtgcaaggcaaccatccacaccccacatccatcccagcgccttgccaagaggaacccatgccaacgcagtctctgacaatgccacccccaacaccatcatcactcactccccatgcttccagctggggcccaaccctccgccacaagtctaccaacccaccctgcannnnnnnnnnnnnnnnnnnnnnnnnnnnnnnnnnnnnncccccccccccgcgccccccccccccccccacgccaatcaagttcaccaccaacaacaacccaactccctcacctgccctcccgctcgtagcgtgtgtacagggcctcgaactcggggccccagcagtctgccatgcccggggcctcgttggggcagaagagggaccaggtctcattggcctcgacgcgcttcatgaagaggtcggggatccagagcgcgtagaagaggtcgcgcgcacgcgcctcctccttgccgtggttcttgcgcaggtccctggcggagcgtgggtgtttgaaatgagctcgagtggggggccaggagggaactgggactggatgcagcgagagcgccgaccctgcatgccggccatgccaccgcacgcacaacactctgcgacaaacacccccgccacagcactcggccgccccgacaccaactcccccgcaacaccaactcatcactccgactcacagccagtcgaagatgtcggcatgccagggctcgaggtacatggcaaaggcgcccttgcgcttgccgccgccctggtccacgtagcgcgcggtgtcgttgaagacgcgcagcatgggcacgatgccgttgctggagccgttggtgccgcggatgtaggaccccgtggcacggatgttgtgcatgctcaggccgatgccgcccgcggacttggagatggccgcacactccttcagcgtgtcgtagatgccctcgatgctgtcggccttcatggacaccaggaagcaggaggacagctgggggcggggggtgccggcgttgaacagcgtgggcgaggcgtgagtgaacctgcgcgcagaggctgcaccccatgcgagacagaannnnnnnnnngcgtgggcgagagtcgctttgactgcggcggcgtgagctcaacctatgtggtgggccagaggctgcaccccatgagagacagagaacaaaacggcatccacagcctaccagcgctgggacaggaggtggtaggtgtccacggcagcgtccacgtcctccttgtggatgccgacggccacgcgcatgagcatgtgctgcgggcgctccactacggccccgttgacgcgcaggaggtaggatcgctccagcgtctgccggtcaggggggggaaggggcgatggggatggcagtggaagggcgatnnnnnnnnnngcgtctgccggtcaggggggggaaggggcggtggggatggcggtggtagggcgaatcagaatgcaggatatgtgcaggactag

SEQ ID NO: 832 - DNA, 321 bp, Chlorella protothecoides
atgctgtacatctgcagaatcaagatcatgtacaaccacatcagccccaagaatggcgacagggcccctctgatcgccgacgatgtgtttgagatcatcatcaagaacgcggcccgcctggactcagagatcgtctacgaccgtgactttgactacgactacttcggcttcaagacgctggagcgatcctacctcctgcgcgtcaacggggccgtagtggagcgcccgcagcacatgctcatgcgcgtggccgtcggcatccacaaggaggacgtggacgctgccgtggacacctaccacctcctgtcccagcgctggtag

SEQ ID NO: 833 - DNA, 315 bp, Chlorella protothecoides
atgccatgccggtccactcacgcagacctgtacttcaagaactacgtgagcgtggcgcacggcaaccccaactactttgtgacctatgcaaatgggaaggccgccgcccggatccacccaggcctgaggcccaacggagcgcatcggtggagcagctacgagaagagcatggaggagtggacgagcgaggtggcggcggtgctgcactacacctacaaccggttctccgacctcaaggggcgccgggatcgctgcgactgtgcgcccacggaggaggacgccaagaggtgcttcatcctgccctttgacaggtga

SEQ ID NO: 834 - DNA, 273 bp, Chlorella protothecoides
atgaaggccgacagcatcgagggcatctacgacacgctgaaggagtgtgcggccatctccaagtccgcgggcggcatcggcctgagcatgcacaacatccgtgccacggggtcctacatccgcggcaccaacggctccagcaacggcatcgtgcccatgctgcgcgtcttcaacgacaccgcgcgctacgtggaccagggcggcggcaagcgcaagggcgcctttgccatgtacctcgagccctggcatgccgacatcttcgactggctgtga

SEQ ID NO: 835 - DNA, 1773 bp, Chlorella protothecoides
atgagttggtgttgcgggggagttggtgtcggggcggccgagtgctgtggcgggggtgtttgtcgcagagtgttgtgcgtgcggtggcatggccggcatgcagggtcggcgctctcgctgcatccagtcccagttccctcctggccccccactcgagctcatttcaaacacccacgctccgccagggacctgcgcaagaaccacggcaaggaggaggcgcgtgcgcgcgacctcttctacgcgctctggatccccgacctcttcatgaagcgcgtcgaggccaatgagacctggtccctcttctgccccaacgaggccccgggcatggcagactgctggggccccgagttcgaggccctgtacacacgctacgagcgggagggcaggccgcgccgcgtgatcaaggcgcagcagctctggtttgctatcatggaggcgcaggtggagacggggaaccccttcatgctgtacaaggactcgtgcaactctaagagcaaccagcagaacctgggcaccatcaagagcagcaacctgtgcacggagatcgtggagtactcctcgccggaggagacggcggtgtgcaacctggcctccatcgcactgccgcgctacgtgcgcgacgccagcgggcgcgaggggcgcaagctgatcgggtccctggacgccaagggccgctactttgactttgaccgcctggtggaggtggtgagcgccgccacacgcaacctcaacaagatcatcgacgtcaaccactacccagtggagaccgcgcggcgcagcaacatgcgtcaccgccccatcggcctgggggtgcagggcctggcggacaccttcatcctgctgggcctgcccttcgactcgcccgaggccgcccagctgaaccgcgacatcttcgaggcgctgtactttgccgcgctctccacctcctgcgccctggccaaggacctgggcccctacgagacgtacgaggggtcccccatgtcgcgcggcgtgctgcagcaggacgcatggggcgtgaagccggacagcggtcgctttgactgggacggcctgcgcgagcagatcaagtcgcacggcgtgcgaaactcgctcctggtggcgcccatgcccaccgccagcaccagccagatcctgggcaacaacgagtgcttcgagccgtacacgagcaacatctacgtgcgccgcgtgctgtccggcgagttcacggtggtgaaccagcacctgctgcacgacctcacccgcctgggcctgtgggacggcgacatgaagaacgagctggtggcgggcaacgggtcggtgcagggcctggacatccccgacgcgctcaaggcgctgtacaagacggtgtgggagatcaagcagcgcacgctggtggacatggccgcggatcgcggcgcgtacatcgaccagtcccagtccttcaacgtgcacatgtcggaccccaactttggcaagctcacctccctccacttctacgcctggaagaaggggctgaagacggggatgtactacctgcgcacccgcgccgcggccgacgccatcaagttcaccgtggaccagcagcagctggcgcggaagaaggaggagcgcgcggcgcgggccaacgtggccgccaccctggaggagctgtccctggccgcgggggcggcgccggccaagcccaagccggtgctggacaccgacgccgcgcgcgaggcggccctggccgccatggatttagggatggtggatggtggtggcgtcgactgcctggctgggatcatgggtcattga

SEQ ID NO: 836 - DNA, 1047 bp, Chlorella protothecoides
  modified_base (76)..(85): a, c, t, g, unknown or other
atgctcatttgggttcgtagtggttctggtatcagcagatcatgtgttgatggtggccatcgaccggagtgcgcgnnnnnnnnnngagtcgttttggtatcagcagatcatgagttgatggtggccatcgaccggagtgcgcggcatccccatcgcgcggcgatggggcatttgaggctgtggccctcatgccgtgcccacctccccttgcgaccagcccagctccaccctctgctcccccacgcagccacactttccccctgccctgtcgctccacattttccccctgccccgtcgctgtctgatccctggaagaccctgggggtgggtcactccgctagcgaggaggagatcaagcgggcgcaccgccgcttggtgcgccagcaccaccctgacctccacgcccctggtgatgaggcggtggccgcccgcttcatctcgatccagcaggcgtacgagatcgtgatgggccgcgccctgggccgcctacccgagtccagccagcatggcggctggaacttccatgactggtgggcccttgggttctggagctttgcgcgacggagggccgatgagggcgtgcccaaggcgacggggccgcctcggcgggaacagtgggagcagcagctgcacctcctgcgccgcaaggcagccatcaagcgcggcgcctacgcccacggcgcggcgaccccgcaggccccggcccccggcaggtctgcgcacccggagcacgaggaggccgttccgggtacgaacagggtggcgcccgccgagcaaatgaatcgcgctccgggtggcggagcaccctctgccgctggggattcccagcctccagatgcagacgctgagtgcgcagaggatactggcgcggggggggaatgccttcagacgccggctgcggctgcacctggcatgcacagtgagcccccgccgccgccgcggatccctttccggagctcccaggacacgcgagagggagtgaccatccagctggcagggctgcgacgccgggccgggatcaagaaggacctgaccccagctccctga

SEQ ID NO: 837 - DNA, 528 bp, Chlorella protothecoides
  modified_base (508)..(517): a, c, t, g, unknown or other
atgttctgctcgacaaggtattcctggttgatcactttgcgtggagaagcgtctcatagctggactgaggtgcattgggccctcgccccagagttctttgccctgccgtcgcacagaggacagacacaagggacaggcaggaaagatcgctgtgatcggaggttgcagggagtacactggcgcccctttcttctcggcgatttctgcactcagagtgaggtcctcttgttgctgacacagttgcctgaagttcatgatgtggtggaatgtgaggcacaacttgaccctcgccctcaaatattcaaagacaggctaactcttcccctgctcaactgcccctgtgcgcactacccttgggaccaggtgggatcagacatcgcccatgtcttctgcacccaaggcgcggccaccgtgatcaagggctactcccctgagctcatagtgcacccctacctgccagccggcgaggacagggacgatactgagaaggcaagggagggaccaggannnnnnnnnntgagctcatag

SEQ ID NO: 838 - DNA, 201 bp, Chlorella protothecoides
atgcagcgtggacaggagtcatgggctggtgatgggacgcgacaggggccgcctgccgccctgctggcctgctatggatcatccctgattgtcaggaaggccgcacacagagcgtatgcatgcaaaggacgagcgatgggggccccagacctcatcgaccagctgggcccagtcgtggatgaccttgttggcgatcattag

SEQ ID NO: 839 - DNA, 396 bp, Chlorella protothecoides
atggtgaattcggcccccgccctggtcaaaggtgaggagccctgtggaggaggaaagcacggcgccatcgtcctcacacccaatgtggtggagttgggcaggctggcggaggccctaggcgttgaggccaagggcgctgacgctgcacgacggctcgctcgggccctggatgggccggcggtgctgcagaaggggcgggtcgacgtggcggctgatgcgcacggccagctggagtgcgaggagccgggctcgctgcgcagggtgggggggcaggtgagcattgtgacgaagatgtgggtcgtggagggcttgggtctgagtcggataatcctggtggcgtcccatttgctgagaggtgtatgccgctgctcctgggcatgtctcccacccgtctga

SEQ ID NO: 840 - DNA, 444 bp, Chlorella protothecoides
atgccgccgatttcatgtatggcgcccgcgcctggcctgaggcttggccccacagccgctcagggcccagcccctcaccccgcacccctcccatcgctgccttcacagaggggaaaccccgtggcgcgcctggcggtctcggacctcgccacgccggccatcgccgtgttcgacgcgcggtcgggcggcgacgaggagctgggcagggtcaccctgcactcgtccccggtcacggccatgaagttctcgccggagcagggcgccgtcatcagcgtggacgcggcaggtggggcctcggagcttgcgtgggtgtgcacatgctctggtcaggggctgcggccggcggtgcgcggggtgggaaagcgcctctctctggcgtctggatccctggccactgcccgtccgggccaggcagggcgttcgcctcgatgcacgcatccgtga

SEQ ID NO: 841 - DNA, 486 bp, Chlorella protothecoides
atggtacagcaccttgtcgcgcatgctggcacccctgtcctcctagacgcagccgggcccacaatgatctccgcgattgcatggataccaaagggagtcgcgaaggcggaactcgagcagacagtcttgtctcccgaggagctggccgcactgcgtgcacagcaagccgaagccggcacctccgatgaggagagcgagtgggaggaggggagcagcgacgaggacgaggtcatggatgaggaggccgcggtggccaaggctcaggccatggcggccactgtgaagggcctcacccccgacccggaggccagtggtcccgcacccggcccctcagacgaatccctcgccgctgcgatggctgagctggacatggaacactacgacgacagcgaccccgaggaggctgggaccagcagcatgaaccgcatccttggtagctctgggaacccaggtgggtgtgagactcttgtctggagcttggactga

SEQ ID NO: 842 - DNA, 2175 bp, Chlorella protothecoides
  modified_base (1097)..(1106): a, c, t, g, unknown or other
atggtggccgcacaggccgccaaggcggcagaggcgtcggccagtgaggcaaaggcgaggaggatcgtgcaggccaagcgcaagcagcaggagaggcgtgcggcggcagcagaggccgccgctgcggcagctgctgcggaggtcacgccccctgcgatgggagacggcgacgaccagccgaccgcggcggcgccaggtggtggccccgcccctggtggagaggtggctgacaacgacggcgacgtgaagatggaggaggcgggggtaacccccgcactcggcagcaccgccgacccaggctcgactgcgcctcccgccgcacccgcaaccaccgccgcgccggcagcgacggctggtgccgatgcccgagagcccatggaggtggatgagggcgcggtgaaggaggaggaggccggggagcccgcctcggctgaggcgacgcaggcgtccgtgcaggcgcccgaggatgggagcgacgctgcgcctggcgaggcgaccggggacgcggccgacgacgccacgatcgacgccgagtttgacgccctgcgccagcctgtcgcccttcaacgatgggcttgtgccatgacgatgacaggaaatcactgccaacagaggcctgactcccctccccccccccaccctgcccccactcaggatgcgtacaagccgcttatccccgccatggcgtccgtccctggcaaggacaaggagctgcaggagtacaagggcctgctgcagacggtgctgagctgcctgaagagcgtgctgtacacactggtggccttccacagcaaccgtgggctggccaccccgctctccttccctgtggagccctggagctctcggccaggcgacctggcggtggtctcccgcatcctggccgcgggcctgcccacgctggcgctataccgcgcctggccggcggccgcggcggccgacatgcgtgagcagttcgccgacctgttcaccgtgctgcaggacgggcgcgacttctgcgacgtgctcgcgccgcggctgcccgcgctgttcgacgccgtggcggcggacgcgtggtacctccccgtcgtgcgccacctggttgacggcgaccaggcggnnnnnnnnnntgacttctgcgatgtgctcgcgccgcggctgcccgcgctgtttgacgctgtggcggcggacgcgtggtacctccccgtcctgcgccacctggttgacggcgaccaggcggcgcgtgccggggtcaaccgccacatggtcgtggcgttgctgcgccaccttgtgggcgagcgcctgggcgcgctgggcgagcccggctccgcggaaggcgcgctggctgcgcagctgctggagacctgcttcgaggcgctgccgcgcatgcaggccgccgacgcggccaaggccgcgcaggtgccgcccgcgcccgcggcggggggcggcatcgaggacgcagtgctaccgcacgtcctggccttcacccagcacgtgtacgcgcgcctttctctggatgggcccgatgcagaggtgtgggagtgggatgtttgtctgtgtgtggtttcaagagagcaggttggagggggtgcacatgcggctgttgcgctcgctcttcttcgcgctggcgacgggcaagtttttgaaggtccaggccgcctttgggcacaccgggctgcacgtgcgcgtgatcgacctgaccctgggcatgatggcgggccccaccccctcccccgcggccggcgagctgtgcgcggagctgtgcctcctggcccccgcccgactggagcacctgatcccggtgatgccgcgcctggcggcggcgctggtcacggcgctgaagggctccgaccgcgccgccagcgtggcactgcgtgtgctggacgtgtgggtggactccttcaacccggagttcatcgagaagagcatggccgcacacatccgcccgctgatgcaggcgctgtggtccctgatccggccgccgcctgcgccctttggcgcgcgcgtggccgagatcctgggcaagatgggcgggcgatcgcggcgctggctgctggacccggcgcaggtggcgcacaaggccatccccgagtacggcttgcgcgtgatcctgtgcttccaggcccacacctccttcctggtgcccctggaccgctccatgcactacgcgctgggcgcgctggctgcgggcgagccgca

SEQ ID NO: 843 - DNA, 1413 bp, Chlorella protothecoides
atgatgcatgggcatgccggccaagaggtcggccgtgcagcgctcggcttgcagccctgggggcaaggaaggagagctttccactggcgtggtctgagacctgggcctctgcggtgccgccgtggtcccacgcacgtgctggttcactgctttgcgaccctcattcatgccgccatcgtcccgccctccctcccgtcccctgccatcgcacagaggatcatgtatgacgtgcacaagatctacaagctgtcgctggaggaccagagcatcccctttttcgagtggctgaagcaggtgactgcttgtcggtgtctgggggatggaggagcagggtcggcggtgcgtgcatggtgtgtagcgcgccacacccgtcagcagatgcgcatgcagtccctcggcccccttcctcctccccgccgatcccacccatcctcggctcaacgcgcccccccccaaaccccgctgcagctgtacgagtccatgcccgccgcgtacgagcgcttcatcggctcgcggctggaggacctggggccagccggctcccccccacccctggtccccgcccgcgcctccttcaagctggcggcggaggtggcggtgttcgtggtgttcctgctccagtcctaccccaagcgcatgcaccagtacgctgcgccgctgatcccggtcattgtggcggcggcgggcatccgcggccccgaccccggcgccacgccccctgccctggcgggcgcggtgtacgacctgcgcatggcccagatcaagatgctggccttcctcacggtcatggcacggcccgccaacctgcaggcggccatgctggagcaccgcgacgcggtctgcgcggcgctggtgcgcgtaatgaccaccgtgcccgaggtggcgggcatccgcaaggagctgatgatcgcggtgcgcaacctgctggccaccaagctacgcccggggctgctggccagcatggacgtcctgctggacgagcgtgtgctcatgggaacaagccgggcctgcatcgagagcgtgcgcccgctggcctgctccacgctggccgagctggtggccagcgtcaaggcggagatgaccctgccccagctgaccaccatcgtggacatcttcgtgcgcaacaccaacgactgcaccgcgcccgcggcgctgcagtccacctcaatgcgcctgctctacaacctgatcgagaccatcttccagcgccgatcaggcaagagggctgaggggttgtgggtgggggtgtgggtggggggggtgcgcgtctggagggggtttggatgtgagcgagaaggggatgggggcgcagggaccgtgttagactgggtctatgccgcgcggcgcggggcagggaccctgtgggaggccgtgcaggggatgctgtgggcttctgggcgcggagctcactga

SEQ ID NO: 844 - DNA, 1066 bp, Chlorella protothecoides
atggagcggtccaggggcaccaggaaggaggtgtgggcctggaagcacaggatcacgcgcaagccgtactcggggatggccttgtgcgccacctgcgccgggtccagcagccagcgccgcgatcgcccgcccatcttgcccaggatctcggccacgcgcgcgccaaagggcgcaggcggcggccggatcagggaccacagcgcctgcatcagcgggcggatgtgtgcggccatgctcttctcgatgaactccgggttgaaggagtccacccacacgtccagcacacgcagtgccacgctggcggcgcggtcggagcccttcagcgccgtgaccagcgccgccgccaggcgcggcatcaccgggatcaggtgctccagtcgggcgggggccaggaggcacagctccgcgcacagctcgccggccgcgggggagggggtggggcccgccatcatgcccagggtcaggtcgatcacgcgcacgtgcagcccggtgtgcccaaaggcggcctggaccttcaaaaacttgcccgtcgccagcgcgaagaagagcgagcgcaacagccgcatcactgcgtcctcgatgccgccccccgccgcgggcgcgggcggcacctgcgcggccttggccgcgtcggcggcctgcatgcgcggcagcgcctcgaagcaggtctccagcagctgcgcagccagcgcgccttccgcggagccgggctcgcccagcgcgcccaggcgctcgcccacaaggtggcgcagcaacgccacgaccatgtggcggttgaccccggcacgcgccgcctggtcgccgtcaaccaggtggcgcaggacggggaggtaccacgcgtccgccgccacagcgtcaaacagcgcgggcagccgcggcgcgagcacatcgcagaagtggcgcacgacggggaggtaccacgcgtccgccgccacggcgtcgaacagcgcgggcagccgcggcgcgagcacgtcgcagaagtcgcgcccgtcctgcagcacggtgaacaggtcggcgaactgctcacgcatgtcggccgccgcggccgccggccaggcgcggtata

SEQ ID NO: 845 - DNA, 435 bp, Chlorella protothecoides
atgcaggacagcctgcgctcgcacctgcgctctctgggcacggtgctgggccaggccaccaagaccgcgaccaatgcggcaatggaggtgtctcgagccgtcgcgacggaggttgggggggcacggtgcctgcaggactatgccctccaagcccaggtcgccactggtggaccccagggcctgtggaggatctactccgcccaggccaagaaatcaggtggggctggatgtctgaagacatatcagagtcatgttttgccttccatacctcttctgcggtctgcaggggtggtcagtgcatggatcctcgacaagcgggctctcacggaatctgacgcgggcggcggggggcgccagggcggcctcacccgcccgtccacaaagagactggaggccttcctggagcaatgcaggcgggatgtgcaggtgacttaa

SEQ ID NO: 846 - DNA, 696 bp, Chlorella protothecoides
cgcgggcgcgcgggcgcgccgcgccgccgcttcgtggacctggcctgcgttgagcccaccgcgccgctgagcaccgcgttgcgcctgctgctggagacgggcgtgtcctgcctgcccgtggtcgacgacgcgcgcactctgctggacgtctacgcccgcgccgacatctgcatgctcgccaagggagcgccggccctgcggtgcggagtggtaaacatccgacgctctgtctgctgcacggcgtggaagacgcaggacccacatccagcataccaacccatgccccccctcctgtcgcgtgtgcagggcaatgcctacagccggctgcagcaggaggacgtgacggtagggcaggcgctgactctggcctcggcccccactgcgcccacccaggtgtcggcctggtcgcagcaggcgctgaccctggcctcggctcccaccgcgcccacccaggtgtcggcctggtcgcagcagacggccaccattctcctgccgtccaccttctcacacgcgcagtcgcagcacctgggcccaaagcagcgcgtctggatctgcacggcggacgactcgctccgcaccgtcgtggagaggctggctgtcccaggcgtgcgccgcctggtggtggtggatggagccacccaccgcgtggagggcatcgtgtccctctccgacgtcgccaccttcctcatggtctag

SEQ ID NO: 847 - DNA, 387 bp, Chlorella protothecoides
gggggaggggtggggttagggtgggggtggtcggaaggggggtgcatcgagcggtggaagtgctgctctggtatagaggaacgaggggcagaaactggaggcaggcagctcccccttcccttaccacttgctctcccaaaccctgagatcccaggcgcctggctcacctcccccgctcctggctcacctcttccgtcctctcaactcatcctgcaatcacccacaccccgcagggcggaggtgagcgacatcgccattgcggtgcgtgaaggtgctgacgcggtcatgctgtcgggcgagaccgcgcacggctccttccccttcaagtccctggacgtcatggccatggtggccaggcgcactgagcgtgccatgctcagctacgag

SEQ ID NO: 848 - DNA, 504 bp, Chlorella protothecoides
atggcctccagccgattctggagcatgagccggccgcgggcaggggcactccgatggccctctcgtcatttcccccacctggccctcacggcgacaaccctcgccgccctcctgtacatagcatgcactcgtgcaccctctccctgcggatcccagtcgcccgccgtcaatgcggcgctcctcagctacccgccccatggccccggggtgtcgagccaaaacgccaccttcgagcactttaagcgccgcagcgaggacgacctgcggcgggcggcagccctgctcgcctcctggcccgagaacaagccgaaggcggcctactttgtgttggcacgacaggccgaccttcagggcgtcatccagtctgtgggcgacctggaggcccgcttcaaccgcagggcccgatacccatgtgcgtgtttccgccggcatggaggggacttgttgcgccacagacctcgctggtgccgcctgggcttgggggctgtaggagtggagaggtga

SEQ ID NO: 849 - DNA, 1242 bp, Chlorella protothecoides
atgggcgctggggggcggcctgcctgcctgcccgcctgccgtcgcacggggttggctccttccgaagtcggaactgcgcattctgcggcacgccgcctcgctcaagggccattgccacctccacccacgctcgcaccatgtgaaccctcgcagaccaccaccgactccgacataacggggcgggtggtggaggactgcgtgcgttggatgagcggtcacgccctacaccgggagggcctcttcaccgaccctggccatgtggacggcaagaagctcctggccttgcgcaaggcgtacgaggccggcaaacgcccccttcgccgcagctgtggaccccatgaccccctcactgtgagctttgggagtaggcagtgggggcgccgcgtgggcttccagcccataccttgtctttgttccggctcttacagcctcgatccttttcaaagtcgctcctctcctcgccccggtcctgcccaggtggccaacttcctcctgctgtggctgagttctctgcccacgccccctgtctctcgcggaacggccagcaggctgatggaggccgccgcgcaggcgcccggcgcgggccccggccgccaggagctgctgcgccgcgcgctgcgcggcatggacggcgcggcccaggacaccctgtacgccctgttcgagttcctgcaccaccactggatcaaccagcgcgacaggaggcaggccctgtgccagctggcgcgcctgtttgggccgctcgtcgtgggcgcccggcgcggtgcgacccccgcccagcccgcctgccacgcggcgctggaggcgacggcggcgctcatcgccgacttccgccgcctcttcgtccagcccatgaagctgcagcgctacctcgccgacctcgacctgcctgatgagtgcggtgaggcgggcgcgggcgccactgacacgagcagcgagacggcagacgccacgtcaggactggagcaggagtcctgccccgacccagagctggtggcagtattagatggcatgctgggggacatcctgggcgtatccctggccggcgcggccaaggcggccaaggagccgtggtcgcccaccggcatcgcggacgctggcgcgtttgagctggacggcatgtccgagagctcctccttctccagcgcggaggacggggaggaggacagcccccagcgccggctctggggctcgcgggggggctgcgtcgccggcggcccgccccttcgcctcgtggtgtag

SEQ ID NO: 850 - DNA, 873 bp, Chlorella protothecoides
  modified_base (288)..(297): a, c, t, g, unknown or other
atgctccaaaccatgctcgcccgccccacgcccccattttccgcagtgagcgacctcctcttgtggcgggacccagttaagtccggggtggtgctgaccctcgccacgctggccttcgccttcctgaggtacgcaaagttcaacgcgattgtggtcacggcctacaccctggtcgccatcgtgatcggcagcttcgcctggaactcgttgcgggccgtccggcgtacctctgaggcctctcagactccttttctatcagttctgaaccctgccaagtgccccgacccnnnnnnnnnngtacgcccagttcgccaacaagtgagttggctggtaacgggttggaagggggtcaacacccgcgcaggacgtgcgggttgcggggcgtccggcgtacctctgaggccttcagtctccttttctatcagttctgaaccctgcgaagtgccccgaccacgaactgtgtcccgagttgggcagatgcatggggcctgccactggtgggcccccgtgccggtacccgaggtgctgaagcgtggagtgactgagcaggaggtccaggccgtggcgcagcgcggcaccgtgctcatcaaccgcgtgctaggcttcctcaagcgcgtgctgcacctcaccgatcccatcgccaccggccagaccgtcgccgcgctgtacgccgtcgcccgcattgccggcctcgtgtcgcccgtgaccctggccttcgtgctcgtcctgctggcgttcacgctgcccaagatctacgagctccgcaagccccagatcgatgacgccgtcgccaccctgaaggtccaggtgagtgggagacagggaagagggatgggagcccatgtcggggcaatggtgtcgagggcggtgtga

SEQ ID NO: 851 - DNA, 717 bp, Chlorella protothecoides
atgcgtgtggacgtcgaggggaacgagcgcctccacagatttggttgcctccaggctcaaccccatccctcgcctgagctcctgatgtccggccagcgtgctcttcccccattcacccttgacagggacgaggtgttctggagcaacctgtctgctgcccgcgccagcctgaaggactggcctgccgcatcggcggccgcggagacggccatcggcctgaagccacgctgggccaaggcgcatgcgcggctggcggccgcctacactggccaggaggaccatgtcagggtgtgtggcaggggagtatgtgtgctggttgcctgtttttctgttcgtcccccgcctgccaggcacctgccggagcatcgaggttcaaggacgagggtgctcgacccccctccaggcgttggaacggcacctgccggagcatcgaggttcaatgacgagggtgctcgccaccccctccaggcggtggaacggtatgagcgcgccctgcagctggagccctccaacgggcagttccaggaggcgctgtcgcgggcgagggtcgcggcgggcaagcaggaggccgagggcaagcaccgcttcaagaggaaggcctccgctgcagcggaggagaggccagtcgcgctggccgggtcggggaaggccccggtcaagaaaaggagcacgatcctttccttctctgctgacgatgacgatgacggggagacttga

SEQ ID NO: 852 - DNA, 720 bp, Chlorella protothecoides
atgtggcttctccggagctctgccacccgagctggcggcgttcagtgtcggctggcctgcatcccgccccgccccatgcccctccctcgccaccggcctggaccccccgaactcacacaggccgtcctgcgcgtgcactcccgctccgcgcgcgggcccgacgagaaggactcgagccggcgcacgcacagcgcggcggtggccctggaccgcgcgctggacgcgttgtcggcgggcctgctggacttctggcgctggtgcgagttcgtgggcgaggccgcgggcctggccgcgatgcacgccgacgcccccgactccgccgcgcggcgctgtgtggccgcggtggcgcgccagctggagcgcatgctggacacgagcgccaagggcgcgcagccgcggggcgacgaggcgctgcgcgtgctgacggggttcatgagcagcctgcgcaacccgacgctggcgcggccgccggcggtggaggacatgctgagctggaacgtgctgaccccgcactacgaggaggacgtgatgtacgcgctcaacgcggccagcgtcgcgcgccacttcgacctccagccctccgccgccacgggcatggcggacctggtgcgcgagaacgaggacgggctgtcggtgatgcagtggctcaagtcggcctacgcgcgcgagtgggaccacctgctggagcgcctggggcccgcgctgaatggcctggagccc

SEQ ID NO: 853 - DNA, 1227 bp, Chlorella protothecoides
  modified_base (443)..(452): a, c, t, g, unknown or other
atgagtccccagatgaccgccaaagttttgtctgtccctgacgagccgtcagagatcagcgctttcccttcctccccggccaccacacgagctgaacgtcagaaacccagtgcgctccctggcactcccttgatgcgcagcaggcgtgcacccatgccccatcgccgccccgtcatgaacagttttgggagcttacatgcacctcgggcgcgccggccagcggggtcactcctgggcgggttcgggggtgtggaaggctgcgaggtaggggtgagccatggcctccttggcggtgagccgctcagcgtggtcgtatcgcagcagcttgtcgatgaagtccagggtgtctggtgtcaccaggtgctggttctccggcgtcacaaaccgggtccagggcttgcgggagtgcctgggattttggtgcggctcccacctctcgcagnnnnnnnnnngctgtcgccaccacccatcacctcgagcctcagtgcggctcccacctctcgcagcctcctcaaatcccttttgcccctgtctcctccctccctccctgccatgcccccaccccccccttcccccccccacacacacactcgcttcttaaataccccactccgcccacctgccaaccatggcctccagctgcggatccagctccaggccatacttggcaaggtagcgatagaagtcgtcggtgcccagcaccttgcagatcttgaccagctggtcgtagttgtcctggccgtagaagaagggttccttgcggaagaccatgccagccagcatgcagcccaggctccacaggtccagcgcatagtcgtagtcctgcaggtccaccagcagctcagggcccttgaagtagcgggacgccacccgcacgttgtactccttgcccgggtggtagaactcagccaggccccagtcgatgaggcgcagcgcgcggcgctcgtggtcgatcatgatgttgtgcggcttcacgtcgcgatgcatgatgccgcgggagtgggagaagtccagcgcgcgcaggacctcgtggatgtagtaccggatgtctgcgtcgcccagcgtggggtaaagcaccttgaagtcggtgttgttcacgtgctcaaagatgagggagggcgtcttggatgccgcatcgcgcaccacgtccagcagaccgatgatgttggtgccgccccgcaggttctgcaggatcttgatctcgcgcttgatctgcaggagggttaa

SEQ ID NO: 854 - DNA, 804 bp, Chlorella protothecoides
atgaaaaggaacagccagcatgcgcaaggcctgaagctacccttcccctcctcccgcaggaaccaggatgactacgaggtggtccggaaggtgggccgcggcaagtactcggaggtttttgaggggatcaacgtgaagaccaaccagacgtgcatcatcaagatcctcaagcccgtgaagaaaaagaagatcaagcgcgagatcaagatcctgcagaacctgcggggcggcaccaacatcatcggtctgctggacgtggtgcgcgatgcggcatccaagacgccctccctcatctttgagcacgtgaacaacaccgacttcaaggtgctttaccccacgctgggcgacgcagacatccggtactacatccacgaggtcctgcgcgcgctggacttctcccactcccgcggcatcatgcatcgcgacgtgaagccgcacaacatcatgatcgaccacgagcgccgcgcgctgcgcctcatcgactggggcctggctgagttctaccacccgggcaaggagtacaacgtgcgggtggcgtcccgctacttcaagggccctgagctgctggtggacctgcaggactacgactatgcgctggacctgtggagcctgggctgcatgctggctggcatggtcttccgcaaggaacccttcttctacggccaggacaactacgaccagctggtcaagatctgcaaggtgctgggcaccgacgacttctatcgctaccttgccaagtatggcctggagctggatccgcagctggaggccatggttggcaggtgggcggagtggggtatttaa

SEQ ID NO: 855 - DNA, 756 bp, Chlorella protothecoides
atggatgtgcaagaagtgtatactgatcctggcgtgcatcgctggcattgcacgggagcagtgctctgtccaagaaggtttctacaccctaggcaaccagccacctcattcacaaacggtcattgccctgacctcaactgccaacctcacccctccacagtcttcccgcccgaccctgagaagaagctggacaccctgactccccgccttatctactgcctggtcaacggcctgggtcttgcgtatgcgtgctatcgcatctacggcatgggcctgttccccacccacctcaccgactgggccagcacgattccagcccccattgtcaccgaggatcctgacacagcccagcatgtcggccctgtctctgtctaccagcctcgcccatgtcggaaggttgacccaagcctcctcccgcacgcgcacggcgcacacgaggcccgcggcgcgtcccaggatgctcctctccagggcatcggcggatgtggacgcggacggcatcgtcagcggagagtgggaggcctcttggtgagtgcgtgcgcgcatggagctccgaaatcaaaccagagtaatagatccttgcgtcccgacaaccctccggcgcctctccctgatcaggtcactcgcgagctacgacgatgttcaggagtacttcaatcgcagggtgctgaaagagggccagcaccctaccacgcgcctggcgtccgtcatgtcggtgagggggtcccgagggaggctgatgaccatcgtgagtag

SEQ ID NO: 856 - DNA, 738 bp, Chlorella protothecoides
atggcagggaatacatgggtagcatacaagcgcttgccctgggatatttgcaaagttcagattcaaacgaggctctacagattcgatgcatcctatccatcccatggtcagtcatcaggtgtgacagggcagggaagcagattaccatccggcgccctccaggcagggttttgggactggcccatgcgatgcctcttcgtcaagccgaacccagtgaagtctgtccttcggcaagatagttctacaaagtttggtgtactgcatatattcttattaagtgagagcccttctggagacatccatcgtgcttattggcgagccatggccgagttccgcaagttcaaggtggacctcgactccaatagcctagtgacatcaaagaagacggttggagatcctatagggttcgatctatcgttcgcaagggatcagtcggagctttccggcgcttcatcgaggcgctccaacctcgcaaaccgccaggcggccctcttcagcctggcgcaaagcccttttaagaatgttgcaatgatgagcttcatgatgtggatggccggcgcccagctccacctcttttccatcatgaccactgcatctggggtgtaccaacccatatccgccatcctcaagtcgggcgaaggtaggggtacggtgctgcatttggggcctatgttggatttggggagtctggagggcaggtgggccctcggcaaggaacaacgcacattgagtttctaa

SEQ ID NO: 857 - DNA, 438 bp, Chlorella protothecoides
atgcgcggcatggtggactttgtgaccagcaggggcatgctggacgtggcctttcggccgcagccggccttcgccgccgtcaagcgccactacacgcacggcttgctgggccgggcgcgggacgggtcggtggtggagctggagtgcctgtcccagctgcccgccgcctacccacgcctggcgcgggagggggtgggccaggacgaactcctcgcccacctcatgttcacctacgagtacgtgttcaaggtgctggacacggcgccgctgccggggggaaagacctacaagatcgtggacctgggggcgctgagcatgggagacctgcgctccgagggattcaagttcatcagcaaggtgaggggggcgcggcttggggtggagggctatgctccaccgtggcgcgacttcgatcaacgaaccccggcgtcgccatga

SEQ ID NO: 858 - DNA, 1284 bp, Chlorella protothecoides
  modified_base (40)..(49): a, c, t, g, unknown or other
atgcatggactccttcctggcatagtatgctctacaaacnnnnnnnnnntggccagcggctcccagctggccacctggacgccgcatgcctcgccccttgccgccctcgccatcgtctccggcgaggctcatgtggccaccgccggcaagggcgagcgctccgccactgtctggcggatggcccccggtcgcaggggcaaggccatgcgcttcacggcggcggccaccctgagcctccgggtcccggcgcgggcactgagcgccgccggcatgcagggccaggaagggggcgtggtcgtcgccgctctgctacaagacggcagcctggaggtgtttgtcgccgccgagctgcccacgaaaaagggactgccggcggtgcaggcgacccgcgtcgcaaacactggcgagggcgcgggggtgctgagcgcgacgataaagtccgcagacgcctcgggtgagtgtgtgtgttttggcacggggaagatgggaatgcgagtgactggctggcgggcgtctgggaggggctggaccatgggaacagcgtacagagagtgtcgtgaaggcgttctcaacggatgcaccctcctgctcgcgagtgggccggctgccaagccccacttccagacgcagcatgttgccttcagcacagatgccagcgcacccacaatcatccccatcatgagcgacgaggtgggtgggatgttacacggggactggggtgccttccagctgacaccccagcgcattctgtactgggaatcacaaggtcctatgctgtgcgcagagtgccgagggcatgggtgcagtggtgccagcgtgcccatggttcaagtcaggagcctgctggtgagctcgacagcagccatcgcctccacggcccccgctgcgggcccaggaaagaagggcgtgagcatcgtgggcgtgtctgacgtcgcgcggtccatggtcgccaccccgtctggccccggcagcaagcgcggcgctgcgcaggcgtccgatgacgaggacgagtccatgcccgaggtgagggggcggcaggggcgctttgacccaccctggcgccgcgcgccaacagggtcacaggcctcctttcttcaaccattcccgccccaccctgctcctccctcccaggcgctgggcggcagcgaggacgaggcagcgcaggccgccgaggcgggccccaccctgggcgagcgcctggcggcgctgcaggtcagcgccggggtcgcgcccgcccccgcccctgcgcatggcacgggcctccccgcccggccgtcggcggcc

SEQ ID NO: 859 - DNA, 927 bp, Chlorella protothecoides
  modified_base (863)..(872): a, c, t, g, unknown or other
atggctccacccagccccctgctggaccccacccagtcccagctggcgactgtgtcgggcgatggacgcctcaaaatattcggcgtggcatcacagcgcctgaccgtagaccttaccccggcagtgagcggcgccatcggcgcaagcggggcatccgtcgacatcatcaccagcatctcctggggcaacaaggtgggccttgttgtgttcaactacttcgtatgcaagctaagaagttccaaaggctgcaagggtgcagtagtctgcgtgtacgaaatcgacaggctttggggagactggatgatagcacttgcacatgcatccctctccaggggcagcgtttcagtcggcaatcaacacgaaacccaccaccttcagggtcggattgttgtcggaacagcctccggaaccgtgaaggctgtggactctgcatcgacgtcccaggcctggaacacaacccccaccggtctggagggcggcgtggcgggcctcgcccactccccagatgccaggcagctgctggtggtgggcagggtgggcggtgctgccgtgctggacgctgccacgggggcgggcgtctcctctttccaggtgaggtccaccgcatcggtttcaggagtggatggtggaagcctgagtggaggaatgaggagacatggagagtgggagggttctggaggcccgaaggggccgctgacgggggtgagcgtcctgtccgaggggcgcgccctcatcagcggcaccaccacctccctggtagacatggccagcggctcccagctggccacctggatcccgcatgcctcgccccttgccgccctcgcaatcgtccccggcgaggctcatgtggccaccgccggcgnnnnnnnnnnagctcagagtcctgcccttgccagagtgagggagcgtggggaggcagaagtttga

SEQ ID NO: 860 - DNA, 1152 bp, Chlorella protothecoides
  modified_base (647)..(656): a, c, t, g, unknown or other
atgcagggcgggaggtggggctgcatgcatgattggaagttcctgccggccggcactggaagggaggggggcccccagggcgcaacaattcgacctttctactgccccgctcgcgaccctcccacgatcgggcaacgatacgagatgggcatgcatgcgcgtggatccgtgttcagtaagctttgcttcacatccaggacaccctccttccggtcatatagggcgaggccatctggggacatggctgcgtgccaaggcataggcgtgagccaacacaggtcgctcatcgggacatacggacggtttcctggtgacccattcgtgcgtcgctccggaccatgtaatatgactgctcatcgcggctcccccacaaccatagcaggcggttcagcatggcgcatgcgacccaggctctcgcctgtgcgcgcccaccctggcacgccaccagtggatgacggggagctggtcacgccagaccccgccccggaggtccttcccctggaactgggggatgcagagctgagggaggccacgggcctgcaggacgggctggcggggtccgacttccccgcccaggacgccgccgacgagcgggcggaggaggccgccgccgccgcggctcaggacgtggacgccgcggccacgcnnnnnnnnnntgacgggctggcggggtccaacttccccgcccaggacgccgtcgacgagcggtcggaggaggccgccgccgccacggctcaggacgtggacgccgcggccacgcgccactgggtgtcgctgcccagcctgcccgcctcgctggcggagcggcccgcgctgcgctacgcggcactgggcctgggcggcttcctggcgctcaacgtggtgctggttggggtcaaggctctgcgcaaggcgctgagcccgcagcagcgccggcaccgcaccgtgaacaagaaccagctggtggtgaccacgctggcgcagtacctgccgtccaaccgcgcggggctggcggggagcatcctgggctccctccgcttccgcaccggtttcaacaatgtggagatcttcaggaagtacctctggtacctcctgcgcgagcgcgccttcaagcaggaggccgtggacgacctcctggccctgaaggccgccctccaactcacagactctgag

SEQ ID NO: 861 - DNA, 1050 bp, Chlorella protothecoides
atgctacggagtgtgctgggcacccctagatccgagtcggacggcaacctgctccagctggcggagaagagcaatggggaggagagcgggggggacgaaggccccctcgccgtcgctcccggggcaaggcgcacggcagactcatctgtggtggatgatgacggggaggagcccccccgggccctgcccaccggcgccgaggcggtaatcacccaggtgaacacccgacagggagcccctaccgggcctgccctgggccagatggtcaccctcccgtcgacaccagaggacacctcggacctgcgggcctcctggaggaacaaagtcaggtggaggccccagcccatgcttcgaccacccgactccccctcacacctcctcacctctccaccccctcatctccctccggcccctcccaacccctttccccctcccatgattctacccaggaacatcttctgctgcctggtcccagggcccggcgaccagtacacgcggcaggaggagggccccgtggtcatccgccccgtggcccccccacccccctcctgggccgacccggtcatcggcccgccctcccccgccgacatcggcaagaagtgcctggtgctggacctggacgagacgctggtgcactcctccttccgccccgtggcctcccccgactacatcatccccgtggagatcgaggggcgggtggtggacgtgtacgtgctcaagcgcccccacgtcgacgccttcctggccgccgtgggggaccgcttcgaggtggtggtgttcaccgccagcctgggcaagtacgccgacccgctgctggacctgctggacccggcgggggtggtgcggtggcgcctcttccgcgaggcgtgctacccctatgaaggctcctacgtcaaggacctgcagtgcatggggcggcccatggagagcctgatcatcgtggacaactccccccactcctacgtgttccagcccgagaacgcgctgcccatcggcaccttcatcgacgacccagaagatcaggcgagcgggaggtatagttttcattga

SEQ ID NO: 862 - DNA, 465 bp, Chlorella protothecoides
atgccagacgggcctgtcatcatctccccagacggcctcttcccatccctgtaccgggggggtccgaggcttgccaagccccctgtggcgctgaatgcaggtgcagtgcctccgcgcctggccgcctgtcaggatcgacagacccactcgcgcctgccatgcctgcaggtgatcctgcggcgcccccacgagttcaagatccggtgcctcgaggacatccgctcgctcttccccccggactggaacccgttctacgccgggtttgggaaccgggatacggacgagatctcgtacctggccgtgggcgtcccaccctcccgaatcttcatcatcaaccccaagggtgcgctggggctgggacaggcatcagacctgggctcggtggtttgcatgccatggtcgaagtggcttcactctgccttcctgagcttcgggatgatccacggcacatctcacagtggctaa

SEQ ID NO: 863 - DNA, 2703 bp, Chlorella protothecoides
  modified_base (2186)..(2195): a, c, t, g, unknown or other
atgggtgggagcgtcatgcgtcattgcacccctcgacaaaatacatgttgggcaagccttcttgcgcatccgcttgagggaccgaggcgacagagacttcacacagcagcgccctgcgctgcccgagtagtctcctcccaccccccttcccctcgcacctgcatcttggcctgcgtgtcaagcctggacaccactgcatccagcctagaggccagcctgaggacgtactgggcaggtgggtgggtggtgaagctgggcagcatgtggcgcccaccacctcgacgtgtgattcgcaagggacatacctttttcgatggccttcttgatctttatcttttcggccttctcctctgtctcgcacttcctggaggcccgcaccagctgcttgctcgtgaacttgaggttgaagatctggtccagcagcttgttatccgccgaggaaaacattataggtatcggaacgggatatctggaatgcgaggaagggaaatgggtgtgatcgccttggtaaagcacaccctcgcgacgcgctttcggagggagcaggggttctccggagcgagggcgcgaagccagaccagagcccagatttgcgatcgagggtctcggagctcatatgggcggtgggctccctgccctctgggaaacattcctgacccgctgatttccacgctcgtgcacgacttccgggcgtcaggcatgggagtcggcagatcgccggaggttgctggcacgaccactggaccagtggtcccaggccggggcacctgtctccctcgcagagcgcgcacacagcggggcccctccagggcacacctcatctcatgccgagcctatacaggcaccagaggggcgcctgacggcgaccccgctgccaccgagcgtgtcctgcgttaccctgacggtcaggagaggcggatccggtaccccctccctacgacggagacgtccgaggagacgctcgtggaggcttgggagacgctgaacgcatacaagtcgtccacaggctggagccctcgggcccagcctgccctcagggacgaggtgaggcctgctggatgtggggccgacctgctgtggtccagcgtgtatcgctgccatcttttggcagcatcgtgtacgaggcccgtggctgactcacccacccacctcccacccacacaccccgtaccctcgccccaggccaactcccaggtgccaaactcgcccctggccctgctcaagcgcatgacatcccccgagttcctggcccgggccgtcgccgaggaggagaagctggagcgaagctaccgcgtgcacgagggctgcccctggccggccccccgccccctctacgtgctggcgctgagcgagggcgggccagcaagcggggcgcccggcgcgctgcacacgctgcgcacccgcctgccgctggcgggcgtccaggacgagctcaaccaggtgggtgtcgtgcggagtttcctgctctcttttgggtggctagggcttgatcaagctagaacgggggacagcgtgcaagggcatggggcctgcttggcgagaagagtggctggcaggggtcaggtctcccgttccagcagttcacgcatctcccccgtgacccccaccccgcccaacatcgcaggccatgggctggagcagcccgcgcatcgcctgcagccgggtggcagacggcgtcgtggctttccggaccctggtggcggccgaggcctacgcggcggagctggaggaggcgcgggggctgccccacgcctcagtggcggtggtggagaccgcgtcgcacgccctcttccgcagcacggccgccgcacaggcggtcgtcgtggtgctggccgacgaagcggacggcagcgggccgcccggacccctgcagctggcgggggcgctcctgcgccggacccgggaggagcgcctcaagtagtcctggccagtccgctcctgtccaaggagagacagcagcagcgcgcccgcggccttgccgctgtttgcgcaagaatgaacccccctggatgtgcacacgtcactgtaccccgccccgccgtgcccagcgccggcttccctgtatcttcctgcacggcgtctgcctccatttttcccaccccctcacgatccagagggcctggcggagcccatggcaccgaggaggaggaggaccactcacccaagcccccgccctgggacaagcnnnnnnnnnngcaccgaggaggaggaggaccactcacccatgcccccgccccgggacaattgcgtgcagcatcagggggggggcgcggcgcggcgtccgccctcccccaccaccaccaccttgtcacgcgtggtggcatgcatgagtcccctgaccgccaccaccagccaggtggcaaatggcggcaggttgtgcagctccatgacgtagaggcggcccgggaagtgctgattcagggtggtggccacgtagcgcaccaccggcaggatgcgggtggaggacaggacgctggccccgccggcatccacgcgcaccaccaggtcctggggccggccctcgccggggacgtccgccaggcgcccctccatcaccgcgccctgcaccagcgtcacgatgacgtcgccgtaggcggccgccgcggcgcggccgcgcgcctcgtgcgaggccgcgcccacgcgcaggaccaggacggggcgggcgccggggccttcgtccccgggcggggcccagtgcgcgag

SEQ ID NO: 864 - DNA, 984 bp, Chlorella protothecoides
  modified_base (883)..(892): a, c, t, g, unknown or other
atgcacgatgctgtggctgcctggagttgtaatcatggtctgtgttgggggaagtgcctgacgctactcccattcttgggcactccaggggcacccaaggccacctgccggtgtgccctttcccgagtgggtggggggaccctttgccgatgcctctatcgtccagccgccacccctcaaaccatcgccgcccaggcaccgcccctcaaatcaacgcagccccgccggcggcgctcaccccaggcaccgccccaccccaattcaacctcttctcacccccccctcctcactgcaggagttccggcggcaggccagcgtggccgggtcggcccgcgaccgcgccgacctcctgggcgccgctggcacctccggcagcgcgtcagcctccggcctgggcgcgcccggctcctcgatgggcctcctcctgcgcgagcgcggcatggtggccagcagccacgccgcgctggacgacgtgatgggcactgcccacggcgtcgccgcggggctgggccagcagcgggaggtgttcgagggcgtgtcaggcaagctgggctctgtgggcgccgcctttcccgtggtcaacaccctcctcaacgccattcgccgcaagaagaacaaggtgggttgtttttcattgcaggagggggggggggttgtggtgatgtgcagggatgcatggcggctggggatggaagggggggggcggctgcgttcttggccgctgccgtcttctgtagagcctgtgacatccctcaccatctagccctgcccgcatacacacaggacaacctcatactgggcagcgtggtggctgtgtgcctgctcttcatcctgatctactgggtcaacaagtgcccgtggtccagactgaatagctgccatnnnnnnnnnnggagtacggacggcgaaggcgcggctggcgatcggttgtctcgcccagatgtggcgcttgcttggcgacaagttgcccgtggtccagactga

SEQ ID NO: 865 - DNA, 165 bp, Chlorella protothecoides
atgcccgccgtcctttcaacagctcgccatcctccacgcaggtgcaagcccaagaaatgccgtcaggagtgcaagaagagctgtccagttgtcaaagttggtgagctggggcttcggaactggccgacacctagcggcagaccatgggcactagatatggcataa

SEQ ID NO: 866 - DNA, 573 bp, Chlorella protothecoides
  modified_base (495)..(504): a, c, t, g, unknown or other
atgctctcaggacctgatcacgagccccagctgcatgtcccttgtcttcaaccctcccatcttaccttctcccttgcagcacccaaggtggagacgggcaaggagaaggtgaccctgcagcgggacgaagtcgtcggcgaccgagccatcggcgccggcatggcgggcgccctcgctttcctccagtcccgcggcgatctggacactgccgtggagtggtctgggcggacgaacgactccaaaaaggtcaacgtgagtggccaaggggggagggatttggactgttcactcttgatatgcagcacctcttcagatattgagcagacctgtaattggtcccctggctctagtgttgcagctttggcaccgccatgtcttcctccaccccctcttcccccaccctctacccaacacgcagatccaaggcctagacgaggtgtactctggcggccgcaccgaggacaggcaggcgctgagcgtggaggtagcgcttannnnnnnnnnttggttatactcgtgtgcaaggggaggcatgttcctcattccggcgttccccttgccgggctggaatga

SEQ ID NO: 867 - DNA, 954 bp, Chlorella protothecoides
atgtcgagacgaggaccggtgcctctctttcgacagatgacgacaattcatgcggagggggactccccgattgcgcgccctccctgcaaaacgcacaatcacccatcgagaccatttttcggcaaatccgctccaagctggctgatggccgcgacgctgaagcttcagactcggagacttcctcccgaagtgaataggatggccgcgacgctaaagcttcagactcggagacttccccccgaagtgaatagggctttgtatgtgcgcaacctgccgttcaacatctcggcggaggaggtgagggggagggtctgcctgaaggtcccatttggccctgcatgcattccagtcgctcatccacccagacacccaccatcccccgagccggcgccctcccaccccccccagatgtacgaaatctttggcaagtacggcgccatccgtcagatccgtgtcggcagcaccaaggagactcggggcacggcgtatgttgtgtacgaggacatctttgatgcaaagaacgcggtggaccacctctcgggcttcaacgtccaggtgtgctgggcacagaggcaatgggatgggagtggggagtctgtggcctcattttcacggcctgcgcttatgggagtgtgttggcgtgcagggctgcatgcctcaggggggaaatcggtatctcatcgtgctgtactacaacccggccaagatgaaggcaaaggccagcctgaaggagcaggaggagtcgctgcgcaagatgcaagagaagtttggggtggatggccagcagcaccctgcgccagcgcgatgaggcccctcctggatgctgcctttgctgctggtgtcgctcccctgcggctttgctgggtgagggcaagggtcagggctggatctgtggtgaggcgcctttccctgggctccaaatgcacccgtgcttgcacgcatgcgggcctttga

SEQ ID NO: 868 - DNA, 441 bp, Chlorella protothecoides
atgtgcccggcgccaacgacgtcatcttctccacccactgccagaacgatctgggcctctccaccgccaactcccttgctggtgggtgcagggcgttttgagttgctgtgcagggttgttcaagggttgtgggatttatggacgtggggatcggtgggttgtgggatgtatggacgtggggatcggtgctgcgttgcaaggctgttgccgccctttggcgtcttgtgcatctttggggcccacatgtggtatgagctgatgcctgggcaaccaccctgtccgcatgctgccttactcaccccaatccctcatcaacccggcgctccctcaggtgccatgggcggcgcgcgccaggtggagtgcaccatcaacggcatcggcgagcgcgccgggaacgcctcgctggaggagatcgtcatggccatcgccctgcgcgggtga

SEQ ID NO: 869 - DNA, 696 bp, Chlorella protothecoides
atgcgcatcgcctgctccagaacatgcaagcagacccctgaacccgcaccccgcccccccgcgtgcaggtgtggacgtcatcgaggctggcttccccatcgcctcgcccgacgacttcgaggccgtgcgctcaattgccatggaggtgggcaacaatgtggacgccgacggctacgtcccggccatctgcggcctgtctcggtcgcggtgagggggggaggtggcggacttgtggggcagtgccctcatgaacgtgccgtgcttgtgttatccaagctgtacaggccaggagccatctttggtggagcatgttgcgcactgcttgcccctcgtatgagccactaccattgccctcgtccacacgccaagtgcaacgccctgctcctccccatctccccatcacgcagcgaggccgacctggagcgggcctgggatgcggttcgccacgcccgccacccgcgcgtccacgtcttcctggccacctcgcccatccacatggagcacaagctgcgcatgacccctgaccaggtcatccgccaggcggtggagagcgtcaagcacctccgctccctgggctgcaaggacatcgagttctcgccggaggatgccagtgagccgcgggtgggggaggggtgtgtctgtgacgtgcactcttgttgggtgggtgggaatctgcggggttgtgcctcaacctga

SEQ ID NO: 870 - DNA, 2742 bp, Chlorella protothecoides
  modified_base (147)..(156): a, c, t, g, unknown or other
  modified_base (739)..(748): a, c, t, g, unknown or other
  modified_base (808)..(817): a, c, t, g, unknown or other
  modified_base (944)..(953): a, c, t, g, unknown or other
  modified_base (1730)..(1739): a, c, t, g, unknown or other
  modified_base (2616)..(2625): a, c, t, g, unknown or other
atgatgagaccggcactcaagccaagcaacacctttagttggttcgcaggtggtgttttcgtcatagcgctcatcagtgaggctactgcacggatcagcaatacgtctgggatgaaaggaatcccctcactgcaggtgggtgtaggnnnnnnnnnnttttgttcatcaggggaaggcctgcaagggtttcagcaatacgtctgggatgaaagggatcccctcagtgcacgagggtgtagagtgattgctgccacgctcttaggtctcaagattatcgatgcctcgatgctccagcccgataatattgcgataattatttatactttgagcaccacctgcgttggcatcccagctatctctcaagacttacggagcccctgcggtagcacagcacagcgtcgcacgcggctggatggatattgtgcagctcggattctccggtccggggtctggggtccgtccccgtgcaccgaccccggcgaggtgttcaagggagggcacagttcggtcccaccccacagccggccctgggacctcgagtggctttgggtgtgctccagtcgttcccggaagcactgtcccagctgtgagttgggtttgttccgagggcaacgacgtgttcggaagcggggaggccagcccgtccatgcattgggcacgacctccgttccacattcccatgcaggcccttggatcttcaaagactgggaagcttggtccaggaccccaggcccatcgnnnnnnnnnnatgcaggcccttggatcttcaaagactggggaccttggtccaggaccccaggcccctcannnnnnnnnnggggtgggggggtgggcgggtgggctggctgcttcgctgtgcagctgggaatgagtcaccctgtgcgccctcagggttgtgttaacaatgctcgctcaggccaatgtgcggggccgaacccccccannnnnnnnnnaccagaagcaagcggaggtcctggaggtggggtgggagggtgggcgggtgggctggctggtttgctgtgcagctgggaattagtcaccctgtacgccctcagggttgtgttaacaacgctcgctcaggccaatgtgcgggccggacccccccatagtcctctcatcctcccatcccccacccccccacacaaactaacaacgcaggtggtggagacgcgagtggcagactacgtggagaagggcaccgccctggaggccgggctgaaggccggcgtagcctccgtgctgccccagggcatcaaggacgcgatcccggcgacgctgcgcgagtcgctgctggggcgggacactggcagggggagcggcgatggccccgcatcccgcgccgagccggcggccgcggagaagccgcagtcctttgccaacaacctgctccagcgccagcagccggcgccggccaccgcgccgagctccaacggcgcctctgcgccgggcctggccacctggaccatcaccaccgacgaggaggacggcgtggcgcgtccgctgtcgcctggcgcggatgtgagcggcgtcggcgacgcgccgcccgccatcctcgccgagctggcggaggtgctgcagggcgtcggcgccctcaagtccacgctgctggcgctgcgcaccaacggcgatcccgccctcggcaccatgtcgcgcctgaacgtccgggaggcggaggtggggctcagtgggtgtcgcgctggggaagggggtgactgcgcggggtgcagggnnnnnnnnnngaacgtccgggaggcggaggtggggctcagagggtgttgcgctggggaagggggtgactgcacggggtgcaggatgccgcagtgggctaaatctcccggaactggggacgtgctcccacactgcctgctccattgagacgctgcggcggcggctgcagcagctgagcgcggtgcacgccgtgagcgcggtgcccgacccggaggtcgccgccgccatccaggaaggcgaggccctgctggccgagagtgcggccctgacggactgagcgccacggtgcgcttcctcgaacaagaagcaggtcactggtctggcgcactcccccctccctccagaatcaaacccttcccacatctaggcctggcgcgggtctgcggagctgtgccagacccaggtcatgccatcccagccgcaggaggcgaggaggccctcggagagcgggctccagtccagccccaccgcgaactcggtgtggtgatcccagactcgcagcgcggcctcctccggcgccgcaaagtcccacagccgcaccgtcatgtcgtaggagcaggaggccagcagcgtctcggcgtgcggggagaagagcacgcggcgcaccgcgtagccgtgccccgccagcacggccacggggcgggcgggcgcgcggacgtcccacaccttgacgctcttgtccaccgaccccgtggccagcaggcagtcgttgtacttgcaccagtccgcggtcagcacctcatgctggtgcgcggagagggagagcgtgggccggggctggcgcgtgtcgaacaccttgaccgtgcagtcgccggaggcggacaggaagatgtcggcctgctgcggattcctgggtgttggtgtgtcggggagaaggggaggggggtnnnnnnnnnngaagatgtcggcctgctgcggattcctgggcgttggtgtgtcggggataaggggaggggggggtgggatgaggttgggacagggggttctgtcgatcacgctggagaggcgctgtga

SEQ ID NO: 871 - DNA, 417 bp, Chlorella protothecoides
  modified_base (371)..(380): a, c, t, g, unknown or other
atgaacaattgccatgttttcaggtacttgttttcgatcccacaagcttccttgtgctactcgatcgccaccagtgcatctcctgccactcaatcctgtcaggatgggacagcaaagccgtccacgcttccggcctctggaggggcaagcagcagccaggcagggtttacgcccccacctggtcccctgggcaagggcgccacggcaggcacgacgagccaggcggggccggggcccagcggacagacaccaggccagggcccaggaggcggaggcctgggggccaactaccttgcgaagatgctggaggggtatcgggccgccaagggagacaagtgcgtggggtgtggtgatgtcctgggagcggctgnnnnnnnnnngggccgccaagggagacaagtgcgtggggtatggtga

SEQ ID NO: 872 - DNA, 540 bp, Chlorella protothecoides
atgccactcctcatccaacaaccaacaaaccaggtgacggaccgcaacgtggagaacctgtctggcggcgagctgcagcgctttgcgatcgcggtggtggctctgcaggaggcgggcgtgtacatgatcgacgagccctcctcctacctggacgtgcggcagcggctgaaggccgcagaggtcatccgtggcctcctggcctccgacaagtatgtcatcgtggtggagcacgacctgagcgtgctggactacctctccgacttcatttgctgcctgtatggcaagcccggcgcctacggcgtggtcacgctccccttctccgtgcgagagggaatcaacatcttcctgggcgggtttgttcccaccgagaacctgcgcttccgggaggagagcctcagcttcaaggtctccgacaccaccgtggatggggacgagggcgccaagcgcttcctgtcctacaagtaccccaccatgaccaagacgcagggcaacttcaagctccatggctgtgtggtgtggtgtggtggtggtgggtgttaa

SEQ ID NO: 873 - DNA, 414 bp, Chlorella protothecoides
gccccggcgcccgccccgtcctggtcctgcgcgtgggcgcggcctcgcacgaggcgcgcggccgcgccgcggcggccgcctacggcgacgtcatcgtgacgctggtgcagggcgcggtgatggaggggcgcctggcggacgtccccggcgagggccggccccaggacctggtggtgcgcgtggatgccggcggggccagcgtcctgtcctccacccgcatcctgccggtggtgcgctacgtggccaccaccctgaatcagcacttcccgggccgcctctacgtcatggagctgcacaacctgccgccatttgccacctggctggtggtggcggtcaggggactcatgcatgccaccacgcgtgacaaggtggtggtggtgggggagggcggacgccgcgccgcgccccccccct

SEQ ID NO: 874 - DNA, 405 bp, Chlorella protothecoides
atgacgcatgacgctcccacccatgaccccactttccgcctctcctatgttcccgaaacccctcagatcatcaacaagagcatggttggcatcgtgaagtcacttgactcggcactcaaggctaacaatcttgagaaggttgctgcaaccatggaccagttcgagaagcagtttgagaacctggatgtccagagcgagtttgtggagcaggccatgggcaaccaggccgcgctctccacacccgaggacgaggtcaacctcctcatgcagcaagtggccgatgagcatggcctggacaccaagctcggcctcccagcggcgggtgcagcccaggcagctcccacaccagcgcagaaggaaggcaacgacctcgcacagcggttggcggagctgcgaggcaagtag

SEQ ID NO: 875 - DNA, 1185 bp, Chlorella protothecoides
atgactgcgcaatgtgttcgactcttattcttccttgccccactcaccactggcagagccaaggagaagcggcggcaggaggagctcctgaaatccaccaagaagctgggagagactggagatgatgtcgacaatgacaccctccagtggatcgagcgggtggaggctgaaaggaagaagaaacaggcggctgcaaagcccatccgagcaatgaatgactctgacgaggatgaggaggtaggcgctgggatgacttgggggcaggcggctgtggcaatcaggaaatggtttcaagggatcctctgtggcggcagcatggcctttgcagttacatgtatacacagtcgcgccactcacccttgtcaccgcaggaggatgcagcggcaagccacactggcgcagacctggccgggttcaaggtgggtggcaaggcactcggtggatgatctggaggcaggggagtcggtcatcctgaccctggaggatcgaggcattctggacgacaagggcaacctggtcgacgacgaggaggcagcgctggagaatatattggtgagagaaaccaagcagcgggaaaaggcgtatcgcgactctggaaaggtggccaagcctctgtgggaggaggatgggcggcagcgcaccctgctggacaagtatgacgaggaggaggagcaggtcattcaggtgaggccggggcccgtggacggtggcggactcaagactgcgctgggtgggccaagcacgccatcctcgttgcccacagaactgctgcttgtgacaatttcacacttctccagcatcctgctcctccccttcctcacctggaccaccaccccaaaaccgcagctggggggcgacggcagcgtcgtggccacgcagcagcagcagctccagggggacgtgaatgcgcggttgaaggcggggctggctttgctggaacaggtcaagccagcgtccgactactacacgccggaagagatggagcagttcaagcccaagaagacgaagaaggtgaggaagctgaagaagaaggccctgactgccgaggagctggaggcgctggcggaaagcaccgcggcggctgccgcgggcgaggacctgggctcccgtgcctctcgggaggcgcgcgccgcggccaaggccgccgcggcgggcgaggccgagaaggagcggcgcgagaggtga

SEQ ID NO: 876 - DNA, 246 bp, Chlorella protothecoides
atgctgcccagcttcaccacccacccacctgcccagtacgtcctgacccacgcagacaaccatgagggcgccaagatctatgcccagaatgccatccggaagagggcggaggccctgaactacctcaggctggcctctaggctggatgcagtggtgtccaggcttgacacgcaggccaagatgcaggtgcgaggggaaggggggtgggaggagactactcgggcagcgcagggcgctgctgtgtga

SEQ ID NO: 877 - DNA, 306 bp, Chlorella protothecoides
atgcagtcgccccccgactgggcagacatcctgacccacttccgcggctccgagctccaaaactatttcactcgtatccttgaggacgatgtgaaggcgatcatcaagcctcagtatgtggaccacatccccaaggcgaggcagggggctgggcagtggagccgcttgcatctggcagtgctaaaggccgtgcgcggcaacgtcggcgtcgtgctggaggaaaaggaccagaggggccagaaggaggccctcctccgcgacctcgacctcgaacaggtgcgacagtctgcgtgcgcctggctttga

SEQ ID NO: 878 - DNA, 276 bp, Chlorella protothecoides
atgcacagcaagaagacggccttcatcgtggagcacgacttcatcatggcggcctacctggcagaccgggtggtggtctacgaaggccagccgtcagtggatgccacggcgcgcacgccgcagtcgctgctgacggggatgaacctgttcctgaagaacctggagatcaccttccggcgagaccccaccaactaccggccgcgcatcaacaagaaggagtcgctcaaggaccgggagcagaagtcggcggggacgttctactacctgggcgactga

SEQ ID NO: 879 - DNA, 1860 bp, Chlorella protothecoides
  modified_base (85)..(95): a, c, t, g, unknown or other
  modified_base (898)..(907): a, c, t, g, unknown or other
atggtagcttgtgcatcgatcatcttgcaggagagcactgctagattttctgctgcacatgtgcctccacccacccctctgcacnnnnnnnnnnnccactcaccactctgcacccaccactctgcacccacccacccgttcacaaacccgacagcccacatgcctgtggcctcctaccctcgttctacatacttttgcccagtggaggccctgtctcgggacctggagacgcatgcttttggcaacccgcacagcgtcaaccccccctccctgctgaccgacgcgcgtgtggattcggcgcggcgccgcctgctggcgctgtttggcgccgacgagaccacgcatgacctggtgctgacgcggtccggcacgggggcgctgaacctgctgggggacgccttcccctggaccccggagtccacctacgcattcacccgcgccaaccacaacagcgtgctgggcatccggtcggtggcggggcagtacggcgcgcagtacggcgcgctgtccgaggagggcgcggaggcctggctggccgaccccgagatgcgccacccgcccttcctgcccggggggtcggagcacgcgggtcctcgccgcgcgcgcgccgccgcggccgagagcgcccaccggcccacctacagcctctttgcctaccccgcgcgggacaactacgacggcgtcatgtacccgctgaagtgggtgcaggcggtgcaggccaagagcacgccggggcacaaatggaaggtgaggcttttctggagggagctgattgggtcgaaggtggtggatctggggagggggttgacgagatttggacgggcaggggcgtggacgggatgcgctggcagaaccagaatttcacgcgagcctctcgtttcatggggggtgagcagtnnnnnnnnnntcagacttggacgggcagggccgtggacgggacgcgctggcagaaccggtatttcacatgagcctctcgtttcatggggggtgctgctggacgcggcggccttcgcgcccaccgccccgctcaacctgacggagacccccgccgactacgtcatcctctccttctacaagctcttcggcctgcccaccggcgtgggcgcgctgatcgtgcggcgggagggcgccgcccccctgcgcaaggcctactggggcggcggctcagtgttcctggccacctcggccctggactggcaccaccgccgcctgcccccggcctcgctggaggacggcacgctgcctttcctggacatcgtggctctgcagtacgggctggatgcctttgagcgcctgggcggcatccacgccatcaagcgccacgtcggcacgctggcggcccacctgtacgaccgcgtgcggggcctgcgccactccaacggcgcgcccctgctccgcgtcttcgggaagcacgaagacccgcgtcgcgccgaggtccaggccgcgacgctgaacttcgagatcctgacgccgcgcggcggcatctactcctaccgcaccgccggcgtggaggccgcggccgccggggtctacatgcgcctgggctgcacctgcaacccgggcgcctgctacgccgcgctgggcgtgcgcgacggggaggtggccgactttgccgccaccaagcacgacaactggaccgactgggagtggatcacggtgacgcgcggcgtggagccggggggcgcgccggagcaggtggtgctgccgttggggtccatccgcgccagcctgggcgcgctgagccggtgggaggacgtggacgcgctggcgcgcttcctggaggccaagtacgtcgaccgccccgagggcggcggcggcgagaccacgggcggacccatcccgcccatcgactactgctga

SEQ ID NO: 880 - DNA, 1725 bp, Chlorella protothecoides
  modified_base (1602)..(1611): a, c, t, g, unknown or other
  modified_base (1687)..(1696): a, c, t, g, unknown or other
atgagtgtctcgcgcagacttgggttcttgctggcgctgcttgctgtggcgaagggccagacgagctggacacctgtgactgtcggaagtgctgctagtggaggggtgaggtggatcgtgcggggcgagacttcccgggcggcgggatcagcccgggtaatcgaggaagccactgcggctcactcccctagctccctcccacgtctctccaggacagcccagctggctccggggcttgcgggtacgggaccctgtccgcttcaagctggccgtatgacgccattgccgtggtcaacccggacagccccttcctggccgggtccgctccccaagggtgcggcacctgcctggagatccagtgtacagacgaggggaagggtcgtcggacagcctgtgtccatgacgctcaaggacctccagagtcctgctgcgccgcatcagcttgccaagcacgagtgtgcacgtccatgctgcgcctctgcgaggaacatcctttccctgctcagaggatctcctcgcgccctcttccctgcagcaggtgtgtggcagtgccgccggcgccttcattgcgctcgtgaccgacaactgcgacggctgcgacctcagccagatctacgtgtccccctccgcgtatgccaagagcttcagtcccagcatcggcctggcaacaggccgtgccactgcggtgcgtcctgggcggcagcgatctggcgctttggggggaagggctggaaggctttcagtgtagaccctgtgcagagagggtgcaaggagcaccccatgacagaggagcgcctgatcaaggcccgcacagcctgcccaggggccacacggctcaaaatgccatcccccaccgccccgcaggtgccctgcgcccctcccggcgacattgttgtgaggatcgacacctttaggcccacgctgggcggttacctccggcttgtgctcctgtcagtggccggtcagggccccatcgactccgtcgagctgcggaccagcggatcccaggtactgccagaggactgtaagggggcaagcgtcacactcagatcaggccctggaaggggcgcccgggggcaagcgtcacactcagatcagaccctggaaggggcgcccggtggttgcgtcggacggcagctccgcaagcctcaccgatatcacggactctggcatagggactctcacccccctatattcacgcaatcctgtaccacagggagactgggctcccctggcgaggtcgttcggtgcggcgtgggacgcctcatccctgccctccctgcccttggacatcaggatcacccgcggcggcgacacgctgatcgtccagtgagtccctggactggcaagtccgcgagcgatgccaactttaagctgcagccctgtggtagcacatttcgagcgccgcacctttccctcgacgcaggagcgccatcaccgaagagggtcagctgggcgacattcagaccggcgtgcagacgactcctgagcccgaggcctcgtgagtggtgcagtgtgtcgtccctgcctgcctgcaagcatgcatgggatggagtgggtggctgtatgtgcctctcaagtggcaatggagccagctgtttnnnnnnnnnngcgcttcctccggacttgtcaacgggtgagaggactctgcgtcaaagggcacgcgagtctagaagggagggggccnnnnnnnnnngcgcttcctccggacttgtcaacgggtga

SEQ ID NO: 881 - DNA, 417 bp, Chlorella protothecoides
atgacgtaccgtctccgtatctcgctgcttcttgcatgggcaatcgcgcaagcatgtctatcccccgcgtccgcggcctggcagggattgcccgctttcggcgcggtacaactgtgcgtgccctataacgtccaggtcaggcccggcaccacctacgccctgtccgtggagggtgatcagagcgtggcatctgccatcacaaccggagtcaccgggaacgtgctggcggtgggatccaacggcttcacgagctcccagcccatccaagtcgtcattacgctcccgagagacaagctggtgggggtgtaccagaacggactccaggccgctgcctacgttgcaccaggtattgccacgacgtttcataccgggcatgggggaggccaccgagtgaccagcctgcatggacaggcatga

SEQ ID NO: 882 - DNA, 390 bp, Chlorella protothecoides
atgcatcgcaggggcaagctgcagcgggcctgcgccgacgggggctctgacctaccctcggagaagatggccggggcttccatctgcctggtgctgcccaagcagcgtggcccttcctccgagtaccggcgggacgacatctggatcctgagcaacgacgcctggctgggcagcagggccgagagggctggcaggcccatggaccgcctgcatgcgccctgggtcgctctggcccggagcctgtggcatggtcccaaccaggagggcagggtggaagggtcgtccatggtgccagtaccacccagtcacgccctccgcatgcgtccaaggcgtctgccgcccaaggcccccaggccccctcaccactcaggctggcgatcgagttcctga

SEQ ID NO: 883 - DNA, 699 bp, Chlorella protothecoides
atgtggttcccagcacctcgccaaccccagaaccccccgctcccaggcgcctgcccccatctgtctggtgcatggaccctttgggtcgggcaagtccaccctgctggtcaccctgctacgctttcttctgcgggcccgaaccgtggccgggagccccctggagggggcacgcattctggtgtccagtggcaccaacgttgcggtggaccgggtgctgatggggtgcagcttcgatggtggggcctcccgggtgcctgtgcgagaggctggaggaactcggctgcaggcagggcgagaggcgccgccgagcgccccctccatgtctcctggaatccgcgcacaggcctcttggaggcggggtgcaccgacttcctccggctcggtcccctgaaaaggatagacaggcgcctgctgccgtactctctccacgcaaggttggtggcaaggggtccgttgcagggctcagcgcagggtggtatgctggcaggcctggctggatgtggtggagcgtgtgagagtccatactctgtgctcacagccggtcagctcatcccaagttccaccccacctgcccctgcttgcagcaagaccaaggccactggaatcagtgaactgagggagatgatcaaggccacgacctcccaagccgaagcctgcttgctgcgcgcggagctgcttgccctcgaagcaggcgcgtga

SEQ ID NO: 884 - DNA, 468 bp, Chlorella protothecoides
atgacccctcctgaggtgcgagtgcagcgtgcgcgcgagaaggagatggagaagatggaccgcgacatgcgcaccatcttcgcttacaacctggcgctgcgcgctgaggagcaggacctgtttggcttcttcgtggccgccggcccgctgaacgacatcaagatcatccgggaccgcgcctcagggcgatccaagggcgtggcctatgtggagtaccagcgcaaggaggacgtgatggcggcgctggcgctgacgggtcgccccctgctgggccaggcagtgatggtcaagatgagcgaggcggagaagaacctggcctgggaggcggcggaggcccagaaggcgcaggccaaggacatggaggcgcggtatggcgcgcccggggccgacggcgcagcgccggcgaccgcaggcctggtcccgggcctcgccgccgcgccggccgtggacctgtcggacccggcggcc

SEQ ID NO: 885 - DNA, 885 bp, Chlorella protothecoides
gggggtccaaggagcgagagtggtggtgtgcgggggaagctctggggcggcgtgccggcgagagcctgtcgtgggggattctgcaggccttgccctgatcatgcacaaaccaggcccggaggaggatcttcctcgcagcctgggctgccccgttcctggctgagatgcggcccctttcctcaccccccgcacactccatctcccccctcactcaaaggcactggcaaggagtcaggggaccggcaccccaagatcggcgactacgtgctgatcggcgcttcggccacggtgcttggcaacatccgtgtcggcgagggggcgcagatcgcggccgggtccctggtgctcaaggaggtgcccccgcacactatggtggccggctcacccgccaaggaggtcggcaagatcacgggtgagggatgggaggagggggtactgcggaggggggttgggatgcgccgcagaggatgtgggtgccggcatcctacactgctcatgccggggggcggtggtgtgccgtcctgctcaggacggatcccaggagcacaggtgatcctcacctccaagcaccacacccacctggtggcaggcctgccctccatcctgatggaccagtggagcgagtgctgccccagagtcgtcgccgaggtgagggagcggcttgagtgtagcatgctgggtgcagggtgtgggtgtggcccgggctggactttctggggtggtgggtttcacagccagggacaggcgactgccatgggtgttccagaagcacccatgctacccaagggatcctttactcctcagcactgtcagctccccccatcccaacagcaagcggtggacgcgcttacgagaccaggcggggtggatgactttgtcatctga

SEQ ID NO: 886 - DNA, 582 bp, Chlorella protothecoides
  modified_base (539)..(548): a, c, t, g, unknown or other
atgccgcgcgacgcgacattgagtctctccaggagacagaaaccacattctagcgtcacggtgtgcacaggggcggaatgaagcttacacgccggtggcaaaatttctccatcttcctaccacatgcagacacatgcgagcgctggaggggccagcaccctgcagaagctggcccgcgtgtttagggagaaggctgccgaggatgctggcaggatgttcaagggcgccaagaagagcagagagcgccttggagttgtgaacgagattctgacttactggaggctggaggatgccgatgccacactggaggacctggaggatgccctcatcgtgagtggcctgggctcgtatactgaggcgcaagcgcccagggagggaggagcgggcttcttgcatctactgattcaatggcgcccagagaggaatgctgcacgaccggacgctgaatgtttgctgggaacacatcttcaagttgcgagggaggcattggacagccaaatcatcacatctttgccagccaatcctaatgcgcccccccnnnnnnnnnntggaacactgcacgactggacgctgaatttttga

SEQ ID NO: 887 - DNA, 1005 bp, Chlorella protothecoides
  modified_base (41)..(50): a, c, t, g, unknown or other
atgatcacacctttgccagccaatcctaatgcgcccccccnnnnnnnnnnaaactccccatcttcgtatctccagagctccgactttggacctcagacggccttcaagatcgtggatgcggtgcgggagcgggtgaggtccggcgccctgcgcacccccgaggacatcaaggccgccctgcgcgactcggtcctgagtctggtcgcccggccatcaggcgggtcctccgagcttgcctttgcgccgggcagcgacgcggcgggtgtggcgggtgatgcagagactggcggcgatgcagcggcatcagatggtgccgctgcatcgggcaccccaggtaccccaggcggcagccccaccgtctacctcatcgtgggcgtcaacggcgggggcaagacgaccaccatcggcaagctggcgcaccgcttcacctcccgcggcgcgcgcgtgctgctggcggcgggggacaccttccgcgcggccgccggcgagcagctgcggctgtggtcccagcggtcgggcgcagaggtggaggcggcgtccgccggcgcgcgccccgacgccgtgctcttccgcgccgcgcagcgcgcgcagcgcgaggcctttgacctgctcctctgcgactcctctggccgcctccacaccgaccccgggctcatggcggagctggccaagtgccggcgcagcctggcctcggcgctgcctggcgcgccgcacgaggtgctgctggtcctggacgggaccaccggggtcaacatgctggcccaggcgcgggagtttggcgcctccgtcggcgtcaccggtctggtgctgaccaagctggacggcacgagtcggggcggcgccgtggtctctgtcatcgaccagctgggagtgcccatcaagctggtgggcgtgggggaggggctggaggacctccagttcttcgaccccgccgcctttgtcgatgccttgtttccccgcgagggggagggcgaggagccgcagggtggaggaggagaggcgtag

SEQ ID NO: 888 - DNA, 747 bp, Chlorella protothecoides
  modified_base (492)..(501): a, c, t, g, unknown or other
atgggaggcaagcactggcagatgggcggtatagataggcagccctgccagcggacgtatgctctccgactctgccccacgccatgtgcctgtgcatgtcctgtctgccacgcaggagtcggcgtcctggattcatgtagtgcgcgtcatgcccatcctggtattcatccttgcccatttcctgtctgcggcacctcaaagtcacccacctcccgcccccatcccacgatgcagggcgcagaggccgccttccgcatggctcacaggctgtttgcagagaggcagtacgccgaggcgttggacgcagggctcaggagtgtgcgggcggatcgggggtggcatgaggaagccgggcggaagctgctgctccgcatgtttgaggcgctgggcgcggggcaccctgcgccctcaccctgtcgaaatagacccgtctttcaggattcacttcacactgtggcagtgtgggtgtttgggggtgctccagccagcagnnnnnnnnnngaaatagacccgtctttcaggattcacttcccactgtggcagtgcgagtgtgtgggggtgctcctgccagcacagggagtgcacggcaggcggagcccagcaggtcaccatacccgggccactgctcacactggcagacagtggcttggctggctggagttctacagcatgctcgcgcttgggggcctgggggatgcagcaacggggagcggcgcaccaaaccaccctgacaatgttgggaggtga

SEQ ID NO: 889 - DNA, 1764 bp, Chlorella protothecoides
  modified_base (5)..(14): a, c, t, g, unknown or other
  modified_base (1309)..(1318): a, c, t, g, unknown or other
atgcnnnnnnnnnntgcttcagatgatgttgttgaaaacaacggctatagcatcgccatcgcatgctcaagatcaatggaagcacacggggtgggcatatgctgcgatgatctgctgcgatgcaaggtcctgactccgaggccactccccagcctcggtaccacgggcgccatggcggagccgcacccagtggtggagcacctcctcgacgtctttgggtatagagacacagtgggtcccactgagctgtatgctgccttcaaagactatcaaaaggatgttcgcctgtgtcccgacacctgtgacgaggccgccgtctctgccttcctgcagtggttcatggaacgctccgatccagctacaggtgggtgtgctgggggcccagtcccggctgacagcctcccctccatgtatgtgcagcgcccactcgccaccctcaatgctaccatggaggcagcaggggaggagtctgaccagctgctcctggaccttgtctccgacagcagcagcgaggaggaagatcaggaggtgtgcgaggtccaggcagagtctccctggcgcacacggtcaccccttagcgagggcgggcggggccgcagccacgatgccgacgacatcagcctggacgccgaagatgtggctccccacttctttccacggcccacacaagctcgcgcgcggcaccggcaccttctcttcgaggcgagcagcgctcaggaccaccgcactccgcactgccctccccgcggctcgccccgaggagcagccgggcagaccgccccgatctcacgcagcctcacgccgcaggaacatgcgatggacatgctggactttgccaactggatgcagaccattaaaagactgtgctcggcgggcgcgaagcaccttcatcgtatgcctaccactgctgttgcgtggccgctacgtgtttggcaaccaaagctttcgtccccggcagcgggacatcgtggaggcggctctcagcggccgcgactgcttcgtccttatgccgacaggtggagggaagtcgctgacctaccaggtggggatggagggctgacatggcatgccagccgattcagcagtcgtcacatgcacatggctcccggccgtgctgtccaaggggctgactgtggtggtgacgccgctgctctccctgatgcaagaccaggtccaggcgctgtgcatgctgcgctgcggcggcgtgcccgcctcctacctgtcctcccagcagggtgtggtagagaccaggggggaagtgcatgggccctagctcgccgtggtccccaggcatggactcccctttgcnnnnnnnnnnaactctcccatgcatctctccagggggcggtcttcatggagctggccaaaccaaaccccagcctgaagctgctctatgtcactcctgagcagttggtcaagggcgagcggctcaaagctgccctcacctccttgagcaacagggtgcggaacccaggggcagcagggggcgtgtgtgcctcttggcatgctgttgggctctcttccatccccctcggtccagcaccgtgggctccaatggattgcggaatactaggtgcaggtctcagagaaggacacggcatcagtgtgtgcactgtccaccatcccctcttcataacacgtcctcacaccctcctcccgtatctccatcaacagggccacctcagccgcgtcgtggttgacgaggcgcactgcgtctctgcctggggccatggtgaggctggggggaaatttactcattcatag

SEQ ID NO: 890 - DNA, 243 bp, Chlorella protothecoides
atggcgggcgtggtggacatcctgcagcgcgccgacgagctgcccaccaacgaggacggcgaggtggagctagacctgggcgtgctctctccaaagacggtctgggcgctgtacgagtacgtcatcgggccggcggcggggggcgcgccgcgtaaggcggcgcccggtgccgccggcgacggcgcgggcttccagctggcggaggacagcgactatgccccggacgatgacgacgacgactga

SEQ ID NO: 891 - DNA, 378 bp, Chlorella protothecoides
atgtctcaccacctcacaaggctcctcactccacacatttcgcagcacccctgggtgacggggcagcagagcgccgagcccctgccgcccatcgtgcacgagcgcctgaaagactttgccaccatgtcccgcgtccgccaggtggccatgctggtggccgaggagcagatctccaaggtgggcatcggtgcttttgaccccggcgtatgcggtgaagacctagggtatctcctggacgcgtaccatggccgaggagagatcgggctgctttggggccgccttcttggtatcttggatgcagtccgacacatgcagctccaggctcttgcaggccaggccagttccggcaggcagtccatgcacccgcccacccactga

SEQ ID NO: 892 - DNA, 621 bp, Chlorella protothecoides
atgcggcgtttgccagctctcggagctctgtgtcgtcgtctcatagcgagcgacctgccccgcgtcgcaaccccaagccttgctttgcgcctaattggaacatcggaatccggcttcaattccattgcccattgctgcgaggtcgcatcccatgccagtcgaacattctcggcctcgactgggttggagcccccctcaccagtgatatcgaccctgagcgacttcaaggcgctgaccgatctgagcatcaacacgcccatcgtggtgtacgccactgccagcgccgatgcagaggtggacccagagctggtcagggccgtgcatgcctccaggggctcggtgcgcctggcccagctggacgcggggtctgcccagctgagccgcctgaccgcccagctccacatcaccaacctgcctgccaccctgctgctgtttgggggcagactcatggactcccagccgggggtcccctccggccaggagctgcgggactacctggcccagatccagaagctggcggacgacgtggcgcggcaccgggcgcagcaggcggatgcagccgcctcgggcgggggcactgggccgaacgccacccccgcgcagctcctcgaacaggggtag

SEQ ID NO: 893 - DNA, 621 bp, Chlorella protothecoides
atgctgtcggggcacccccacgtggcgtccctggtggagtgcatcgaggacgagctggcagtgcacctggtgctggaactggcggccggcggggagctgctgcagcgcctgggctgcccccacgccgacagcccgtccgaggcgcaggtggcacgtcacttccgggccatggcccgcttcctggcccactgccacgcgctgggcgtcgtccaccgcgacgtcaagctggagaacttcctgctgagcacccccgacccggcgaccgcggagatcaaggccgccgacttcgggctgtcccagttcctgcgcccggggcacagcatgcgcgctgtggtgggcagcgcctactacatggcgcccgaggtgctgcgccgcgactacgccacccccgccgacgtctggtccctgggcgtggtcctgcacatcctgctgtcgggcctggcgcccttctggggagacaccgaggccgaggtgtgggccgccgcggagcgcgcccgcctggatttctcggtcgagccctggccccgcgtcagcgccccggcgcgcgcgctggtcaagtccatgctgcgccgcgaccccgcgcgccgccccaccgccgcgcagctctgccgggtgagttga

SEQ ID NO: 894 - DNA, 420 bp, Chlorella protothecoides
atgagggactactgcgaggaggagaagcagtgccgccacgcccgcctgctgcgctactttggcgaggagtggacacaggagcggtgtggggatcgctgcgacaactgcctgcccaagcccaagcccactgccaagggtgggggtgcggcgcaggggccgcagggcgccaccaaagcgacccagctcaagcgcaagggtgagcgggggacggggagggaggcactgtcggacgtgggcttccgcagcgctgcggccctgctggccgacgcgccgccccccgtccctgcggtgtcaagctcgcgaggggcggcggccatggccaaggccaaggcggcgcgcagcgggaacgagcggccgggcatcgctgccttcctgagcaggggccctgcgatggcgggccctcctccaaccagcggatga

SEQ ID NO: 895 - DNA, 633 bp, Chlorella protothecoides
atgcaggagtgtgggcgagggtgcctgcaggtcctgacatgcggtctgatgacgtacggcaaggccaggcccccgccatggagcgagcccctgctgggcccgggcgcatacccccagtcgacgcacccggcggatgcaccccccaagctccaggacatgcacggcagccctacgaagacggacgcctacctccgcactcacaacatcctggggcgcggccactctgaccttgaggcccgataccagctgggccgggtgctgggccggggcgccgacggcgtcgtgcgcgaggcggtgcacctagtcaaggagacgcggcacgcgtgcaagaccatctacaagggctggctgcgccgccgctcgcaggtggagggcctgcgccgcgaagtccacatcctgcaggtgggtcttgaggtgagaggaagaggggaaagggaatggcggcttggcagggggtcatgcggcggatcgtttgccgcacagtcccacggcgtccctgctgcagggcagctgtgctgctgctgggacggcggtgcccctcgggcagggtcctgggcagccgttcctgggcatccgtcatcgacccctgtcccgatgctgctcagcaaggcgcgtccgtgcacaagaccttga

SEQ ID NO: 896 - DNA, 1287 bp, Chlorella protothecoides
  modified_base (5)..(14): a, c, t, g, unknown or other
  modified_base (212)..(221): a, c, t, g, unknown or other
  modified_base (712)..(721): a, c, t, g, unknown or other
atgcnnnnnnnnnnaagggaagttgaggttgggagcgggaagggggtttgctcatggagctcctctttgggaacagagatatatgtggaacaatgtgaatgggttcaggacgaatgccgtgataagttgacgagctccaagccccgtgcggaaggctctcggcctggagctcgtcataatagagtctcccggttcccaggcgctgatgcggnnnnnnnnnntatcgtcaccatagaatatgtgtttactgagaactaagagcttccagcgctgagcaccagtggacttcaacgctcctcacggccagctccaagccccgtgcgggaggctctcggcctagagctcctcataatggagtctcccggttcccaggcgctgatgcggggctccatgccccctccctcccctcgggctccccgcagacgggaggctgttctcgaggaggacgagtgggtggcgagagcagaggccatcatagagcgcgacttcttccccgagctcagcaagctggaaggaaaagtgcagtggctggaggtacgcacgtgcctgtggagtgtggtgcgctgtgaatgggtgcagcctggtcgtgcatgggcaaggggcatgcaaggtgcccagcggatgccagcgccccccccccaccaccacacacacacgtgtctcagaccatgtttaactctgctcccacgccacaggccgtgcgcagcggcgnnnnnnnnnntgtctcagaccactttgaactcccactcccacgccacaggccgtgcgcagcggcgacccggcccgaatgcgcgaggcgcaggtggcctttgcggcccggcgggcgggcctgcgcccgggcacctcgacgggggcgggccccctcttcactccgggtggcacgggcgcacgcgtcctggctggcgacctgcccaccccgaccggcgacctgtccaccccggccaccctccacggcggcgcaggcggcgcacgcgcggcgtccggcgccgcccaggcccctgcgatgtccctggacgctttcatgcgcgcgcacaccagcgaggacaacgcctccttcgccgcgctgctggccacggagaatgggaggagggcggaggcgtacgccgccattgccgccccgccggggtctggggaacaggccatcaaatccgccgcgggtccccggccgaccgacgggttcggaacgggggggcagccctccgaccgcctcgtgcagtggcggtacgagcccaggaacgccctcatgtacgatgggagccagcgggatgccctggccctctcaggtga

SEQ ID NO: 897 - DNA, 1080 bp, Chlorella protothecoides
  modified_base (18)..(27): a, c, t, g, unknown or other
  modified_base (827)..(836): a, c, t, g, unknown or other
atgccgctgcagcaaccnnnnnnnnnngctcatgtacgatgggagccagcgggacgccctggccctctcaggtggggactcttcgtcttgttgagaagttgtgtctcccttgccctgcaatgccgctgcagcaaccctcactcacatcccctaggttccccgccgagccccctcaccaccagtcccacctcccttgctccacacattcctcagggaccccccccttttcctcccctgcacaccctatccacagataaggagcgggcggcgcaggtccagggccccccaaaggccatcaagcaccggaacacgcggttcccgggtccccaggccctctcctcctgcggcgacacaacccccgcctccagcgccaccgggacgcagcccgggtcacctgggacgcggcacggcgccgcctttgtcggcgtggacggcctgtcctaccccgtgctggccacgccctcctttgacccgggcgaggccacgcccttcatgacctggggcgacatccaggccacgcccctgcgcatcgaggcagaggacctgcctgcaggggatctcaatgcaggtacgggccatggtctattcatgtcgaagcgggagcaagtttatgttttccgagccatgaacgccgacgctggatggccgccgggagccggtgctgcgtgggatgtcgctcgtcgctgcatcctgcgctgccatgctgccatcctcgccaccgcgccgtttggccagccacgcgtggaatgtagagtacctccaccatcaaaccctctcctcctcctctgcgttgtgtgcccgcaggcgccgccaagttccacatccgnnnnnnnnnntgggagccggtgctgcgtggaacgtcgctcgtcgctgcatcctgcgctgccatgctgccatcctcgacaccgcgccgtttggccagccacccgtggaatgtacagtacctccaccatcaatccccctcctcctcctcctctgcgctgcgcccgcaggcgccgccaagttccacatccgcgagtcgtcggcgcgcgagcagacggggcgcgacctggcgcagcggtccgccccggcggcgggcgg

SEQ ID NO: 898 - DNA, 336 bp, Chlorella protothecoides
atgtccaacctgggctgggcggcacacgtgacccaccactccagcaacgactacaacctgagcacggccctgcgccagggagtgggcgagagcatggtgggcgggcgatgcaattgtgtgtacagctgggcgtactacctgatcctggccccctttgcaccgctgaaggtgtttgcgctacataaaggcgccaacgtcgtcattcaggtcagcctgattgcgaggccatgggtgctggcggcaggccggtgcggggttcctctgctgcgtgccgcatgctctccccctgccaagccagctgggtgggatggagtgctgtccctccgccctctctga

SEQ ID NO: 899 - DNA, 276 bp, Chlorella protothecoides
atggccgcgcctggcctgcgcgacgaccccatccccacggtggacctgggccccggcggccccgtgcgctgcgccgagtgcaaggcctacgtgaacgcttacttccgcttcgtggccgacggcggccgcatggtctgcaacttttgcggcgcagagcagcccgtgccgcccggctacgcctgcccgctggacatggaggggcggcgccgcgacgccgccgaccgccccgagctgtgctgcggcagtgtggacatggtggccaccgcagagtacatg

SEQ ID NO: 900 - DNA, 2244 bp, Chlorella protothecoides
  modified_base (438)..(447): a, c, t, g, unknown or other
  modified_base (845)..(854): a, c, t, g, unknown or other
  modified_base (1362)..(1371): a, c, t, g, unknown or other
  modified_base (1594)..(1603): a, c, t, g, unknown or other
atgcatgtgggctggctcccgtcacaagcccagtgtatgaccgtgcttgagacccccacccggagctcccaccatgcatggcgacccgagtcacaggacctgcccttggtggctgagaggaagctggatcccagcatctgcgtgccggtctacaccagccaggccgcgtgcgtgaccggtggcgcagctgccaaggagctcagcctcgtgcatggtgggtggtgttaccaactctctggaaggtgcctctttccattgcaggatctggatctaccttcacatgcaatctttcagaccctcctggtgcatgctctgtcgtgcagcgtccgatgcaacctggctcgcttgttcggtggcctgaatttccttcagggatgcactggagcaacaaggcaatcctcgcacatttcagcctcttcctgctcacaacgaccatgnnnnnnnnnnctttcagaccctcctggtgcatgctctgtcttgcagcgtccgatgcaacctggctcgcctattcgggggcctgaatttccttcagggatgcacaggagcagcacggcaatcctcgcacatttcagcctcttcccgctcacaacgaccatgcagggtccagtgtggccctcttcctgggcaaccccgccgaggacaagctgcccaaggatgccacggccgggcgcattctgtcgggctcggtgtccctgggtacactggcttcgtccccgggcaaggagagcccagacacgctggccctgtcctttgtcgtgccgcccccaaagagcgacgtcgacaagggcaagggcgacgcgccggagaacggcaacgggaagaaagacgctgctgatgtggatgtnnnnnnnnnnctttgtcgtgccgcccccaaagagcgacgttgacaagggcaagggcaccgcgccggagaacggcaatgggaaaaaagacgctgctgatgtggatgccgacctggaaaaggcggtgctggcggcccaggtggccttcctcaaggcatgcaactggctgttggtgttgtttggcaaaggaggctgggttgggcgggttgttcaacatgatgaccgtggagacctcaaggatgggagcgaggaggagcgatcaacctaccaacgtctgtgggaccgagtctttgaagccaacaagggacacctgcccctcctcaccgagcgtctcacgcgattggatgccaggtctgacaaggacagcctggtcgaggtgaggagagggtgcatgcttacggagcatggttgggcacatggtaagtgtgggactgcctgccccaggccaggcccttacatgttaggaccaagtgcttcttttatcagtgcccaaggcttcactcccaatattcctacgacnnnnnnnnnnatgcttacggagcgtggttgggcacatggtgagtgtgggactgcccgccccaggccaggcccttacatgtcagggccaatgattgcagcaattgacaccaccaaattggcagtgtatctcgcacagaagtcgcctgagacaggtccagacaaagacagccgcaagaaaggtaagcgcgagctcacccttgtgcctctcgagaggtgtgttcgttgtagacatnnnnnnnnnntggatgtgtcatactttgcattgccaggcagttttgaaggatgtccgttgcagtgtgttcattgtagacaccgtgctgccccaacttcccgtgtgctttggcaccaccgcacagactttgagctgcagagggatgccatcattcaagccttggcatccaaggcatccgctctcctcaccaagtatcctgaggtggtgacactgccttgccctgcatcgctctgctctgatcacagcctgtcatgggctctgcctaatacatcatcttcagtgtctgcacatagtggagtccacatgctgatctccattcctcctcttccatgcacttgcctcattcagcccgcggagaccgagaccgatgagtttgaggcggcctttgtcgagctccagaagtgggtggacacctccgccgaggggactcacgccaacctgaacgcccagcgcctcgcccgcaagggacagctagcactggcatacagggcgctggacaaggctctggcggacgacaagcttgcatccaagcacaagggcatgctggagacgcgtgtgaagctgctgaagcagctgggctggagtcactgggaggctggagccaaagcccgcctggagacctccttccccgccacattccccctcttttga

SEQ ID NO: 901 - DNA, 909 bp, Chlorella protothecoides
atgctccccacgcgcctgacactgcaccctcccaccactcagtctggggagctgtgtgctgcggctgtcattaaccttccacggcgtgacagccaccacaccggccaagggcctgctcctgaacggcgcggccggaattgcaaggctgacggtccgtgcacctctggggcccgaacgcatccagcccaaggtgtgttgtgcatgccggcagggttctgtgtgtggccgggtgccctggccgtgctgggtgtcgggctgcagagggatgggcatgcaggcaaacgaagtccacctgccacggaatcctccccaccctgtttccaggagtcatctcatctgatacccttctccgatcgccccacacacacatcacaggcaagcctgaccacgctgtgcattcccctgtgcccgacggctgcagagctggcgccgctctccgctccgcgcgacgcgctgcctcgctcccgcctgacgcaccagctcacgctaacctacagcctgaccctggcagagggcgggactgtgacgccgcgctttccacgcctgaacaggctggtgtacgatggcatcctggacgggcagatgcacgtggtcaccgacgccaacaagaaggtcctgggctggggtgacatctaccccgaggtgggcctgggcaggggcaccggggctcggcgggaaggggtctgtgacaggggagggggagtctgtctgcggccctactctcccagcgagggctgtggagtggaggaggggtgctccctgggtagagcggacggctgtcgggcagctcctcggattatcctcacaacgctgccgctgaaagtagtcatcctgcccaatcaacccgccgcagggaatcaagctcggggcggggacattcgccattcgcgtggcgctgcggcacactga

SEQ ID NO: 902 - DNA, 2307 bp, Chlorella protothecoides
  modified_base (316)..(325): a, c, t, g, unknown or other
  modified_base (986)..(995): a, c, t, g, unknown or other
  modified_base (1563)..(1572): a, c, t, g, unknown or other
  modified_base (2199)..(2208): a, c, t, g, unknown or other
atgacatcaaggttcgctgttcaacaggctcataggtgtgtgccctcccggcccagcgtcggtcgcacggtgggtggcagggcctgctcgcagctccctgcacgggcagcctcgtcagttcaaggacaaagaaccagtaacatggattcagatactgggcgtcaagctgctgtcgtcgtgtctgatatgaatgagatcaccctgggagatcagttattggaggaggagagggaaggcccccccgatcccttcgccggggccatgccgaagaaggacatccaagcagatgccttcctcaagtgccagcccatggtgnnnnnnnnnnttcgccggggccatgccgaagaaggacatctaagcagatgccttcctcaaggtttgaagcttaggattttgtctttgagggatgagcaccctgagttcgatggccgcggcatcgtcgtcgcgattctggacactgggatcgaccccggcgctgctgcgctgcagaccacgcccaacggcaggcccaagatcatcgacgtcctggactgcactgggagtggggacgtggacacctccaccgtggtcacagtggcagcagactacaccatccagggggtgcgaggcagcgcgctgcgcctcaaccccgcctgggacaaccccagcgggaagtggcacgtgggtagcaagcgcctctttgatctggtccctaagggcctggcagactccatccgggccgacaggcggcgggtgtggatgcaggagcagagggatctgctggccaaagccaccgcggaggttgccaagggttgtccctgttgtggtgtcgtatgcgagtctgtccatttccaagacatgtcgttggtcaccaaggttcctgctcagtggtgcttgctcctgggtccatcctgcacaccgattccttgtcctgtgcccgttactagatcacctgacccaaaccaggccaatacttgctgtcagaccacaatgcacttccatgccgnnnnnnnnnnggacaaccccagcgggaagtggcacgtgggcagcaagcgcctctttgatcttgtccccaagggccttgcagactccatccgggccgacaggcggcgggtgtggatgcaggagcagagggatctgctcgccaaggccaccgcggaggttgccaaggtgtgttgggcttttgcctgtgtcctgcgaggaataggacctgacccacaccaggccaatgctctctgtcagaccacaatgcacttccatgccacgcactgtgctcaacgctcctgtactgcccttcttacccctcaagccctcctacgtccgcccatgctgcagctgtcgactcaggggactcccaaggtcaccaaagaggaaagggaggagctggaggcacgcgtggcgctgctctccgagtttgccgaaaaggtcgaggaccagggcccggtgctggatgccgtggtctggcaggatgccagctcggtctggtgggctgcgctggatctgacggagctgcgtggccccgcccgcggcgctctggccgacttcaagcccatgaccgactttaaagccaggcgccagatttannnnnnnnnnggcgccaggtctgctgcagctgaggagagcaggggggagggggtcctgcctgccaggcctgctcagggtgcaggctcgaaggaggggcgtttgtgcagatctggtaaatggagtgcagaaacctgcaccccctcccttctgtatggcaccccaactgtgaatttgtttgcagcaaggctctccctcaccgatcgtacgccaacccctcttccattgacattcgcctctgctgctccggcctgcgcagtacacggcattctcgccgtccgacgcatgcaactttgccgtcaacatctacgacggcggcaacatcctgtccatcgtggtggatgccgggagccacggcacacacgtggccggcatcaccgccgcctacgatgcggcagcgccccacctctccggcgtggcccccggcgcgcaactcatctcctgcaagatcggcgacacgcggctggggtccatggagacggcgccggggctgtacagggccctggccgccgtcattcagcacaaggccgacatcatcaacatgagctatggggagagcacggccacgcccaacagcggtggggcttttggatggggtggagtcgaggttctggaggggaaagtagggctggattgtgnnnnnnnnnngccacgcccaacagcggtggggcttttggagggggtggagttgaggttctgaaggggaaagtagggctggattgtagatatccgacggttcagcagtga

SEQ ID NO: 903 - DNA, 717 bp, Chlorella protothecoides
atgatcaatatcttaccccaccctccgcacccccctccctcccaaggccgcttcatcgagctggcggaggaggtggtgcacgaacacggcgtggtctttgtctccagcgctggcaacagcggccccgccctgtgcacggtgggcgccccggggggcacgagctccgcgatcctgggcgtgggcgcctgggtcgcgccagagatggccgccgcggggcacgcgctgcgcgagccgctgcgggacggccagcagtacaactggtccagccgcggccccgcgcccgacggcgacgtgggcgtcgcgctgtgcgcccccggcggcgccgtggcccctgtcccgcgctggacgcgccagcgccgccagctcatgaacgggaccagcatggcctcgccctgcgcggcgggcgccatcgcgctggtcctgtctggcctcaaggcgcagggcgtgcggcccagcccagcccgcctgcgccgcgggctggaggccacctgcctgcggacgagctgggacgccgacagcgtgctgagccagggcgcgggcctcatccaggtggccgacgcccacgctttcctcctcgcaccctgcagcccggcggcctcgcagccctgggaggtcacgctgcagcgcaccgacgcgggcgcggcggcggggggtggaaagcgtggcgtcttcctgcggacggggcaggagacggcggtgacctccacccaccagtaa

SEQ ID NO: 904 - DNA, 576 bp, Chlorella protothecoides
atgcgaggcatacaggctcagactgcgcggggcaaacccagaccaaaccgcccctcccctccaccctcgcaggaggtgttcaacgagacgcggtccatcctggaaccggcgggcgcggtggcggtggcgggcgcgctggccttcgcctcgaggtatcgcctgcgcggcaagaccctagtggcggtgacctccggggccaacatgaactttgaccgccttcggatcgtgtccgagctggccaatgtgggcagcgccgagacgatgctggccaccgcgctgcccgacgagcccggcagcctgctgcgcctgatggacatcctgtccggcaactcgggcccgctgaacatcaccgagttcaagtaccgctacaacatgcactccgacggcctggcacgcatgctgttcagcgtgggggaggccccggggtcgaaggagagcagggcgctgatggcgcgcgcgcaggcagcgggcatccgcgtgcaggacgtttcggacgtggagctggcacagacccacctgcgccacatgatcgcggggttgggcgggaacgtacccaccgaggagattttccaggca

SEQ ID NO: 905 - DNA, 1488 bp, Chlorella protothecoides
atgtcctactcatgcctgaagccctggcgcaccaccagcttcgtcacccgatccaccgtcggcgcatactgctccgacccgcgcttcgccagcgcctttgactgcgcggcttcctgcagtgcggacgacgcctcggccggctgccccgcggacagccctccgcagctccaggccccgccgccccccggcgcccctagccccgaggacccggcggacgcggcatgcactgcgcaccagccctgcggcgacggcggcggcgccgccgccggctgcggctgttgcacactggccgtggacgcgggcacgctgcgggcggcccacgccgtacccaccgcgcagctggccaccttcctggtcggccaggcgctgacgggggtgtggatagccgcactgctggcggccctggccagattcaagcgctccgcggcgcgccccgtcctctccgcctcccgcttctcggtcctgctgcgcggcaagcggctggaggacgggccgctggccgactgggcgcggcagtatggcccggtggcggcctgcgcggtcatccccgcggtgggaggggtcctgcgctggggccgggaggcgcaggtcctgaggtccaggttgcccgcggcaccttcaactcgacagtggtgcctgcgcattggatatctgatcactcatcctcaaccctccactcctgccctccgccgcccccaaaactcgtgtagcctagcggaatcggccgcgcagcagatcccgcccccgctcggcgccttgaaacgctggctgttccgctgcgctgcgctgggctgcgcctcccacgcgcgcctggccgcccgcctggcacgagccgagcgtcgggtggcgctgtacagccagccgcgccacgccggccggcccaccggctcggcgctcgtgactttcgagtacgcggcacacgccgacgcggccatcgcccacggcggcgccggcggggcggtgggctgggtgctcgatgccgcgcacggggtggtagggtgctgctgccgctgctgtggggccggcctcgcatccggacctgcaggcatccgcctggcggggtcacgcgtgcgcgtctcgcgcgcacccgaaccctccgacatcatctggcggcacgcggccagcgcgccacgccccggcgccctggccgcccgccgcgcactcagcctggccgccacagcactgatcgcggcggcgggcgccgccgcgcagtacggcctgtgcgtggcggccgaggcggcgcgccggcgccgcgtcgcgcgcttctacctggacccctccctggcccagggcatctccttcgacagctgggcggcctttgctgcctcggcgggggacacggtgcgcctgtccctggtgtccgccaccgcggggctggccgtcgtggtcgtcaacctgggcgtgacggccgccgtgcgccaggtgggaaggctgaggggagagggcggtggggaatggtgtctggggaatgcgccgaggttgaaatga

SEQ ID NO: 906 - DNA, 357 bp, Chlorella protothecoides
atggaggtccgcgccgagctttcttcggagcgctcgtccttcgtcagccaccccaagcacctgctcctgtacgccacggggcgcagcttcgagatccaggtggacccgcggagcctggagccggggctgcaccacaccgagatcagggggaccgacaccagcgaccccggcgcggggactctgttcaccatccccatcaccgtggcggttcccacgcccgtgacggccggcggtagccagccgggggcggacgtggagatcgagggcgagggccacgctgagctgcagcggccccacacctttgacggtgggaaggggatggtggtgttttgggtttggctggcctggcgtttgtga

SEQ ID NO: 907 - DNA, 378 bp, Chlorella protothecoides
atgcccaccaactctccggagatcaagtaccaggccgtggagaggctgggtggcaccgtggagctcgtgggtgagtccttttacgagacggcggcgcacgccgtggcccgtggcatcgccgagggccgcaccttcatcaacgcctacgacgacccctactgcatcgccggccagggcaccgcgggtgcggagatccttaggcagggtgacattgacaagatggactacatcttcgtcgcggtggggggtgggggcctcattgccggcatcgccgcggtggtcaaggcgctgaagcccagcattaagatcatcggcgtggagccgacaggtgccagtggtcagagggagagtagggtttattgtgcatcattgtcttag

SEQ ID NO: 908 - DNA, 453 bp, Chlorella protothecoides
gactggctggcggccagcgccgcgctgccgggcggcggcggcgcccaggtcggccccctcctgcgcctgctggtggcggggctgggcagccccgaggccagctccgccgccgcgctgtccatccggcgcttgtgcgagggcgcggcggcgcagctggccccggagctcccggccctcctccgcatgtttgccgagatccaggggtcgggcgacgtcgcccagaacgcctacgagcagtatgacctggacgaggaggacgtgcagcaggtcgactcattgttctcaggggaccattggctgtgttgtgttgttgctgttgtatcgaggggggggggggcactatgtagatgttggaatcccccagagatgcacgcaaaccacacctgcacacaagccggcaccgccacccaaccatcaacctcctccgctcctccccctcatccatccagctga

SEQ ID NO: 909 - DNA, 927 bp, Chlorella protothecoides
atgcaggcggcgctggcgcgcgccgcggccgcgacacgtgccggcgccgagccaggcgccgagtccgggctggggctggtggtgccgctcatggagcgcaccaccaccgtcttccgctccagcagcgaccgcgccgcggtcggccaggcgctggtccagctctggcccaccattgaggcggccttgggtgcgtgtgtgggtggtaggagggggttggggagggttttggtgggggggtattctcatgtcgagtggagggggtcttgggtaagtgggagggagggcgccgtggactcacccactttgcaggatcacggctcccctccacatgtgcgagggtggccgtcgccccccctcctccccattgatacccaccagccacattccccctcagatacaccatatcccaaccccctcatacactccagatcgattcgcggacgaccccgaggcgacggagcgcatcctgcgcgcgccgcggtacggtctgcgcagcgccgggcgcgccggcgcgggcgcgatcccctccctgctctcctccttccccgcgcgcttcgcggccggccaccaccccgcctacctctacgtcatcagcgaggcgatcaaggtcttcggcgacgagcccgggtacgtggcggtcatggagcccatcttcgccgcgctggtcgccgccgcctgcgcgcggctgggcagcctggccgcggtgggggccagccccgacctggccgacgacaccttcctgctggcggggcgggcgctggcctactgcccgggcctggcgctgacgccggggacgctggcgcgcctgtgcgacgccgcactggcgggcctgctggtgcagcaccgcgaggcctgctgctccgtgctggctttcctcgcgcgcctgctggaccccgcgctggccgcgcgctcggggccggcggcggc

SEQ ID NO: 910 - DNA, 1086 bp, Chlorella protothecoides
  modified_base (36)..(45): a, c, t, g, unknown or other
  modified_base (129)..(138): a, c, t, g, unknown or other
atgaaccatggggagggacagccgatgagggttcannnnnnnnnngagtggggaggggggggtggcttttctttctttcctggggcattgcgtgtgaaccatggggaggggcagccgacgaggattcgnnnnnnnnnncgtgaacaccattcagacatcaacaagcccctcctccagcccctcaccgacgcagtagtggggcccgtggccaaaggtgaggaagttgcgcgcgtgcacgatgtcctccttgcgctccgggccaaacctgtccgggtcgaaggtgtgggggtccgggaagccctgcatgttggccgaaacgatggaggggacaaccatggtgccgcgcggcaccacgtagtcctccgtcagccggtagtcggcgtagaccatggaggggaccatgggcgccgggggccggaagcgcagcacctccttcaccacctggcgcgtgtaggtcatctgcgccagcacctcgcccgtgatggtggtggccaggtcggggcgcagggccgcctgctccgcgcgcacgcgcgccagcacctccggccgctcctccagcagggtcaggcaccaggtgagcgaggcggtgctggcgtcctggctggcaaacaggaagtccagcatggcgtccgccatgcggtgctcggtggtgtggggcgggggcggcacgccctccgccgccgcctcctcgatctcctgcaggcacttgacggaccagaagtccatgaggcagcgcggctcgccccccgcgcgcacgtacgccaccgagcgacgggcgcaggtggccagcaccttgaggatgtacagccgcccctgcttgcccttccacacagcggtgccgggcaggcacacggggaaggcctgcgatgtgatttggggggagaagaggggaagctggaggagatgcacgcgggacaagcttggtggggacggcggagggggtgcaacatcactgagcatgtcacgaagaggcaggccatttcagggcggcagcaaagcggcagcggcggggcgggggagttgggacatgtgattgggagagcagccctgcaccggcacgtccgcgtcccagggggtgtggcgtag

SEQ ID NO: 911 - DNA, 1500 bp, Chlorella protothecoides
  modified_base (660)..(720): a, c, t, g, unknown or other
  modified_base (1263)..(1366): a, c, t, g, unknown or other
atgaggctgatggggtgccagactccccgcgggctggcactcgccaggatgccagtcttgctggccctgctgctcaccctgctctgcgccacagcgagatcttcgcccctacgcttcttcatagacgcttctgcctttgcggagggtgagactgacttactgttggaggccatcgcggcctccaacggcacggccagcgtggtgggggtctcacgtggcggattcctggcccacaagggctggcacaacacctccatgtgggacatgtactggacggggcgggaggtagggagatcggggtgtgggctgtcgtcgtttgtgggtatcattggtggctcgtggctttccttctcggcgcacagcgctgcgctggcgtcgcggactacagccccatgggcaagaagatcacgatcttttcccccacacacacacaccctttccccaggcctgctaccgcgccttcctgtcccacctggcccccggccagctggtgtcctgcaccccgggcagccaggccatcacgggcaaggccagcctggtggcgaccatgaagcgtgcctacggcacggccgcgtccctcttcgtcccagagtccttcgtcctgcccggcgactacctggcctttgcccgcgccgtggttgcggcgggggccgccccggnnnnnnnnnnnnnnnnnnnnnnnnnnnnnnnnnnnnnnnnnnnnnnnnnnnnnnnnnnnnnacagtcaccgcgggcgcggcatcgcggtgctgccgccggccgccgcgctggccgccgcgaggcagcgtcggctgggtggcggtgcgcagcgctacgtggtggcccagcgcttcgtccccggccagctcctggtgcggcgccgcccgcttgttcggctcgcgccagggtgctgacgacggcagcgacggggatgacggggacggcgtcgccgacggcggcctcacgggcatctctgctcagggcgccgatgcgtcagggcaccaggccatggtggtcaacctgtggcagcaggaccgcgccgcggcgcgcccctggtccctgcgccagctctgggaccatttggactcccgcttcggcgccggcgcggcgaccggggcctgggcccgcatgtgccttggcgtggccgccgcgctggcggcaggcctgcccgcgcagcgcgaggccggcgcggcgctgcccgggtaccagggcgggaacgcggaggtgctgggcgtggacttcttgctggacggcgcgctgggcgcgcacctggtggaggtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcggcgggggaggcctgccgcgccggcacgcgcgagcccttcgacgcgcagaaggaggccttcctggccgccgcgctgcgcctgctccgcgccagcagcgacgcggcgacgggcaccggcccgggccggcc

SEQ ID NO: 912 - DNA, 429 bp, Chlorella protothecoides
atgctgatgtcgctgcacccttctgccaagaacatcctgggcccaaacaacctggccttcatgcacggcccagagcacaagaacatcaggaagtccttcctctccctcttcacgcgcaaggccctgggcctgtatgtcgagatccaggacgccatcatccgccgccatctgacctcctggctggccatcccgggagagcgcgaggtccgcgacgcttgccgcgacatgaaccagatgaccagccaggaggtgttcgtggggccctacctggatgacccggaggtcaccgccaagttcagcaaggcctaccgcgtcatgaccgaggccttcctggtgggggcgctggagggtgtggtgtacattgattctggagatgagggtgggctgcatgtggcgacaaggcagcgggcagggctcgcagtgcaatga

SEQ ID NO: 913 - DNA, 261 bp, Chlorella protothecoides
atgacgccaccctttcctcctgcaccccgaagggccacctcgagcggcaagctcatcccggggccggagcgccccttccccctcgtcggcggcatcgtggagatggtgatgaaccccttcgccttctgggagaagcagcgcgtctactccgaccccggcatgtcgtacaactccctggtgggcaagttcatcctcttcatcaccgacgccgagaaatgtcgcgaagtgatgtcggtgcgtggtgctgagcgggaaatctga

SEQ ID NO: 914 - DNA, 717 bp, Chlorella protothecoides
  modified_base (601)..(610): a, c, t, g, unknown or other
atggaggagcagcaccaacacccactctccccaccatcccacacaaaaccaaaggcactgatccgattcgtgctggagctgggccagaagacggggtcgggcagctacgctagccgcggcgccctccccttctacgcagcagtggtgtgtgagtatctcgccggcctcaagcaggtgggtgtgcaggctgtgaagggggttacttcgtctcagtctgagtgcgattgtcgtgtccatggtgtgcagagctgtgtatcactgtggcctggaccccagagctgtgcatcaccgtggcctggaccccaggtcaccgaggacaccgccaacctcctgctgccgtacctggtggcggggctggggcctgaggccctgcccgactaccgtgccgccaccctcatgatcatcggccagctgtcggcgcgcgccgccctgggaaccgacctcgtgacaggtgtgagcgtgtgtgaagattgtgttgatggggcgggtctgaggctgcgaggcccagcacgtgcatgtgacctggcggcaggcttccgccctcgggtgatgaggcaagaggctacgacagtgatgcctcggctggcgggtgatgagaaannnnnnnnnngaggcccagcacgtgcatgtgacctggcggtaggcttccgcccttgggtgatgaggcaagaggctacgacattattgcctcggctggcgggtgatgagaagctatga

SEQ ID NO: 915 - DNA, 1731 bp, Chlorella protothecoides
  modified_base (1088)..(1210): a, c, t, g, unknown or other
  modified_base (1482)..(1491): a, c, t, g, unknown or other
  modified_base (1710)..(1719): a, c, t, g, unknown or other
atgtgcaaatccctttcgcacatccctccctccgcctgctcaacaacacttttcattacagatgaaggagacgggcaattctcagagcatcctcatcactggcgaatctggggcagggaagacggagaccaccaagtttgcaatgcagtacctagccgttctggctgggggttccggcatggaggtatattgttatgtttcggtgatgggcgcatcatctggctccccgcgactcagacgggacatgacgcatcagttctcccatgttgggttttgagcgtgaccgatgcatttgacatgggccccagagccaacctgtcatgcctgtccaccaatgtgagcgcaaaggtcggcagttcgctcccctttcccttcatccaccccttgttccactccaccaccttgcagcgccgcgtcctggactccaacccgctgctggaggcctttggcaacgcctccacgctgcacaacgccaactcctcccgcttcggcaagctgaccaccatccactttgacgaccggcacgccatcgcgggcgccaccatccagacctacttgctggagaagtcgcgcgtggtgtcccacaccgtcggcgagcgcagcttccacgctttctaccagctctgcgcgggcgctggccccgaggagcgcgccgcgctggggctcccggatgccgcggcctgccgcttcgcctacctttcaggcggcgagagcaccccccccgcgctgggccccagcgacgcggccggcttcgcccaggtgaaggccgccatggaggcgctgggcgtgcccgcgccgcccgtgctgcgcctgctggccgccgtgctgtggctgggcgacgtcgccttctgcgacgatggccagggcgcggcgggggtggtggggggcccacgctccccagcgctgcgccacgcctgccgcctgctgggcgtggcgcccgaggccctggccgccgcgctgacgacgcgcgagctggcggcggggggcgaacgcgtcagccggcgcctgagtcccgcggcggccgctgaggggcgggatgcgctggccaaggccctgtacgcccgcctcttcgactggctggggcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcctttgccaccaactccttcgagcagctttgcatcaactacgccaacgaacgcctgcaccagcagttcaacgcccacctgttcaagctggagcaggcggtgtatcgcgacgaaggcatcgactggaccgacgtcgagttcgtggacaaccagagctgggactgtggcagagcagagggccatcgacatgataatggaagaaacaaagaggtgaaaaggtgggttaccgtgggttcattaatggctggctcgccggatgcccaaatcctnnnnnnnnnntcagagggccatcaacctgataatggaagaacaaagaggttaaaaggtgggttaccgtgggttcatcaatggctggctcgccggatgcccaaatcctgggcgaaaacccaaccgcatgggcttgggcaggtatgccatgctgtccaggtatgcacaacctctcgcctactcgagccatgtactgctgaaccagcgttccctccatcccaaccccgcccnnnnnnnnnntgctcgtattga

SEQ ID NO: 916 - DNA, 1521 bp, Chlorella protothecoides
  modified_base (442)..(451): a, c, t, g, unknown or other
  modified_base (555)..(564): a, c, t, g, unknown or other
  modified_base (1111)..(1120): a, c, t, g, unknown or other
atgtcggcttccatccagggaacccacctggtgggtggcatctccaggggatggacccccgtccgcccgatccataggcacaaccctcccttcctgcgcgctgggaggtgtctatcacaggcgcttcggtgtcagggagcaagcactgcggcagaaaccatcgccaaggcacgtgttgtgagggatggtggaactagggatgcttccatgcaccatttggaggggggccagccccaacctcattgccttcctgggcttgagattcagacgcaggagcatccacagtgtgccggcctgcgaccgccgctcattctttcttcccgcagacggagcgcttctcggccctggaccgcgtgtccatcctatcggaggcgctgccctacctgcagcgattccggggcaagaccgtggtcatcaatgatccgtggtgcccaggcgatgnnnnnnnnnnagcgcttctcggcccttgaccgcgtgtccatcctgtcggaggcgctgccctacctgcagcggttccggggcaagaccgtggccggcgtcgtggcggacctggtnnnnnnnnnntggcatggatctgatggggagtctgttcttgtagcttcagtgatccgtggtgcccaggcgatggtagcgattcatagaattcggctgcagccagggattggccggcgtggtgaaatggcttggaacatgctagacactctggacagagccggcgtcgtggcggacctggtgctgctggccactgtgggcatccgacccgtgctggtgcatggaggcggcccggaaatcaacatctggctcaccaagctggggatcgagcccaacttcaagaacggactgcgcgtcaccgacggtgggacaagcatgggaggaaagggggaggagaggagcagccggtcggtgcatggtcgctccccctgggcgccccgcagccacccccttgtatgctcatgttccactaccccgcgggacaggcctggggctgctgtcctgtgcgttcatgagcccagcccaagttcctcctcaatcctcatcttccagttcccacccagttcccgtgcacccgtcctgtcctcgcagaggcgaccatggatgtggtggagatggnnnnnnnnnntgcagccacccgcttgtatgctcatgttccactacccctcgggacaggcctgggctgctgtcctgtgcgttcatgagcccagcccatttccctcctcaatcctaatcttccagttcccacccaattccgcgcacccaccctgtcctcacagaggcgaccatggatgtggtggagatggtgctggggggccgcgtgaacaagtccctggtgaccctcatccagcagtctggggggcgggcggtgggcctgtgcggcaaggattccgacatcatcctggcccggcagatggtggagaaggagatcggcttcgtgggcgaggtcaccggcgtccgctcagacctgatcaaggtgcgcttgtgaggcgagcatggggctgggtgacagagtctgccttgcagtag

SEQ ID NO: 917 - DNA, 1395 bp, Chlorella protothecoides
  modified_base (6)..(15): a, c, t, g, unknown or other
atgaannnnnnnnnnccaggtcaggaagaaagggaggaacaagctgctgggtcgcaaggattcccgcttccccttcccagactcggcctcacctcaatgttcatccctcaacctccacccacacccacccaccaggcgttcaaccgctccaccaccaagtactggatccgcacctccgacgtgtcggccgtcaagcgcaccatcatcgagaacatgccggtgttcgtgttcaacgccgagaactactcgggcgacgcgcagctggtcaactcggtgtactttgacaatgacagcctggagctgtaccacgggcgcctggacaagaagcccggcgcactggccatccgcgtgcgctggtacggccccaacgacccctccctctgcttcgtggagcgcaagatccacaaggagtcgtggaagggggagaagagcgtgaaggagcgcttcacgctgcccgaggcgaaagtggtgccctacatcgagggcgagtacacggcggaggagtatgaggagggcctccgagccaagggagaagacgagctgaaggtggagtgtgaatgtggctggcaaccccactcacactcccgctcctgccaaccaaacgtacagggcaagtcggaggatgacatcgccaaggcatccaagctcttccgcgagatccagctgaccatcgacagcaagcagctgaagccgtttgtgcgcacgcagtacatgcgttccgccttccagatggggcacgaccgctccgtctccttcaccctggacaccaacctggtgatgctgaaggagaaccccgagggcgcgcccacctgcgccatctcggggcggtggttccgcgaccccgcgctccccgtctcgcgcactgagatcacgcgcttcccgcacgccgtgctggagatcaagctggcgctgccggagggcgagtcgccgccggagtgggtggcggacctcatggagtcggacctcatcaccgaggtgcacaagatgagcaagttcatccacggcactgccaccctcttcccggagatggtcagggtgcgttcgaagaaagggggaagggggtgtttgtcctgtggggtgtgtgatgccgttggacgagtagttctgagtacgtgccttcaaaagtgcatggagggtagcccgggctacgcatatcaatttgagcctctgtcagagcacccagcctcaccccctcctgctccatcaccccaccaggctgtgccttactggatggacgacgagtccatccgtgcctccatcctcaactcggccccagatgccaagcagatcgactccaggtgggcgacgcatgcaggcttgctggacacgggggaccctggatgtgggagtggagagttggctgggcgagggcagggagattttagaggattgtga

SEQ ID NO: 918 - DNA, 1992 bp, Chlorella protothecoides
  modified_base (222)..(231): a, c, t, g, unknown or other
  modified_base (1444)..(1453): a, c, t, g, unknown or other
atgggcttggaattaagtgcacctgtttttgaccgcagtccgcattcgatctggcctgcaaaatgccgtagtcgggctggggccagcaccgcctcgttgagcatcagcagcctggccgtcaggaggggccccactctaatctacgtcgcgtccctgtcctccaccccccccctcgcaccccacgattccacccctgcacagtgcttcacggacatcgtggtnnnnnnnnnngatctacctcgcgtccctgccctccaccccctccctcgcaccccacgattccaccctgcacagtgcttcacggacatcgtggtcatcggcgcggcacatgccctggccatcgtctgcagcctggccagcctccatgcctcgctcctggattccaggacctccaagtaccgcctgggcacgagtgaccgccggcgacatgtcgcggccgcggtcctggccggcgtcgccctcctggtcctcgccctgcagctcaacgcccgcctggcagcgcacgcgctgcccctggtgcagggcgccgccgcgcccttcgagtgggcggcctacactctggccgcgctttcctgggcgctcctcgtcgcgctgttcgcgacgcacgccagggcctttgcccccgcctcgtcgccggccctgtggcggttccctcctttccttgtgctcaccggcaacctggccaagctccgcttcgtgctgcagtcggaggagcgcagcgactactttgcggccctgttctacgcctacgtcgggctgcaggtcgccctgtgcctgctcctactctggctggcgccagattgccggaagatggtcctcgtggagcagggcacggggccggaccccgacaccgcggcctacttggtgggtgggctggaggagagcgggctccctaacgcagatgctggtgtgctctggaatagcccttccgatgcatgcttgagccagcagccaggctgcatctgcggcagattattggctccgcatcaccgggcctgcctccatcacctcgtttgtgcgttttcctccccatcatggaggcccccaacccctcttccccctctcacgcccgtcccccaatggcagccgctgcatgacgacgaggacgtctgccccgaggtccgcgccggccccctctcgcggctcaccttcagctggatggggccgttgatgaagcgaggctaccgcgcccccctcacctttgccgacgtctggcgcctgccgccggcagacaggtcggccaccctggaccagcgctttgcccacttctgggcggccgagcggcagcggaacccagagaaccccagcctggtgagggtggcgggggtagattgttgggcggctgggagtctggagagctgtggtgacgcagggaccgtgcatggaggttggactcgtagaagtggggatgggcagaggtgtacagccttgtggacactcaggnnnnnnnnnngggttggactcgtcgaagtggggatggtcagaggtgtacagccttgtggacactcagtatgccatgtggatcctccaagctctgtgatatccaactctttgttcatgcccatcaaacctccctcccactttcaaaaacccctcccccacaaacagacactcgtgtgctggcaggcggtgtcccacctcttcctgcccgccatcccagtgaagatgatctccgatgcagcccagttcgtggccccagtcttcatcaacctgctgctgagcgccgtgtccagtggtgcccccgaccgcaccggctacctactgtccctggggctgctggcggggctgctcacgggaaccctggccgacaaccagcaattccagctcacaatgcgtgcaggtgggggcgctgttggactgtttggtaggggccgggagaggcaggaaagggcagggagtggagtattcagcctggcacttgaagaatttgtgtctggatggttcgaggagctagccgctgggttgcttcatccctgcgctgttgatttgtag

SEQ ID NO: 919 - DNA, 3084 bp, Chlorella protothecoides
  modified_base (635)..(644): a, c, t, g, unknown or other
atgacggggcttgttgtgacccatgaacgcctgaatacacgtcagccatccatgccctccctccacaggctaccaagtccgctccatgctgacacacgctgtgtaccacaagatcctcttcctgacacccaatgcccgggcccagttctccagcggccgtctctactctgccattgggtcggatgtggacacgctgcagaacctgagccagggcatcctgggcttcatcagcaggtaggaggctggcaggacttgcctagggaccatgcccgggtagatgggctccttgcctgggtggaaagccgtgcgcctcgcgatgcccctgccacgcccaagtcctgctccgccccctgcatcggcctcatccctcatccgccgcccattcttcagcccggtccgaatcatcggcgccctggtcctgctctacttccagctcggcattgctgccatcaccgccgtcgcctttctggtcctgctcctcccggtccaggtgattgtgtggctgggtgtgttccaagatgcccttttgtcactgctgggtgtcagattgcaagggtagaggctcaccccccatctcggcacttgcagtccccctttccacaacaaccatccgtccctggccacaacacgcaggnnnnnnnnnngtgcactccttgtcactgtcgggtgtcagattgcaggggcctggctggtgaggcgtcagcgcgccatcctgcgcgactccctggccgccaccgacgagcgcgccaagctggagtcggagctgctgggcggcgtggacgtggtcaagtgctacgtctgggaggacagcttcctggaccgcatccgcggcgtgcgggaccgggagctgtggatgctgtggcgtgccttcttcatcgcctcctccaacaccgtcatcatgctggcagtgcccgcggccgcggcggtgggcgcctttggcacctacgcgctgctgacgcacaaggccctgaccccctcccaaggtgcgttgaaagttttgccttcacctccctgagcctgcttgcggtgctgcgctttcccatcgccagcctgccgcagctggtggcctcagctgtgcaggccagcgtggcccttggcaggctgcaggccatcctagccagccccgagcagggcgaggtggagcacctccctcctgccggccccggcgaggcggcggtgtccctgcacggcgactttgcctgggccttggacctgccccccagcctgcgcgacctacacctggacctccgagccggccagctggtggcggtggtgggtgccaccggctccggcaagtcttcgctcctctccgccgcattgggtttgctagagcggctgggcgagtcccccccgcgtgtgcgcggccgcatcgcgctcgtcccccagaccgccttcatcaccgccgagtcggtgcgaggcaacgtgctgttcggcgcgccccacgaccccgtgcgctacgcggccgcgctgcgcgccgccgcgctggagccggacctcgcccgcttcccggccggggacgagaccgaggtgggcgagcgcggggtcacggtgtcgggcgggcagaagcagcgcatcgcgctggcgcgggcggtctacgccgacgcagacgtcgtgtttctggatgacccgctgtcggccctggacgcgcgggtgggccgccgcgtcttccgcgactgcgtgcagggcgcgctggcggggcgcacgcgggtcctggtcaccaaccagctgcagtatgtcagctccgcggaccgcatcctgctcatgcgcgacgggcggatcgtggaggacggtacctacgcggagctgatggcggcggggggggagtttgtgggcatcatgtcgcgggccgagaccgagaaggaggcgggcgaggaggaggtggaggagggcgcggggggggaggagagtggggaagaggagcatgtgcaggacggggaacagtccgacgccaagaatggcgaggcagtggcgcgctccaagctgtccacctcgacgaaggcaagggggcctcggagctcgccggccaacgcgagccgagcaggcggaggcaccgggggcccgtctggtggaggaggagggacgcagcaccggcaaggtgtcctggggcatcatgcgtggctacatcaccgcactcggcgggccactcctcgttctcgtcctcctcgccgtcttcattgccgtggaggcggcgcgtgtggctgcccagctctggctgcagcactggacgggggaagtggaccggacgcatggtgggccggggtgtgggtttggggtgctgcggctccagtgaatagtgcaaggggggatgatcaacgcgatggaggtcacaccaagcgctccattggcttctacctgggtgcgtatgaagagtatttttcaaggcttgccctcggtgacttctgcgctgtcgatgtgctgatcccagagctgtccccgcaagtgtctgacaccatgcatttgggtagctggcccggggtctcaacaggcgtcatgctgtgggaaaccattgcagtgatcagcccagcatgttctctagtttacaccccccacagaaggcatgatccactcttccacctctcctgccggcccaaacccctatactgcccccagatttctcccctcctgtcactattatcaggcatgtacgccgcgctgagcgcgacccaggtcgtcttcacggccatctcgcagtacctggcgcggtacatgtccctgctcgcttcacgacgcctgcacgatgcgatgatcgcgcgcctggtccgcgcccccatgtccttcttcaacatcacgccgcttggtcgcatcgtcaaccgcctgaccaaggacacctcggagctggacaagaacctgaccgactactccgccttcttcatgcgctccgtgttccagctggcctccaccgtcattcttggtgggttgagaagggggggcagcacagggtccggtggagggcggcgcccactgaccgacgatggtgcagcctgtgcagctcatcctccttgctggggaggattacctgaaagggtttgcttggtgggatgcagtgctcgaccatcccctgacctgtgtccctgctgtccctga

SEQ ID NO: 920 - DNA, 267 bp, Chlorella protothecoides
atgtactgctggaccagcgttccctccatcccaaccccgcccacgtgcaggactgcgtggacttgctggaggcacggccgccagcggggcaacgacaccacctttggggagaagctgcgcaaggaggccggctggcacccgcgcttctccttcgatgctcgggcccccggcacggacttttgcatccaccactcctctggcagcgtggtctactcctgcgccgccatgctggacaagaaccgcgacacgctgagccagggtgagtga

SEQ ID NO: 921 - DNA, 207 bp, Chlorella protothecoides
atggccaccgctctcacacagcagctcaggcagctggccgtagcgtctggccagcctgccgggggcaagcgcctgcgcgggaagccaagcttgatatggtcgacacaggaggctgccgatgtggatgtggagaccgtgtacagcataggacgggaaggtgaggggcttggctgtccggaatgcagccgtcgggctggtgactggtga

SEQ ID NO: 922 - DNA, 744 bp, Chlorella protothecoides
atgcgcaagctgacggggctccagagcgtggggcccgggacattggcggcggaggtactgcgcaacgtctactcccacgaccttgcctcctgcgggccacgccagctggtgctggacggagtgcaggacccgggcaacatggtgggagggtgggagggctgtggggacagggggcagggaggtctctgggtggggccgactgcatactcgggagccaaccaaggcccgagtaccgccgctgccctttcccacccacgcgctctcgaccccccttttgtcgcagggcaccctgctgcgcacggcgctggccctgggctggaccgacgtcgcgctgttgcctggctgctgcgacccaggcaacgacaaggcgcctcgctccgcctgcgcctcgtggcgacggaagacgttgagctggcggcgtcctggaaggccaccggccgcatggccttcgcggccatggtgccggaggggacggcggtggggcggggtgggggcgcagggaagaaaggacgagccctcccctccctggatgtcgccaacggctaccccgacggcgtcgcgctggtgctgggggcggaggggcgcggcctgtctgccagcctggcacgcgcgtgcctccacctgagcgtccccatggtgcctgggtcggtgcagtccctgaacgtggcggtggcgggggccatcctcatggccgcctgctccggcgcatggccgcacctgggagagccccaggacggccggtga

SEQ ID NO: 923 - DNA, 594 bp, Chlorella protothecoides
atgggttgcgcccacgaccctgttttgggccatggattgcctaacaccctgctggaccctatgcgtgctgatgccgcgctccacgcgcacccctcttggcctcttgagcccgcgccgcttcatcccatccctccacgtacccacccacgcgcagccttccgccagctctgcgagctggacaagcgatacgaggccttccagtccaccctgttcagccccagctccatcaccctggaccggagccagcagagcgtgggggtaggggccggcatcgatgccgccgtcacccggctgtgcacgctcctgtcctcctccttcctcctgccccccgccttccccgtgctggagtacctgctgcgccgctacgccgtgcacgagcacaacgtggacagcctgatgctggccgcgctgcctttccacgccaccaaccagtttgtgcgcctggtgcagctgctgcgcctgcggggcaccctcttcgagttcctggagcccatgcaggagagcggagcggccctgccgcgctccaccctcgtcctgcgctgcatcacagacaaggtggcccagcgggtttggggcgatgggttcttggggtga

SEQ ID NO: 924 - DNA, 183 bp, Chlorella protothecoides
atgcagtacggcccctgtgacccagcccggacccagaacatcgggcgctcccctccgcagttcggaaaatacctggatgagaagaaacgggccctgtgggccccacattacgtcgactacaaggccctgaaggatctcatcaaggactgtgcggctgctgccgagctggtgggcaggcagtga

SEQ ID NO: 925 - DNA, 606 bp, Chlorella protothecoides
atgcccgcctcgcagaacgatggctggcaatcatcccaggtgacttcgctgtccgtcactcgcttcagctcccgggacctacccgaggagcagttcttcaagcgcctggaccaggaagtgtccaaggtgggcaaattcaccgcccagctggtgaccacgctgcgtggccgcctgcagaagctacaggactcggtgcataaggaccttaagcccggcgagagggacgagctgctggaggtgagaaagatggggcaaatttctgagggcaagaccctggaaatggtcgtttatagggtgatattacaaacgtccaaccagagtactccctgggagctgggcacaatcattgagacccggtgctcccccaccctatccccatccaagcaggaggccaaggccatcggcgacgagttcctgcagctcgaaaagtacgtcaacctgaactacatgggcttccacaagatcctgaagaagcacgacaaggcgctgccccagactccctgccgccagttctacatctcccacctgcaccagcagccctgggtccaggtgggcgccgtggccatgggcttgtgggcattggcagcttcagctcgggcactctga

SEQ ID NO: 926 - DNA, 276 bp, Chlorella protothecoides
atgcaccgaccggctgctcctctcctccccctttcctcccatgcttgtcccaccgtcggtgacgcgcagtccgttcttgaagttgggctcgatccccagcttggtgagccagatgttgatttccgggccgcctccatgcaccagcacgggtcggatgcccacagtggccagcagcaccaggtccgccacgacgccggcctgacaatcaagcagggcatgagtgtgatgccgaattctatgaatcgctaccatcgcctgggcaccacggatcactga

SEQ ID NO: 927 - DNA, 531 bp, Chlorella protothecoides
  modified_base (33)..(42): a, c, t, g, unknown or other
atgccgcgatgcacgaggcctacgtccgagtgnnnnnnnnnnccgcggcctgagcacccgcgaactcacccacgcgcaggcaagatgatcgaggacgccgcgatgcacgaggcctacgtccgagtgatcacgcccgagcattccccctcggaggagacggaggatgtctgctacatgctccaggaagccatggagctcaggcatgttgaatggcgcattttatcgcgtatgagggtgtttcagtggccacgtatgggtgccgggctgcgccgattcctgtgctgcatgccccgtgcatggccgcgcagcggttgccgtggcggcggcccagtgactgggattcaggctgcagcgcagtgcatgtcgattgtgcatgcattccacccgcaggcatctgatgaacttgcttgccaatcccaatcggaccccacgctgaacccacacatgcacgtacaggcgaaagtggctgttcaagccggtcctatcccccgagcagctgtcgcacctggccgaggccaaggagctgtctga

SEQ ID NO: 928 - DNA, 582 bp, Chlorella protothecoides
  modified_base (246)..(255): a, c, t, g, unknown or other
atgcactgggtgcacaccaagtactggaagatgggacccgaaggcaacgacatccagaagacgaatgtgcctgccctgcgcatgagattcaggtcggtaggaggttggtgctacagagccagcacagggcagggattggtgtggcaatgtgtggcaaggcaccctcactcccaagcaggaaggattgtcatactgaagaggtcacgctcctgcagtctggcgcatcagcccatgccaacaggctgnnnnnnnnnntatgaacaggggcaccctcactccctagcaggaaggactgtcatactgaagagtttacgctcctgcactctggcgcatcagcccatgccaacaggctgcgggaacgtaagccaaaggactgagcagcttctgtcccctgctcccactcttatcatggagcttgtcaagtgctggcgtgtaggatctgtgcctgctggggctgtcccaggcccagttgtgacaagtgacaggcaaagtggggccattgtgcagatgttgtgccagatcaatgccccaggatcccccctgccgggcgtgcaccggccgcacagggcctcccaaagatga

SEQ ID NO: 929 - DNA, 978 bp, Chlorella protothecoides
atgcgggctctcttatccaaccgagcgctggcccacaccaaggctaggcggttcgagaaggccctggaagatgccgaggctgcagtggccctggctccatcctgggacaaaggatactggaggaagggtgtagcactggaaggcttgcatcggattgcagacgctgtgcaggcctttctgagggtgtggacaataaatggaggtgaggcagacccaggcatggttggaggcaggatttgcggcatcccatgctccctgcctgacgagctgccacccagtgcaggagacagcgagagcactgcaaggcttcaggccgtggttcgaaaactcacccgagagcagctgggcagtgggatgctgggactcatagaagctgccgtccaggagggagccatccccaaggctactgtggagtgtgtccctgtagatgctcttcacgaagctgctttcctggttgtcaagcaagctcatcacggcgtccccagtccggggccttactatgccaggtacctctcctggctcacatcgggcatctccccaccagccgccctgatagagcgctctcgcattcacgccgcgggccgctgcttcctccaggcggctgcggatgccgagcacagcgtccgcctcctgttcaaagccgatatccacggtattgagctggcgcaggcgtatgcctgtcagggcgccggatacctggcggtgcagggccatgccgaccgggcccctgcgcctgccgccgcctgcttcctcaaggctctggacaacgatcaggggctgctgtctgtgcaagcgagcttggaagaggctgtgaaggacctcaccaaggaggagtatgaccaggtgtggctgggataccccgatgctggggccttggaggggttcgctggcctgtgtaaggaaggtggcgaggcctgggcggtgccatccatccgtggtcctgccgtacctcaaactctcggggatgcgtgcgagtga

SEQ ID NO: 930 - DNA, 450 bp, Chlorella protothecoides
atgccaggcgaggctggagatgtagaccacctggcagtcacgttcatggcggcggagaacatcgcgcatgggatcaacctgcgcaagtccccctccatgcagtacctgtactacctggcgcagtcgggcgcgccgggcagggcgccggctgcatgcccgcacggagttgtagccgtcaggtttgctggacattgcatgcagtcaatggacccggggcaactgccgcatcccacccttggctcaggtgggcctgtgcatgagccccttgtccaacaacttcatcttcctggactaccaccgcaaccctttcccaaccttcttcgcgcggggcctgagcgtcagcctctccaccgacgacccgctgcaaatccacctgacaaaggagcccctggtggaggagtactcggtcgctgcccaggtgaggagggtctggcgggtccagcagactga

SEQ ID NO: 931 - DNA, 630 bp, Chlorella protothecoides
atgctggacgtccacgccgacaagaacatcttccagcgcttcgaccgcttcaacctcaagtacaacccctttgggcagagcaggctgcgcgagatcttcatcaagcaggacaacctgctgcacggccgcttcctggcccagctgaccaaggaggtgtttgtggacttggaggcctccaagtaccagcacaccgagtaccgcatctcagtgtacggccgcaagcccaacgagtgggacacgctggccgcctgggtggtgcagaaccggctggcctcggacaacaatatgtggctcatacaggtgcctggggagctctttgcacgtggctatgtaatggggttggggggggggcgggcacccggcgtcgggagacgaagcggtgccggtccagcctggtccttgcgggcatgtgcgatccttgccaacatcgtttcagctgtccagggtggtgccatcggcctgagaagagggtgttggtgcgtcaggggagatgtggactgcgccgctggtcgcagaaggcacaagctgtctctgcctgtcgtaatcactcgagtgttccttgtttccacacacacagatccctcggctctacaatgtgtacaaggagtcgggcatcatcgacaactttga

SEQ ID NO: 932 - DNA, 687 bp, Chlorella protothecoides
atggggtcagcaaagcagcaggagcccgcctccaccaaggccctgacagcgggcgtgcgacaggcactccgtgccgcccttgcttctgctgccggccttgagctgcgacgagtcaccctggaccgcgtgtcaaaccctcggccagactctccctacttgggagttcgcctggaggctgctgtgggcgggaatgaggaggccgcataccagatcctgaggcttgtcgagggcactccagcagcgcaggaggctgccttggagagcgtcctatccgcggtttcaagcctgggacctgtggatcatggggccagttcggcagacgtggtggacatcacccccaggggcgtccagcccctggatgccggcggccctgactcggccgggccgctcgtcccagccaccccacccaaaatggagctggaggtgccgtatcgcatgtatcgcatcacccgcatcgatggatccacggtggacagggtggacaagcaccccttctgcatgagccgagtgtactatgatgcggcggagaagccggaggagctgtgggccgagctggcggatggatcttgccgttggaggcagaccggtgctgaggtcaaggtctgcgtgctgaaagtgccgcacacgctgcgcccccgccagctcagcgtgaccctggagccctactccatcaaaggtgatccctga

SEQ ID NO: 933 - DNA, 1236 bp, Chlorella protothecoides
atgctcgtcgtcagagtcgcccgcttcgaacaccgatggtttgagcgttttggaggcagcactggtcttgggaccttttactgtgagcccgtacttgacgcccttctgcccaatgatcattatgttgatgggctggtgggaggagcacagccgatttatcttgcttttcagccacgacggctttacagccaagctgagcaatcaaggaatatctgtacacaacaacttgacatgacgctgcaacggcaactctttaagcatgagatgggcggcaccatattgtcggaggatggaatcctctccgcaagggaatggtactacaggactcctcacggcttccgacacgacctggccgcagaaggaaaatctgctgggcgggcgtcgatgcctttgggcagcacatcgcccggcaacgctcagtcttattcaggaaaatgccttgcgagctcaaacccctcgcattcttcgtttcgtggcagggcgtactcacatttgcatacaggcaagaggtttgctgtgaccagcaggtgcatgggccatgttggaatgatcgccaggtctcccccctgcctacaactccccttgagcgggcaacatctcattgcagcccgcgtgttaactctctcaaactccccccgcattcaaaacaggggtttcccggcggcgctccttgacctgaaggcacgcctgactgcaaatgtccagggccttccctccgagcagccgggctccctctggccaaagacctccctcggctgcctgcacgacaggcagcgcctcacccccgaccagctgcgggtgctgctggacctttgcgccaagcacagcgccgacctggcctcggcggcctccctgcgggtccgggatgcgcagctggtggtgcaccagtgccgctcactggagcggacgctgagcgtccagagcgtccccttgaggcccgcacgcgagggggagggggctttgccgccgcgtgagcaggaggagagggtggcaagcatcctggcggagtccggcgccccagactactggtttgctgccagccgcgacggcaatcgcagggcgcactacgccgacgcgcacctcggggtcaccctggttcacttcctggtgggccccgaggagctgctggctgccgtgcggcgcttccggagggcagtggatgctgccctcccgggaacctatcactggtttgatgatgcagcactgcatgtgaccattcgcgctgtcgtgacatag

SEQ ID NO: 934 - DNA, 300 bp, Chlorella protothecoides
atgggcctgggcaaaacagcccagtccatcgccattctggcgctgcagcagcagtctggcggcgtggccggccccttcctggtggtggccccgctgaccacgctgggtcactggcagcgcgagatcgaggcctggaccgcgctggactgcgtggtgtacgctggcagcgctgcagaccgcgaggccatccaggtgcacgacctgtggcgcgccgcggggccggcaggcggccgtgcgatccgccccagcatcgtgctggtgtcctttgacaccatgctgcgcgacaaggccctcttcctg

SEQ ID NO: 935 - DNA, 327 bp, Chlorella protothecoides
atgcaggtagcagcgttgcatgccgcagctctggctgaggacgccgctgtgtttgactacgatggccactatgatgccattcaggaggccagggaggagcccaagcgcagagagaagaaggagcgccaatcccgctacattgctggactcctagagaaggctgaggagaggaagcgggagcaggacgtcctgtatgagcgacaaatgctcaaggagagggcagccgaggatcatctgtttggggacaaggagcgctttgtcaccgctgcctacaagaagaagctggaggaagaccaacgctacgtcgccaaccagaaacgcatgtga

SEQ ID NO: 936 - DNA, 504 bp, Chlorella protothecoides
atggaacaacagcctcactcattgtcgggccccagtctggctactgcttggacccctttgccattccctgccagccatgctcacgaactcccacaacccctccaccctctcgccacccatcacttccctgcctccgcctcacaggaggttcagatagagacgggcgacatccaggtgctgctgaagcagcgcgcctcgctgctcgtcatgtccgaggccaagaagtgggaggaccgaggccggggcatgctcacgctgcgccagccccgctccggcggccagccctttctggtgttcaccaccgacacggggcgcgtgctggtcaacgcgcccttggtgcgcggcatgaagccgacggggaaccccaagacgccgcgcaacctggtcatggccctgcacaacgcggtgggggggggaccccccgcgcacggcatgtacatcttcaaggcggaggacgcggaggcggccaaggcgctgcggggcgccatcctgcagcacgtctga

SEQ ID NO: 937 - DNA, 312 bp, Chlorella protothecoides
gtctggacggcgggggctgaagactacctgcaccattccaagcagcttctggccgacttccaggacgtcctccaggcggcggatcaacctgcgccgtctgcacttggagcgaccaagcccagcctgcctgcctttggtgggctgagcacgcctgccgccacggcagctacccccctcttcaattttggtgcagcgccggtgtcctttggcacaccaggccccactccctctgcagcgccacccattgaggcccacgaagaggaggaagacgtgcaggaggagccagaggtgagtgggcaggcggcctgctga

SEQ ID NO: 938 - DNA, 729 bp, Chlorella protothecoides
atgggccgtcgacgagggaagaagggagagaacgcaggcgagaatgccgatgaggccgacacaaaaacagcagccgacgtgcagggggacccactgagggccctcatcgccatcagccccacgagcggcagcgtagctgtggcagccggtccagaactcagggtgctggctcgaagtgcagcagggtgggtggcaatgtgccagcatggggagtgttggcagggctggctggggggggtcttgcacgcgcagcaaccccaaccagggccctctgcgatccgcacgcttgcatttgatggcagtggggagttcctcctggcatcgacggacgccaaggtgctctacgtatggaggacagccacctgggagctgcaaaataccatccctcattggcgactgtggccgctgagcaagcctcgttgctcctgtctgtttacagaactcacagctggtacctcccctgcattacccacccctgctgctctgccctgcgcctgcctccctcataccagcaagctgcccaagcgtgcgacgtcaatggccttcacagccgacaaccagcactggctgctgtccgacaagtatggcgatgtgctggtggcgccgctcgcctccaaacaatccggtgtgtgtcgtggcgctgctgggcgaggggaaggagagctcgcaggcggcccagtgccccctcatgtgggaccacttacccctcacgccttaccagccccttga

SEQ ID NO: 939 - DNA, 1722 bp, Chlorella protothecoides
  modified_base (422)..(431): a, c, t, g, unknown or other
atgcagctcctgtccaccaggcctcctggtgcagcctcgttcctcccctgcggcgcgggctccggggtatgtaatgggcagtggttccggccagtgctccccgggctggctccctccacccgcctgcgccggtgtcggcccctcccagcgagcacgagggcaagcgcatccatggatcccgcctccctggagccacctcgcaagcagggcttcctgtcggccctgcttcagcccctgcgtgactttgggctgggggccaccagcctaaggcaggcgaccaatggtctgttcgtcatcgccggcatcagtgagtcggcgaggatgggatgtggcaggccttggcatgggggccagggacagtctggaggggagggttgcatgggcagtttgccggttttcacaagtggggtggaggttgcctnnnnnnnnnncatcgccggcatcagtgagtcggcgaggattggatgtggcaggcgttggcatgggggccagggacagcctggaggggagggttgcatgggcagtctgccggttctcacgagtgggggtggaggttgcccgggcggggtgtatatcccagggatggttgctggggcctccgttcatcctcgcgtcctgcatttcgctatgcctctcctcacccccccccgccctcacactccaggcatggccttcatgctggcctcgtgggccaagggcaacaacatggggcggcgcgggcagagctaccaggccatcctggagttccccgtggcctgcggcatctcggtgggcacccccgtccgcatccggggcgtgcccgtgggtggcgtgctgggcgtgcagcccagcctggagaaggtggaggtgctggtggagatccgcgactccaccaccgtcatcccccgcaactccctgatcgaggccaaccagagcgggctcatcgccgagccgctgattgacatcacgccccagctccccctgccggagtacaagggtgagctgctttgcgaggggggtgggagaggtgggaccggggtgggggctgcttggtaccaaggcacctgcaccctcggccgctccgctggccctcgacagcctcccctggcctgccccccgcgctgctcaggcaacccgctggacgactcgtgcgaggaggagggcaaggtggggtgtgccgcagtggggagaataggccgtgtgcccccatcccgcccgccctcgtctcctgccgcccctcggcgggcacctcccttgcgcaaagcaccgcctcaaccccctgggcccccccgtaacaaaagtttcttgcattcgcacccgctccccaggcgtggccatggacgacctggtgtacatctgcaccaagatcgcgcggcagatggatgccgcggggctcgaccgcatgttctctgccgtggacgcggcccaggtagcgctggagggcgcagagccccttctccagcgcgccatggcgctgacagagcaggtgtgcggcggcttccttgctggatgtgcgcatgtgtggaatcttcagggagagcagcggtgtttggtccgagcgtcatgcggtccaatcatccctctgctggaggagctgaggcaggggggcttgctgggcaacgtggaggcgctgacctcggtggcggccgaggcggcagccgacattcagcggctgcaggtggaggattgtttgatattcctgtaggggagagaagaggaatggtaggtgctgcgtcagcttga

SEQ ID NO: 940 - DNA, 543 bp, Chlorella protothecoides
atgcaggccccgcccgcccacatccccgacttcctccccgccttcccggaccggcacacgtactgcgagacgcacgagctccccctgcccgacgcggaccccgcggcgcgccatctggcaggcatggaggcgcagcaggcggccgagcaggcgctggtgaagctgcacgcgcgcgccgcgccgcaggaccccgtgctggcatcggcgctgccggccaaagaggaggggcctgctgcggcggcggagggcggcgcacgtgcgcaccccgaccccgccgtgccagcgctggacccctggtccgccccgccgctgccggacgacggcgggccgcccgcgccaccctttcccggcggcacaccggccgaggaaggggcgccggtggaggatgcggcggacacggacatgccggacgccaagccggagccatcgcgagacccggaggtggcggccgcgctgggcgccacgctggcccccgccttccagccctgggactggcaggcgcggctgttggccctggccgcccaggcacagagccaagcgtga

SEQ ID NO: 941 - DNA, 258 bp, Chlorella protothecoides
atgtcggaccaatacgcccttgccgttgcccgcatcgtcgtggccaagctggcagatggatctgggttcgatgccctccagacctcctcagcatccatcctgtcggagctgctggtgcggtacatggaggaggtgggggtcagctctcatgcctacacagagctggctggccgcaccgagcccagcgccatggacgttgtgagtggcttgatggggagcatcatgatgcatggtggtaggagctgccctgggggatga

SEQ ID NO: 942 - DNA, 411 bp, Chlorella protothecoides
atgcctgttggagttgctgctacccagctggcgcattgggctgctcaaacatgctgcccaacacccccattgaaatccctttccctccgtcccctctcaggcacgggcatcctgctggcggtcaccatcatctacaactactgggagatgtacgagaaggagaaggcgcagatgggcaacgatcatggagactcgggcgtggtctgtgcggccctccagcggggccgcgcgctcggccggaggaggtcgccttcgcatgcgccgagggggtggcccgccgggccacccgcactcagagggaggggccacccgccgagcgacgtgtgttttgcgctgcggcccgccaaacccaacctccctgcgtgcccgtctgccagccccgctttggaccccccgcgagcctgcccgtga

SEQ ID NO: 943 - DNA, 210 bp, Chlorella protothecoides
atggcccttcgagccagcgggctggtgggcaacaaaacactccatgaagtctccggctgtgtttgcgacctttgtggcaaagtggccgacagcgaggtgtccgaggtcaccgcgctggactgctcgtaccaaaattgcgatgccatgtccgccatataccatcaggcgtgcctggagaaattcctcaaagcgcagaaatgcgaacggtga

SEQ ID NO: 944 - DNA, 2394 bp, Chlorella protothecoides
  modified_base (898)..(943): a, c, t, g, unknown or other
  modified_base (1270)..(1279): a, c, t, g, unknown or other
  modified_base (2014)..(2023): a, c, t, g, unknown or other
atgcgagtgatcgatcgggctacatcacactcccgcagagaaggggggcgatcccgaggtcgtgcgggagtcccagcgtcggcggtacgccgacgtggccttggtggaccgcgtagtggagctggactccgagtggagggatggcgggagtttcgggctgccaacctcccaagcccctgctccttcgcagtgcgcggccgcctggacggcgccaagatggagttcaaccgcctggtgaacgagatcaaggagctgcgcaaggccaagcaggacgccacagagctgcaggaggcctccaaggccatgaaggggggcatcaaggagctggaggacagggagaaggagctggcggaagcccgcgacagcgcgctgcttcccatcggcaacctggtgcatgacaccgtgcctgtgtccgacaacgaggtactacttccgggggggagagatgatactgccacagagcgcggggctggggttgggaaacgtggcggcggggagggtcggcgaaggcggccggtggagaggatcccttgccccccctgcagaatcagccagatgatgaaattcacattactcaaggatcaaccatcggactgcgcaagcacatgccgacacactcgagttctgatggctgcctgcttggcgttcctgccggggatgaccggcatcgtacttttctgtgcgcgatcgccccctcatgccctgagagtgggaccctgctcccgcatcggccgcaccctcttgacctcgtcccactcattcacacaccccgcaggacaacaatgtggtggtgaaggaggtggggacacccgcccccgcggagggcatgctcaaccacgtcgacctcgtacagcggctgggcattgccgagctggaccaaggcaccgtggtggcaggnnnnnnnnnnnnnnnnnnnnnnnnnnnnnnnnnnnnnnnnnnnnnntggtggaccagcagggtgtttggtgcccagccccgagcccggggaaggagttaaacgcgtgcccccaccctgcagccgtcgcagctcggtcacacccgcgcgtccatcgtcgcaggcagccgcgggttctacctgaagaacgagggcgtgctcctgaaccaggcgctgatcaactacgcgctgcaggttcagtgctgttcgggggggggcgtcgagccgtgcctcggctcattgccccacctgaccgagcctggccccacagccccatgcctggagctcacaacctcgaccccaccacctcacatcgcgcaccccccccccccccgnnnnnnnnnncgccccacctgaccgagcctggccccaccggcccatgcccggagctcacaacctcgaccccaccccctcacatcgcacccccccccctcgcgcagtttgcataccggcgcggcttcgttcccgtgcagacgcccttcttcatgcagaaggacatcatggcggagtgcgcgcagctgagccagtttgacgaggagctgtaccgcgtgagtggggagggagcggacaagtacctgatcgccacggcggagcagccgctgtgtgccctgcaccgcaagggctggttcgagccaggcgagctgcccgtcaagtacgtgggctactccacctgcttccggaaggaggcgggcagccacgggcgcgacacgctgggcatcttccgggtgcaccagttcgagaaggtggagcagttcgtcatcacctcccccgcggaggacgcctcttggcgcgcctttgaggagatgatcacaaactcggaggagttttatgccagcctggacctgccatacaggtgggggtggttttggttggaagggggcggggtgggcaggatggaggaggaaggaggtgtggggcagaggggggcattgcaagacgcagaggaaggcgaatcctacagccgggacgaacagcagcctggtttgctttgttcactgcccttcatggtggtcaacatcgtgtctggggagctgaacaacgccgccgcgaagaagtacgacttggaagcgtggttcccgnnnnnnnnnngctctgttaccaagactggaagggagggtggtcaacatcgtgtctggagagctgaacaacgccgccgccaagaagtacgacttggaagcgtggttcccggcctcccagacctacagggagctggtctcctgcagcaactgcctcgactaccaggtatggagactgctgtgggcaggggatgtgtgagtgagtggggcagattaaggcaaggaaccctggataattctggagggacatcccaaggcagttactctgtttccaagactcgagggaaggtgctcatggggacctttactctgcataggcagtgttactggtgtcctcacactgaggtgatgcacctggtggcgagcagccagcccgtcttataa

SEQ ID NO: 945 - DNA, 1296 bp, Chlorella protothecoides
  modified_base (572)..(581): a, c, t, g, unknown or other
cgcgcccagccacgcgtcggcgtggccgccgcgcggcgcgagttcgccgccgccggcaccaaggccctggccgagcagccggccttcctgcgcggcggccgcctgcgcgactaccagctggactccctcaactggctgtcctactcctgggcgcgcggcgtcaactgcatcctggccgacgagatggggctgggcaagacggtgcagtgcgccgcgctgatgggctggctggcccttgcccagcgtgtctccgggcccttcctggtggtcgtccccctctctgtggtccccaactgggtccgggagttcgacaagtgggtgccgcagctggacaccgtggtctacgtcggtgacgccgcctcgcgccaggtcatccgcgagttcgagtttggcggcggcggcggcgcggggcgcggcggcgccgccgccgtgcccgcctttgacgtgctggtcaccacctacgagatggtgatcaaggacgccgccatcctgcgccccatccgctggaactacctggtggtggacgaggcgcatcgcctgaagaacgaggactcggcgctgtaccgtgagcnnnnnnnnnnctacctggtggtggacgaggcgcatcgccttaagaatgaggactcggcgctgtaccgtgaattggccgcctggagcttcaagtccaagctcctggtcacgggaacacccctccaggcaagcccctcaaggggggagggggggtgcatggaaatgtcgttgggattgaagaaggatgaggcagtaacaggctttgccgtcaaaggggagcaggcaagggccgtacccctcccgatgactggctcgagctgcccacccttgcaaacccaactgcagaacaacatccgtgagctctgggccctgctctctttcctggagccggccaagttccccagcgcggaggagtttatcgccaagtacgacaccaccgactccgagcaggtgggttactgggattcttggcagggtcattggcggtgggcctcatctgtcacttcagaggtacagcatcagcaacgtggcatgcattgcagactgtcctggcatgacgacaccagctgtcaccctccatttccacccaatccctctgcctttgcaggtggggaagctgcacgctatcctgcgcccgcacctgctgcgccgggtgatcaaggatgtggagaggtcgctgccgcccaagacggagcgcatcctgcgcgtcggcatgacgccgctgcagaagcagtactacaagtggatcctgtccaggaactaccaggagctgaacaaggcgagtga

SEQ ID NO: 946 - DNA, 1335 bp, Chlorella protothecoides
atggtgctgctggacaagttgctgaagcgactgtatgagtcagggcaccgggtgctggtcttcagccagatggtgagggtgctggacatcctggccgactactgccgcctgtgcggctacagcacgcagcgcttggacgggtcaaccccagcccaggcccggcatgccgccatggaggcctttaacgccccggggtcgaaggactttgcgttcctgctgtccacccgtgcagggggcctgggcatcaatctggccacggccgacaccgtcatcatcttcgactcagactggaatccccagaacgacctgcaagccatgagccgggcccaccgcatcggccagaaggacacggtgaacatctaccgcttcgtgacctccgggtcggtggaggaggacattctggagagggcgaaggccaagatggtgctggaccacctggtcattcagcgcatggacacctccggccgcacagtcctgggcggaccccagggcggtcagtcgggcaccaagctgtttggaaaggacgaaatggccgccatcctgcgcttcggggcggaggacctgttcaaggaggacgaggcggccacagcctcccagggccaggcgctgtatgaagaggatatcgacgccatcctggcccggtctgaggtggtggccagcgccaagggggccgagggcgggcccggggcggagctgctgggcgccttcaacgtcgccaccttccagacctcggagagcgacgcggagttctggaagcggctcataccggagtcggaggccgccgaggccagccaggcggcgcaggtgggcgcgggggtcattgggcttatgaggcatcgacgagcacgtgagaataaccccagagtagcgtctgggagaagactaaaacttcctccaagccagaagcccctacaccctgacctgcccccggttccgacaatcaattgctgccgcacgcagggtgaggaggagccgggcatccgaacagcgcggctgcggttgctggaaccaggcggcaagtcgctcgccgaggaggatgacaatgaggacggggaggagggggaagccccggcctggaatccgggtccgagaaagaagggcaaggccgccaaggccgccgccagcgtggagggagcgcatgcccggatctcacgctggccgccgccggtggacgccgcggggtttgcgccagaccaagcggcggtggggcccccgccctccggctggccctccgcgctttctaagaaggacgccacggccttcctccgtgccgcacgccgctacctgcaccccggcaggctggccgagatggcaggtggggagggggggggatga

SEQ ID NO: 947 - DNA, 723 bp, Chlorella protothecoides
atggagttttggagtcactcccacgatgtctccatcgtgggttcgacgctggtgatcccggccgtgaccgtcgccagcctgggccaactcgccctagacgtgctgatcgagacccagcaggcagacaaaatcggcaatctacatcatactgccttgctgccctgtgccggatccaagtccttcgatcacgtgaaggacgctggtcccgccctggccatggaggtgtacaggtcaggcgacctggtcctcctccagcaaagggcgccggtggctgccgggtgtcagtcgaactttgcacagagcatcgcgtcctgggctcaggagcaggggttggcacaggtactgctgctggggggcctggatgccacgctccgccgcggcgagcagctggacggcgcgcagcagctgcggtactggcaggcgggcgagggcgtgctgtctggggcgctgcacgcgggcgcggtgcccccgctggaggagtcgtggtgggaggagcaggcgctgcgggagtggagcctgccgccctggccactcgcggccgcctgcgccgacctgggcctccccgtcgccgccctgctgcgctttgctgccgagggcaacaacgccgccgatgccgtggagctggcgggggcggcggctgaggcgctggggctggggctggcagcacgggacctgcggacgccgtcgacctggcaacacgtgtttggcatgccgccacggtga

SEQ ID NO: 948 - DNA, 765 bp, Chlorella protothecoides
  modified_base (206)..(215): a, c, t, g, unknown or other
  modified_base (577)..(586): a, c, t, g, unknown or other
atggccgcggcggccagcctcctgcccgggcgccggctggacctggaggacgtcgcgccgggcctgctgcacctgcccccgggcctcctttgcatgccaggtgggaggggaacgcccataatcgctggggggtggggaggaggtcccccaccccccgcgccgtgccggtttgcgccccccatcacctcgctctgccacccacccgnnnnnnnnnncataatcgctggggggtggggaggaggtcctccaccccccgcgccgtgccgctttgcgccccccatcacatcgctctgccacccaccccgaagactccagatccacgccgtcgcaccaccgtctcccctcccctctccctcgcccccgccagggtgcgagcacgtgcgcgtggctgggtttgcctccgggaccgtggatgtgctgcagaccaagacccggcccaagctggtgcacctgctgggggaggacggcgtggcccggcccttcctgctcaaggggcgggaggatgcggcagcgcacgcctggctgctgcgcctggcggacctggcgcggcgcgcggcggcctcggcctcgtcccccnnnnnnnnnngcgcacgcctggctgctgcgcctggcggacttgacgcggcgcgcggcggcctcggcctcgcccacgctgcgcgacgccgcgccggcctacggtctgctgcccctgggcccccgcgccgctctggtccagtggctgccgcgcgccacgcccctcatgcagatgcactcccgggccgccgc

SEQ ID NO: 949 - DNA, 2304 bp, Chlorella protothecoides
  modified_base (1537)..(1546): a, c, t, g, unknown or other
  modified_base (1619)..(1628): a, c, t, g, unknown or other
  modified_base (1791)..(1841): a, c, t, g, unknown or other
gttctcgaggcaggttccgtaagtggggctggtgctcacccaccgcttggggctggcaccctcatggtcgtccctggcaccctgcgcaggccgcaccctcccctccgtggcctgcatcgtccagccaggcagccagggcgggatcttggcgctacattgggcgtcccaggctggaaacagccagtcagtataggagtgccgtggcatggacccagcgtacccacctgtgcctctccaccggccttcaccctcccacccaggttccaaaaggtgtttttcggcgcagaggaggttgccatcccgcagtatggctccacggcggaggccgcaaaggcccatcccaaggccgacgttttcatcaacatggcttccttccgcaggtattggggtccaggaaggcggggggaaggagtggggtgctcaggcacggtgagcgttgaccggaccccaggcgccagcaacggcacattgatgtgcatgggcatctcacctccccccttcccaccacacccaaccagcgcgtacgagtcgacgctggaggcgctgcagctgcccaccatccgcacggtggcggtgatcgcggagggcgtgcccgagcgcgacacgaagcacctgattgccgtcgcgcggcgcgggaacaaggtggtgctgggcccggccacggtgggcggcgtgcaggcgggtgccttcaagatcgccgacgcggcgggcaccctggacaacatcctggcctgccgcctgtaccgcccggggtgcgtcggcttcgtgtccaagtccgggggaatgagcaacgagctgtacaacgtcatcgcgcgcgccgccgacggcgtgtacgagggcgtggccatcggcggcgacgccttcccggggtcgaccctctccgaccactgcctgcgctaccagaacatcccgggcgtggccatgatcgtggtgctgggcgagatcgggggccgggacgagtactcgctggtcgaggcgctggcctccggcgccatcaccaagcccgtggtggcctgggtgtcggggacctgcgcgaccctcttcgccactgaggtccagttcgggcacgcgggcgcaaagtccggcggcgacgacgagtcggcgcaggccaagaacgccgcgctggcggccgccggcgcggtcgtcccggcctcctttgaggacctggaggccaccatcgcgcgcgtgtacagggggctggtggacgccgggcgcgtgacgccggcgcgggacgacccaccgccggccgtgccagaggacctggccgccgccaagcgcgcggggcgcgtgcgcgtccccacccacgtggtcagctccatctgcgacgaccgcggggaggagcccacctacaacggcgtctctatgtcggagctcatgcagggcgacgccaccgtggccgacgccattgggtgcgggggctggtggtgggtgggtgtgggtgtgcacatggggggcgaatgcatgttgctctcgaggcgcctacctgccgacatggcaccgtaccttgcatggggggcggcgaccctgctccagtctnnnnnnnnnntcccttggatacacacacacacacacacacactcactcttctcaggctgctgtggttcaagcgtcgcctgccnnnnnnnnnngggggggcgaatgcatgctgccctcgaggcgcctacctgccggcatggcaccgtaccgggcatggggggcggcgaccctgctccagtctccgcagcctcctcagcaccatgcctgccctctgagcacctcatacgccaatactccaccccccataccccccannnnnnnnnnnnnnnnnnnnnnnnnnnnnnnnnnnnnnnnnnnnnnnnnnncgggtacgccaccaagttcatcgagatgtgcgtggtgctctgcgccgaccacggcccctgtgtgtcgggggcacacaacaccatcgtgacggcacgtgcggggaaggacctcatctcctccctcgtctcgggcctgctcaccatcgggccgcggttcgggggtgccatcgacggcgccgcacagtacttcaaggaggccgtggacgaggtgagggctgtgagggagagggggttggttgggagggtcggcctgcctatgaacaggccgggaaagagcctcattgctccagggctgggagccggacgagtttgtggagaagatgaagaggcgggggatcagggtgcctggcatcgggcacaggatcaagagcaaggacaaccgcgacaagcgggtggagctgctgcagaggtggggcgtggggctcggcatgatctgggtcctgggcatggcgggcaggcctag

SEQ ID NO: 950 - DNA, 327 bp, Chlorella protothecoides
atgtcaatcacctccacctcttcccctttcccaccaaacccaggtgtgtttgacgagagcatcctgcccctggcccatctggagggcacgctgacccgcatgctcacctgcctgccccggcctgaagtggcagcagcccggaaacaaggtgagctggcggccgtgctgaccgtgctgagctgcatggccagctcagggcgagtcatgcaggccctggactcgatgcacgccgccgcccgcctgctgcactttggccacgccacgctcgacccccgcctgcgcgcccgcgcgctctccttggtcaaggtgctcaaccacagcgcctag

SEQ ID NO: 951 - DNA, 1578 bp, Chlorella protothecoides
  modified_base (1448)..(1457): a, c, t, g, unknown or other
atgggctgtggggtcggcacaaaccagtcctgcccctccaccacaatacagtgtgtcaccccccgtcacactccctcccccgtccatgacatcgtcgtgcagacatccctggcacaattcactgcgctctacgagcgctccatcgaccaggctgatcgctccgtagtcccagcaaaacgcgtgctgcacataactggcgcgctgggttgcagcctggggggggggggtggagtctgtacgcacatgtgggggcctggctggaagactctgtgcaggtatcacattccctccactgtccctcccatccaactcacagatcactttacctatgcggccttcctgtacgtgtgccgtggactctttgagcgccatcgtgctgtctttgcctttgctctgagctgcaccctcatggtacaggcggtgggagggcggggggggcacctcgtactgaatgcggggaccgacggaatggctgtctttggatggggaattgggatgcacctccacgatcacatgtcagatcacttttgtacacatcccctgtcgctctgtttaggtggcagctggccaggcctcgtcggaagaggttgcagtgctcctggatgtgctccctgtcaagaacgacgtcccgccaaggccaagggaatggctgtccaagcccgtgtggcaccgtctgcagtctctccagggcctccggggcctgtcagacatcctggcggtcctggccaggggcgatgccgcctggcacgcctgggcgggcgcggagacgccggagagcctccccctgcccgagctggacgcccgggtgtccccgctgcagcgtgtcctcgtcgtctgggccctgagggaggacagagccatgatggccgcggcacgctgcgtgagagccacgctgggggagcgctacaccgaacccccgccagctggcttggaggaggtgctcaaggagagcggcccctccacccccatcatctgcctcctctcaccaggcaatgccagcgggcagggagtggggccaaactcttgccccacatcgccacacccaacaacacacggcctcctgttatcaccccgcgctgcgcaggcgccgaccccaccgagcagatcgagacgcgggccaagctggccaaggccaagctcagcatcctgtccatggggcagggccaggaggtggctgcccgccggctcgtcagcaccgctgccttggagggccgctgggtgctcctccagaacacgcacctcaacacccagtacctggccgaggtgtggcttgggtggtggggggaaggggtgggaagggctccttctgtggggtccatggctcaagcatgtggccttgatgggatgccctgttcacactcacctactttcaagaatcttggtcgcgttggatgtgaagcatgtgatcgccctttacaacgcatactgcttcacatgggcatgcgtcnnnnnnnnnncactcacctactttcaagaatcttggtcgcaccggatgtgaagcatgtgattgccctttacaacgcatactgctttacatgggcatgcgctgatcacacctcccaccgcaacacaccctaa

SEQ ID NO: 952 - DNA, 1035 bp, Chlorella protothecoides
atggagctccagcatacatgtgccgccatacaatgtgccatcctcaaaaggcagattccccactggcatgaaggccttcgctcgtccctactcacacagcctaccaatgagctgacgcgccagctcctttctcagagcagctactactccctggagaaacccatcggggacctgaactttgtcgtcgacgtatgtggcgtgcatgcgagctccaggagtcgggtcgcaggacatcccctcccggctcaagcgccagtttgccatctttgggctgccctcgccttccgtggagagcgtgagcagcatgtttggcgcagtcctggagggccggttccacaccgctgccgttgggcgcgcggtcgcggacgccgcctcgagcctggtcgccgccaccctggcagtgctggaggaggcccaggcaaacttgcagcccgccctgtcgcggctgcactaccagttctccctgcacgacgttgccaaggtggggcgcgcatggggcccagcacatgcctgcgccaggcatgctggggcccctttacatttgcgccggcccaaaccttgtccacctccacatgcgactcgcctgctcgtggcgattatgtaccacttgcatgcgctgcatctacagccctctctcaccttggtctctataaccatgcaggtggttcagggaatgctgcatgccagcagcgaccacgtccttggcaagcacccaggctcatcgccacccacctacatcgctgggctgtggcggaacgaggtgttgcgagtgtttggagacaagctggtgtgtgcggaagacaaggccttccttgccaccgtcattgcatcgcagctagacaagcgcaatctattcagatcgtgaggtcctcagtgcattactgtggtgcaggctggtcatggcggtcttggggagctggtccagtacgcaggcttcacccaggagcgtctggaggggaggcatggaggagccctggtgctgccggcgtacatgggcatcccgcaggccgcggcgtctctgaaaacatacattga

SEQ ID NO: 953 - DNA, 228 bp, Chlorella protothecoides
atgtcatcacagatacactcaatcttctcggcactccgtgagcagaagacctcgttcctcttcactgatgggacaaccattcccctggacccacgtgtcgggattttcatcaccatgaaccctgggtatgccgggcgacaggagctcccagagaatctgaaggtgaggccactggtgtcagcttatgcacgacaagcttggggcaacatcccatccatgggtcattga

SEQ ID NO: 954 - DNA, 1647 bp, Chlorella protothecoides
  modified_base (493)..(502): a, c, t, g, unknown or other
atgcctgaaccccatgagggccttgcaaccaccaaggttgatccctgccccgtactggcttctgcagtttgtttgtggacctcgtcacggctgtggaccagctcagtgccatgccctggagagaggctgccagccagattacctctatgctacaacaagttgcctccttccagagccggagcgaaaccctctccgaggcaaggttccgggccttcagccaggcagggtgcacggttgacctccttgaagagatacccagccttccaggtgtctggaatcctcccattattgcaccgcacatgcctcagaccttcatccttgactgtgtcaggatctggcaagccttccggcgcagctggagttcaaggatcagctcaagaacctgtcagacacactgtctctggtccaaggcctggcaaacagctccatcaggccgaggtgggcctgagaatgttgaagggtgtgcttcgtgagcaacagcctgcattgaaannnnnnnnnnccaaggcctggcaaacagctccatcaggccaaggtgggcctgagaatgatgaagggtgtgcttcgcactggcagcgcttgcaggagctgtgtggcactccccttccatcagatgatacgggtctcatccttggggacctcttgaatgcacagctctctgcccactgggaggagctggaggagctgttctcctgtgccaagagggaggaacagattgagcagaagctggggaacatagaggcacaatggaccacagaatgctttgtctgggtcgaccacaagcttcgacccgccagcatcctgaaggcttctgacacatctgagctcatggagcggctggaagatgcgctgctgggcctcacttccttgatgagcaatcgctactctgcctgcttcaggccaggccaggtgagccaatgtggcagggacgcaggggggctcccaggccctgcatcttacaatacatcgggcttgggaaaaggggctaaggcattgaggctcgggaactcactgcagacatccaggcctggacctccaagctgtccaccatcagcgacgttatggagcagtggcttgtggtgcagaacatgtggattgaagcggggttctcaacccagcatcatctgcccctcctgcagcggcggagacatcgtgaggcagctcccccaggaggcgcgtcgctttgctgcgatcgacaagagctatgaaaacgtacactgggagggtggaggccgaggctgtggatgcttgtgtgccacgcagcactgcatgcatacttggcatgctgggaggcacagcccatctttggtgccagccaccacccccaccctgcttcccctgttcgcagctgttgcgccacgcccgcgagagccagacctgcctggcagcctgctgcaactccgatgtcatgcagcacatgcttcccagcctggtacagcagctggaggtcgtgcagaagagcctgtcggcctacctcggtggggttggttatgtgtgagaagtttagggccttacaggacgctgatgcactgccggcgtggggctactgcatctgtgacttgtcactcaaccttgtgcaggcatctttgcgtgaagttactcgtgcactccaccccactccttgtgtgcagagagcaagaggtctga

SEQ ID NO: 955 - DNA, 2277 bp, Chlorella protothecoides
  modified_base (962)..(971): a, c, t, g, unknown or other
atgctaatcaaactcggccatccccccatcgtcacaaacctacagattgacgtgctggtggagctgacgggccacactgcaaacaaccgtctggggaccatggctgcctgtccgtcccccgtgcaagtgacatggattggttaccccaacagcactgggctggaggcagtgcagtataggatcactgacagcatctgcgaccccctagacacaacccagcgtttcacaggttggttttggtgctttctgggtggagtgtgcttacagtggctggacagtgtgttgctcgtgacctcgaaagaagggcctctgaagactcgtgcacttgccagtcatggaccttgcacacctgtctggcatgcacacactgcagtgtcctcgcccttgtcccagcctgatgctatcgttggctgggtgctgacccaccaagaaccgcgagccctgaaccctgccgctccggcgacgcacacacgtcagtgtcccttgccagaatgcggtgagcacccatcgaggcaggccccccaccccatggctcccactgcagagcaactggtccgcctgcctggctgcttcctgtgttacacaccggcccaggacctgccggacgtggcgccatgccccgcggcctcccggggttacgtcacctttggctccttcaacgccctggccaagcagatgccgggggtgctgcagacctgggcccgcatcctgcgcgccgtgccctcggcgcgtcttgtcctgaagaacaagccctttgcctgcgaccccgtgcgccaacgatactggcagctgttcgaggggctgggtgtcaagcgccacagggtgcgcgggttgtcgtggaggcaggggggggggacacttgaacgcgcacgggcttggagtgcccttcaggaactggtcagtcagactccctcccctcatcaccccctcccacgttctgcgtgtgcaggtggacctcctcnnnnnnnnnncacgggcttggagtgcccttcaggaactgggcagtcagactccctcccctcatcaccctctgccgcgttctgcgtgtgcaggtggacctccttcccctggccatcagcaaccgggatcacatggcgcagtacggcctcgtggacatcggcctggacccctggccctatgctgggaccaccaccaccgccgaggccctcgtcatgggtgaggcgcaccccttcccttcaccgcttcctcctccccaacccctccaccccacccaggcgtgccctgcctgaccctggccggcaggtgccacgcgcacaacgtgggcgtcagcctgctcaccgccgtcggcctccaggaggaatgggtggcgcacgacctggacgcctatgttgcagcggccgtgcgggccgccggcgacgtgcccgggctgtgcgagctgcgctctgggctgcgcggccgcgtgctcggatttggatggaatgtctggcgtgccagtgctgccatgcaaaggccattgccgccacgtccctccaggcctcatgcttcaggcaacggtttctccctgcaacacagcaatgttctcatcgaagaaggtcttcagggtgtcgtagtcccgagcacctggacggtagtgtgcgagaacatgtggatgcgtgtgctggcgccaagcgggcagcagccctgcacatgcagggtcaagggcggcaccgccccctactcactcctgaagctctccttctgctcgccattgaagtagatcttcaagcttgggaagccagccttgtccttggtgcagtccacagagaccacagctgcctcttcactgccttcataggccttggcgagcttctcccaggtgggcgccagcttcttgcagtgtccacacctgcagaggggcaaccatatgagaagcctcgggagcaagtctcatttcgggcagaagtataccccagcagttgccacgagcgacacacacatccacatacaggcaataccttaccagggagccctggagcgtgtgacatctcgatgctggcattcactcacttgacgaagtacaccttcccatccgatgtcacttcatcaaagtctgtgctggtcagatgcctgacgctgctgccctttgctgcgagcgcaaccccgatcagtgcgaggatgatgaggctgcgcgacgtgagtgccattgtgaaaggtccttttcagcctgagagatgctggaaaatgactgcaataatgatttgggagttctgtctagaaggcgaccgaaccagcatctgccgtcctccaggcgatctccgaggcgggaacgcaaactga

SEQ ID NO: 956 - DNA, 1257 bp, Chlorella protothecoides
  modified_base (1243)..(1252): a, c, t, g, unknown or other
atggcctctgggcgtaggagcctggccgaagacatcgctgacctgttggagcctgtcgcagtgcagggtatgtcgagagttacaaggataccgtcgccgaggagcttctggtcacgctgcgccagccttcgacagctctgtcacgccggaagtgctaaagtcagaaaaccctccgcaccatgttgctgcaatgcagaggctgagcccgatgcgcatgtcgtcctggatggtgtacccaccctggaagagagcgatgaggacttggctggggtggtgggcatgggccgtgcccgcatcttgccagacatcgccctggatgacccggcgtatgccggcgtacgctcctcccgggccacagcttttgaaagcgaagacttcacacacgacgccgctgaagagccagcagaatctcccaggggatccgatgccagcacctcccagagtgaggacgaaaggcccggacaccacactgaaccccaagatgatgacgaggtggcagccctcgaacgggcggtggaggacctgcaggcaggcgacggcgacaccgccgcataccttgccgagcgagcaaaccgcgagaagcgcaaggcgctggcggtgcagtcccagcgacggctgtgggaggctggactggagatccggatcctcctgcagcgcctcctcaagtccgcagtgcggtttccccaggtgaggatcgggaggattgctgagcagggcaggcgcaagaagatagagttgcagatggggggttccagccgagccacatggactccagttggaaagggcgtcctggcaaagaccatccaggccagcgatcaaggtgtggcagctgccgtcgaagacatccgggcggagtctgctggggcgatcagcgacttgctggaggtcatcaagggcctgcacgaaacgaaccctgccatagccgccaccccgcccaagtggcagcggaaggaacggcgggacagcacggcactctggcgctgcgcagatgcatggtatgaggccaccaagcccttccaggacgcctccatcgaccgctggcagaggaagacgctggtggcaggaggtgcgcagggctttgcatggcatcgcttgctggctcttgagcagatcgcgagaccaatacagtgtcgctcggaggacatccaagctggggactgctgtgctgactacgtctcgatgttctgcactatgactctatctctggatataccaaccctcgcagggaacttgaaggccctgnnnnnnnnnntatag

SEQ ID NO: 957 - DNA, 1029 bp, Chlorella protothecoides
  modified_base (933)..(942): a, c, t, g, unknown or other
atggtgtgcatgctggagtcgctggacgacctgctggagatcgcagaggggccaaagcttctgggccccgaggtcctgggcgtggtgtttgagcgcttcgcgtcggtgctggcggggtacgaagcacggcgcggggagcggctggcccgcgcctccaccgaggactttgacgcggaggaggcggaggcgctggaggaggagcacgagcgcgagtcggagctgctggacggtctggcggcggcgctgagcacggtgctgcgcctgtacggcgacgcggcgctgcccggggtggagggcctcatgcctgccatcggcgcgctgctgggcaagggccgcttccccgaggagcggcgcatcgccatctgcatgatggacgacgtgctggagcactcgccggcgggcgcagcgcggcacgcgccctccatcatgcccctgctcctcgccggcgccggcgaccgcgacgccgacatccggcagtgctccgcctacggcctgggcgtggcggccgcgcgccggcccgaggccttccgccccgtggcccccgccgcgctggccgcgctgcgcgccatcgtggccgcgccggacgcgcgcgccgacggcaacgccagcgcggcagagaacgcgctgagcgcgctgggcaaggtgctggagcacgcaccggaccttgccgagccggggctgggcggcgcctggctcgcagcgctgcccctggtggaggaccgcgcggaggccaaggaagtgcacgcgcagctgctgcgcttcatcgccgcgggcgacgcgcgcgtgctgggcgagggcaacgccaacctgccccaggccgccaaggtgctggtgcacgtgctgggcaagggcgagaagctgctggccgcagaccagatccccaacgccgtggccatgctcaagcagatgcaggttggtgcactgcgggtattnnnnnnnnnngggggggggttggaactcaaagaggggagagggcagatcagggaggacagcacggtggtccctgctggggggtggggttgcgtgtga

SEQ ID NO: 958 - DNA, 1233 bp, Chlorella protothecoides
atgcagagcgacgcctgccggtgcgtcgtgggcatggcctcaaagggcgccgccgcgctggagtggcgttcgcagcagcagggcctgggagaggcgctgtcagatgctgaagactgcctccagtacctggaggtggtgcaggagcttatgcagggcctacggagtggaacgctggaggaggcaattgaggggctgccaaaccttgtctctgccctggccacagcccaacacatcagccgccacttcagccagccagcatcctttgcaacggtcctccaggtggaggcacacctgaggagagagggcatggccacaatgctcgcctcgccttgccatggtgctcagctgcctgccttcccccggccacaatcacagatggtggaggaggagctggttgccttctgccagtcctccctggaagctggcgggcggctctgggaccggaagccctgcgacctactgatggcgtgccaggcatgccagcgcctggaagcgcagtggcaggtgtgttggggatggggagttgctgagggaaggagtcacccggcggctggtctcataagacaagtcaggggagcctgcacagctgctcacgtgggggttacctggcgttgtgttcagccccaccagcgcgagcagtacaccccatcgccctccccacaggctgcgctgatggaggagaggctgaaccggtacgccggcaagggcagcgccccgcccgccgccgccgcgccctccccactccatgccttccgcgcccgctgcgccggcgtggagctgatctcgcagcgggccgcctggatcgagctcctggccggattcacggatctggagggcgtgccggagctggtgcgggagggacagagcgccctggaccgggtgcgtcggcagccatacaacgtcctcgacacgtccaagcagcagtttggcgtggaggtggagggctttgcggcgcacatggcgcgcctggaagcccagttcgaggtgacgggggcttgcgccgctcggggtgttggggtgcccgatgctggagggggtgggatgcattgcatgctttggtgcgggacacaggctgatcgcctcaaacgtcaggcaagacgaaacacagcctcccgtactggggcaagccagcacccatgcaccactcctcacacagaccatcaccgaggcagccttttcgtgctcgcactccaccacggctgccctggagctcctgcagcgcctgtccaataa

SEQ ID NO: 959 - DNA, 1116 bp, Chlorella protothecoides
atgctggattcctggcttgcgcagcgacgaaccccggaggcaatggtcctgcgacccttgtttgaccgccttgtcgcccctctgctggatcacgacgcggcgacgcggtgtcagaaaggagcaggagcggcattcacatgtccaaaccgctctgcggcccagaagcgtctcgtccactctcactcctgcaggtcggcgtgcacgcccatcatgccggtggaggcctgcggtctggtggggaccctgctcacactgctgacggggatgctggacggtgtggcctcgtccgccccagacggcggcgcagcaatgacccccacccaggcgccgcagctggagtccgtcgtgctcttctgtctggcatggtcccttggaggcctgctcgaaaatgccgaccggacaggctttgatgccaagctccgcaacctgagccaggccgctcctcccctgggttctgttggagtctgcaccgctcccccacagacttacccgactcagtgtggagcgacaggggtaacagaagttgcacttccctccgctgattctgggccagctgctgcacacataatccttcaggatgggagtggcctgtccaccatttacgactatgtctatgatgtggcgggagcccgctggacaccctgggtccagctggtgccgaggtggagctaccccacccctggggcgcgggtggccctgagcaagacggtggtgccgaccctggactccacacgctacggctacctcatgaagctggtgcatgctgcagggaagcctgttctgccctccctgcctgaccctcagattgttgggcagcctggcaccggcaagtccactctcgttcggcagtacctgagtcgggcaggcgagggcggtctggcgtccaagacgctggtcctgtcatcgctgacaagtcctggggctctgcagtactctgtagagagatccttggagaagcggcaggggaggagctatgggccccccacaggcaggaggatgaccatgttcttcgatgacatcaacatgcccgctatcaatgaatggggtgaccaggtggggcagaggttgggatgcatacacacacacggactgctgggggatggagctccagcatag

SEQ ID NO: 960 - DNA, 291 bp, Chlorella protothecoides
atggtcattgggcctgccggggctggcaagaccagcgtcatggagagcctggcagctgcgcacactcgcctgggtgccaagacggtgctgtggcgcatgaaccccaagtccatgcgtgtcgagcagatgttcgggcaggtggaccctgccacgggcgagtggacggacggcgtgttcgcagtgttgtggcgccgcgcggcgcgggcccagcaccagcacacctggattgtgatggacggacccattgacgccatctggatcgagaacctgaattcagtgagtggaggttga

SEQ ID NO: 961 - DNA, 273 bp, Chlorella protothecoides
atggcactcacgtcgcgcagcctcatcatcctcgcactgatcggggttgcgctcgcagcaaagggcagcagcgtcaggcatctgaccagcacagactttgatgaagtgacatcggatgggaaggtgtacttcgtcaagtgtggacactgcaagaagctggcgcccacctgggagaagctcgccaaggcctatgaaggcagtgaagaggcagctgtggtctctgtggactgcaccaaggacaaggctgtctgcaacaaggccaaggcaagttga

SEQ ID NO: 962 - DNA, 1782 bp, Chlorella protothecoides
atgcgggctcccgcgcgcgcgcgcagaaacaccatcgagcgcgcgctatggtgtaggcgtccatcaggcgagcaggtgcaaggctactacatccaccgcgaggccacaatcctcaaggacatgtatagtatggagtcgaaagagcgattgaaagaggacgtaccacagaccagcccgatgccatcggggccctcttcgcagctacctcatgaggcgtcacctgctggccatgaaacatcagccaccccatgcgtgccacctgccgatgctcaggaccttgaaatcgtcaaatctcaagtcctgatccttctggatcaatgtaatcgagcaccggatgtcctcgccctcctgtccaacctgccgggccaggctgtggcagccagaccggacctcatctgcctcaggggccgggccctcctggcgttgggcaacaaacctctggccgggccacagggacactcgtcatgccaggctctgcagctgtcgcccaccagcacccctcacaccccccaccccccacccggccctgcccaggcgctcgcagcgtacctggaggccttgctgtcccaccccacaaatatcgacgccctcctcggctgcgcctcggtgtacacagcctcggccctccccctggaggcgctcaagtgcctggagcgtgccagggggctggcccccacccgcgccgatgtggtacaggcccttgccaatgtgctgacggacctgggcaccgccgagaagctgaccagggtgcccggctggaggggccggtacgaggccgcgctggaggcctgcccctcccacgcccaggcccactacaacctgggtgtagcggcaggggaggaggggcgggcggaggaggcggccgcgcactaccgcgacgccgtccgcgccgcgcccgcctgcgccgaggcctggtgcaacctgggcgtcgtgctgcgcagccaggcgagctgctgtggtgcgggtgcactcctcgtcccggggccagacagggacgacgcatgcgacgcagggccccgcgtgctgcctgcagtactgctgagggtatcccacaccaaacctacttcacagggcaagctggaggaggcggtggccgcctacgagcacgccctggccgttgcgcccaatcacgacatcgtgcgcgtcaacctggcggtggcgctgtccgagcgcggctccgtcgtgaagctgcagggtgagcggggagatctgctcggctgggtgcaggcaggttctgtgaggccgggcggagcccaccctggatggcggctggggcctgcctggttagctgtgggcggggtgggttggtgccagctcgctgagcacgcgccaccataccttggctatttggcgccgacattggcgccacaaaccccacgttcccgctcccccctttcctcccccccaggcaagcaggaggaggccgtggccctgtacgagcgcgcgttgggcctgtatccgctgcatggcgagtcgatgtacaacctgggtgtggcggccatggaggccgggcagatgcaccgcgccatcttcatgtacgagtcggcggtgcgggtgctccctgcctgtgccgaggcacacaataacctgggagtggtgtacaggtgggcgatgggtgaggaggattgccctgcggagagagaggggaaaggatgctctgtcaggagaaatcaaggccgcgcagttaccctacagggccaggagtgtcctgggggcctggtgtcctacgatactcagtccacatggggtaggcaacttgatcattgcaggccgtacctttaa

SEQ ID NO: 963 - DNA, 210 bp, Chlorella protothecoides
atgggcaacatcgaccgggcggtgacctgctacctggcggccctgaatgcccggcccaacttccctcagggtttgaacaaccttgcggtggtgtacacggcccggggacaatctgaggaggccctgcagctcctgctctccgccctgagcctggcgccggagtatgcagaggcctggaacaacataggagtgctgcaggtggcctcatag

SEQ ID NO: 964 - DNA, 495 bp, Chlorella protothecoides
atggcgcagacgcgtgaggatgtcgcgagcatgcagacccagctcgccagcaagacagagaagctggaggccgctgccagcgaggccaaggccctgctgcaccagatctctgtctccaccagtcaggctgagaaggaccgtcagaaggttgccgcaatcgtggagactgtgacggccaaggtgggcggcaggggtggctggtcgagcgctggacctcagccatgtgtagggggcatagaatccaccctccaatatccatgtcctctacaggcgcacgacatagcggctgtcaagcacgatgcggagcgagacctggaggaggcccaaccagcactccaagccgcgctggcagcgctcaactccatcactcccacggatatcacgtcgctgaaggcgctgaagaacccgccaaacatcgtgaagcgcatttttgactgcgtgctgctcctcaggtggggggtcctagcatggcctgaagggcagggcttggggtga

SEQ ID NO: 965 - DNA, 180 bp, Chlorella protothecoides
atgcagctgctcatgcgcgccctgcgcgacatgaatgtcagcaagctggtgggcgatgacctgcccctcttcctgagcctggtggaagacgtcttccccgggcagaagctggagcgcatgcagctgggggacgttcaggccatgctaaagacggtgcgggcggctgtggcgggtgcttga

SEQ ID NO: 966 - DNA, 582 bp, Chlorella protothecoides
atggatgtgaacaccaacgcgctgtcggccgacccctggacctcgcgtgccgaggacctggtggccatgaatgcccgagggccgggctgcttcgacttcagattctacaccgaggtgggacaaggagggttgagagggcaacaccctgaagctgaggggccggggatattgcgcatgctgcgattcccgtccgcccctcctccttcccctgtgccactggctgaccccaccctgccagtctctcggcaacgtctccttaatctcctgtcccacaccccatcaccaccgcgtctccagaacaacccggacctggcggggaaggcagggtcgcccctggagctgtgggagcactggctgctcctgggtcagttccagggccgcacccaccgattctcctgcccggtacagatgggcaccacataccggattgcatacctccgggcgcgtggtggctcctgcttcgaccacaactactacctccggcacaatccggacctgagggccgctggcatgaccagctcaagcgagctgtacggccactacacctattttgggcagttcgaggagcgcgccgtcaagtga

SEQ ID NO: 967 - DNA, 213 bp, Chlorella protothecoides
atgatggttcccaaccgccagatcatcatgaaggtgaagctggcggcatgcggataccaagagaatgacgtcctctcccggcgcttccacacgctgtatggcctgtgcgagcagcagctctcacgccagccccactacgactttggcctccgcaacatcctggcagtgctgcgctcctgtggatctctgaagcgccaaaacccccaacagtga

SEQ ID NO: 968 - DNA, 498 bp, Chlorella protothecoides
atgcttgtgacgctgggcgagactgaggtggaagtggccacgggtttccgcctgtacatcaccacccggctgcccaaccccaacttcacgccggagctggcggccagggtgacgctcgtggactgcaccgtggcccgcgtggggctggaggaccagctgctcagccggctcatactgaaggagaagcacgagctggagcaccagcgtcgcaagctggtggcggaggctcccggctgcagctcccaggatgcagggtgtgctggtccagagtaccagggagtcctgcgcaaggccccgccagggctgagtggccccctacttcccgtgtcccaggtccaaaactaccacgccaagatctcagagctggaggaggagctgctccagcgcctgtccaactgcgaaaacctgctggaggacggcgaccttctcaacatcctcgccaggaccaaacagacggggtgtggcgcaggggcgtggtgctgccggcatgccacgtga

SEQ ID NO: 969 - DNA, 300 bp, Chlorella protothecoides
atgggcacctgcgcgctcgtcacgacaccggtcagtgtcacaacatccttgcaggcactggatgatctggtgaggaagaagatcaaagacccatccgactttgagtggcagaagcaggccaggttttactggctggaggagaggaccctggcccagatctccatttgtgatgtggatttcgagtacagcttcgaatacctgggtgagccaggggtggtggtgctctgtgtgccgccttcggacggtagcgctgggaccggcacgcaatggcagggacacggcacttcagcactcccttga

SEQ ID NO: 970 - DNA, 591 bp, Chlorella protothecoides
atgcgcacacacgctgcgcatgcagctcatgcgttcctgcagtttgatgcccagcctctgctggcaggaatgatagatgagttggcctcatggaaggccctcttcaccgagcgcctgcgagtccaggggtcagatgccctgcaggtgcggggcgggctgatctggggggatggagtctttgtgctccagggcttgaagctgacctggactctaccaattcccactggctccccggcccaggctttgagcaagaggctggctgggctcttactcgacctggagcggccggtggaggacctggaggactaccgccacctcagcgcctgtctcagcatcgtacatgacatggagttctccttcggggatgatgtggagcctatcgagtatacctacgctcttcttggaagggtggaggcccagatccccaagcaggagctggacgcggtagcagacctgaggtacagctggcagaaggttctgcacgccgccgcagggatgggggaggtgctcctgcaagagagggtgagccgcctgtggggacagggccatgtgaatgcgggcatgttgagcattggagcctgtgctggctaa

SEQ ID NO: 971 - DNA, 282 bp, Chlorella protothecoides
atgaacagctttgacggggaggccgtgaggctatcgcgtcccatccaagcacgtgggaacgtcgaagtctggctgcagcagcttgtggctggaatgcaggaaaccttgcgcgtcctggcgcgccaggcactcagggacgtgtatgagcaggatctggagaccttcctcttctctcacccggctcaaatcgcactcctgggcctacaattccagtggaccctggacacccatgtgcgtggaaggaaggaatggcacatgtgggcctcagacggggatctgtaa

SEQ ID NO: 972 - DNA, 333 bp, Chlorella protothecoides
atggagagggggtctgccgtactggtgggtgtaggcgggtcaggcaagcagtcgctggccaggctggcagcgacactggtgggggcgagcgtcttccagatcaccatgacgaaacagtatggcgttccccacttcctggaggatctcaaggtggaggagcacagtggtgggacagcagcataccaggagcacgatgcatgcttggccctgctgcccctatactctcattttgaaactgaggcggaccctgcatgcctctcgcccgccccaggtgctctgcaaagcgctgctggcaaagaatcagcccatctgcttcattgcgaccgatgctga

SEQ ID NO: 973 - DNA, 849 bp, Chlorella protothecoides
atggtcgtgcaggccaggctcagccgcatggtgtccaacgtggagagcatgggggccgctgatgcggagctggccagaatcctcgtggctgagaacaaccagggtgatctgggagcacattcgatgtctcagtcccaggcgggtgctacctacttcaaaaggcccccggtggataccttcgtgaccgtggatggcgtgctggcacgcaagtgcccagaagcggctactgctggcacattacccccggccagggctgcgtccaccctggttttctatgtgtacaacgccgtggatgaggagcagatgggcaactttgacttcttcctcaagttcggcctgtccgccaatgacaccgtcacgtaccgcatcatcatcacgagtgggggtgcggtgaagccccccctggccatgccagagctaccccccaacgccaagtacatcagcaccacggcatgcaccggcacctggggagccctcggcgcaatcgaggagcaggtggatgccaccaagttcccattcgtggtggtggtcgactccagcgtgcgcggcccattcctcccgccctatgccgccggcgtcatgcactggacggaggccttcacctcccgcctcacgaagagcgtgaagatggtgggctcggccatcagctgcgagggggcgccgcgcgccgggcatgcggcactggagtggcgccgcaacccctatgtgctgccatacgcctgggcggcagacgcggtgcgcgttcgtgacctgcttgttttgggtgtttgcctttccgaacctgttgggagggtgcagggtttagaatgggcatgctgccaccatatgtgtgagtatgcaccgtgctga

SEQ ID NO: 974 - DNA, 675 bp, Chlorella protothecoides
atgtgcctccatgttggccacccctgcaggggccggtctgcacggcacgtacgccagtcccgactccaccccaatacccccacttgtcatttgacagcccgcgatcggcccccgcagctctcccaggttcacatccaccccacctcacccgatccccttcacgacagggaggaggcgcagcgcgactccgactccgaggccctgctttccagcttcctgcacgccagcatcctggcccacgactccttccctcgcgccctggccttcatcctggccgcgcggctggcagacgccacgctgctcccctccgagctgtcggagattttccgcgccgcgctggcctcccacccgagcatcgtggccgccgcgctggccgacctggcggcggtgcgcgaacgtgaccccgcctgctccggcctctcccaggccctgctctactacaagggcttccacgcgctgcaggtgcagcgcatcgcgcacgtgctctggcaccagggccggcgtatgatggccagcgcgctgcagagccgcagcaacgaggtgttcgccgtggacatccaccccgccgcgcgcatcggggcgggggtgctactggaccacggcacaggggtcgtcatcggcgccaccgctgtgatcggggccaacgtgtccatcctccagaacgtcaccctggga

SEQ ID NO: 975 - DNA, 966 bp, Chlorella protothecoides
  modified_base (632)..(641): a, c, t, g, unknown or other
atgctcatgaacggtaccgccgccttccaggccgctggctggttcggcgcgacctacccctacgagtgggtcccctggtccaataagatcctgtggaacaccatgggctgctgcaaccccgacaccaatgagttctggtccctaatccgcgcgttgttcggctaccaggccatgcccaccaacatccagctcctctattactgcctcttctggttcgtggtcctctccgccatggcctaccgcgcctggctgggcgtgctgaccgacgagcaccgcttcgcggccgaggacgaggaggggcgccccgcctccttcaaccccacctatgacggcgagggcaagctggccaagggcgtggagggggcctccggctctgacagctccccgcgccagcacagcagcgaacgcgcgtcgggggacaagtttgaggacgcggcggtggcggagccgtccagtgccgcggtgcccgccccgcccgtcgcggctccgcccggtgcgccgacgggcctgcatgttcgccccccttttcgctccctctccttgctttctcgccgtggtgagccggcgtggcgcgcctgcctgtcggcatgcttggcccctgcccctgcacagggtctgggtcctttggcgtnnnnnnnnnngcgtggcgcgcctggctgtcggcatgcttggcacctacccctgcacagggtctgggtcctttggcgtaagtttgttgctacagcgaaatctatcggggtgggatgttcatgcaccaatctccgaaggcgatttatccatgagattgtgtctccctcaaaattgagcgcgcgctccaacgtcagctgggcgatgccacacccaaaagacctctgccccgaaaggggaaaccgtcgggctgcacctccccacatgcactcgtacatatttgaaagcttgtgttgcccgaaacagcagagtttctggcgcccctcacatcccgtctga

SEQ ID NO: 976 - DNA, 1083 bp, Chlorella protothecoides
  modified_base (1006)..(1015): a, c, t, g, unknown or other
atgccctcgttgtacccagacatccctgaccctgtaacaatctctctacctgcatctgtggatgacagtgggaaaacctaacccttgggggcgcaccacctcgacacatcgcccgatctggaaacctcaaggtcccccgacatgggcccgcccgtgcgagttgccttgctcggcggtgggacattcgctcggtcggcgtacctgcccctgctcacaccggggcagacggatcgcaccctgatcggcatctggagccggacacgggagtcggcggagtcggcggctggtgaagcaggaggggtgccttcctggcatggggaggagggcctgcaagaggtgctggcccggccagatgtggacgcggtcatcgtggtcgtggctgcccaggccacactccaggtggggcctgtgcggcgagagccaaggggagtgcgatcctgagctcccgggcaccccttcattcctgccatccccgagcctgccattccagcggaccccccagatatctcgtcccactacacaaatccacagatcgtgcggcaggcgctggcggcgggcaaggtggtgctgtcggagaagccggcgggccccaccgtggcggccgtgaaggaggtgctggattggatgcaggcctctggcatccccgcagcacgctggtcggtccaggaaaactaccgcggcgagtcgggcctcgtcatggccgctgagctggcgagatctggcgcgctggggcgcctggtcaaggccgacctcgtggccgagctgcccatgaaccccggcagcaggtactacgccagcgcctggcgccgccagctgcccggcagcttcctgctggagggcggcgtgcactttgtggccgcgctgcgcctggtgtgcgccgcggcgggggcaggggaggcgggtcgggtgtcggccctcctcacccgcggcagcgaaggcgtgcctgagcctgataccttggtcggctgggcgcgttttgacggcggcgtgccggcgggcgtgagcnnnnnnnnnngggcgtgcctgggcccgataccctggtcggctgggcgcggtttgacggcggcgtgccggcgggcgtga

SEQ ID NO: 977 - DNA, 762 bp, Chlorella protothecoides
atgtatgccgcagcacagcacgacacggtcaggagacccgatggatacatcaccatcatttgcgcccgaactgtatcccgcgtttttcaacatcagcaagagtgctcaccggaacccgcaggcccccaagatcgtgtgttcgttggaggtctcccccgcaccgtccggcctgcccttcctgcccggaagatggctctccgggccgtatttgtcgtggcttgcctgtgcttgagtttaactgcgcgcggcgccaagcactccttcaccgcgggggacaaggtcacgctctgggccaacaaaggtggggccgggctccgtgaagtgaaacctaccagtactacgacctgcccttctgccagcctgagaacaaggacaacaagctgctcaccctgggggaggtgcgacagttgggagcccagcccgcagattcccagatggcggcattgctgctggaagcaccctggccctgcgcagtatgatcactctgccagccctcagagtccaccaggctgccgaacaagcactccacccccttcctcgcaggttgtggatgggaaccgcatggtcgccactccctacgacctctccttccgcgttgacaaggacaaagccacactgtgctctcgccacctaggcgcggaggacatcaaggccttccgcacggtgagtcgttgggtgttggcactcgcggactgtagcaccttggtgttccatgtcgaggccagcggaatggtcgccttggcctgggttaccgggatttga

SEQ ID NO: 978 - DNA, 2568 bp, Chlorella protothecoides
  modified_base (1565)..(1574): a, c, t, g, unknown or other
  modified_base (2090)..(2099): a, c, t, g, unknown or other
atgccacccaagagaaggggcaaaccctggcggcctgcaccccctcgttgcgtggccgctccggcccctccttcccctcgtgctccctttgtaatgttctgcctcctcaagaccagtccatgcggcgcaggggtgacgctgggtggcacgccaaatccccgtccctgccaatggaagtttgagagtttccgcttggaaacgtcaaactcgggccgagaaacctctctgcgcgtaacgcatctgctcgaggtccttcccccagatcccagagcagcaaagctgctctactattatattttcattcactccggagccatgccgggggaacgcttcaatgtcaggctggcgcccgaggagggtggatcgcccgagcccgtggtggtagaggtgggcctggagggcctgaacctcctggcccccggatctggacgggcgctccgcaagtatccattgcaccacatcagccgctggtccatgcggggcagcagcctgatcctgtttgccaagagcccggtaggttccggggaagcgaggggtctcggcgcagcctggcccagctggccgcgcggggcctgcatccctcactgtgtgacggagcacatgaccctgaggtttcctccatatacctgcaggtggacgtggaggacaggacggtggtcctgtcgggggacgagtacaccattcggtctgtgctggacacccttacctccagctgcatgcagtgagtcttcgggctggctcggccgcgtgccggggaccatggtgcctgattgttgtttggaagatcctgcaggccgtgggatgtgggctgtacaaggagcctgccccttgcaggtgcccgtggccatccttggtcgcagtgcccgtggcaatccttggtcgcagtgcgatcggctcccccccctccacccctcgacaatgccaaaggatggcggagttgctgcagagcggccgcaccgtccccggcacctcggacggcgccctggccgcctcctccctctccagcctgctgaaaaaggcaaaaaaaccggcgctgctcaccgccgatcaggtggagttctggcacgacccggagaaggcgggctggatgcactcccagggcgaggtcatccgtacctggcggaagcgctggttcgtcctgaagcagggcttcctgttccgcttctccgggccggacgtcaccgccgccagccgcgcgcgcggcgtggtggacctctccaccatcaccgacgtctgcgacggcggcccagccacgggccgccccaactccatccgcctgtccacggccaccggcaagatctgctacctggccgacagcgagaccgcgcaggtggagtggctgtcggcgctggagggctctgttgcggccatcctccgggtgctgagcgggtgggaggaggaggcagaggaggcgccggccagggcaccgcgcggcggccgcgggcgcgccgtctcctcttccgacccgggcaaggcgctggaggagacgctgcagcgcagcttcgctgcggagtctgctgccgcgaaggggccggtgggaggcagtgggcggcgggccgccgctnnnnnnnnnnctccgacccgggaaaggcgctggaggagacgctacagcgcagcttcgctgcggagtctgccgccgcgaaggggccagtgggaggcagtgggcggcgggccgccgctccgggcatgatcagcgtggtcaactatgctgggctcagcggcggcagcagcaggtcggagcctgagccccagtacatcaacgtcgactatggggctggcattgcaggattcttgctttgctgtttgggggagtcctgcaacgacaccctgtgcatgaggggtctggagcgcctcccacttcgggatcaggactgcaggctacactgtagcttgcatcccacagcttgcatctcctcaaaccttggctatgcgggaaccctcgaccctcttgcatcccctgacccaggtgccagccagcttccttcgagcggggccagatatggcgcacagccgtacggaggcggggcctcggcaggatacggtggccaccaggcctacgctacgtcccagggctacggggagggccccgnnnnnnnnnnatcgagcggggccaggtatggcgcacagccgtacggagcggggccctcgggaggatacggtggccaccaggcctacactacgtcccagggctacggggagggccccgggcagcattgcgccccagcccgtcacggcgccccgccgcagtacgctcccgcgccgcacgggggcgtcctgcagcacgcggggccccagcagtacgaggcgcagcagcagcggtatgagccccagcagcaggttcggtctacttggtgctcgcacactgcattgcgcagcttttctcgtgatgaagcagcgatgatcaggaccctcccaaccccggttgcaggctgcccccaacccagcaccatcgggaccttggcaaactcaccacacggcggagggcagaccctacttttacaatgtggtcacaggcatcacgcagtgggagacaccggtggcgtaaaggacgggacggcagctccatga

SEQ ID NO: 979 - DNA, 405 bp, Chlorella protothecoides
atggccatcaccaaggacaacgtctccctgaccatcgacggcgtgctgtacaccaaggtcaccgacccctacgccgccagctacggcgtggagaacgcgctgtacgcggtgacgcagctggcgcagaccacgatgcgcagcgagctgggcaagatcacgctggactcggtgtttgcggagcgcgacatgctcaactccgccatcgtggcctccatccagcccgccgccagccagtgggggcttcaggtcctgcgctacgagatccgcgacatcatgcccccggcctccgtgcgcggggccatggagttgcaggccgaggccgagcggcgcaagcgcgcgcaggtgcgcgggaggacggggggatggaacgggggggggatttgcaccgactggcgcacggcgtaa

SEQ ID NO: 980 - DNA, 240 bp, Chlorella protothecoides
atgcatcatgcaaaccagtccctcacccctccacccggacaggagcaagcagcggggtacaagaagaaggacttcatccaggccaagcacgactttgtggaccgcatgatccaattcgcgggggtgtccaaccccggcagcatcctggatgtgggctgcggcattggcggcaccacgcggatgctggcttcccgctttcccggtgccaaggtcgctggtgcgctgactttggggctgtga

SEQ ID NO: 981 - DNA, 1005 bp, Chlorella protothecoides
atggccaacctgagctaccgcctgccggcgttgctggcgctggtggccacgcaggtcacgctgctggccagccaggtgtcgctacccatgctggcgccgctgctgctgggcacgggcatgctcctgcgctccctccgcgccaacgccagcttcatcttcccccgcatcggcctcatggtggtcctgctctgggccctctggttcttccagggcgtggtccagaacaccgtggcctaccttcgcaaacaggaatgggggtcttctctgttgtcggggtcggaaacggagggtttggatgggaagggagggtggcaagggtgccaacaaggttgttctggaatggccaaggcgctcaaggagcgggcaataatgcaaaggaggcccgacctgatgcccgactcagcacctttccttggcgccccgccacttcgacagggcgcgctggaccagcgactggcgggcggcatcatcaccaccagcgagatcagcggcctgctggcggcggtggtcatcctgctgagcatgctgggcatcaacgtgtcggccctgctcctccccgccggcgtcgcgctggcggtggcggcccaggacctcacccgcaacttcctggccggtttcttcctgttcgtggtgcagcccttccgcctgggggacaaggtggcggtcggcgtggcgggcgggggcccaccggggtccaccggccctgcagggccctggttcgagggcgtggccctggttcgagggcgtgtgcgagaaggtggacctgcgctacacctgtatccgctcggggcggcgccgcctcatggtgcccaactccatcttcatggcgcgcgagttcttcgtgatggacgacgtgcccgccgccggaggtgccgcggacaacccaagcatgcgcgggcccggcgcgcccggatacgcggggccgcagcagcccctgccggggctgggcccgcactatgcgggccacgtatggcagctggtccagggcccgcccgtgcacgctga

SEQ ID NO: 982 - DNA, 615 bp, Chlorella protothecoides
atgacaggcataccacccaatcatcatggagacggccttgtcctcctgtcagccctcccactcctcctcgtcgacacagtttggataggagcagcagcaggggtgggcgtggccctcatcgtgggcgtggtcttcatcgtcctgttctatgtggcaaacaactctatcttcacggggaacgcggagaacctcttcaagggtttcattttctacatcgcggtcctcctcatcgtgtacgtgtccttccacatgctcaagttctacaacctggagaagaagtggagatataagctggagcaggccttcaaggagcgggaggtgggggcaggggccgggttggaggggggttgcatgcatgctgggtgtctcgtggtcggcgccaaccccaccacgcaccgagtcgtccatccctgtctgcgcgcccgccatcacgcagggcatgaagaagagctacaggtacaccgtcgccttcctcgctttctcggctacggcattgagtcggtgctcttcctcaccggcgtgtccggcgggcagggcatcacctcggtcatcatccctgggatcgtcggagccatcctggggctgatcgcaggctgcatcatcttctacacgtga

SEQ ID NO: 983 - DNA, 408 bp, Chlorella protothecoides
atggaggcggctcacctggaggactgggccaagtacacgctcccgtcctggcgccactccatctgggtcggggtttacgacccctggattgtggtcagcaaggtgggcaggaggaaggcgggaatggggggaggcagggggaagtgtgaggcggagtgtcacatgttggagcgaaaggcaggctcagtgcacgcgcccatggagcgtcaaggcctgggtcatgcatcacattccacaaccgaggtccaacctcacaaaagccaccctgtcccccaatcctggcagccgcacctgtggtacaagtgcgctcgggacggggtgaccctggagcgcttccaccgtgcattcgtggatggcctggtccagtacggcatgatccgtgcggtgaagaagaaggctgctgcctga

SEQ ID NO: 984 - DNA, 1008 bp, Chlorella protothecoides
atgagcatcgtgcgggagctgcgccaggcagtggtagactgcaatgcgcgcggcctgatggagtcctcccgctgggcagcgcagcagctggctgggttgccagaggaggagacgggcactggggaggcgagcctggagcctgtgcaaccggtctggagcagggaggacgacagacacgccctggctcgctgtcactttgatgtcaaggtgctttgtttggtcttgtgcctgcagcgatgggcgctgcttgcggatattgaaggggagtccctttccagaatgagcctcccctcctgcgtgccacactcgattccaccacacctccccccactgcaggaatacaggagtgcggcacacgtcctctcagactgcacatcccccaaatccaccttcctgaggctctactccctttacctagccggcgaaaagagaaaagatagtacccgcagcgccgacccgtgcccagccggcatccctgttccaggctccccacatctccccacctccagggaggagcgggcggaggctgccgggggccgacccccacgtgtcagcccccagaacgccgagctggagggcctggaggcggagctgtcccgcctgtgtgcgggccccgccgacggcttcctgctctacctcctgggcctggtccgcctggacggggccagcctggacggtgcgcgccaggccctggtggccgcggtccgggcctaccccgccaactggtgcgcgtggaaggcgctgcagcgcgcctgccccgacctgcccgccgcgctggcgctgggcttgccggagcatcccgctcgcgccttcttcctggcctccctggctgtggacctgcacgacagcggcgaggcgctgggctggctggaggagctggcgccgcgcttccccgcatccgatgtcctggtccagctggcggcggaggcgcactacaacctccagaactttgacgaggcccaggccctgtttgaggacctgctggcccgggatccgcatcgcctggag

SEQ ID NO: 985 - DNA, 513 bp, Chlorella protothecoides
atgcaggcgcttccagtggcacacacgacgccgagtgcccgtgccgtgacctcccaatggagcaccgccccccggcgggccagcgcggtaacatgtcgagtcacggggtcagagcagcatagcgtgtcacacatggagagatcgagcaagaggaatagtgatcgggtgccctttgccgcggtgacgcccactgccagggcggggcctgtcctgcttggcactgaggtccccactcccctggtggccgctgtggcccttgggggagctgctctgggccttcgggccataaaaaaggtgttcgacaccccgtctcgaacctacgatggccagaacgtgggcaaggagtacgatgcatggaccagggagggcatcctggagcactactggggcgagcacatccacctggggtactacaccgaggaggtaggccattggggtgatgagggaagaagggactacctgcggaagtcctcctgccatgcccagagcatccatgcggcacgcatggggtaa

SEQ ID NO: 986 - DNA, 384 bp, Chlorella protothecoides
atgacaccctttgcgaccaagtccacccccgccaacactgtcctgcggatcgtgccccagcagatggcctttgtggtggagaggtttggcaagtacagccgcacgctcagcccgggcctccacatcctgatccccgtggtggatcgcatcgcctacgcccattccctcaaggtgcgtgcatgcgtgagaggagctggtggcgtggcgtccctccttcagcgtgcccaggcagaccgccacgcaaggcgcccggcgggcccactgctctcgggtgctgaggcctccttctcagaaacgctcccggctcccagcccctgccccatcctcgtattccacaccacaaccacccccccttcccccctcaccctctcactttgttcgtga

SEQ ID NO: 987 - DNA, 519 bp, Chlorella protothecoides
atgggctgggggttctggggtgggcgccgtcactctggggtcctgcggcgcgtctgtgcagggctcttgctgcctggccgacctcggcttgcccctggccacgagcctgagtcgatccctccccaacctcctgcccccctgaaccccgaacaatcgacatccggccaggaccccgacgacgccgaggagtctggctggaagtttgtgcacggcgacgtcttccgcttcccgcccgcccgctccctcttctgcgccctggtgggcaccggcacccagctcctcgtcctgtctttctgcgtgtttggcctggccctggtgggcgcattctacccctacaaccgcggcgccatgttcaccgccctcatcatcctctacgccctgacggcggcatgctttgtggttgggggggtggccacccagccttgccagtgccgacagcgcgtgggtgcggatgatgggaatggctgggagaagctcacgggctccacatgggggcaatgggcccctccgacaccatga

SEQ ID NO: 988 - DNA, 585 bp, Chlorella protothecoides
atgggcgccgtggtgctgcccgtggcgggcctggtggtgggcaccacgcagctcgtccgcggcctggccaacacgccggaggccatctccgccgcgcgcgcaggcaaggcctgggacgaggagcggcggacttgggtggacgaccccggttcggccctcgcgctggaggacgagggagccgcgcccgcgcgcgccgcgtggcaggccgctgccatggccgcccgcggcgaggatgacctgtatgcgctgctgggggtgctgccaggggccagcacggaggagatccggaagcagtactacgtcctggcacgcaggaaccaccccgacaagaaccccggcgacccagaggccaacgaccgcttccagcgcctgggccaggcctaccaggtgctgggcaaccctgacctgcgcgcgcggtacgacgcgcatggcgcggagggcctggacgtgaactacgtggacggcgcggccttcttcaccgccctcttcggttccgaccgcttcgagcacctggtgggcgagctggtgctggccgccgccgcgcgcgcgggtggcggcggccgcgaccccggcgcggccgtcgcc

SEQ ID NO: 989 - DNA, 201 bp, Chlorella protothecoides
atgccccttaacaccccgggcattgtgcggccgggcaggaagctggtcctcctgggggacacggccgagtcgacggccatcgccaccctggcgcggggcgcggacctcgtgtcgcacgaggccaccttctgcgcccgtgagtccatggggagcttctcgaggtttccggggggagggggggtttgcttgcctgtggagtga

SEQ ID NO: 990 - DNA, 1107 bp, Chlorella protothecoides
atgtgtccccgtgcggtatactctgcaacagacccagcgtcagaaccgccctggatatcactggaggcacgtttgtggtcagatgttgaccctcctggaggggaaccgattgcagatgtccatgcagtagaaagccacgtcagcctatctcggaagatgagggctgcgtgggctctggttcgacggagggaggccttgacgattgtctgtacgaactccaggcgagctgcgtcaagcgcggcccaggcgacacctaagcaagagtcatctcatcggctcgttgtctacgagtctgagcaaccctggtgtgaatccaaatgcaacaggtgcaaccactttgaccttgacccagagccacgtcaagggctgtacgagtcccgccctcctccagaccagtctggggggcctcctcgacgacctcgcacggcgtcagccggatgtggaggctgtcgtcagcctgcaccagggcagccgcctgtcatatgccgggctgcagcaagaagcgtgcacggcagccgcagccctggtgtctcttggggtggagcaaggagacagggcatgcctgctgccctgggggtgcacattagggaagtggaaggggtgaatcgctgggtgggcaagcaggagcagcacattgccgttgttcctctgatgcggcctggaggctgccgcatcccagccagctgtgtggatctgtggcctcaccgagtcgccctcccaacccatcaggttggagctgtgctggtgagcatgaacccagcgtaccagaccgctgagctggagtatgctgtggcgcgctgtggcatgactcacctcattatgtcacctggctggagagcctcagactacgtcggcatgctccaggaccgagacaagagggcgcacagggtcttgcaggcagaccgtgcggcacgcagcgccagtcagccccgcaagccactcctgcacagagcatcagggcagaggtgcccaccctgcggcatgtggtcctgctgggaagtggcgagagtgcaccaggcaagcagagggcctgaaggggcattgatgggtcggccatcgatgccaagtgcctgtgacctggattgccagggctctcttgctgtttag

SEQ ID NO: 991 - DNA, 288 bp, Chlorella protothecoides
atgggccagcgtgactacatcaagcccctcttggaagcgcagggcacagtgcactttggcaaggtgtgcatgaagcccggcaagccactcacctttgcggaggtgccgcgggagggcaggtatggggagatgggtctggtggggtggggccaggctcgctggtgcctgggcaagatggtgtggtttgccgcagtgcctgcaatgctggccgccgcccccgaggtctgtcttgggggcgttggcctatggcatggaagacgacatcctcaggatggacatcgctcctga

SEQ ID NO: 992 - DNA, 444 bp, Chlorella protothecoides
atggagccggtgcgaacacctgccgcaaactattccatggtgtcggtggcggaggccgtcgagacggtgctgggcgcgacgaggccgctccctccccaggagttcagctacatcgatgcactaggactgaccctggcggaagatgtgctggccagggatccaatccccgcgtacagggccagcattaaggacggttatgctgtcagggctgtcgatggacctggcatttaccccgtggcttttgaggcgtttgcaggggctgagccggagaccctcccccccggcaccgtggcctacatcggtacgggcgggccgctgcccgagggggcggatgccgtggtccaaatcgaggataccctggatcagggagcggacgatcgtggccagcgactggtcaagatcctcatggaggtgcctggtccggggggctccaggggcggatag

SEQ ID NO: 993 - DNA, 384 bp, Chlorella protothecoides
atggcggcgctggcgacacgcgcgccgcacgtgcccttccgcaactcgcgcctgacccaggtgctgcaggactcgctctgcggctctagcaaggtgctcctggtgtgctgcctggacccggaccccgcctccgccccggagtcgctgtcatccctggcctttgccgcgcgcgcggcgcgcgtcgagctgggggcctccaccccgagcgcacgcgcgacgcccagccagggcagggcggagggcgggacgcccggcacggggcagagggcggggacgcccctcaccgggccggggaaggacgaggaggggcggcggcgcgccccccgcacccccctgcacgacctcctcaacacgccgccgccggccttggcgcgggggcggtga

SEQ ID NO: 994 - DNA, 540 bp, Chlorella protothecoides
atgcgcgcatgccatgcccgccacatgtttgtcttattgagtagatgtggtgccgccaccccttaccaccaccagatcgggagtgatgtcgctcagggcgaggtcatcctgccggcagggcatcacctgctgcccgcggagatcgggatcctagccggctccggggccgtcaccgtgaaggcctatccccggccacgcgtggccgtgctttccactggtgacgaagtcaaggatccggcggccgtcgcactcgggccgggccaggtcagggacgccaacagggccatgctcatggccgcggtcagcgaggcgggggcgctggcgcaggatctgggcatcgcaggagacaccgaggaagaaagcacggcggcattccgtagggcgctggatgggggcgctgacgtcatgctgatcacgggtgggttgcaccttgagaccatgggagctggaggcaaacgggttggtacacgatgggggactggtgtgggtgggtgtttacagaccccgggaagggaggcatgggaggtgccatggggctga

SEQ ID NO: 995 - DNA, 351 bp, Chlorella protothecoides
atgtgtccgtgccaacagcctcgacgcccctccctgcaggacccaggcctgcggcgagtgcatgccaggctctcctttgacatcaagcaggaccccgccaggccagagtaccaccgcgccatcgggtcttggagaaggatggcggggggcgataagtgggaactcgtggcacaatccacgggaggacagatcagcagccgcctgctcagtctccgggccgccaacctgctcctggagatccccaggaggaaaggcgtgctggtggcagggacgcaggtctcagcactcatcatcggtgacctgggttgcatgccagtacatgagtctgttgacacaacccctggcttttga

SEQ ID NO: 996 - DNA, 525 bp, Chlorella protothecoides
  modified_base (99)..(108): a, c, t, g, unknown or other
atggagggtgggtgttttggtgcgggcgggggtgtttgcgttgggtgcatcacggtcggtgtggagggtctggggggtctgaaacacgacagatgcacnnnnnnnnnngccctgctgcgtgacatggcggcggcgcggcgcgccgccggccgccccctcaagctcgtactgatgagcgcgaccctggacttcggtgcgctgtccgagtactttggcggcgcgcccgtcctgtcctcccccggccgcaccttccccgtgacgcagcgctacctggaggacgcctacgaggccaccgggtacgcgctggccgaggattcgcactgcgcgctgcgggccggctccgacgctgcgctgcgtgcccgccaggccgccatccggcgggcggcggcggggagccagggggtgctggcgcaggggtggggcgacgacggggccaggccgggcgccgtgctcaacccccactaccacccaggcctgtacgggcacctcaggtgtgcagggtggcaggtaggggcggcgtggtag

SEQ ID NO: 997 - DNA, 927 bp, Chlorella protothecoides
atgcaccaccagcccagcttctcctccctccgctcctcggtgtccggggagaacctgggcggggaggagacggcggccgcgacggccgctgccgcgcgccccgggccgcgcggcgcgtgcgtggcgttgtcgctgaagctggcgggcgtgcactggtggtaccagacgcccagccacgccgcggagctgacggcgggctactacaacacgccggagcgcgacgggtacgccgcgctgtgcgcgctgtgcgcgcgccacggcgcagcggccacgctgacctgcgtggagatgtgcgacgctcagcacccgcccgaggcgctgtgcgggccggagggcgtgctgcgacaggtgcgcgaagccgccgctgcgcacggcgtgccgctggcgggcgagaatgcgctgccctgcttcatgccggcctccgtggacgaggccgcgctggcgcgcatcgtgcacaactcgcgcgcctggggctcgccgctggaggaaagcgcggggcgcggggccgggggcgggcgggacggggcgggcggcccgccgtaccaggcacgtcggccgtggagttcctcggtctgtgagctgtttcggaagctgcgactgcagcttgctttgcaccgacagcatccttcaagcgggacctgccatgccaggggcatatcagcggcaccggcccccgcagctccaccctttcctcatcccctagaaaagaaccaacaaaacattacccccatcttgttccccacccccatcacagctgccgcccctgaggggctgcaccttcctcaggctgacccgggagctgatggcgccctcctgccaggagcactgggtgcgcttcatggcacagatgagggtcaacggtgggcccgccaggacgcagacccagaccaagctgtaggtcctggcgcgggccaccgccgcgcctga

SEQ ID NO: 998 - DNA, 504 bp, Chlorella protothecoides
atgaaggaagccgtggacctggacgccctccccctcatcctggacgctgaggtcgtggccgtggaccgcgccgatggcaaccgactccgcgctttccaggagctggccacgcgcgcccgcgtggacgtcagcgccgcggcggtgcaggtggacgtcgccgtgttcgcctttgactgcctgatggcggcgggccagagcctgatgcggtccccgctgaccgagcgacggaagctgctggcacaggcgctgagtggggcggcgccgggcagggtggagctggcgcggtgctatgagggggctgagggggcgggggctgatcctagtgcagacccgcccagcaccggcactgtggtcccagccaccaccgcggaggaggagcgtgcggcggctctccaggccgcactgttagaggcctttgcgcagggcggggagggcctgatgctgaagagtctgggggcggggtacgagcccagcaagcgtgcggaccactggatcaagctgaag

SEQ ID NO: 999 - DNA, 369 bp, Chlorella protothecoides
atggcccgcaaggtatttccagtgaggcgcaagggcggctgcagcatccacctggtgccctacagcgagcactcctcctacctggagctcctggagtatgtggagttcctgcgccctcatcaggtcattcccacagtgggcgtggagggggattccggcgagcaggccatgcgcaagatgcaggcgcagttcaggcacctggtggacgagaccaaggacaaggtaggggtgggactgggatgggtctcgagcatggccaggctccactcaaccttcaggtgcaggcgctgtctcccacaaggcttcccacgctgtgcatggcgcaattaccccacaggagaagttcttggcggttttcacaaagcgtaa

SEQ ID NO: 1000 - DNA, 675 bp, Chlorella protothecoides
atgggcgttttgcgtcagcgcctgcaccagctgtacagccagctgggggaccttggcgacgtggcgcagtcctgccgcgcgacgcagtccatgctgcgccgccccgacccgctcactgtgcccggcgtcttccgtgcgctgcacgacatggccgcccaccgcggtacgggggcaggcggccggcgccagcacgccgtgctgagcctgctgcgcgcctgccgtgagggcgaggtgcgctacgtcgtgcgcacgctggtgcagggcttgcgcgtcggcgccagctggcgctctgtcatccccgccctggcgcgcgcggtgctgatgcacgtcgagggcacgccacggctgccgcgcgcgcggctggacgccgcggccgcggccgccaccgccgccttccacgtctgccccagcctggacctgctctgcgccgccatgcgcagccacccggtggaggagctggagcgccatgtgggcctggtggcgggcgtgcccatcaagcccatgctggccaagatctcggagggcgtggccgacgccatcgcccagctcaagggcgcatcattcctggccgagctcaagtacgacggcatgcgctcccagatccacgttttgcttggcggcgagtgtatcagggcggcagtgtatcacagcatgagggtcgaagagttggcataa

SEQ ID NO: 1001 - DNA, 489 bp, Chlorella protothecoides
atgatatccaacatctttacgctgtcaggtctgggaacactggaggcatgttgcgtcctgtggtacggcgccgggcaggcaagcgtgcgcctgggggcccccaagatcactggcatcatgctggctggggtgctggtggggcccagcgcgatcaacctgctcaccgccgagctggcagaggacctggtgggcctggagcatgcctgcctggccctgatcgccctggccgcgggcatggagctggcagcggaggagctggccaggaccggcacccaggttgtggtgctaaccctctgcatcgccctgggctcatggctcgtcaccgcagcaggattcctgggcgttgtggcgctggtggggccggaggcgctgcacctggagccgggcctggtctggccggcggcctcgctgtgtggaacactggcgctggcacgctccccagcctccgcggtaggccgggcggagagggttggcaagtgggtcccctga

SEQ ID NO: 1002 - DNA, 516 bp, Chlorella protothecoides
atgcgctacgcaccccacctcaaatctgatccccatctgcaacgttttgtgggggcggatgccgttttcctggacaccacctattgcaataaacggcacaccttcccgccccaggaggaaagtatagcctacgtggtggccgccgaggaaagtatagcctatgtagtggccgccgtgaagagattactggccgggcaggcgggggaggcggagcccgatgcgccagatggccccgagcacgcagacgacagtgcggcagcccctggagccgatgcacctgctccaaagactcccgctgggcccaggcgcgtgatcctgatttccacgtatggcattggcaaggagcggatcctgagtgcggtggcggctactactgggcttcggctggccgtcactgagaagaagctggctgtcatgcgttgcctgaaccttccaggcttggatgtcgacggcatcttcacctccgacttctcgtccacgccgctgcatgtgacgccctggggcttcatcgggtga

SEQ ID NO: 1003 - DNA, 543 bp, Chlorella protothecoides
atgggcggcggctctggcctcagggacgtgtcccaggtgctccacgccggcctggcggccgccatgcccttcgtgaacgtcctcttctttggcctggtgggcgcgcacctccgcctgggtctgctggcggggctggccccctttgccgtgctcctggcggccgcccgcatcgcgggggtggccttcgggtgtctggccggtggggtggccggcagggtcccgcccgcgctaaggacccggctctggcagggcatggtcacgcaggcggggatcgcgctgggcctgtgccaggtcatcgctcgcaggctcccagactggggtctgcacgtggctgccctcatcgccggcagcattatcgtcaacctgctggtcgggccccttctcttcaaggtggcgggacagggcatgatgagaaggggcatgatgaggctgtgtgtggatttagggggggttggcagggggccgtcccccatcaccctcccactcatttgcgcatggcgggtgcaaaccatccagctggctcaaatagtatcggtgccttga

SEQ ID NO: 1004 - DNA, 1668 bp, Chlorella protothecoides
  modified_base (630)..(680): a, c, t, g, unknown or other
atggccgggcagcgccctcgagtgctttcccctcatgcttccaaatccccccaatcaccacctgcaggcgggtgcctcttcccgtactatattggagtctctggggcccttcgggatgggcagatactcactggtgcgcaggcgcggagggctgaggggaaggccgtatcgattctggggctgctggggggctgtgccctccccacccgcctcgccatgtccccttggcctccctcgctgagagcccctcgtcccgtcccgcaccgagcagccaacaccaaggtgggggggtcctctgccggctcgctgctggcggtgtgcctcacctccggcatgcggctggatgacatcaccgagttcagcctgcgactgatggccgactgccggctgcatggcacgcggggccggctgggggaggtgctcgccaggaccctgcacaagcacctgccggaggatgctcacaccaaggtccagggcaaggcgtatgggctcgatgcaacaggggggttgggggaaggggtggccctggagcagcagccagctgcttggctcccgtggcacgctgctgacatcctcattgcagttcccaggtcactgcaacacccctcgactgggaaacctcaacctcgnnnnnnnnnnnnnnnnnnnnnnnnnnnnnnnnnnnnnnnnnnnnnnnnnnncccccccccccccccccccccggccctttccactctgcagatcggggtgagcaaggccttccccatgctccagcccatgctgctctcggagttccaggacagggaggacctcatcgccgccctgctatcctcctgccacatcccctactggctggactccagcctcttcaccgagttccgggggtcctacgtcatggacggcggcatgaccaacttcatccccattccccctggcacgacgggggtgcgcgtctgctgctttccctcgcgccagctcagccccatctacaggcgagcacggaggccttgggggaatatgggcgcctggagggcactcctgtgttgcaccgtcgctgcggctgtcaggctcagccccatctacaggcgagctcggagcccttgggggaagatgggcgtctggagggcaatcctgtgttgcaccgtcgctgcggctgtcagggtaccggctcaagctcgctgtggggtcctcgttcgaggttttgtgctctctacgacccctccgttcgccccgcgccacccacaggattggcatcagtccagacaccttcacgccatggccgcacagcctggcctccatggtttcttgggccctggagccggccgacgaggcgacggtggtgtcgctgatcgacaagggccgggccgatgcgctggcctggatggagagcatggagctgggcagccaggccgaaagcgctcgcaccgagggcggggaggtgggggcggccaaggaggccgcgcgggagacgccagacggcacgggggggaggggccaaggcgggcggcaaaatcccaccctctgagcgccactcagccaggacttccgctgctagcagggaaggtcatcttcaagaactgggtttccttgaagggctccaacccactccaggaacgagcacttgagttgcagacccaaatgaatgcagatctgttccacacacacatccactgtgtcaccttgcaataa

SEQ ID NO: 1005 - DNA, 1383 bp, Chlorella protothecoides
  modified_base (468)..(477): a, c, t, g, unknown or other
  modified_base (716)..(725): a, c, t, g, unknown or other
  modified_base (1277)..(1286): a, c, t, g, unknown or other
atgcacgtcccggagggacccctcccccgcctggggcccagggcgaccagcctgcaccccgggggcgaggcccccgtgccccctggcccccacctgaggagcaatctggtgtggttccaggctcgcgaggccagccacttccaggagcgggtgctggagcacccggtggcgggcgacctggcggtggcagaggcggccgagacggccgcgctgcaggggttccctcggcctggctcacggagcccgggcgcaccccagcacaaatccccgcccaagctccccgcaatgatgcccgagaatggagccccaggccacgccgccggccgagcggccggcggggtcaaggctgacctcgggccgctgagtccgaggggccggggcgagaagtccggcggccccaatggtgctggggatgatgaagaagtggtgagcttggctggagggggaccccctggagaacgatctggnnnnnnnnnnatttggctgttcccccttccccatacttgccatgcattgccatctattgtaatgggacacgttcagtatccacgcacctccccggcaggaccccctggagaacgatctggactggacgacggggaagcggcctgcccaaaagttttacaagcggcgctggttctggctgtatgtcatccccctctccatctccgcaagcctcgtcatcctggaggggtcccaaatggcatgggggccannnnnnnnnntgtcatcctggtgaggggcccgggaattgaggaagcgacgctggggctattcatcggggatggggggcatgctatgtgcactttgcaagcagcactctcctgggggatgtccagctctggaggctgctcttcttcctggcaggactccccatcatctggtgcggcgcctggggctgtggtggtaaatgagactgaagattgtggcttgaatccatacatcgcagtcgctgcccccctctgtcactgtatgtcgtttcccatcgacctgctgcctcgcctactccctgcccactccatgctcaggtactttggcgactttgtgacatgggcggcggtgtggggcgtggagaagtcgcttttcacttggaagaatgcgctgtactttgcctatgccgtccgggtgagggcggggtctgtgtggtttatcctggctgaaagggacatgccgctggataggagggaccacagctgtctgcccttcattgccccggcacatgcctgtgctgccctgcctctgcgtccaagagacctcagtaaccctcacaatgcccnnnnnnnnnntgtcaggccaggcccacctaacaacgtgcctcgacactgcgttgtgctcctgtgccaaggtgttacctcaggcctctgcgtcaagagacctcagtaa

SEQ ID NO: 1006 - DNA, 585 bp, Chlorella protothecoides
atgtcgtccacggcggtcgcggctttcagcctgaagaacttcaacaataacggcatcccctccaccagcgacgtcgggattgcagcatcactgaggaagaaggtggatgatgccaccttcaccttttccttcacggattcttcgctgaaggagcctaagctggggaagggggtcgtcctggccgtggagaagcccctggcaggtgtggcggcagggtggggtgtgtgggaagggaggtggctgtccgaaccgggtcagcagcgagtcccggctccgtgcatcgccctcctcaaacccccctccctcgaccccacagatggcttgaaggccagcctggcacatgactttggcgccagcaacagcgtggcctccctcaccctgaaccggttggtgaacggctcggatgtgcaggtgaaggccatctacaagcgggctggggatgtgttcatcatggaggagcagtggaaggtggacaagaacacgcgcatcaatggcaggtgtgtaggggcaggtggcctgggagggggcgcgggggggggcggagggatattcgggacacaaagcgtgcaattgaacgagagctga

SEQ ID NO: 1007 - DNA, 1092 bp, Chlorella protothecoides
  modified_base (606)..(615): a, c, t, g, unknown or other
  modified_base (898)..(907): a, c, t, g, unknown or other
  modified_base (979)..(988): a, c, t, g, unknown or other
  modified_base (1075)..(1084): a, c, t, g, unknown or other
gtgtccgccgccgcggcggcggaggccgccgccgcgccgccgcccgcgcgctccgtcgtccccctgatcgtcaaggccgacgtggctgggtcggtggaggcggtgtgcgacgccctcgccgcgctttcctgccgtgagctggaactgcgcgtggtgcacgccggggtgggccccgtgtcggcctccgacgtgcagctggcggtgcccctgcgcgcgcgcgtcgtggcctttggcgtgcgcaccgccggcgcggccgtcgacgcggagctgcgccgccacggcctgaccctacaccgccacgacgtcatctacaagctgctggaggagctgggggaggtgatgctgggcgaggcgcctcgcgtcgagcgcgaggtggtggcgggcgaggccgccgtgcttcaggtcttcgatgtcaaggccaccaggtgggcggggggtgagtggcttttgtgtgtgatggaggggggccatccatggcgcgtgcaaagtggctttgggcgcggtgggagaatggtctccgacagagggagttggggggttggcatgtcttctgaaggaacagggcccatgcaccgtcaggggcggcatgctctgtggtgggagcgnnnnnnnnnncaggtcttcgatgtcaaggccaccaggtggtcgggggatgagtgctgtttgtgtgtgatggagaggggccattcatggtgcgtgcagagtggctttgggcgcggtgggagaatggtctccgacaaagggagttggggggggggttggcatgtcttccgcaagaacaggggccatgcagcgccaggggcggcatgctctgtggggggagcacctcttccacgatgcggttctggacgcccgacgcggtgctttgctgtgccggaggacgcccccccttgtcctnnnnnnnnnnctcttccacgatgcggttctggacgcccgaggcggtgcattgctgtgccggaggacgccccccctcgtcccnnnnnnnnnngagctgccgaggcccgactgcgctcaccccagagtgctcgccgcacctcgctcgccgcacaccccgctcgccccaaaccccgctcgnnnnnnnnnngggaatga

SEQ ID NO: 1008 - DNA, 225 bp, Chlorella protothecoides
atgactcagcggcccggggagcctgctgtcctcgaccccatccctcaacctcacgccctccccccaggctggaagttctgggtgcccgcggccagcatcaacttcttcgccataccgctgcagcaccaagtatggtacatgtcggcgtgtggcctgctctgggtcacctacctctcctactctgcaactcacaagcagtcgcctctggcgcccaagacggcgtga

SEQ ID NO: 1009 - DNA, 261 bp, Chlorella protothecoides
atgctgcaagcctcgcaagcatggcatgtaaagaatccgcttccttcccctcgacctccaataaccaccttcacagccatcctggcgcccgtgctggaggagtccgtcttccgtggtttcctcctgccctccctcacacgggtgttgcccgtgccactggcggtgctggcctcctccgcggcctttgggctcatccacctcacgccgcgcgacttcccccaggtgagttccccccgcaacgagtgtgggcaagggacttga

SEQ ID NO: 1010 - DNA, 519 bp, Chlorella protothecoides
atggcgcaggtgccctggggccttggggagaccgccctgggcctggtttcatggagcctgacctttgccgccaccggactcttctccgtcaccctcctgcgctggacgctgggcagctccgtcggctccctgcccatggacgtgaaggcgctgttcatccttttaaaccagatgctgggcaccggcgtcacgctgggcctgctctggctcttcacgcgccgccacacacccctgcccgccgatctcttctccatcgaccccaggcgagcccggtgtcgaaggagaggaatcgccgcgggggctcccttccggccctcggatgggtggctgctctgggccctggtgggcatcgcgctctccccgcttgtggtcatcgcctccgccaccgccgcggcggccatctggggcagcgcgccctccgatgctcgcggcacggtggacagcatcagccagctgatcaacgtcgatggttcgacgcgcgccgcactgttgaccacgacaggtgagtctgtatgctga

SEQ ID NO: 1011 - DNA, 864 bp, Chlorella protothecoides
atggcggcagaggtccccgtgcctccacagtacattccgcagcccgtgacagactttcgcgggttcccggatggtccccgaggctttaaagtcggagtgacgaagaagggcgtgctaggccagaagaggaggctggaggagtacgaagaacaggtgcatgctcacccgggtcgcgacccgcctacaatgtgtttggcgtccgcagcatccagacgcactcatatcggcttgcaggtggagaaggagcaggaggagcaggccatggcgggcgaggtgcagccattcggacccaggaaaaaagtgaagcacaacacccatggcctggccaaggtgtctgggcgtagctggaagcaggcaggcgagcgtgcaggcacactccgcaaccccaaactgtccaccagctgggatgagaaaatgaggataaaagcggagaaggcttcctttttggaacagaagcgggacatggactcgtcggtctggccagtggtcacacatctaagagccctcacccccccccaaaaactctccccgccctcgccagatgctcaagtcccagcgcgaggaggtgctgcgcaagaaggaggagaaccgcaagaagagcgaggtgacggtgtgggtgtccagcgccacggccaagaagatgcagaagagcaagaaggcgcggaaggcgctgaggacgggggagtaaggcctcgcgcaaacggtagccgtgccggggcgccgccgaatttgacacatcctgtaccaaaactgctccgccccctcctgggccattctccttctgtacgtgtacacgtttgcccacacaagcagaggggcggggcagaaacgggactgggtgtcgtgcacgcatctgcatgctga

SEQ ID NO: 1012 - DNA, 660 bp, Chlorella protothecoides
atggccggcaaggagtgtgtggccatagccagcgatctcagatttggtgtccagctacaaacgctggcgaccgaccacaagaaggtgtacaagatccatgatcagctgttcctgggactctccgggctggcaagcgacgctgaaacactatcacagcgctttaagttcaagcacaccctgtacaagctgcgggaggagcgggacatcaagccctctgcctttgcgcagctggtctccgccacgctctacgagaagcgcttcggcccctacttctgccagccggtcatcgcgggactggagcccgacggcacgccctacctgtgcggcatggactccattggggccattgagacggccaaggacttcatgatcgcagggacggcgtctgacgccctgctgggcatctgcgagtccctctggcggccagacatgggtccagaggagctgttcgaggtcaccgccgaggccctgctgtcgggccagggccgggactgccttgccggctggggcgcagtgcacgaaggaccagatcatcgcccggcagctcaaagagcggacggtgtagagcgtgcgtgcgccgcccgtcttgcctccctggctggagtcccccgccctgaattccagcgttcacccaacaagaaggctgtgggcgtcacctaa

SEQ ID NO: 1013 - DNA, 810 bp, Chlorella protothecoides
  modified_base (100)..(114): a, c, t, g, unknown or other
  modified_base (355)..(364): a, c, t, g, unknown or other
gcagggcgcgacgtcgtcgtcgcggggtaccccacctttgaccccgccgcctcgggcctgtcggggccggtgctcacggcgggggcgctcagcaaggcannnnnnnnnnnnnnngatggggtgctgggggcgggatctgataatgttgctggcggcacacccggtggctgcatgtggccagacccccgcacacctgcatgcctgcaaggcagccgcctcttgcctcctcgcaccccgagacccagcgcatgggcctggtcaccctccccaacaccccgcactcaccgaaaccctccccgccttcaccgtcacgcggcgcaggttgtggcgctgcgcggccggccggccatgctgnnnnnnnnnngccgaaaccatccccgccttcaccatcacgcggcgcaggtcgtggcgctgcgcggccggccggccatgctgctgaccagcgccagcgtgcgcagcggggcgtcgggcggggggctgctggaccgtgactccggcgcgctgctgggcctggtcaccagcaacgccaggcacgtgctggggaccacctacccccacctgaacttctgcatcccagcctccctgctgaggcccacgctggcggcgctgctggaggagaggagcgccggcccggactgggcggccctggatgcccccgacccggcgctgagccgggtgtggcgcctgggcagccacgagccgccggacaagcagggtcttgagccaccagtgccccgcgccctgcaggagctcttggctgagcagcagggggaggggggaggggcgggcaaggcacgaccgcgcttgtag

SEQ ID NO: 1014 - DNA, 732 bp, Chlorella protothecoides
atggtggggcacaccgggaagctgaaggctactgtcatctcctgcgccgctgcagacaggggagtcaagacgctagggtgtcacttgctggagcaaaatgcagggagttggctcgaacctaatgtgcgggtgcaagctgagggtgagcatcatgatcacaggccatggtgtgcccactgtccacctctggctggatcacaggtccttctggatgcagtggaggaggtgggaggcagcttcctggtgactgcagaccatggtaatcataggaagttggttttaatgtgggttgtcccaggcacacactggctagagaggtttccgcagtcctgtgcccatgctggtgccctgcatgctgtgatgatcgacttgttgtacctggagggtttgtgggaccgcaagcacaccctggcaacagttacggctggggattccagcatgtcgcatgacataatgtgctgcccccccccagggaatgctgaggaaatggtcaagcgcaacaaggatggctcaccaaagtacacggatggcgaacctgaggttctgacatcccacaccctgaaccctgtccccattgccattggaggtccgggtctacccaagaacatccgcttcagggaggacctgcctggggctggcctcaccaatgtgacggcaacctacatcaacatgctcggatttgaggctccggacttttatgaaccatccctcatcaccacggacaagccttaa

SEQ ID NO: 1015 - DNA, 1116 bp, Chlorella protothecoides
  modified_base (1059)..(1068): a, c, t, g, unknown or other
atgcacctgcatcccgcgccgcccctccccactcggacgacttcaggcaagggaaatcgagggctggaaggtggagtggtcccaacgctattcttccaaaagcgatccccgacagcccccaaaaacattgcggtgcatcttgacaaggacgatgaaaacttccaccatacctcctcccctcacagcacaccaaagcggggtcagcgccctgccgcggcgcagcacgcctccaccacccccggcacgggcctcaagtcgctgatgaagcaggcggccatggccaagcgcgccgccggacccgactttgtccccgactccgagctgcacctggccagcctgcgcagcaccaccggcgcggtcctgggcctggcctggtcggcagacggggacgccctggcggcggccactgacgggggtagcctgcaggtctggcggctgccccccgggctggacgtggcggcgccgggcgggcgccagccgccccactcctcccacgagctgcgacagggggccagcgacgtggccttcggcgcagggcccagcagcctggcggtgctcacgcggggcgagggcggcgcgcccgccgtgacattgctgacactgcccaagggcccacgtggcgacccggagccggcctggacgcggcacggggcgcacgcggccgccaacgaggggcggtgcctggaggccagcgccggcagcaaggcggggtaccccatcatcatcagcagctcaaacaagacggacatccaagctgctgggaatgatggtgacgcgcatcaacatgattgtgctcgactgcacgcagaatatcaggatcatcatcccaccacccgcagcgtctactctggctcgggggaggacctgggcaccatagacactggcggcttcgaggtgcgcaagtgtggggatgggcggcatggcagcagatgctcgcattggttgggatggggtattgtgcagcgacccagacttgagagtgccggaggcagggctctaggtgtgtccttgctacctatagcatgccagcatgcacgcctgcaccagcaccccggcatnnnnnnnnnncgaaggggggtggggtgtgccgggggagcagcgtggcattgcatctga

SEQ ID NO: 1016 - DNA, 1623 bp, Chlorella protothecoides
  modified_base (1253)..(1262): a, c, t, g, unknown or other
  modified_base (1366)..(1375): a, c, t, g, unknown or other
atgacgtcaaggcaggtctcagggctgggagtttccagggcctgcgcactctgcaggagagtcactgaagcattcgctgccccttactttttcaaactttatctgtttgtgacaactttaacgcccccccttctcaatcccctcgtgacagatctacgaggtgtcattcgacaggcagggcaccttcaccggcctgcacaaggccatggccctgaagggccatgccgcgcgcgtgctggccctggccttctccccggatctggggcgctgcgcgacggcctccgccgacggcacgctccggctgtggaacatcggcgtgcgctacgcgctggccgaggaccccaagctgctggcgacggcgcggctgccgctggcgctggaccccaagctgcgcgcgcggctggcgtggggcgcagggggggtgatcgcgctgtccaacgggcaccgcctcgccttcttcgacgaggcgggggccgacctcctggccagcgtgcccgacgcgcacaccgcgcccatcgccgcgctggcctggtgcccgggcaggctgaccgccctggagcggcccacctggacgctggcgacggggggtggggacgccagggtcaggctgtggcgctccccggagcgcagcgcgggcaggagggtttgagggcatgtcgctgcctcacactgagcacatgcagcgcgactgaggacctcctcttcgctccgcgatctgtgtttcaagacacagaagcgggcgtgcgaccctgcccaagtccctcaactcctgaattcatgctctatggaacagtcagatgggatcctttgctgatagtcgtccagatagtggcgttccaatgctacttttacggcacccttggcttgctgctcttcctcctcaccggtgcgagaccgtatgtgccggatgtgaacctcttccatgtgtttgactggcgatggatccagctgaagaccttcgtgggggccatggtgatcctggcttttgtcatcacgtccgtcctcaacgccgtcttcctcagactgatggtatggaggtattgttgtgggctcgtgcacgacaggcctcaccgtggcgttccacgcaactgcccactccctctccatatttacaatgcttttgtgcagatcaggcgcgccaagaagtgtctggacttcacggccaccctgtacggcatccatctcatacttgtgtggtcgacctatggcctgccccggacaaagacatggtgggtggccgctcaaggggtacnnnnnnnnnnggttgttgtgggctcgtgcacaacagggctcactgtggcgttccgcgcaactgcccactccctccccactttaacaatgcttttgtgcagatcaggcgcgccannnnnnnnnnggagagtgccactcagaaatatggtgacatgtattctaatccaatatgggttgacttacagtgccattatacctctcaacaggtggatctgtaatctggcgttcctagccatcacgaccggccttggggagtggctctgcatgcagaaggagctgcaggatatccctatgagcagcctgtccacggcaggcgctcgaatagagcaagagctggtgcgtcagattccagttgttaccatcctctcctag

SEQ ID NO: 1017 - DNA, 441 bp, Chlorella protothecoides
atgccccagaatgcggctggagagtgcttggggctggtcgtgggagtgggcctgggagcgcacaggcgacgttgcgtgcaaggctcagccgcgggggcggcgatcagcttcccgctgacgcagcgcccagacgcttctggcgccagcgccagcccgccaccttatccagaggccatcgaggtgtacaccacccggcctgacaccctctttggcgccacattcctggtcctggcgcccgagcacccggccacgctggccgtggccaccccggaccgcgccgcggaggtgcaggcctacgtcgccgccgccacggccaagtccgaccggcagcgcgcggcgtcgggcgtcacgggggtcttcacaggtgtgggggttgaaaggagagaggcgttaggtatgatgatggagttggtggggccttgtgggatgggcatgccttga

SEQ ID NO: 1018 - DNA, 798 bp, Chlorella protothecoides
atggctctcgctgtcttggactcccccgcgggtccgcttccgcccgctcacccagctctcccccagcctgcacgctgctgcgcacccctttcggaacgatacaaaaacacgaagccccgcccagcacaccaccgacctgtgccgggcaccacggtctgcatccaggccgtggccttggccagcggggggtctgcggtgcctgtgggcgtgaagtcctccacctcaggcaggaccaggggcagctcagactccggaatggcaactgaggacgcagggggcccagtcaggacgccacacgtacatcatccacctttcgggagttatatcccgtacctaaccaccaacccatcaacaggcctcccactccccccaggacccagcatctctgcctacctgatcagggctgccatcgggccccagcgggaacacgacggggaagggctcgccccagtagcgctgccgcgcgaacagccagtcgcgcagtttgtactgcgtcctgccccgccccgccccccgcgcctccagccagtcgatcacggcgcggctggcctccgcccggcccagcccgtccagggtcagacccggcgcggcggaggcgcaggccaccgtcccgcccgcctcgccgtcccgcaccaccgcgcggctgggcaggcggtactgcgcggcaaaggccgcgtcgcgctcgtcgtgggcgggcacggccattatggcgcccgtgccgtatgcgcccaggacatactcggccgtccagatgggcaggggctcgcgcgtggcggggtgcagcgcatacgcgcctga

SEQ ID NO: 1019 - DNA, 1146 bp, Chlorella protothecoides
atgccagcactgcatgcatcgggcccattgctgggggctgcgggcccccgcagcggcaccgtgcgctgcgctctgcggtgcgcgaggaccgccctgacaccatgggccggcgtggcaagggcgccattctcccccagggttccatgcacgccgcttcgctcggcgagtacggccaccacccagccggaaaccgagacggggcctgtgccggagtccggcaccggcccagccacccgccacgcagcctacccctttgccgagctggagcccaagtggcagcggtactgggaggagaaccagaccttcaggaccccagaattcaaggacctggacaccagcaagccaaagttctacgtcctggacatgttcccctaccccaggtgggtgtgtggaagtgtgggggggggggctctgctactctggatgctgggcggcgggcttgggagtgtgtgcggatcacgcagcactccacgttctgtcggacatccagtcgcggctctcttccccggtggccatcacctacccccgcacacctcctgccgtgcccatccctcacgattcagtgggtcgggattgcacgtgggccaccccgagggctacaccgccaccgacatcctggcgcggtacaagcgcatgcgaggcttcaacgtgctgcaccccatgggctgggacgcgttcggcctgcccgccgagcagtacgccatccagacggggacgcaccccgccgcgaccacggcgaccaacatcacacgcttccggcagcagctgcgcgcgctggggttcagctacgactggcggcgcgaggtgtccaccgccgacccggcctactaccgctggacgcagtgggtcttcctgcagctgcacgccgcggggctggcctaccaggcggaggtgccggtgaactggtgccccgcgctgggcaccgtgctggccaacgaggaggtggtcgacggcctgagcgagcgtggggggcacccagtgatgcgcatgcccctgcgccagtggatgctgcgcatcaccgcctacgcagaccgcctgctggccgacctgcccaccctggactgggaccccgccatcctggaccagcagcgcaactggatcgggaggtcggaggtggggcgccggggcggggtgttctctgggtag

SEQ ID NO: 1020 - DNA, 501 bp, Chlorella protothecoides
atggacagagcaggggcgcattgggcttctaatacgcgggaaagggccaccgcatcacagtcagcgctctgcgtgcaggcttccccacgctctcctgcgcccttgtccctccgtgcaccggaccccgcacctgacagccgccgcgcccgcgtcaccctcgcgcacgggctcgccgcccggccctcggtgcacggagtactccacctcccccaggatcatgccctggctgaccaggcgctggaagggctcgggcgtgctgacgtggcccagatcgaagaggaccttgtgccagaagcgggcgtagaggaggtgcagcacagcgtgctcggcgccgccgacgtacaggtccacgggcatccagtaggcctctgcttccttgctcaccagcctagatgtcgggggtgccaggttgaggtgagcgaggaatgggtcatgagcagggtggttctgggaagccagcaccagacacagagggtcaatgtgagctttggaggggtgtaa

SEQ ID NO: 1021 - DNA, 531 bp, Chlorella protothecoides
atgctgctgtggctgacagagggtgtgttgggttctcgagcggcgcacccaggacgagacgggtaccctccacggcagcagcagcaggttgacaagcgatacctccacacttcccttccacagatattcatcgtcagcctggacgcggccgcagacgagtttcccctgtttgagaacaaggcgatccagcgcaagctgagcccggaggcccgctccctgctcctggaggacctggcggcctcggggcggggccggtggctgggccccgacaggcgccgcctgctggtcctctggcgcggcgtaggcgagtgggccgacgtgatccatgcctgggcgcgggttaacggcctggaggacagcgtggtgagcctggaggagctgctgggcggcgaggatgtccgcggcagcgagctggcgggcatgcctcgcgagctgctctctgccgcgctgcgcacgctggaggagcggggcaaggcgcgcgtgttcaggggcgacgccaacgacgacactggggtcaagttcttcgcctga

SEQ ID NO: 1022 - DNA, 417 bp, Chlorella protothecoides
atggagctgtaccggaatggtacccaggttctcatcggctgcggccagaagggaatggtggcgtacgacctcgtatctggcaagtccaccggccagtgggagacagaaggcatgggcgcggtggcgctgaggggccccctctctgggggtggctacctggcggcctctcccgccggcaagatcttcgtcatggacggccgtagccggagcgtgcgcccaggcacctccctgaccgctcacgtcggcggctttgctgccgtggatgctgcaggctccctggtggccacggcggggtactcgatcaggggcgggcatccggtcctggagcgggccgtcaaggtatgggagggttccggacgggtcctcagtggggcatgtttacgtggagagggagggttgtcaaataagaataactaa

SEQ ID NO: 1023 - DNA, 609 bp, Chlorella protothecoides
atgctgccacctctctctgccctgggaaagcgtgcacgggtcgcccatgcacccttgcaccgcgcccatgacgacctcctccccccgccgcgcccatcgtactcgtgccacccctccccccgcccacacaatccccagtccgacttcgtgggggtgatccccaaccccttctacgaccccgcggcccccccgggcaccgccgcggcggcctcggccaggctgcgcgcggagcgcgcgcagccggcctgcgtcccagtcgacgtcgcggcccggcgcgcggagcgcgctcagcgccgcgccgcggagggcggcgtggtcctgcccgatcgctaccggcgcgtgctggtggcgacccagcaggctgcggcggcgcagtcctggttccaggactacgactactcggcgtgcaacgcctcgccctttgtcgggctggagaacgacctggccaactcctactgcaacgcgctggtccaggcgctcttcttcgtccccggcgtgcgcgccgcgctgctgcgccacgtcccccgctccaacgacgagttctgcctggcgggggagctggccctgctcttccgcctgctgcagacgcgcggcgccgtcgtatgccgg

SEQ ID NO: 1024 - DNA, 474 bp, Chlorella protothecoides
atgcagtcgctctccagctcgcgaggtgttaccgttgcgtctttcccgagcactcggcgtgcccagcgcaccagagcatcgcgcctgccggtcgtgacccgtgcggtggtggcggagagggacccccccgcagtcaatgaaacgagcagcaagtccagcgacaagactcgcgtcggcatcaacgggttcggacgcatcggccgactcaccctgcgcgcagcaatgcagaacccagatgtcgagatcgtggccatcaacgatccctttgtcaaccccgagtacatggcgtacatgctgaaatatgacacaggtgagcaggtccacgccgggatacccggcctgaatgtgctgcacagcgctgggcatcgtcggggcggcgctcgcaatctgaggaacatcgaccgaatttccggcgttccaccctcaagcccatgcctcacctgcagtccacggaaggttcaagggagacattga

SEQ ID NO: 1025 - DNA, 2058 bp, Chlorella protothecoides
atggcacagcaccctccccttccgtttccctgccaccccccgccctggcccaggggtccaagagccatcctcctgacagcctcccctctcccttctccacacaccaggccgtaccacaacacccccgccaccatggacggtgtgctccgggccatcaaccgcgtgtcggccatcgcggcgctggcgggcgacacccaggccggcgacgagacgcgcggcggcggcggcatgccctccctcgcccgtcagctgcccaagatcgtggtgatcggcggccagtccagcggcaagtccagcgtgctggaggcggtggtgggccgcgacttcctgccgcgcgggaccggcattgtcacgcgccgccccctggagctgcagctggagacctcgcccgacgccggcgcggccgagtacggcgagttcgggcacctgcccggcaagcgcttcctggactttgaggccattcgcgcggagattgaggcggagacacggcggcacacagagaagcgcgggaccatcgtgtcccccgtccccatgacgctgcgcattgtgtcgccccagctgcccgcgctctccctggtggacatgccggggcttaccaaggtgcccatcgacgggcagcccaagtccatcgtcaccgagctggaggccatggcgcgcgagtacgtgcgccacgagaacgtgatcatcctggcggtgacccccgccaacgccgacctggccaccagcgacgcactgcgcatggcgcgtgaggtggatcccactggcgagcgcaccatcggcgtgctcaccaagatcgacatcatggaccccgggaccaactgccgcgacgtgctggacggcgcggcctacaccctgcgcaacggctggatcggggtggtcaaccgcggccaggccgacatcaactcccgcatggacatgggccgcgcgcggcagaaggaattggacttcttccaggccaagcccgactaccagggcctacgcaacattggcaccggatttttatcctcggagctgtccactaagctggtggccagcgtgcgccgccagctgcctaacatcgccgcgtttgtgaacaagaacgtggcggagctgcagaaggagctggacggcatgggcggccccgccgccaactcgcgtggcgagatgatccacctcgtcctcaccctctgccgcaagttcgagaccgggttcgccaagctaatcgacggcgggaaggggggcggcgagctcatcctcactgtttttgagaagcggctgccggacgccatcgaaaagcaacccttcaagaagctgctggaggtgaactacgtcaagcgcgtgatcgaggaggccgacggcatccagccccacctggtggcgcccgaggccgggtaccgccgcatgctggaggaggcgctgggctacctgaaggaccccaccgagaagagcgtggaggaggtgtttgtgctgctccggcgcatggtcgacagcgtcgccgggtctgaggaggtgaggttcgagtggtggggcgggtggggtctcgaccaggcatgctctcacacacgcatcccagccaccctggcgggggatgtgcacctcggcaccctcacggtgcgcgccctccggcgctaccccacgctgcgccgggagattgtgacggcggcctaccgtgcactggagcgcttcaaggaggagacgcggcgcatggtgaacatcatggtggagatggagcgcaactacatcaccgccgagtacttccgcgccatccagatggggcgcatgcctgacggcaaggtgttgtacacgctggacgggcgccccgtgacggaggagccggaggggaccatcgaggagaagcactacaagcgcatcatcaaccaggtgtcgggctatgtgcgcgaggtgtgcgggcagatgacgcagaccatccccaaggccatcgtgcactgcatggtcatccaggtgggtgggggtgtggcttcattgggagagggggggtggggcaagaggagggcatgggagggtggtgatgctcgggcaggggggagggacctgccatgcgggcctgcaacttcgtga

SEQ ID NO: 1026 - DNA, 1626 bp, Chlorella protothecoides
atgctccgtcacctcccgtcctccgcccagcggctcagacagccatgtgcgggcggagcaggcctgctagactttaggttcttcagcaataagaatcctccggggtgcgaggaggtgcctcagggccacaaggactcggagctcacgccacacacctgccacgctggcctgctgcgacggaaggagctgtaccacctgcgccacgtccagctgcaggtcgatggcaagacactttctgtgaaggatgtcttcaaggtgagcgctcgtcaccccggtgtgggtgggtggggcccagctcagtaccgcatgctggacttcacaaatagggtgaaacctgctgctcccgggggcagcactgcttttctctggggagcttgctcctcttcagcccaagctcatggtgcatccaatgcgcaccatcctgcttcaaaagctcatttggagacctgcctcctcgctctcctctccacctccccactccccattcttggacacacaccccagggcgggctccaaatcgcctttggggtgccggaccggggaaaggtgtgcagcgagcagcatgcccccggctttgccaaggccctccagcgattcaaggagcttgaggtgcagctgcccgtgctgtgcgtgtcccagggcacgccccgcgaggcggagcagtgggccagcaagctcggcctgaagccggaggaggtgcggcaggtggtggacgtgggcgggcggctcacccgctacctgggcgtcgagctggggatcggggaggagggcggcccgaagtcccagcgctgggcggctatcctggacaacggcgtgctcttgaatctggtgtgcgagggtggtggaggtgtgatggtggcagggcaaggtgtgatggccctgcctgcacctcattcctgggggcgcccggcacggcctctgcgtgcctgcgcgttctccccacagcgcacatcactggagaaccggtctacccctcccagttcgtggacaagacgcctgcagctgtggacgtgtccagcgccgagaacctggtgcaggcggtggagaccatgcgcgaggcgcagaaggggctgtaggcgcaccctgctggtaccccagcctcctgttgcattgttgggcttgctcagggccatcgcctgccgagcatggatgcagggtctctctcatgctgtcgaatcttgttgcattcttttaatattgatgatcggggaccgggccccgcggcgtgtgccaggggaggttggtggcgccaggtccgagatctcacgcgccctggttcacactcggcatggcgagcagttgccttgggggtacgaaaccgtcccacggcgccctcggctggcgaccaagcacctgtatctggcatttgtgggcagtgacagcctcgacatcgctttaaccgtgctgctcacccacgtcgcggaggtcaacctgcggttgcggacgaacacgctactgacacccgctcctccctcgccgaccctcgcccccctgatccttgctccaggtgtgcacctggctgagtggggtcgtgcacggagggatgagacctcaggtgcacccacgcgatcccagtgccacccccgaccacgggatccccggggcgggggttctccgagcaagtaa

SEQ ID NO: 1027 - DNA, 819 bp, Chlorella protothecoides
  modified_base (219)..(228): a, c, t, g, unknown or other
atgactcgtgcccgcccctggaggccggcctggacagccactacatgcgtctggcactcgaccaggctcacaaggtgcttggactttcggctcctgcggggtcctggggaattttcttcgggctggccgctgggattcccgggacccaggtcggacatgggtgcaggctacaccacagcccccccagccctgcccaagtcctcgctccctgccccaccnnnnnnnnnnattttcttcgggctggccgctgggattcccaggacccaggtcggacatgggtgccggctgcaccacaggccccccagccctgcccaagtccttgcaccctgccccacgccacaggctgcctcaaagggcgaggtgcccatcggcgccgtgctggcggcggcggacggctccctgctggccagcgcccacaatgaggtggaggccaccggcgaccccaccgcccatgccgagatgctgtgcctgcgccgcgcggcgggcgtcgcacccagctggcgcatgccggacgccacgctctacgtcaccgtggagccgtgcgccatgtgcgcgggtggcgcgctggcggcgcgcctggcggccgtcgtgtacggcgcgcgctccccgctcatgggcgccgacggctcctgggggtccctgctggggcgggggccgggtgcgccggcccaccctttccacccggggctggaggtgcgggggggcgtgctggcggatgagtgccagcgcctcatggtggagttcttccgggcccggaggcgtggcgaggtgcggggcccaccaggggcagggtcaccggtgcaaagggaggcgtcctga

SEQ ID NO: 1028 - DNA, 993 bp, Chlorella protothecoides
atggactacaagttctcaaacttgttgggggctccctaccggggcgggacgttgctcatccatggctcggagctcctcagccccgtcggcaaccgggctcgcctgcctggcgcacttgcgctcagcggggggctgagcttctctacttgcaagctccagcgcccatgttgccctgcgcatgagcccagggcacctgcgatcctcgtcccctccctccacctccgagtccccaccccccacatctcacaaccactcccgcagatcgatctgacccagtccacgtccagcacgctgccgtttgaaaacgggcaccaggtgcggacgctggccctctcccccgacggccgcctgctggtgtccatcgacgtggagggccgcgcgctggtcatcaaccgccgccgccgcgcgctgctgcaccacttctccttcaaggaccgcgtgcgctcggcggccttctcccccgacggcgccttcctggcggtggccgtcgggcgcctggtccaggtctggcgtgcgccggagctgcgcaagagcgtggccccgctggccctgcaccgcacctacggccaggcccacgccgacgtgaccgtcctggcctggagcccctgctccacctggctggcggcgggggcggaggatctggtggtcagacccctttccctgaatcccatccaagggtaccgggtccccagcctgatgggccaccgcgccccgaccgtggccgtgcagttctccagcgcggcgcagcgcgaggcggcgggcctgctgggcctgcccacgccgcacctctggaccctggcccaggacggcgccctctacacctggacctacgagggcggcggcgcggaggaggatcacgcgggagacggcggcggcgcggaggggccgcaccagtcgcacgagttctacggcgggcactggcgcctggcctccaagtactacttcaaccaggtgcgtgctgggatggtgggggtaatctatggggtccgctga

SEQ ID NO: 1029 - DNA, 558 bp, Chlorella protothecoides
atgcccttcctggcgggcgtgcccgcggcctgcctgcccacgctgcgcacgctggccatggaggaggtgctactcatcgacctggacacgctggggtcggcctcgccgccgccgggcgggccgcgcgacgacgcgctcctcctgccccatgccgacgcgctggaggcggccttcgacgacctgcgcgacctccagcggtcgcccgccgaggcagcctccacgcccaaggccgccgagatcgtgcgtgcctgggcggtgcgcgtgttcggcggctaccgcgctttcctccgcccagaggacgcggcgggggcgggcgcggcgctgggggggccaggtcagcaggggctggtgcacgtcgcgcgcagcacaggcagcgtgcagcgcgcccggtccgacaccagcatcaggcggaatgaggggaaaggagaggggggggtggaggcgaccggtggaggtagggacggcaggatgagatggaagggagtgcggtcaagcgaggtgaaagcagagagaaaatgtgctcgagtacaggccagcgactccgtggatgaggggtga

SEQ ID NO: 1030 - DNA, 741 bp, Chlorella protothecoides
atgggccgcctggggctggtccggctcaggcctcgcacctctctgggcaccaggccccgccagcacgcgctcgtggccgcctgcttcgcggcctccctcttcctgggcaacgccgcgtacctgggcctctccgtggccttcatcggcatcctcaaggcactcgcgcccgtggccacgctgggcgccagcctggcgctggggctggaaaggatgtcgctgcccgtcggcctggccaccgccctcatcgcggcggggaccatgttggccaccgcgcaggtcggttgggaggtgggacccgtgtggcactccaggaatgggggcccaggaggtgttgcaggtgccggtggaggcactgagctccctcgaatggcctgcggcgggggctcatcatctcacaatgaggccgcatcctcccacttctcggtgctggcattcgcagcgttcgccaccagcgtcggcttcgaggccctgcgcgtcgtactgacggagcggctgctggcgggggagggcgccgcgccgcggatgagtgccgcggaggtcctggtctacatcggccccttgacgggcctcatgctgctggcggggtccgtcctcgtggaagggccccacatcctccggcgggtgaggggtttgcgtgcagggttcgcacggatggagggtctgaggaggttcgatgtggcacggcaggaggcggtggacggcgatggggcagagcgcgagtgccacggcggactccgttga

SEQ ID NO: 1031 - DNA, 2001 bp, Chlorella protothecoides
atggcccatgctcctgtggccctggaggaggacagcggggaggccacgacccacgacccacctgttgatctcagcgctgtggatcgcctcctcctcattaaatctctggggagggcctgcgggtccctgggctccacggatgccgagctccgaagggacctcgcggcagagctgagcaccgaggccgtggctgctcggctcaacatccagcgcctggatgagttgttcaccatcgagcaggcgcataccggttcccgatgcgtcgggagtcggggaggagtgagtcccaaacctgggacggcacgagttcgggagcccacgccggatcgagggcggcgggcagcgcgcccggggtaccaggactacatcctggcccccgagcagggggtgcgggcgctgctggccgagtgcttctcgacctggcagctccccgcgcatgcgctggtgggcgcggtgcacgccctgctggcccgcgccatgctggcggcggtggcggtccgcgccgcgccgcgcagccccgagctggcggaggaggcggagcgggcgtgcctgcgcttcctgggggcgcgccgcgacgccacctcggcgcacatcagcgccacgctggcggccgaggcgcgattcccctcttctccggccttcacgcgcctgcgcgcgcagctggccgacgtggcgggcctggtggcgcgggcgcagcgcgaggcggcggccatcaggagggcgggcgaggatgcgaccctggccgtgtcggcggcagggacgccggcgcccgcccccctcccgcgcaagccctcggcggtgccgctgcacagctactacatgggctggctggagaagcggtcgcgccacgggcgctggcagcggcgctgggtggtggtcagctccgggctgggccgcatgtggtacatgcacaagcctgggtcaaacgccacgcgcggcgtgctgggcctgctgggggccacgctggcggggggcgagtctgtccttgccgacaccgacatcggtgggtggcatggggttgggcatggggagcaggggctacttgtgccttcagcgtgcactatgggtgcgacaggcatgaaggtggggatcgggggggccaggggggctgccaacaaggtgcctggactcgcatcacatgagattggctgtgctgatggtgcacaggcgagcttggccctccaaagcatcgattcccggtcgatggccatgcccctcccttgcctcgcttcccgtgcccaagtccgccactctgccgcgtcacacgtactgaccacccccccgtgccgccaccccgcagcctcgcccacggtgtttgtggtgctggccggcggcctagccgcgggcagcgagcgtccccgcctggtgctgcgtgccgagtcgccatcggcgcggaacaagtgggtggaggcggtgtgggcggccatcgagggcccgcacggggacgtgccgggattaaaggacgccgccctggccctgccccgcacgctggccctcgagtccacggagggggcggagctggacgctcccgtcggcaccggcgtggaccgcaagatctccacccgagtgtttgacgaggccgagctgcgggggggcggggcgccggcggaagagggtgcagaggcccaggcgcacgagactgaggaaggcgaggagcgggggctgcgggggggcgggtcgccggcggaagagggcgcagaggcccaggcgcacaagactgaggaaggcgaggggcggggggagcccggcagccctgggcggacgctgagtcagcagagccacgacgagtgggcggcgtgcccgggggcagcacagtcggccatcgcgccggaggagcgagctgtgctgcaggcggtgctgcccgtcgtgcggacctacgtgcacgagacctgcctccagctggcctcgcaagtcagcaaggtgaggggtggtgatggggggggagggggacgccagaatgtcggtcatgaattctatggcggcgtgtactgcaccgggtaa

SEQ ID NO: 1032 - DNA, 591 bp, Chlorella protothecoides
atgttccgcacttgcttcgcagcgacgattgcggaggtcaagggtgcacggcaggccttcatcacctcccgcttcgagatcgactccaagggccttccaacagatgccaacatcctggaattttgtttcccgctgggcgctgcagccgtagtccccaaggagtaccaggcggtcgaggtaggtgggacacctgttcatcatgggaccaggcctggaaagcgaatggctgccagagatcatggaacacaggactgttcctctcccccccgcacaagtacctcgtgcaactccattgcctgcctgacccggccctccccgagccactctccgcaggagttcctgtttgccctgacggggggtggcggcgaccgcctgtatggcttctgcaggcactccctcccccccaaccgccccggggagggcaacggtcgggggatcgccaagctccagcgatatccccaggcgctgtgcatcgtctcgccccacccatgggcccagttcttcttcagggtgcggccaagcggcgagtcggggtgccagtcccgtgatggacctgctcaggcgccagcaacctcggcagcaggcccatga

SEQ ID NO: 1033 - DNA, 1356 bp, Chlorella protothecoides
  modified_base (479)..(488): a, c, t, g, unknown or other
  modified_base (646)..(655): a, c, t, g, unknown or other
atggcgaagccgaggacgcgcccccccaaggagcgcaaagtgctcgagcctctgtcggcggagggagactccaagtttgcacgggccctggggagcgtggatggccgcacgcgggaggcagggctccaggccctggcagtatggctctcacgcagacaggaagtggacaggctggacctgctcaagctgtggaaggggctgttctacaccttctggcacagcgaccagcccaccgcccaggtgtgcgagccgcgccgcgcgagggtcgcggctgtacctgcatgcatgcggcatggcatgccctgcattccatctttacactgcccgtgccagtgcctgactcccccaaacgctcgcatgctcgcagtcagctctggcggagaggctggccgacctcctcctagtcctcccacccctggttccaccagaatatcgaagacccagcccatggtcctcagacctccatgctcatcccaacnnnnnnnnnngcgacaggtttcaccagaatatcgaagacccagcccacggtcctcagaccttcatgctcatcccaacacccgcccttccgatcaggtatctgatctcttctatgagacctttgtgcagaccatgcgccgcgaatggtttggcattgaccggctgcgcnnnnnnnnnntctacgagacctttgtgcagaccatgcgtcgcgaatggtttggcattgaccggctgcgcatggacaagttcatgatgctggcaccacgtctgcctcacccaccccctaccccacccacttgcccacccagggacccagccgtcataaggaagacaaccagcttctggctggaggagatcctgcttcccactgacacgctctccgccaccggctttgcataccatctcacggacctgctcctgccagagctgcagcgagtggtgaccagcgccgccgagcagccctccgcagccgccttggccgcgctgctagaacccttctgccaagcgctggcgcagacgggcaaccccgccctgcagttccgcctcaggtgcgaggggtggcacatgatctcactcttgggggctgaggcgctgtcaggactgagcaacttgggaattctcggggcgtcgccctgggcaacatacagggtgttgctgcctgctttgaattcatcagcgcacaacgggtgctgcttcctcccgactgccattagctttggaggaggacccttaggttgcataaactccaattcaccccaaaccgtcatggacacgcaggcacggcgtcttcctgaccatgctcaaggagatccaaaatccctcgccgcatcagcccctgcggcacctggccatcaccgactttgcggctcacatctttga

SEQ ID NO: 1034 - DNA, 393 bp, Chlorella protothecoides
atggcagcggcgtcggtggcaaaggcagcaaaggcagcgacggcgacggcatcgccgccacggacgcccacggtgcctgctgcgccacacgacacgcctgacaccctggcaaagaagaacgtgcgtttctcgctgcggcgtaacctggtcatgaccatcggcgagccgcccgcgcccagcgaggtcaggacgccaccctcctccaagcccaagggcccggcgctgaagaaagcatcctcgcttggcagcgcgcccgggcgcctgacaggcaagtctggcggtgcggcgcggcggctgtccatgcagggcatgggtacgtctgccagcggcgggaagccgggcaaggggaggagcagtcttgggccgcggccgcgggccgccgactttttctga

SEQ ID NO: 1035 - DNA, 468 bp, Chlorella protothecoides
atgcagtgtgggccaaacgatggacgtgacagaccccttgcgctcggcacccgcaccctggccctcatcgcgggagatgagctcgttggagaaggtcagccccggcatgagcccccgcttcttcacccagtagatggagcagaaggagccggagaagaagatgccctccacgcaggcaaaggcgaccaggcgctcggcgaatcgctccgcgctcgagatccacttcagcgcccagtcggccttcttcttgaccactggcaccgtctcggtggcgtggaacagcatgtccttctgccgcgggtccttgatgtacgcatccagcagcaggctgtacatctcgttgtggatgttctcgatggcgatctggaagccgtagaaggcgcgggcctgccaggtggtggtttttgggatggtgggggcaagggaaaggtgagtagcattgtggaggggccaagttcccaagactga

SEQ ID NO: 1036 - DNA, 1062 bp, Chlorella protothecoides
cgtgctgcgcgacccccagccccagctggcccacgagctgatccagggcgacgcggcgcggttcgccgcggcgcacggcggccgcgcgccgcccaccctggtgctggtccacggcatcctgggctcgcggcgcaacctgctctccctggccaagcgcctgctggcggggaacccggcctggcaggtcctgctggtggacctgcgctgccacggcgagtccgcgccgctgtcgcgcgcgctgcaggccccgcacacgctggcctcggcggcgggggacgtgctgcgcctgctgagcgcgctgcgcctcttccccgaggtcctggtgggccactcctacggcgccaaggtggtcatggccatgagtcagcagtttgcggccaggacggggcacggcgggcgcctgccccggccggtgcaggtctgggcgctggacgcgctgccggggcgcctggcggaccacgaggacggggtggacgcgggccacccggacctggcgcgccgctcgcgcgtggaccaccccgcggacctcatcgcagcgctgcgcgcgatgccgctgccgctgcgctcgcgcgcggaggccgtggccgcgctgcgcggcgccggcttctccgcgcccgtggccgcctgggcgggatcggcgctgcgcccgctctcctcctccgaccccggcgggcccctggtctgggcgcacgacctggagggcatcgccagcatggcctggaactcaacttcgtgcgcgccgagcgctccgccttccactggagcgcgggggatgtggcgcgcatccgcgccgctgggcacgccgtgcacgacctccccgactcgggccactgggtacatgtggacaaccccgaggggctgctggccatcctgcagcccgcgctgcgacgggctacgccacctgcgctgctcgtcggctccgggagtgaaccggctggggcgccggcacagcagccgcctcaacagccgccccaccagccgcccctggccaacatcgtggccaggccggcgccggggcccgccgccagccccctcgcagaccaggcgctgtccttcccctga

SEQ ID NO: 1037 - DNA, 525 bp, Chlorella protothecoides
atggtgcctgaaaagcagcctccagctccccattgttgggcacctttctccctcgcccctccccaggcacggcgctctgtggcactgcacgccgctgcaccgcgcgacgacaggctctcttcggtggcagtcaggcagcagcttcgaaaactgatccagtccctggatggggtgcttccctacttgaccctagccatcagcgccgtggggctcctttcctcggcaggtgtccctgcggtatccccatcgaggtatgcacaggcctcccacagcctgctgagtcagcagcttcctggcgaggttgtgtactccctggaccaggtcgcctggtatcgccagtcttcgttgcggccccaggccggcgtgccgccacagatgagcgaggtcttcccgctgtgcacgctgagcctggtgcggggccaggcccccttctccttccagctcagcatccaacagggcctggacgatggcaggttccacgatgaggaggaaagcgcagagagcattgccctccaggtgatatga

SEQ ID NO: 1038 - DNA, 1146 bp, Chlorella protothecoides
  modified_base (261)..(270): a, c, t, g, unknown or other
atgcaagcaccttgcccatgtcaaaaggtgggtgtcaccgagagagccaacagctttgccgcgctgaggagcctggcgcggcagacaacaggtgctcaagttggtagtgtgggagggcagagtgctggtgcccgctgtctgctaaatctgttcccgattactttcgcgtggcggcgaagcaacgctgggcaaggctatcctatctggccatcgctcccgccactgcaaggcccatcctgtacgccttacccttgctcatcnnnnnnnnnncggcagacaacaggtgctcaagttggtagtatggaagggcagagtgctggtgcccgctgtccgctaatctgttcccgattactttcgcgtggcggcgaaccaatgctgggcaaggctatcctatctgggcatcgctcctgccactgcaaggcccattctgtacgccttacccctgctcattatgcttgtatcgcagagctttggtcggagcggagggaggagcagggacacccccttggcaatgcgctcctcgactgcaaggccagtacggtcgtcgacctgggtcaaccccccgcacacagcccgcccacgggcccagcccccttcctgctggagattgggtgcgaggagttgccccccgccgacctgcagcatgcgctgactcagctcaggtgcagcttcaaggaagggggggataggggtggacggtgtggggattctcgagtcgtgtggctcatatggcagcatgtgccaaacatagtccacatatactccgcctcccaaacccacaggcaaggcatcccacagctgctgaaggcctgccgcctgagccacggtgctgtcactgtcgcgggcactcccaggcgcctggtggtgaacatcgcggacctggctccccagcagagtgcagcttctgagcggatccgagggcccccagcaaaggtcgcctttgcaccggatggaagccccacccccgccctgcttggattctgtcgaaagaacaggatagaaggtgagatagtgcggaattatgctgtgaaggacaccgtgctggaggctgatgccaatggggctgactatgtgtggtgtgcgctcgagcattcccaagctgctgcatggcaggtgctgttgacggatttttgttcggatggctag

SEQ ID NO: 1039 - DNA, 900 bp, Chlorella protothecoides
  modified_base (504)..(513): a, c, t, g, unknown or other
atgggtgtgctctggtgtcctgccggggggactttctccccactcactggtggtaccacagccgaccgcgacaatgcgagcccttcatcccccgaggcgcaggtgggggcagggaccatgaatccctccaccttcctcagagtactgggtccggagccctggagcgtggcttacgtggagccctccatccgcccagacgactctagatatggcctgaatccaaaccgagtgcagcggcacacgcagttccaggtcaggggcccagggatgctggagtggcaaatggacacggcgcattgcctgatgggactgaggggtgatcctgaagccagaccctggcaatgctcaggacctgtacctggccagcctccgagcgctgggagtcgacacacagcagcacgacgtgaggccggcggttcgacggcatgggagttggagatctttgatcttggcgcagagtcatgtgcatggctgaagtggtcgtcctctggccttgtttccatnnnnnnnnnngccggcggttcgacggcatgggagttggaggttcgcttcgtggaagacaactgggagtcgccggttttgggagcttggggcctcggctgggagacagggagatgcttccagagagccactccctccctccaatgcgcaggtctggctcaatgggatggaggtcacccagtttacatactttcaacaggccggagggaaggtcctggaggtgccgtctgtggagatcacttatggcctggaacgcatcatcatggccatccaggtacagtgtgggaccctttgaggaggggagcattgcagaccgaaccaagagttcccagcagtcgggtctgtaggcatgctgctatggacctgctggaattttgcatgaccattgctcttctttga

SEQ ID NO: 1040 - DNA, 1440 bp, Chlorella protothecoides
atgctggcccctggtgggcagtgctacaactactctggctgcggcaacacgctcaactgcaaccacccagtggtctccgccttcatcctggactgcctgcgcacctgggtgctagacttccacgtggacgggttccgcttcgacctgggctccatcctcacccgcgccccctccatgtggactcggcccaagggatgtggtggtggtggcaagcacgaggatgcggccaggggtgaggccgccggggcccggatgtccggcgccacgtcacctccacccccccagggcccccggcacatggacgccggggcgggttcggccactggcacgcccctgtctgaccccggcctgatcgaggccatctcgaccgacccggtgctggctcgcaccaagctgatcgcagaggcctgggactgcggcgggctggtccaggtgggcgccttcccccaccacgccgggcgctggagcgagtggaacgggcgcttccgcgacgcggcccgcgccttcctcaagggctcccccggcgcgcacgcgggcgcctttgcggccgcgctctgcgcctcacccgacgtattcctgcacgccgcgcccgagggcgactggtgggggcgaggactcggcgcggcctggcgcggcggccgcggccccgcggcctcggtcaacctggtcaccgcgcacgacggcttctccctggcggacctggtggcctacaacgagaagcacaacgaggccaacggcgagggcgggcgcgacggcgagacccacaacctgagctggaactgcggggaggaggggccgacgcgcgacccgggtgtggccggcctgcgcgcgcgccaggcgcgcaaccacgccgccgcgctgctgctggcgcagggcgtgcccatgctggttcagggcgacgagtacgggcacagcaagggcgggaacaacaacacctactgccacgactcgccgctcaactggctggactggcgcgccgcgtcggccgacgagggcgggctggcgcgcttcgtgcgcgcgctgctggcgctgcgtgccgcccaccccgcgctgcgcgagaaggggtggcggggggggggggacctggtctggcacggccccgtcgcgggggaggagccggggtggggcgaggacggccgcttcgtggccttttcgctgccggaatctgatggcggggggctctacgtggccttcaacgcggggcacggcgcggtgaccgcggcgctgccggcgcgggcggggcgggtgtgggaggtggcgctggactcggggcgggccccgcccttcgacgtgctgaccgcagacagcgcgctgagcgcggaccaggtgcacgcggtgcgcgcagcgggggagccgtggcggcgcgcgggggtgctgcccatgcttccctactcctgcgcggtttgcgtctcggtgccagacccgctgacgtcggcgtag

SEQ ID NO: 1041 - DNA, 228 bp, Chlorella protothecoides
atggaggacctggtgatctacgagatgcacgtccgtggcttcaccgcacacaccagcagcggggtcggggcgccgggtacgtactcgggggtgattgagaagctagactacctgcaggatctggggatcagtgcggtggagctgctgcccatccacgagttcaacgagctggagtactatgtgaggaggggctgggagggttggagtggagttggggaggcgatttga

SEQ ID NO: 1042 - DNA, 759 bp, Chlorella protothecoides
  modified_base (75)..(84): a, c, t, g, unknown or other
  modified_base (537)..(546): a, c, t, g, unknown or other
atggtctgtgcccaagggatggcagcgccagcagtgtgtgacgaaggcacaggctacccgcaagactatgacccnnnnnnnnnnactggctggcaatggtctgtgcccaagggacggcagcgacagcagtgtgtgacggaggcacaggctacccgtaagactatgaccaaccgccaatcacccgacatgcacaccgaggctggattcccgctgccccttggtgcaagctggaatgaggcaacgggtgctgtcaactttgcggtgtactcctcctctgctacctcgatgttcctgtgcctgtccacccctgcggatcacgcactgggtaggttgacacgggagatcgcattcgaccccattgtcaaccggactggagacacctggcaccttgccgtcgtaggcactggctggcatggaggaggtgatgagctcggcagtagcaagtggtgcatgctctttactacgcaagcactgttattcactggcacccagcattctcgagagccagcactgaattgcgctgggctgacccgcaannnnnnnnnnctcggcagtagcaagtggtgcatgctctttgatgcgcaaccaccgctattcactgtcacccagcattctcgagagccagcattgaattgcgctgggctgacccgcgcagcccatgccggccccatccggccatctgtgcaggtttcaaggtggagccctgcggcagcttctccgagctggatggtggcacagcaggcgccaaacccagggtga

SEQ ID NO: 1043 - DNA, 363 bp, Chlorella protothecoides
atggccagtgtcattgcgaggcgtcaagaggatgtagtctgggctggatcccaaagacttgcagcgttgcatgatgccgaggagctgcgtccatggccctcctgcccaaccctccctcttatgccacagttggcatctgcttccgagcatggcgctgtcctcctggatgccggcatcctggtggatgtagcggagcgaagggccagcatctgggaggcttgccagagtgcggcagcgagcattaacggttcgatccctgaggccacgacacatgacctgctggaggaggttgccgatctggtggagagccccactgtcatcctgggatcttttgaccccgagttcctggggctgccgcagtga

SEQ ID NO: 1044 - DNA, 1275 bp, Chlorella protothecoides
  modified_base (413)..(422): a, c, t, g, unknown or other
  modified_base (605)..(614): a, c, t, g, unknown or other
  modified_base (1128)..(1137): a, c, t, g, unknown or other
ggcgcggccttcgcggcctccgccgccgccgccgcctggccagcgctgggctggcgcgtggccttcgaggacccggccatgctcctgggcgtggtgctggcggggcgcaccgccgaggagcgcgcgcgcctgcgtgccgcctccgacatgctggccctccagggcctgcttccggacagcgcgcgcctgctgctgggcgacgggtcgctgcgggacgttcccgcgcacgctgtcgcgcgcggcgacgccgtggtcgttctcccgggcgacgtcgtgcccgtggacggcgtggtggcggagggccgctccgcctgcgacgagtcgtcgctcacgggcgaggccatgcccgtgcccaaggccaagggtgtgttgggagggtgtttgggggggacgaggggatgcgcattcatgtnnnnnnnnnnaagggtgtgttgggagggtgtttggggggggcgaggggatgcgcatccacgcgggcggcaggccgctggcaggaatgcaggcggggcctgcgggcggcctccacgatgggtctgggcgcggcggggctcctccgcgtcaaccccccatcccgagtcgcaccccaaccaaccccctcccctccnnnnnnnnnncgcggcggggctcctccgcgtcaaccccccgtcccgagggcggctggtggtggtggccgaggcggctggggaggcaaccacgctgggcgcgctggggtcgctgatcgaggccgcgcagtcgcgcgccgcgcccgtccagggcctggccgacgccgtggcggggcgcttctgctacggcgtcatggccgcctcggccgccacgctggccttctgggcgggccccggcgcggccctgttcccgcgcgtcgtgaccgcccacgcgccggccggcgccgcgcggcccgccctcctcctcgccctccgcctcgcctgcagcgtgctggtcgtggcctgcccctgcgcgctgggcctggccgcgcccaccgccgtgctggtggggagctccgccgccgcacgccacggcctgctcatccgcggcggcgacatcctggaggtgaggggggggggccggcttgcttgtttctgttgcagtgtgtgaggggggaagggaagctgtgtggtgacgaggagggannnnnnnnnnaggtaggatgcgggttggatggcgaggtccctcgtggcctctgcatgagccggccggtggtgtcctcgccctcgccccctccgactcttgcgccacacaccgcagccccgacgtgggccgctccgatcggcccgggat

SEQ ID NO: 1045 - DNA, 657 bp, Chlorella protothecoides
atgaccacagcacatcgtcccacatgggcacccgcgaagggtggagaggagcaaggtggaatgcgcatcttcgcccccagcaagcagcagtcggtcaaggacctgccgtcgcagactaggctgaagttcaggcaagatggacagagcaaggcggaggagctttcccagaaagacttgcgggcggagttggaagagaaggagcgggctcactacttgaagaacaaaattcacacctttgagggcggaatggttggcctgcaagccgttgatgcagagtttgggtgcccgtgctgtccaaggggatgcggtgcatgtgcgtgtgtagccctccttgctcactcatcctcgcctcccccccattgtggccctgcagaggagcgagaagatgacctgagattactgcagagcgcttcccatgctcgagaggaaccgccgcgaaccctgatacccaaagcggccgatgccgacgacgaggacgactcggatgctgcgggatccagcgacgacgatgatgatgacgaggtgcaggtgctgggtctgttaactttgggaaatagtcctagagactcttgctgcacagctgtttgccagcctgtgtatgcgcctcacgtgccagccgctagtttttctttgcacctagaggatacatgctcctga

SEQ ID NO: 1046 - DNA, 702 bp, Chlorella protothecoides
atgagggggacatgtttccaccaaagagcactgccagtgatgtatctgatgttggggaagctggaaccggctcgaagtgtctcacacagcactgagtgccctggaccctcctcgcgcagcttccggtttgagcgcctggacggcaccatgtcagtcgatgcgcgggcagccgccatcgccaagttctctgccgatcctgaaactgagatcatgcttatctcactgaaagctgcctccctgggagtcaacctgacctgcgccaaccacgtcatcgtgagttgggggcgtggctttatgagcccaacctgcatcctcaaaggctttctccttgccttattccatcattctatcacaagtttcacccttgctgacgttactgaaccctccccctcccgctccctgtttccaccccagctgcttgacccctggtggaatccgactgtgagtagggtgcagcaggcgccgaagcatgcatctgcatgctgtgcagcctggagttctacaattatgcgaggaagtcaaatggacaaatccaaaccgcaaagttgtgaggtcacaccccgcatgtcccacccacaccaacaggtggaggagcaggccatcgacagggctcaccggattggtcagacccggacgctgcacgtcattcgctacctggtgaaaggcacgccggtggcggtgggtgtggaagggtgggactga

SEQ ID NO: 1047 - DNA, 2874 bp, Chlorella protothecoides
  modified_base (1006)..(1015): a, c, t, g, unknown or other
  modified_base (1425)..(1434): a, c, t, g, unknown or other
  modified_base (1878)..(1887): a, c, t, g, unknown or other
  modified_base (1960)..(1969): a, c, t, g, unknown or other
  modified_base (2435)..(2444): a, c, t, g, unknown or other
  modified_base (2549)..(2558): a, c, t, g, unknown or other
  modified_base (2635)..(2644): a, c, t, g, unknown or other
atgacgcacgagagccccacccgctgcgtcgtggcggcgcgccaggctggaaagcgcggccgcgacggcgaggagcaggtggtgaggcggcccggcggggacctgtttgccatccgctggcaccggctggtgctggacgaggggcagtgcatcaagaacgccaagacgctgacggcgcacgcggcctgtgccctgagggcgcgctgtcgctggtgcctctccggcacccccatccagaactccatcaacgacctcttctcctacttcaagttcctggtgggggcgatagggggtgatgtcttgatgagggggagggagggatgggaagcggccgctgggatgcaccctttgagtgacagtgcggtgtgcaggaagggtgcgtgcctcgcttgggcaacaaactgtcgtgcacgtccggtatcacccctacgaccagttgaagaccttccaggcattcatcaaggagacggtgcagcccgagaacggcgccagggctccgcggcacctccacgccatcctccaggtgtgcagtccctcggcgtatgcaccgcgagtgctcctacccatgtatggagggcagggtcatcgtctacatgctatatgtcaagcgccctggaacttattcatccctcatgcaagaatccatgttcctatctcgcagcctgtcctgctgcggcggaccaagcgcaccatcatcgacggcaggccgctgctgtcgctgcccgaaaagcgcatcgagctgacgacgctgaccttctccaaacaggaggaggagttttatcagcagctcgaggcggaagccaagaccgagtttcagagggctcaaagcgaggcggatccgacgcgcttcaatgtgctgagcatgctgcagcagctgctgcgcctgcgccaggcctgcgaccacccccagctcgtgcgcaacgcgcgctccgacttcgccacatacacgccggaggagctcgagcgagcgcctacgtcccaccctcgcctccatccctctcagagnnnnnnnnnnggtgggactcgagtgcatggggctgctggactgagccggtccgcgcccctttccaccccccctgcccagctcgagcgagcatctacgtcccacttcgccgccctccctctcagaaagcggctgccgtgcgactgaccagcgagaagaggcttgccctcgtcgagctgctgtcacatgggcctcacggtacgagcagtgggcctgctgcctgctggggaggcagtgtgcacgatgggggggagagcggagggccgccagcctctctagccaggcgccacacatgtgtgctcttgcggtcgagagcctttgccggcaaggccagccttcacaaaggatgtgagccgcacagagaagccgcaatcgtgcgtcgagtggcgcagagtgtggattcctgcctcaggcatggacgnnnnnnnnnncacaaaggatgtgagccgcacagagaagccccaattgtgcgtcgagtggcgaacagtgtgaattcgtgcctcaggcatggaccctcccggattccaacccggtgcgcacattcaacagcgccgccactctcacccgctccctcccgaaatccatcgccagagtgcaccatctgccacgacctggccgagtgcccggtggcatcggggtgcggccacgtcttctgcagccagtgcatcgccagcaaggtgacggaggccggccatggccacgcaggctttgtttacgactgccccacggacgtgctgcaaggtcagcagccggccctctgctttgcctggaagtcatttatgacccagttccctacccctccccgcagagagagagctagcgtatcactgcccccagtgcggcagcgtgctgggcgagcgcgacgcacactcccnnnnnnnnnnagacctcgagaaggctgcagctgtgcacctgatcgtacctctgcgacattgccaggcttttttgacgactggnnnnnnnnnncaggcgcgggcggaggtggagggcactgcgcccgaggcggcactgcccgccaccgaggcccagatcgcatctgccgcctggagagccgctgtggcccagccgcacagcgccaagatccgggcggtgatgcgctacctacaccgagtgctgcgcgctggcagccctgcaggtgggaggcagtggtgtcacgggatggttgggaaggggatcgcaaggcaggccgcatcctgggcttgggacctgcagcaggccacgaggctcccgtcaagcacgagccaaagcctgagccgggggtggagccaaagtctgagccaggggtgctgccaaagctggagccaaagcctgagccgggggcagaagcaccacgagagctaaagccggagcctggcaccgaaccgcagccgaggccgggccgagcatgcagcggctgccctgcttcagtcctgagactggagcccaagttcannnnnnnnnnaccacgagagctaaagccggagcctggcactgaaccgcagccgagaccgggccgagcatgcagcggcagccctgctccagtcctgagactggagcccaagttcgnnnnnnnnnnccatgctcaacctgctggaggggcctctgaaaatttcagcgtatgtttgttgtgtagtggggggaaaggggtcgagnnnnnnnnnnaggagcaggacgtgtgggatctcttcccgccctccgcgccaaaagccgaaaaggaggccgccgagcgggacaaggtcatcatcttcagccagtggacgtccatgctcaacctgctggaggggcctctgaccatttcagcgtatgtttcttgtgtgctggggggaaaggggtcgacggcatcgcaccctaagcatgcagatgggtggatctgccgtgtctgcctaggctga

SEQ ID NO: 1048 - DNA, 585 bp, Chlorella protothecoides
  modified_base (354)..(365): a, c, t, g, unknown or other
atggaacacaaattgccatgcgctgtgccacttgacccctcgtcctggcaacactccgcccctgccatgtgcacaggccgcgagatcttccaagaggagggctttgtggcggcagacgacctggctgccgcagacgattccggctacctgcgggaggtcgacgaggaggcagagtttgcgcgggcttcagctgcggcgcgcgagagagccgccgcagctgctgccgccgcctcggctggggttgggcgcgccgaggaggcgggccagggcacaacagcggcggccggcgagaagcagggcgccatcgcgcccgctgcaccgcaggtgcagctgtccaaggcagaggaggcggannnnnnnnnnnngtcttggttgatcttacgatttacaatgtgttctaagccgacacagcgtcaaggcaccattacagcagtcgtcgaggcaccattacagcagtgtactgttaccgggcaggcagagcatggagccttggggaatcgaaataggcagggagccagtgcggtgtcgcggtgtgcccgaggtgcggccgacaagagtggccctctcatggccattgcggggtga

SEQ ID NO: 1049 - DNA, 378 bp, Chlorella protothecoides
atgtcgccagcctgcggcactctcaccattccctctccacctctgctcgcctaccaggatgacgaggcagagctgctggcggagctggcgcgcatcaaggctgaacgcgctgaggaggctgcgaggaaggcagcggctgaagccgccgccgcggagtctgtcaaccaggccgaactgctgcgtggcaaccccctgctcaaagagaaactgcaggcggcggccggcggcgacgccagcttcgccatcaagaggcagtgggacgacgacgtggtgttcaggaaccagacccgcggcgagcccagggcccagaaacgcttcatcaacgacaccatcaggaacgacttccacaagcgcttcctcgagaagtatgtgcgatag

SEQ ID NO: 1050 - DNA, 480 bp, Chlorella protothecoides
atgggcagtctccagcggactggagtctctccagccccccatgaggctttcgaaggagtcaatgctggcatttctcacgcccgcgccccccccccctccctcccctctctaggagtggaccccaagaccgtgctgtgtgagttccaccgccacggcaagtgcaccaagggcttcaagtgcaagttctctcacgacctgaacatcgagcgcaagacggctaaggcagatgtctactccgacaaccgcgacggcgccgatggggagtctggggggatgggcgagtgggacatggagcagctagaaaaggcaattgctgagaagcatgggctggagaacaagaatcgccccaccgccatcgtctgccgctacttcctggacgctgtggagaagaagcagtacggctggtgcgtcgaaatggcgtcccctttcacagacgggagggcggctgggctaccgagcgcctctgtatgggggaactga

SEQ ID NO: 1051 - DNA, 369 bp, Chlorella protothecoides
atgaagtctcagatgaaggagctgctggaggccgaggcagctaatcaaccgtcggtggaggagatcatcgaggaggagcgtgctaaggtggacgccaagacgcccatcaacaatgaggtatgcagagggaccctggtggatgcccatgagcctaccttgcactcacatgcaagccggcatgcgaaagggtctcatccatcacctcaggatatgacggcaaagcatgtcacgcagaagatgctcacctccgcccctgcgcacatcccaacagacgtttctgcagtggcgtgctgggaagcatgctgtcaagatgcaggcacaggcggagaaggaggaggagcgacgaagaaaggggctcctcaccggtga

SEQ ID NO: 1052 - DNA, 744 bp, Chlorella protothecoides
  modified_base (577)..(586): a, c, t, g, unknown or other
atgcgaggacagcggcggcggcggtccagacggcgaggccaccccacctccctgcatcaatccatgccactgaaaactcaacatgcacaggagttggaacggagcgacagcatctcagtctgtgcctgctgccccatctgcaagcgctcgctgcaagacaactccgccacctggcggtacctggactccatcgcggcctcacaccctctcccagaggagtatgtgggatggcaggccgagatcttctgcaacgactgcctgtgtcgtgaccagattaacacccctcttggtcccacagatcaacatgcacagtgcagtataaccttgtggggctcaagtgcggagggtgtggctcgtacaacacgcggcggttggcgctcgtgccggctgtcatcaggagatccggcgggcagaaccagcaaggtgagggatgtttgcttgaggtccacaggcatgcttgcagtggctgctcaacctcgggctgctcagaggactcccaggggagtatgttgcaatcaaacggtgaggtggtgtcattattacatgggaccagagcgaccatatggcattgcaattnnnnnnnnnntgcctgcagaggactcccaggggagtatgtcgcaatcaaacggcacagagatcgtgaggaggagtagggaccaggccatgcatctggaggagcgatggagttccgaagaggatcggcagctggaggcatatagaggcagtcctgaaggctcagattga

SEQ ID NO: 1053 - DNA, 231 bp, Chlorella protothecoides
atgacggaaaaggactacgcgcggcagcgagaccttttcgaggccatcttctcgcagcacgcagccgccccggacgtgaccagcgggccgctggaggagggcgcgccgcgctggggtgcctacctcctccagtccgggctggaggtggtgcagcacgaccgccgcttctccggcaccaaggccgtgttcaacgccgtcctgcgcctggccaacgacaacttccggcagtga

SEQ ID NO: 1054 - DNA, 819 bp, Chlorella protothecoides
cccccaccatgccaccccccgccccacccaccccccgaaattcgcggcagggcggagctgttttccctggtgaaccagcaccccacggtctacgaggtggtcaccggccgcgttccgcgcaccaagatcaacaagcgcaagcagccggtgtacggcaaggcgtacgccggggccatgcccgccccggcctcgcggggaaccggggcggggcccaccgggcgcctggcctcgcgaccccgggccgagcagcaggcccccgcggccgaccggcccctgcccaccgggcggaagctgacctacgatgacgtgtcccaggcgctggtgggccgccaggcggaggtgcgctgcgacggggcgccggggggcgggccgcacggtccccggggtggggacgggcgtcacggacggtgctgcggcgccgcgggtcgtggggaatccccggcagcaccacgcccggcactccccccctgcatctcggggaggacccccccctcgtcccctctgcccctccgcctgcctgtgctggagctcccccccccctttccccctgcgcagttgtactggcccgacgacggcaagtggtacctggtggagatccactccgtcgacccggacaccatggaggcgaagtgcgtgctgaacaggctgggcgctgggtgggacgcccgggcggggtgccgtgctcctccctcaacccctcctcccaacctccccatgccccacgtgcattgcagggtccagtacgcgacgggggagtttgaggcgctggactttgacgaggtcatacccagcggccacatgtcgctgctggcaggctag

SEQ ID NO: 1055 - DNA, 438 bp, Chlorella protothecoides
atgagcaaggtaggggttgaatttggttcacaagctctggctcaggagagggcaaaggtgccagtcgttccccttccctgctggcacgacgccctgccaaccactgttgccccttcctgccatggaccagtggagatcgccaagcccgacacctacctcgaccttcgtggggccaagattgacatggtcaacaacagcatgaggctagccgtggccccaggcgggagcatggaggccgtgacagggcacactttcaacccccggaccgacttcaacctgtccctcatcgagttcgagctggtcctggtgccacgggaagaggctggccccagccccgctacagtcgggggcatcgatccagctagagggccttccctgacaggcggagccgagggcacggaggagcccagccaggcgatcccagaagaggaaggttga

SEQ ID NO: 1056 - DNA, 501 bp, Chlorella protothecoides
gtttagatattgacactcgtgcctactttactgcagctacaatgattattgctgtacctactggtattaaaattttcagttgggttgcaacaatgtggggtggtagtattgaattacgtacacctatgttattcgctattggtttcttattcttattcactgttgggggagtaacgggagttgttttagcaaactctggcttagatgtggcgtttcatgacacttattacgtggtagcacatttccattacgtgttgtcgatgggtgcagtatttgctctattttcaggattagctggaatgcctcgtcgtattcctgattatcctgatgcttatgctggatggaacgcagtagcgagttacggaagctatttatcaattgctgctgttttattcttcttttatgttgtatataaaacacttacaagtgatgaagtatgcccacgtaacccttgggaaactacacctggtgtatctccaacattagaatggatgttacctt

SEQ ID NO: 1057 - DNA, 828 bp, Chlorella protothecoides
  modified_base (584)..(593): a, c, t, g, unknown or other
atgggcgtgcagcccagcgaggacgcgctagggcgtcttctggacaaaaaccggaagctttatgggcaggttgaggcgcagaggggcatcatcgaccgactggaaagccgcatatgcaagctgcaagaagacgaggaggtgcagcaggagacgttgctccacgtcaacagggcgtgggacgagttgaatgcctccatcgacttcttgagatacagggctggtgccgcacccgagccgtcagcagacaaccatgcagctgctcagctgccctcgaccgacaccttgctgctggcatgctccccctttcttgctcgcttggcgtccacctgcttgaaatccgacgccctggactcggcggagctggaggagggagagccggaggagctggaggttgccctgtgcgccaggtctgccgccacctccgcggcggccgcagggctcctggacgccatcgaagccctcagggctggtggggtgcctgggaagagggcagagccagacgctgcggcagaacctgcctctgtctcggagcagagtgcggccacgcagcccatcgaccccgccgtcgagccacaggcgctgcnnnnnnnnnncgcggcagaacctgcctctatctcggagcagattgcggccacgcggcccttcgaccccgccgtcgagccacaggcgctgcttacccttgtcaaggccgagaaccggcggctgcggagcgtggccctggccagcgctgcccgcgtgaagaagctgcagaccagcctggcagggtgctggagccggccggctaagcccagtgcagtgggagagcctgcttacgagtacctttgttga

SEQ ID NO: 1058 - DNA, 1314 bp, Chlorella protothecoides
atgaatctcactggacgtccttcttcaagaggagcgccccacacgacgcaacctcattgtgtccctcttcctctcggtcaccccattgcacaggcaccgctgactattcttgggtccctaccaaggactgcgccctcttcggcacttcacacccccactacacacgctacgccagcacgcggcacaaggggctgcaaaaggccgtggatgaagcctgggcagcactgggccagccacggcccgatgtggcgggcaaaccccggggaggctgagctcgcatacgggcgagacctctatattacatgcgtgcatcctttcaaggatcccatcccaatgccccggaaccggtcagggcgcagagggcgatgggcatctacatccctttcacggcgcagtaccgggggtgcagcgaatcacctgtcggggcggtgtacctaccccgtttcgaccccggcctgccccatgcagttcgattgggtgtggatatggggcggaccccttgccgtcgccaatctgtcagctccctggggggcgcggcggtcgtgcacggaccgtcgaccaggcgcgcgattcccaggaccgtctcctgcccatgcagggcccagcagtccgagccggtgcgatggggaggctggtgatggctccatctgcgatgggcccctgcacaggggcaagctcgcgccatgcaaaggtcatgcctcagcacgcatgcccccatgcccacagatgatggagcgccgtgcggccctgggcctgctcgcgggaaccgctgccctgctggccggtaccggcgcgtcccaggccgcctacggcgatgccgcgcgcgtgttcgcaggcaagatcaccaacaagtcgggatttgtgccctatgcgggcgagggcttcgccctgctcctgcctgccaagtggaaccccagcccggagcgggacttccctggaactgtgctgaggctcctgtgcatcacttgcgcgggtacattcggagtctgcggtgcttgcatgtcacttccatccattgtcgagcgatgcatgcgttgcatgccaagcgtattgctgtcactgtctcggactctacatggtcttgtgtgcacttgcaaagttcagatttcctcgcctccgatgcacaggtatgaggacaactacttcccggttaacaacctgatggtcatccagcgccccgtcggcaagaacagcatcgaggacctgggcgcgcctgacaagttcctcagcgacaacgccttcctctttggagagtctgcggcctggaagggtgaggcggcggaggcagcaagggttggcggcttgatggcctga

SEQ ID NO: 1059 - DNA, 264 bp, Chlorella protothecoides
atgtacatcaactcccctgggggtgtggttaccgcagggctggccatctacgacaccatgcagtacattcgctgccccgtcgccacgctggcggtgggccaggcagcctccatggcgtccctcctcctggcctctggggagccggggcaccgacggagcctcccacacagcagggtcatgctgcaccagcccagcggcggcgcgcaggtgcggactgtgggaaaagggagttggcaaggggggggggttggaggaggtttctga

SEQ ID NO: 1060 - DNA, 1164 bp, Chlorella protothecoides
atggatcttgtggcatcctacggtagctcgccgtcaggctccgcagtatcagagggcagtgctcatgttgaggacgatggagagctgacttcccaggagagcaaagagccctcccccaaacgcctcaaggtggaagaagcaaggcgagctgccagaccccagcgccctgctgcagcccgatcaggggtgaggaagccctgcaaatgctgtttaaagctcctaccggcctgcaaatgccatcggaataggaagggcattgactccacattcacccccatctcccccaacccacctctcacagccgccaccgcaccggcgcccgcacctcctacccagcgcatccgcgccttcccccacgtggagggccagttcgcagtgcatgtcaccctttcggcccccgccccgccggatgtcacccgcgcgctgcgcgctgcgctcccccgcctgcgcgccgcgctgcccaccctgtgtgggctggacctgggcacggggcacgtgtccctttcgcacaccgccccagcagtcggcagccagctggagtccctgcttcgcatgctgactgccgccgcgtggcggctggccccatttgccctcgacctgcgccgcctggcctgcctggccaacgaggacgccagcctcgcctttctggcgattgagggccagggtgcaggcggcgcctttgcacgcgcggtgcgcgctgtggacgcggtcttccgccggcacgggctgccgacgttctacgtggaaccccggccccacgtctctgtggcctgggtccctggggatgcgttagagcggctggaagcagtgctgaagcagcagtctgtcccgctcccggcctggcacattgagatgcctagtggtcccatttctcgtctgctccacctgcccattgcccacaccctttcaggcaacagagctggcgcctcttcgacagccgcccacccggtgcagccgccatgccctgtgctctctggcggtcccagggtggcacagcccccggtttcaggtgactggcggccgcagtctcaaggcgccgccggcgtgtgcatcctgggctggatcacctcgtccaccaccccaaagtccagggcctccttggccgacatgaagaagtcacgctccaggcactcctctgcaggtgggggaaggaaagcgagttag

SEQ ID NO: 1061 - DNA, 756 bp, Chlorella protothecoides
  modified_base (269)..(278): a, c, t, g, unknown or other
  modified_base (707)..(716): a, c, t, g, unknown or other
atggcgcgaggaggactactagccgccttgtatctcacaagtgtgatttatgccatagaagtgtgtgcatggactcgtgggagagcggtaagcgagtggggtgaccggcctgttcatgtcgacggtgcgatccctgtccacgaaatgctcccgaatgcacacatgcgcaacccttctgcagacattctacggagcggacggttacagtattcatggccgagcatcaccgatggacaggggagtgtttactcgttattaaattattcaannnnnnnnnnccggccagggccgagcatcaccgatggacatgggagcttcaaaatcaccggctcctgcggctttggattccaatggccgggcatcgggacggggttcgatgtggccgccatgacggatgctgctcccgacttcaccgattcatgcgggcgctgctatgaggtgcaatgcgatcccactccccgactcctggacggcttcggagatttactggacaggagtcatgtgtgtctggatgaggcggccagcgtcatcgtgcgggtgacggacagctgtccctgtcgctaccctgacaatgcctactccaaccagaagtgggtcatggaggtggtcaccaggcacagtgaagaagctggcggtcatgagctcctctcatctgtccctggtgctgcaatcgacccattcgcactccaacctgaatactcaccgcnnnnnnnnnngggttgcagggtcatggaggtggtcaccagaacacagtga

SEQ ID NO: 1062 - DNA, 1437 bp, Chlorella protothecoides
  modified_base (111)..(120): a, c, t, g, unknown or other
  modified_base (612)..(621): a, c, t, g, unknown or other
atgaaacgagcaaggcgccttgctgtgtctgtgttgccctgcatccccttcgctcagcattacccaggtccctcgccagctggcttcctgctgtgcctcgcctcaccccgnnnnnnnnnnccttcgaccctgcataatcatgcttgcaataacgtgagctgcatggaacaagcaaggcgccttgctgtctgtgttgccctgcatccccttcgctcagcactactcaggtccctcgccagccggcttcctgctgcgcctcgcctcacccctcgtgcccttcccaattatttgtccatcacaggtgctgtcaccgtgtccggcaatgtggatgctgcccccccctcggacaagatcacctacgagtctaccttcaagggaggactggcgcccaacagcgtccccaatggctccaccacggcctctgcgggcagtgacagctcctcgtccagcaccagctccgagggctgcactgacaatgctcccgataccggctcgtgccagcaacagctggactggggcaaggtgagcgggggttggggtaggcactcgtgcagggagatgcattacctgttgggttgtgctgttgtttgtggtgttgtgacccttgccagnnnnnnnnnnaggcactcgtgcagggagatgcattacctgatgggttgtgccgttgtttgtggtgttgtgaccctcgccatcatcagacactgctgtgagccatgcaatgacgagtggctcaccagcggcaacttctgccagaccacctgcggccggtgcagcagcagctccagcccgtcttcaccctcagagtcatcgtcttccccatcagacgcttcgtcttcctccccatcctcctccccatcgggatcgtctgctgactgccaggacactgcagtgccgtacaccatcagctacggctcctgccaagatcagaagaactggggcaaggtgagacgacatgcctgggcccttctctcgatgattttgggagctggtgggagcctacttctaagattctgcctgagagaaggacagactgccaatatgtgtgtgcgatggactgttttgccatcagctttccagtattggcgtccatcagatagtacaatctcaccctgcccatcccattacaaaccctttctcccacagtgcggggagcagtggatgatcgacggctcctactgtgcctccacctgcggacgctgtggatccagcgacagcggcagctcatcccagtccccctcgagctccggcgattcctcctcatcttcgccctgcgaagatgcccctgtgccagaggaggcagagtgctggcagcagaagcagtggggcaagtgctccgagatcactgcaaacggctactgcaaggccacctgcggcgcatgcagcgcgcccaccgtctcggcctacgactcgtcctttggccagggacggcggctgtga

SEQ ID NO: 1063 - DNA, 1269 bp, Chlorella protothecoides
  modified_base (109)..(118): a, c, t, g, unknown or other
  modified_base (455)..(464): a, c, t, g, unknown or other
  modified_base (1171)..(1180): a, c, t, g, unknown or other
  modified_base (1243)..(1252): a, c, t, g, unknown or other
atgacgacctggtcaacgcttgcccaaaccaccgagacatattcacgacccggttctcctctgttctggctgcagcccggcgtgaccttgacgacttcaagctccgctnnnnnnnnnngtcatgacgacctgcccggcgtgaccttgacgactccaagctccgccggcggcttactcacctgtccgtcccaaccctcccccccttgctcggcagacaacagaatggccagccacacgatgcttcctctgcttctaatgtgcttgagcttcagcggagcgctcgcctggcagaaaggccgtgcggtgagtccatgtttgcagttgcgtgatcgggcagcgggtgtcacatgcttgagcagtacagggcatccacattgggatggtggcgcgcgtctcccctgggcgtggccccatgcccataccgcctgtcagccggttcgaagccgcgtacacannnnnnnnnnagtggtagggcatccacattgggatggtggtgcgcgtctcccccgggcgtggccccatgcccataccgcctgtctgccggttcgaagccgcgcacacccccgcagcccggttgcctggggcgcgcaccaacccttcctcgccatcactccgcagactgggtcgtgcggcttcggctatcagtggccagatgtgggcaccgggttcgatgtcgcagccatcgccgatgccgctcccgagttcggtgggtcgtgcggacgctgctatgaggtgaaatgcgacccccagtccgccgtccctgacgggtacggtcaaacccacgagcgctcctctgtctgctacgactcatccaagaccattgtcgttcgtactgtcgacaactgcccatgtgactaccccaataatgcttactccaacaagaggtggtgctgctatgacaacgggatgacgcactttgacctgtccatctggcccgctttggtttctgcttctcccagcccgaggcactccactcataaatggtgttcacccgaccacagggcctacgagcgcctgagcgatgtgaagtggggcgtcatgggcatccagtaccaggaggtgccttgcaccaaggcggccgacaaccccgcgccgcccatcgccaaccccaccccacccgaggagccccagtcatggatggtgaagccttctgaggataccatctacgtannnnnnnnnnccaccccacccgaggagccccagtcctggatggtgaagccttctgaggacaccatctacgtgnnnnnnnnnnccttcgaccctgcataa

SEQ ID NO: 1064 - DNA, 2124 bp, Chlorella protothecoides
  modified_base (191)..(200): a, c, t, g, unknown or other
  modified_base (875)..(884): a, c, t, g, unknown or other
  modified_base (1234)..(1243): a, c, t, g, unknown or other
atgctctcggtgcatgctccagcagctatgcagctgagcggtgcgccggtgaagggcaaggcctctggagcgccaggcaacaggctagccgctccccgcagtcgaaggcagcgtgttgacccctgcgtgccacgcgccatgtcctctgttacccatgaagcctccgagagccccgatgctccacctgcagnnnnnnnnnncttactcggggaaccccactcacttagtgcccctgcctggactcattcaccatggcctcagagccccgatgctccacctgcagagcgtcgttattcgacggagaccaccaaacagcgcttccgcccggaattgcgggcctctgggcttcaagctggtgggcatccagacttgcctgtacactctgctcgtgcccaggccccctgcaaacccccttgttccctcaccctccacatgtcccctccaaacccccttcttccctcaccctcctcgtgtgctgctctctcaatggccaggtataaagctgtggagatcgagcagtggcgggccagcacacccctgtccaagctggcagagcaagcaaagcgcgcgaagcctgcccgcgacttcatcggcgctctcagggcccagtccgaggcacgggggggctgtcctgggctcatcgcggaggtgaagaaggcttcgccttctcgtggtctactctgccccgactttgaccctgtcaaggtgagcgctgtgcattgccgctgcacaacagccagaggccaggcaggatattctcgtacagtccaccttgagtccctgaaagggaaaggcttctcccatgctgtgatgcgctggccacgccctgcacaagacccgcccacacacgccctggctccctcgcagatcgcgcnnnnnnnnnnaagcgctgtgcattgccgcttcacaacagccagaggtcaggcaggatattctcctacactacaccttgagtccctgaaagggaaaggcttctcccatgctcttaggtgctggccacaccctgcacaagacccgcccccacacgccctggctccctcgcagatcgcgcaaggatacgaggcgggcggtgccgcttgtctctcggtgctgacggatgccaagttcttccagggcgggtttgagaacctggccgccatccggagggctggcgtgacctgcccgctcctgtgcaaggagttcatcgtggaggtaacctgcctcttgtctctggggatgcctagagtgtgtgctnnnnnnnnnntgccatccggagggctggcgtcacctgcccgctcctgtgcaaggactgcgtgccctggcctgatcctgctcaaacttatgccggcgaccgcctgcacctttttgtgccaagctctcctctgtcagtcagcaaccatgcagctctttgagtccccaccatggcccccgatcgccgtcacaccgatgccatgtcctgcaggcgtaccagatcttcaaggctcgggcctatggggcggacgcagtcctgctcatcgccgccgtcctttccaatcccgacctggagtacctgaccaaggccacccgatccttggggatgcagtgcctgatcgagcaaaccctgctgacagccccacgccttctccccaggtgcatgatgtgccagagatgcagcgcatgctggacctggacctgaccggctgcatgctgggcatcaacaaccgcgacctgcgcaccttcaaggtctccctgcagaacagtgcggacatcatggccagcgtcccaggccaggaggtgggcggcgggtgcgtgcggcgctgcctcgcaaagggggaggggcgtaggcgcgatgggtatctgcgagcattgttcgtgcccggatgcaccctctccttcgaccctcatccccatggcagcagatgcctgtcgcgccactgcccccccctcctcctcccccctcaaacacacacaatcttcccaggtccagcgccggggcctcctggtggccggcgagtccggcatcttcacgcacgaggacgtgcaggaggcgcggcgagccggctgcggcgccgtgctcgtgggcgagtcgctcgtgcggcagggcgacgtcgcccaggcggtgcgcaccctgctgggggagtgaggcaccagggcaggatagcgtga

SEQ ID NO: 1065 - DNA, 1548 bp, Chlorella protothecoides
  modified_base (173)..(182): a, c, t, g, unknown or other
  modified_base (774)..(783): a, c, t, g, unknown or other
  modified_base (1197)..(1206): a, c, t, g, unknown or other
atggacttgaggagcgcgcatggggctcactggggtgattggagatatcgaacgagcatattactcgatatcatgcgacatgccggagagagggaaaggtatgggtccgtggactccggtgcagacggcgctttgccacagtacagcaaaggcgaagcagcaggcaagatcgnnnnnnnnnnctcgatatcatgcgacatgccggagagaggaaaagggattggtccgtggactctggtgcagacggcgctttgccacagtacagcagaggcgaagcagcaggcaagatctatttggagaaggcacagccactgccaagggtgcatggtacagtttcaagaattatttccagctccacagggcttcaagatcatttgggaggggaagaagctacggagctaccaagctgacggagatcctcaccgtagctgtcgcatcgcaggcccgcaatcctttcgcatgcgccaggaagtttgtctggaattgctgcaaataaccgtgagcaccgtcgggcatacgcgacggtccctatacagtgcacctgacgaaagtctggggtgtgctcctggtgccccctctttcagcccaagcgtggataggcagcaaaggtgtgttctcagcataccgtcgaggattgagggtagagggcggcgccctgtctccttgccccgccgtgtgcgggcaccgagaggcgtgcttggactggaaggggctgaacaattgcgccttcacggcctcgacgtatcgagaactcctgggcgatgctcccctacnnnnnnnnnncgcccggccgggcctcgtccagcgtctgtgagcagggactcctgggcgatgctcccccacccccccaccgcactgcagggcggcaccatggtgcaggcagtcatcaagaagtcccacgggcccaagaaggccaagaaggccttgaccttcaccatcgactgcaccaagccggtggaggacaagatcatggagattgcgtcctttgagaagttcctgcaagacaggatcaaggtcgatggcaagacgggtctgctgggcgacaacgtcaaggtgtcccgcaccaagtcctccgtcaccgtcaccagcgagatcgccatgagcaagcggtacctcaagtacctgacaaagaaggtgcgcgtgggggtgtcgtggagagggccaggtggaccgctctttctccagactgaagagatnnnnnnnnnnatcgccatgagcaagcggtacctcaagtacttgacaaagaaggtgcgcgcggggatgtcgtggggagggccaggcggaccactctttctccagactgaagagagacttctcattgttgcacgtgcaaggcccctgcctggtcaaggccaggtcccatccctgggaacccctggtgcgcccattgagccgcctgccctgccacccccctctccacagtacctgaagaagcacaacgtgcgcgactggctccgggtgattgcctccaacaaggaccgcagcgtgtacgagctccgctacttcaacattgcggaccagaacgaggatgacgaggacgacgagtga

SEQ ID NO: 1066 - DNA, 219 bp, Chlorella protothecoides
atgcgcgagcgcggccccgcctgcttcgactttgacttttacaagctgcgcaacccggacctgcccatcccgccctggaccgccgcccacatgtgggaccactttgtggactttgggcagcacgagggacgcgtgttcaggtgggctcgcaggacagaggtggagcggagggagggagggaagtgcggcgtgggaggggggttggggggaggggggtag

SEQ ID NO: 1067 - DNA, 414 bp, Chlorella protothecoides
atgcggcgcctgctgcctgccctggcgcatggagggtgtgcaggcagcggcgacgcgcacggtctggtcccaccttccctcaggtactcctccacccctcacccccaaaccatccccccttctcgacacacccacagctccaacgtcgtggagcggtgcctcaaactggggggcggggagacgtcgtccctgctggaggagcgcgacgcggtggtggaggagctgatgacctcgcccagcttcgggcgcctgctgcaggacccctatgccaactacgtgatgcagagcgcgctcagcgtgacctccggcgcgcggcatgccgcgctggtggaggccatccgccctttcctcccagccctacgcggcacgccgcatggcaagcgcatcctggccaagatcgccatcaaggtctga

SEQ ID NO: 1068 - DNA, 411 bp, Chlorella protothecoides
atgccgtggcgctggatgggagcgagcagcggaggggccctcctccccgcgcgcacccccgctctcccccggcccttcgagcaggggtttcctggcacagccgccgccaccgctcgcgccctcacccttgcgctgcgcaggctgaacccgtacgcagagtacatgtacgacggcatcaacctctcgccctttgaggtcatgtttgtgaagatgaaggagtatctgctggaggccaactggaccaccgccaccgagatcaaaaagtacacggagtgggcgcgcgaccgggtgagtggtgggtcggaggggggtagggggggtgatgtgggggaacaccgcccgccccctctcaggccatccccaggaaagggtctgggcccgcggtggctgggcgtcgctgcggcgcactga

SEQ ID NO: 1069 - DNA, 312 bp, Chlorella protothecoides
atgaccaacgaggacctgggcttcgtctacgccgccgccgccgaccactgcctggacatcgccacgcatcgccacggctgctgcgtgctgcagcgctgcatcgaccgcgccgacgccgcgcagaagcgtcacctggcgcaccgcatcgccgcacatgccctgatcctcagccaggacccctttggcaattacgtggtgcagtacgtgctggagcagggcaacggcgagatgctggcgcccatcctggcacagctcaagggccattatgccgagctggcagtgcagaagttcaggtgcggcgagggtgattag

SEQ ID NO: 1070 - DNA, 1701 bp, Chlorella protothecoides
atgccggcaggaccgcttggtcacgtgacacgcagtcagtctcaccgcacatcgcgcacgcagcgcccgactcatgcgcgcttcccgatgcagacagggcctgcagtacgcctcttaatgggacgcccagagcaggtccctcgcgagtatgcgtgcacgcactgcgcattcccgttgccgcacagcgtaccccaccggcgccatgaccctgaagtattcctggtcgagggcctccaggttgcctgcggccgcgacggcggcggcatcctgcgtgatccacccgcgccaagtctgagcaagctcgggaggggcggtggcgagggcagcttccagagcctcggcagaggatgggtccaggtcgtcctctggccgccctcctctcgagcctgcatggggttgggggggcctgggcttgtgggataccatcagcgacggcatggcacaggggcggcgagcccttccccgacatgggacggtcatgaatggaacccggggcatgtctcaacactcccacgcatagcctcgcaccctgccgtctgccgggtgccccgccggccgtcacctcgcccagcaggttggagaaggcctcgcggagggtggcgcccctcaggacgtggccctgctggccaccctcgatcgcaccatcacccaatatctgccccatcatctgctggacggcgggcgactccgccatctgcatcagcgccgggttgttcatcatgccggacaggagcgaccccagcccgccgcctcccccagcgccgtcggcggaagggggccccgaccccagcatggactgcagcatgttgcccagcgccggcggcacaccggccaccgcgccagggcccctcgccggggcgccagctcgcggggcgccagcttgcggggcgccagcctgggaggcctgggcctgagggcacggcgcccctgcccgggaagcctgggcctgagaggcctgggcctgggggcacggcgcccctggtccggctgcctgccccactcccgcgtcagaccctgctgcctgcggcggccccgcctcgcggcccgccgccggggcctggggcaccccgctgcccgggcctggggctcgtttggcggcgcagcgggggcaggctccccgcttgggccgccgccctctctgcccttgccggcctggcggcgcaagggcagcggcctgaggcccttgaaaggcggccggggcttgggggccgcctgcacgccaggcgcaggggctgcgtccacgggcgcaggcccggccggggcgaagggtgccgcacctgccggcgttgcttccgccgcccccttttctgttgtggcaggggcggggccactggaggggccggcctcggagtcgttgctgcgctttggcggtcggggcgatgcccccgcctggctgctccctgcggcgccggtgggcggcgggacagcgcccgacgtgctgaggggagccgcgggtgccgtcgctgcggtcgcggggccccgaacagctgcgtcggaggggttgggagcagcagccgaaggttgacgacccgtctctgccggcggtggcacggccgggaccgaggtcccagggccggcggatggtccggcggcgacaggcgggccttcagcaggtgcttgctgcgcatgctgcgccggcgcggcgtacacgttgggcacgccgggacctgcgcagcgaggcgtgccagagcggggtcttga

SEQ ID NO: 1071 - DNA, 1494 bp, Chlorella protothecoides
atgcagggcgatgagggggcaagggtgcgtagatctggctcggggcagacacggtgcaagggtgtgtggaagattcggtgggcataccctggcgcaggggcacaggtcgatgcctgggcacaagaaacttcgggaagggacgcgccctgtcgaggggcacaggtcgatgcccgggcacaagaaacttctggaagggacgcgccccgtcgaggtgtggcgggcacccagggcacggcgtccgaggcgctgacacccatcctagtggcagccggtgcaggcgtggcgcgggccatgggcctgggcctggggctgggctgcggccttcgccccctgctgcttcccctccgcgccctccacctcggcgcgcaggatggcggccgcctgcaccatgttgcgcaggctgggcaggacctcggcccagcgccgcgtcttgaggccgcagtcggggttgacccagatgcggcgcgcgtcgccacccaggatgcccgtgccggagaaggagcgcagcttgtccaccaggaactcgacgctggggacgacgggggagtgcacgtcgtagaccccgggtccgatgtcgcgagcataccccgcgctggccagggccagcaccatctcgttgtccgaccgcgagttctcgatggtcagcacgtcggcgtccatggcgtcgatggcgggcaggatgtcctcgaacgaggagtagcacaggtgggtcaccaccttggattgattggaggtgggtgggggtggggaggaagcgcaaaggcgacggggagcctccctgtgcgtacatcagcaggtgccaccactctgcagcccactcttcctcccagtcaccccccaacacctacattcctcacagcttcagaccatggacgcacaccacccacccactccctcccggcgcaccccaccccacgaccccaaacacgatcaccccacctgcgtctcgggcttggcgccggcgacggagagcttgaaggcgtccaccgcccagtccaggtaccgcgcccagcgccgctccttgagcggcaagccctcgcgcagcgcgggctcatccacctgcacgatgcggcagcccgcgccctccaggtcctccatctcctggcgcagggccagcgcgatctggaaggcctgcacgctgcgtgccacgtccttgcgcgggaaggaccagttgagcatggtcaccgggccggtgagcatgcccttgacggggcgcgccgtcaccgcctgcgccaggcggtactcgtgcaccgtcatgggcccggcgcgggtaacgtccccggacacgatgggcgggcgcacgtagcgggagccgtagctctgcacccagccgtgctcggtgaaggagtagccgtccagcttcaggccaaagtactccaccctgggagggcaaaggggagggacgggtggctggggcggagcgagctttcggtgtggggatggaatggggcgatgcagcaggaacatgaacagactgcttggcctcgggtctga

SEQ ID NO: 1072 - DNA, 312 bp, Chlorella protothecoides
atggtagccgcctttgccttcaaggaaggccgctgtttcttcagcaatcgcttcgtgcgcaccaaagcctataccgaggaacagcgggcggggcgcatgctgtaccgaggcgcattctcggctggcaaccccggcggaaagggtttcttcaaccccttcaagcttgatgtgaagggcatcgccaacactggggtggttcgctggggtgggcgtactctcgccctctacgaggtaggtgccctggatgtgcttgaggcatgctcgtgcgcactgatacgtgcacccaagatcccaggtccggctagaacctag

SEQ ID NO: 1073 - DNA, 180 bp, Chlorella protothecoides
atggctcggcgtcaggcgcctgtcccccggcgtgcgcggctgcagtacaagcgcggcaccatctccacggagcagtacaaggagcagatcggcgtggagattgggtatgccatcggcctgcaggatgccctggacattgacgtgcccgtgcacggcgagcccgagcgctccgacatgtga

SEQ ID NO: 1074 - DNA, 1548 bp, Chlorella protothecoides
atgagctgggcttccatagccaagaaagcggcgcctgcaatccccagcaccgacataggcccggacgagtcggtggatgtggcggtgctggatgccaatgccatcatctcggggcaggggctgctcctcctggccaagctggccaaccgtgcagtgaccactcccgaggtgcttgcggaggtgcgtgacaaaaagtcacgtgccaccctggaggctctgccctacaccctggaggcaacagagcccgctgaggaggacgtcaaagcgggtatgcaatgttgggcggggagagggggaatgtgcatggggcgtggaggaggcggcgattggttcgtggccggccagcgccccagtcctttgacctcggtatccccacccaaaaacattcctcggccggtgctcgccggcacatgtgtgttcctgcatcaagcccacaacctccccgcccctccatccacagtgctgcgctttgcccgggccacgggcgacgcgcatgccctgtccagcgccgacgtgcggctgattgccctgacccgcatgctggagatcgcgcgccacggccccaggcgcgtgcgggacctcccccccccactcaagatcgtctctcggcgcgtgaaggagacgcgcacgctgcccggctggggcgagggcggcgacaactgggcggagatggagcgcctgaacgccgccgaggaggccgccgaacaggaggcgctggccgccgcggcggggacgggcagccatgtggccgcccagatgcaggcgctggcgctggaggaaagggagaccgcggacggcgacactgaggccgctcgagcggcgcgggccctggccgaggcggccgtggcggcgggctccagcagtggcggcgacgactcctctgacgacgacggcgacagggaggacgccgaggggggcgacggggaggaggagggcgaggggtgcgaggcggaggcccggagccagagcggggacgatgcgggcccctcccccgccgccgcctcctcggtctgcatcctgaccgccgactttgcgatgcagaacgtgatcctgcagatgggcctgcggctggtcacccccgacaaccgccgcgtgacgcggctgtcgcgctgggtcctgcgctgcggcgcctgcttccaggtgtccaaggaggtgggccgcgtgttctgtgcgcgctgcgggaacgccgccatggagcgcgtccaggtcagcgtctcgcccgagggcgtggagcagtacggcgtgcgcaagcggcacgtcctgcgcggcacgcgcttcgcgctgcccaagccgcgtggcgggcgggccaaggacgtgatcctggccgaggacgtgctgatgcagcgcacggggaaggcgcggcgccgcgcggcgcgcaaggcggagggcgaggtggatccctttgcggccgagtacaccaccgacacctggcaccaggctgcgggtctgggggccatggcggacaagggcgcggccgcgctgctggcgggctggaagcacaaccccaatgagcgaaagcacgtggccaccaaccgccggcgcaagtag

SEQ ID NO: 1075 - DNA, 1536 bp, Chlorella protothecoides
atggtttccacgcagatctcgtccgccaccatcggcttcccccgcatcgggcccaatcgcgagatgaaaaaggctctcgagtccttctggtcgggcaagtccaccgccgacgacctgcgcaccgtcgctgagcagaccgagcgggtggcctggctgtcccagaaggatgctggcctggacctggtggccctggactccacttactacgaccagatcctggacttcatcacctacctgggcctcatccccaagcgcttccagcacctggagccgggcttcgctcagtactttgccatggcgcgtggtgtgcacggtgcccacgcgctggacatgcagaagttcttcgacaccaactaccactacatggtgccggagctggaggccagcccagcggtcaaggcagactggtccggcctgctggccaaggtggagcgtgggcaggcggtgctggggtctgatgtggcggtgcccatcctgatcgggcccatcaccctggtgtccctggcgcgctaccccgagggcaccgacgcctcggccctggtcggggcgctgctgcccgcctacgtggaggtcttggggcggctcaaggcgctgggtgtgccggaggtccaggtctgtggtatgggtggaccccccgggcgggggcggggcgtcgacgttatgcacgagcctgtgctggccctggggacagccattaagctgcaggccgatttcgaatccagctacagccagctggcgggcgtgggggtgccactcaacctggtggtctactacgacgatgtggaggaggacgtctactcctggctggtgcgcctgcctgtgcaggccatctccctcgacttctgcgccgtgcccggggccgcccacggctgtgccaccgctgccaccatcgccaggctgggcttccctgaggacaagcggctgggcgccggcatcgtggacggccgcagcatctggagggacgatggcactgcagtggatctcctggccgcgctccgcgcaaggcttggacccaaccaggccatcgtggtgcagagctccgcgccgctgctgcacctgccctacgacgtgagggccgagaagaaccttccgggggagctgactgcccgtctggcctttgccctgcagaagctggaggtgtccaggcggcggggatgcggggaggatgcaagcgatatggtgggggtgggctggatatggagtgcaccgacaacccccgggcccctggcgtccctcttgttgcaacgccacccttgcgcacagcctcacaacccagtcgcccgcctgtcgcgccccatcccctcatcccgaccccgggaaatcgtggccgtggccaagtctgggagcggcaccgcgccgcccgcgctggagacctttggcgccgctttcccctccgacgagggccgctccggcatcgacgccagcaagtaccaccgcagcgaggactacgccacgcgccgcccaaagcagccccagttccgccccttccccaccacctccatcggctccttcccccagaccgagcagatcaggtga

SEQ ID NO: 1076 - DNA, 381 bp, Chlorella protothecoides
atgctgattctgatcctgatgctgtgcgctggcaggcaattcccactcatcccagcttctgatattgataacagggccaaggtggagggacctgacaccgtctatgggcgtgaagagaaccgtgggtccctcacgcgcctctccatcaatctggcctcgggcaaggtggaccagcgtgtgctcatcgataggtctgtcgagttcccgtccgtggcttccacggtcgtggccaagcctcaccgccacatatacatggtcggggataggttcaactcgccagacacttggggccccgtccagcatctcagagggcatcgagagcctgagccccaaggtctcccaggatgtgtactacccgggcaagtcctgctgggtgcatga

SEQ ID NO: 1077 - DNA, 708 bp, Chlorella protothecoides
atggctcccaaggtgattgacgagggtcgggtgacttgtggccgggaccggcctggtccactgctaggccccgcctgggccaatcgcagcgctggcgacgcggtccccgatgtccagctcgttcatctcgtgaacgagaagcctgagaaggtgtccctgcgcgacctcttcaagggcaagaagggcatcctcgtgggcgtgcccggtgagcgagtggacgggagcggagtcggtccgcaggtgacctcgttgtcctgcccaacgccttcttctcgatcgttgcctcgtcgccaccctcatcaccccctcatcccacccggccgtccaatccacccctgcacaggcgcattcacccccggctgctccaagacgcacctgcccggctacatcaacgactacgagaagctgaaggcggccggcaatgagatcaccgtcctgctcaccgtgaacgacccctttgtcgccgatgcctgggccacctcggccggcgcgcagggcaaggtggacgtctacgccgaccctgcgggcgaggcggtgaaggctctgggcgtggagttcgacgccacgccattcctaggcaacgtccgcagcgcgcgcttctcggccgtcgttcaggacggcaccttcaagaccttcaacctggaggacggcggcggcctgacctgctccctctccaaccagatcctggcgcagctcaaggatgcatga

SEQ ID NO: 1078 - DNA, 324 bp, Chlorella protothecoides
atgccctacgagctggagtctccagacctcaagaccctgggaactacagatgccgacggggcgctcaaggatacagacccctactttggggcgcactatcgcatcaccaccgacgctggtgggatggacggtgcattcgggttctaccacgactttgcgatgaccgagaaatactacgttttcctacagaacccaatccgactgaacttgtacaagttcgtcacccagtacatgctgggaaaggccggcgtggcaggtgggcaggctgagcttgaccctgggggtgcttggaagaccttccagcttcttgtggaattggtttaa

SEQ ID NO: 1079 - DNA, 651 bp, Chlorella protothecoides
atgttgagcaagaggcccaccgcgagaccggacgcaaccctgttcccggccgcggcatgccaactggccgagatccgcgggatcctcaaagtgttccctatccctgaggacgacggcccgcgccctgacctgcctgacaagcaggcatggaccggtgcggccctgtcccagatcgacgaccttcacaccctgggcttcacccagtcccagtgtctggaggcggtgacagccacgggcacccttgaccgggacgctctgatcgagtggctgctcctgcatctggcgccaaaggacatcccccgtgtttttgccctccagtcagcctccgagtccggggacgtggcggtgctgcgcaaggcagaccctgccgcccgggaatcggcttgtgcgctgggtgccatggcccgggaggcgcctgagccctgtgggccagcattgcaggagctgaaggcagagacggcggcacatgagccggcttccgaccagaaggcctggatcctgcagcacctggaggctgcagggagcagcagcggggacagcgacgattcccgatcccgggtaggtcatggtctgcgagtgagtagctcctgggtttccttgcttgtaggtcccggcgaagggcagtgcatgggtcaacaggacatgtcgtga

SEQ ID NO: 1080 - DNA, 1827 bp, Chlorella protothecoides
  modified_base (1286)..(1295): a, c, t, g, unknown or other
atggctcccactgtgacaacagctgccgctgagtacgagcagcttcaggacggcgtgctgcttgcagcagaggagcgagcacctgctcccgcagacccccgccacctcttctgcatgtcgctccctcaatgcactaatggtggcagtgttgctgcgttcttgatagagccttctcccatgcttctctcaccctttaatcagccagggacgctccatgagccaacctggcatgcagattcgatagtatcaatcacgcatcctcgttgcctgcaggtccatggcttgtttgggagccgggcaaactggaaggtgatcgcagaggagctgcgtgatgcgatgcgagaggaagagggcatcctattctacatctctgaggtcaatgaattcaaaaagcccctgccatcccctggacaagttcctccgctcgcttactgttctgaaccccaatcctcttgttcacttggcacagacctacgagggcatcgatgggtgtggggagcggctggtggaggagatccatgggctcatggcccagtaccccctgctggaggagatctccatcctgggccactccatgggcggcctgatcgcgcgctacgccatgggccgactgtacgacgccgagacggggcgcatcgccggcaggctgctccccgtccacttcatcggcatggcctgcccgcacctgggctgcgacaccgcccccggccccgcccaggagggcaaagtcccgcccctattccatctccttccccaccccacccttccccaaacccatcgacgtggcaggtgcctatgctgaagtggatggaggcctggccggtggtgggcccggtggtggcgggcgcggtgtcgtccgtggcggccagcttcacgcgcgccagcttcaagcgatccggcgagcagttcttcctgggagaccgggaggccggggcgccgccgctgatctggcgcctggcccgcgacgagggccccggcgccgccttcctccccgcgctggccgccttccagacgcgcacggcctacgccaacaccgacggcgaccacctggtgggctgggccaacgcctcgctgcgccgcctggaggagctgccggagctggatggtgtttcgggaaaggaggaatacccaggcgtcctgcgcgccgacccactggagactgcgtgggggcccaggtatggccggggccagacactgccgagtgggaccgagggtgccctgggtgacgacgactacgatctgcctggaacgggccctggacgaggcgacgaggaccctcccacgcnnnnnnnnnngagtgggaccgagggtgccctgggtgacgatgactacgatctgcctggaacgggctctggacgaggcgacgaggaccctcccatgttgaagagtgcaccgacgagcttcaccggagcgccgcccgccagcccatcgccactctgcggagccatcgagctacacccctccccccaaaccgcctcgctgccgggcccccttcggcaccaggtgcggtaccggtcggcggcgctgggcagcgcctacgacgccgcgctgcatgccgaccgcactgagctggtggaggacacgctgcgcgcgctgcgcacgctgagctggcggcgcgtggacgcggggtttgcgcacagcgcgctgccgctgctggcgcatcagcacatccaggttcagcggctgtgggtcaacggcgcgggtgtgccggtggcgcgccacctggcgcacagcctgcgcgggatggaggaggcgcggagggagggcaggcgcggcgcgcgtgggcgaggcggcgccgcggcggggcgctgcctcggcgcgcggtga

SEQ ID NO: 1081 - DNA, 1197 bp, Chlorella protothecoides
  modified_base (554)..(563): a, c, t, g, unknown or other
atgagcacatacgggcaccagactgcctgtgctatccgtgtgaatatggcccaggaagaggagcttccccactcggcgggaattcatgaggatggatgcgctgagacagctgtgaagcgcctggctggagttttagttcctccccctaggaagacccgaccacgtgagagaagctcccctccatgggcagggccgaggctgcaaccccaggtaccgacccggatcgctcgttattggaatatgggccctgtctccccagaaagaaccaaatcatctatagccaagccaggtgcaaaggtatcccttaataccttcgtcgcctcggctggggcgatgaccatggcccttacctcgggcccatactggcgcctagctgtggccctgtcattggcattcgccgcgtgtacggttcccggcgcgcgcgctcagggtgcgtctccaagggctgcatgcccctggcctcccctctgctacattttgctggccggcagtgctagtcttgcgtgcgcagactcgcgtaggggctctctacagggcgtttcatcccccccccnnnnnnnnnnagcagtgctagtcttgcatgcgcagactcgcgtaggggctctctatagggcgtttcatcccaccccccctccttccgccaactgcaggcaactccagcgctgtgtcccttgtggccaccggacctgtaaggatctgttggagggtcttaaaggggaggaaactcagtccaaagtgcctaatgttgaatcaatggcccgagattgcatgcatgcggagtccaagctgccgttcctcggcatgcggggaatcacgctcccgggctttagtgctcactacctccccgctctgcccacatggcaggtgctgatcaatgagatcctggcaagcaacactgccggcctgaaggactcctctggcacggcctctgattggctggagctgcgtaacaccgggtcttccaccgaggatctcggggggtatgtcttgagcgacggcgagaacagctggaccatcccgagcggggtttccattccggcggggggctaccagctcatatttgcgagtggaaagggctcaaagtctggtgagactggaatgtggaggcatagacattgcaagctgaggtgttgttccccgcatcgggtcaaagtgcacagttgtgcagcagggcaggcatggtccacctctgggtag

SEQ ID NO: 1082 - DNA, 1653 bp, Chlorella protothecoides
  modified_base (499)..(508): a, c, t, g, unknown or other
  modified_base (795)..(804): a, c, t, g, unknown or other
atgcccgtggggggtgatgaggagagtctcaggccactaaaagccgtatgcattgctatcactccgatcaactgtcttcccagtcacccctcattgcacctgtgtgttctcaccacctctgcaccagcacaaggttttcaagctccaacctccatcttggatcctttccaatcggcagatgctcagccctccagctaccgcctgaacctgggctctgtgagtggcgacgccggcgggtacgtggagctggtcaaccctaacgactttgccatggacctttccgacgccaagctcagcggggcggcggagttcacttttgctaaaggtgaggaaatggtatcgcttgggagcttgaagccagggaccaggagcaagcatcgttacccatctctgtggccacccaggttcccaccaccccgtctatcccctcacggtcgttctccaccctgcaaacccacaggcaccactgtcgcggcaggggactcggtgcatgtggcannnnnnnnnncacctatctctgtggccgcccaggttcccaccaccccggctatcccctcacggtcgttctccacccttcaaacccacaggcaccaccgtcgcggcaggggactcggtgcatgtggcagccgacgtcggagcttttgtcaaggccaagggcggcgcgggcctgtatgtggtgggccccttctcggggtccatccagggaccggccgcaagcgtgagcgtgcagagcgcgggaggggactccctggtaggctgagacatccctggacctccgtcccggttcctgtaccnnnnnnnnnngcagagctggttatctctgacagccgcaacccatgcccctcactgtttttgcaacagccatacaccattcagacatcctactccctggacctccgtcccgagttcgatccgggaagcgcatattggacggtcctgtgtagactgagtgcaggacgcgacaacccgggcgatcggagctgcttgggaaaagttagctcacaccacgaccgccctccggacagccccgaccccgccgtggtcacgagcccatcgacacgctgggggcctcgttgcaggcgggaggctcctttaaacatcattatgggatgcagggagctaccatggctcgcggtcctttgcacactggcaatgctccggcctagcacatgccagtccccaggcgcgtcaactgcatgggcccgggcggggaggggcggacgggaacgcgacaaccccacgggtcgctgggcattacgtccaattttccttggaatccagctggtcgtgggtgatgctccctccccggcacccagcaccgcgtcgagccaggtcgtgctgaccaacaagaatagcttcacagacgccaatggggactcaccctcgtgggtcgagctgtacaacacggcaggcagtccagtgaacctccaggcaagaatacggggaagggatgtaaagggccatgagtatatacgctgtaacatgtgcagatccagcacatcacgccctgtgccccacgtgacacgcacaggggtaccagctgacggtcagcaaggcgagcggcaaggcgtcggcatggacctttcctgccggagtctccgtgcccgggaatgggtacctgctcatcctcgccgatggtctggacacaggtga

SEQ ID NO: 1083 - DNA, 453 bp, Chlorella protothecoides
atgcggcgtgtgggaccatgggctgccgcaagtgtcccgtgcctttgtgctgtcgctggcaatgcacgcctcagagcacgcacgcctgctgcaacctcagccctccctaccctctgtgcaggtgcacaggcggccggcgctgggctgaccatcggtcagggccacacggatgccgggagctggttggagctgacgaatcctggggcggaggctgtagatgtgtctggctgggctctgaccggggatgtggacttcaccttccgaccaggtgagcagctcgtgaaaaccaggagtgcgcatgggaccgtggtggatgctggggacaccatcgtggttgcagccgacatcctgcagttcaagtcatcctacggtgggcaaggcaagtatgtcgtcggcccacttccccagcctctgacaagcagcagcccatcagtcagcctcgtcaaggcctag

SEQ ID NO: 1084 - DNA, 2091 bp, Chlorella protothecoides
  modified_base (836)..(845): a, c, t, g, unknown or other
  modified_base (932)..(941): a, c, t, g, unknown or other
  modified_base (1160)..(1169): a, c, t, g, unknown or other
  modified_base (1250)..(1259): a, c, t, g, unknown or other
  modified_base (2020)..(2029): a, c, t, g, unknown or other
atggtcaagcggaagaggcagcgggtggacacgagccagagtcctgaggccggagaagcagggatcctgtcggtggtggtcagcaaggtcgaggcggaccctgcggccccagaggctccccaggaagctgtgctcgtcgaggaggatgtaccagacacatgcctgtgtcccctgtgccaggagatcctgtgccaccccctgatcaccgcatgtggacatcgatattgcagcttctgcttccacagactatttgccgtgccccgacccggggacgcgggcagagccagggagagccgttcacgcgactgcccaatgtgcaggtcgagacttgtcggctgtggggggctgaaggacctccttcatgagcctgcttggctgcctccatgctggcctaacactggcagggcagactcgactatcggtggcgctggggcgtttctcagatctcaccatccatccctttctcacaggcagcccatctccctccagtctggcacgcatgcccttgccgatgaggagcgtctacgcaaggactacccaatcgcttacgccgcacgggagctggccatctcccgggaggaagcagacctggccgagcggggggtgcagtacctcgtccttcgctttgggaaccgtcacaccctcataccaagggcacgcaagaacaagcacgagtgggaattctttgtgggcctggatggcggggaggagacgcgcttcatagaccacgtggaggtgcgactgcaccaggcctaccgccccagctcgctccgcctggagcagcctcccttcatgactcggtgggtgtccggggatcacgctgacctggcagtttnnnnnnnnnngcagggagggcctggtcttgccacggcagccacacagccatgccagatggtgaattccttaggccgctgtgccaccctgggccacgnnnnnnnnnngcagggagggcctggtcttgccacggcagcgccacagccatgccagatgctgcctcactggggctgtgctagaggcagtgtggggggtcccctggctctggtgcctaagtccgagaatcatgtggagtgcaggcggcgcgtgcctggcagcttgtggccaggcaggcatgatgccagagccaggaccgtcgtgggctctgttcgatgtgcatccccacnnnnnnnnnnccgccccagctcgctccgcctggagcagccgcccttcatgactcggtgggtgcctgggtatcacgctgacctggcagttcnnnnnnnnnncttgtggccaggcaggcatgatgccagagctaggaccaatgtgggctctgttcgatgtgcatccccatgtgcaccctgtatgcttgccaagctgtcgcattccggtctcgctttccacagccatcggaccagcacggggtctgaggtaagggccctggtcacgttcaggagcgagttccagcggccccccctctggctcgtatggtcgctggacctccaggggaacggcagcagccagaccttggagtttgagctgcagaaaggaggactgcccagcaaccacgacctggagacaggtgggagggtggtagagggagcaaaggacgtctgctgttggtcggatgcacatggacagtgtggcgtgcgagcagcacatggagtggcaaggcgtcgcccctgcaggcgcggccgtggtgccgagcgactggtgggagtcgagggggagcatgctgagcatgctggggacgcaggactggcaggccgcgctgctggggctgatgtggcagtctggtcggtggtcgggcccgggcgaggcgagcgaggtgaggtgtttggtggggaggggaatcggctggaaagtatgctgaatggctcaaagctgtcggaggggcccttgctgtgcacccgtggaggggagggtgctgggggagcagcgcacaagcccccgtcaggggaagttgcaggcaggcctggtcatcgcaagatcatggacgccacccctccacaggatgactcgtggacaccgggggagggggaggagnnnnnnnnnngctgggggagcagcgcacaagcccccgtcatgaggacttgcaggcaggcctggtcatcgtaa

SEQ ID NO: 1085 - DNA, 588 bp, Chlorella protothecoides
atgggagtggactacctggagtcgtaccagtcccatgtccgcttcaacggcgcctactttggccgcttcatctacgtggaggactggactcccgagtcgctgaagcgcaacggctacgacaccagtgacattggctccctattcaaatcagaaagtggggagtacagcaacctgcgctgggacctgcccaaggagacctgctgcaccctgcttgcgcctcgaccgcattgctgtcctgaacttcccctcggccccctctccccaaatgcacctgcagaccaggtgcccttctactggggccaggatgagcccaaggcggacgaatcggctctcctcctcgagctgacgcggggcctggccggggcgggttccaaggagagggagaactacctctttgatggcctgaacctcccaaaggtgaggcaggcgcagtgtggtagggggcaagggggacggagcttctctccaggcaggcgtgcatgccatcgagcactacctgctggggtcctcggtggtggtctggtgccaggttgctcaagccaccaggccccactgggtgtccagctgtgcatagagcctgctcgctga

SEQ ID NO: 1086 - DNA, 1143 bp, Chlorella protothecoides
atgtgcgagaggtgtcccgagcagacggccgacggaaagattgacgtcacggaccacactgcagaaagtgcagtgcaccccctgtgcgtggactccaccgtcaccatcttttgcatcccctggtcctgggagctcgtgcagatccctatggccacggaggtcacccccgccgcctccgagtggacgcgggagttcacggccgacgccgcggcgccctccgccacgcacgggccctccccctggggcgaggagttcgcctccttccaggcccgggcggcgggcacggggggcgactgggccgacgcctttgccgagggcgtggcgggggagtgggcgagcgagttcgccgggccccagaccgaggactggcaggcggagtacgacgccgagctggagcgcctgcacggcgcccaggcgccatcagctcatgggggttacgtaatggccgagaacaaccccttcctgagcgacaccgactccatggccaagggctgggacctgttcaagcgggtgcgcatttgggagggaggggagggagtgttggcatctccgaaggtaagggacagtggcccagcctggctcccgagggtgcgcggcaggagggcggtgctgacgcccctgcccaccgaggttcccccctttgccatccagtcctcccgcgcccaggggggcctgcctgcgcttcatgccacgttgacctgtcatttcctccaccctggcaggggggtgcctgcctgcgcttcatgccacgtcgacctgtcattccctccaccctggcagggtgtgctgacggaggcggtgctggcgctggaggccgagtgccagcgctcgcccaacaacgccgaggcctggcgcctgctgggcaacgtccaggccgagaacgacgacgatcagcaggccatcgccgccatgaacagggcgctggccatcgacccctccaacctggaaaccctgctcagcctgggcgtctcacacaccaacgagctggactccagcgaggccctgcagtacctgggacagtgggtgtcgcgccacccgacgcacgcccccgtcgtcgccggcatccagcggcccgcggatgccagccagagcctggtccatgtggtgagggattggttggttggtggtgaaatggggacttga

SEQ ID NO: 1087 - DNA, 927 bp, Chlorella protothecoides
atgggtgtcgagagcctgctctctttccacgtccacgtgcgcttcaatggcaagtacttcgggcgcttcagtctgcaggaggagtggagcaaggatgcgcttgaggtcttgagcacacctgtgtcccaccacggagggccccctcaggtcttcagagcggtgaacgtgtgtgctgcgccatttcacctttcccttcttccccaacactcccacgccctaccaacagcggacctgcccgtggtgtatgagttggagagctccaagtccaagcaggacgcggcggtgcaagcgctggaggccttcaccgccggcctggccggcggtggccccgtggcgcgcagcaagtacctgtttgacgcagtaaacctgccccaggtgatcaactacctggccgcccagaccctgatcctgaatcaagaccgctgcaccaagaacttctacgtctacctggacgcctccagcggccagtggtccatgctgccctgggacgtggagtcggggttcggcatcgaccgcggcctgggcgggcagcccgcccccgactactgcaccctggcctgcgagcagtggaactcgccgctctactgcgaccgcaaccacactcaggacttggtgatcagcaccccctacggccgtatcagccagcccgtgaccctgggcgcaacctctgggacgccggcctcgcgccgcaggcgcctgtccagcctgcagacggcgctgggcacgccgcgcctgggcaggaagctgctgcagagcctgttccaggacaccaccgtggacacgggggcggggcaggacctggactccgactacgacgcaaacctcaccagcggtagggttgtagggagcagggtttttgttcatctgttgcttacttctgcatggaagagagggtggggtatgtcgaggggagtttgcatggtttga

SEQ ID NO: 1088 - DNA, 237 bp, Chlorella protothecoides
atgcagctggtgcggcaccttcgccagctggccgagaccaatgcgctgactcagcgccgggccttcctgccccgggactccgccctggccaccgcggccatctactcctccctgtttgggaaggagggggagcccgagcagggcataccagccacctttcaggcaagggtgggtctttgtggtgctatggagatgggtgtaggtccgggagggcatgaggtggtgcccagtttctga

SEQ ID NO: 1089 - DNA, 588 bp, Chlorella protothecoides
atgcccaccctgtcccccaggctgcccacggaccacccctccctcttccgctggagtgccccctgcttcgtcaagctgagcaccaccgggttcggcctgggctttggtcgggtgcactccgcctccttcacggtgtgcatgaactccagggtgcgtgacacgctggaggagcaccgccggcgcaagttctcgggcctggacgcgctggtggtgtgcggcagccggatcatggaccaggccgacttcatctccgcccccgccacctcctacgccaccgtgggcgcgcacaccgtgaccggcgcctccttcgacctctccttcgcctccggccagctcatggtggatggcgaggccaacgccgccgcctacggccccgacgcgagtgcgacctccatcctggagggcaaggtggatgtccccgccgagatgcagccactatatggcgagctggcggagattgtgcacagcgtggaaagggtgtcggccgcgccctccctcaccaggagtagcctggaccgggccacgctggggcatgaccccaaccagggcgtggtcttggacgacggcacggtgatacgcgaggcctga

SEQ ID NO: 1090 - DNA, 483 bp, Chlorella protothecoides
atgactcgtgcccacctgggtcagggacgcctccccgctccggcaccagcgcccagaaccatgtcatccacagcgctgtacagacgaatgcaacctacactgatacacccctcccctcccctttccatcgcgccggtgaccgaggatccagccccccgcccaaacggcggctccgcaatccccatctcggccgtggtcactccccagcaggcgacagtggccggggccacactcacctacgtgatcggctacggctcccccgtcagcgtggacatggcagcgacgggcggcacctacaccgccgacatcccggcggctgaggcagctgccgggcagttggtgcgctggtacgtgacggccaccgacgcgggcggccgcaacaccgtggtgccggccaaggactccaacggcgcggtgcaatactttgggaccatcgtggcagacccgaccgactctgccagcctgcccatcctggagttgtga

SEQ ID NO: 1091 - DNA, 939 bp, Chlorella protothecoides
atggccaaggccaaggagatcctgtcccgctaccccgagaactaccaggcctcggccatgatcccgctcctggacctggcccagcagcagaactccggcttcctctccctggccgccatgaaccgcgtggcggaggtcctgggcgtggcccccattcgcgtgtacgaggtggccaccttctacaccatgttcaaccgctcgcccatggggcgctaccacgtcatggtctgcggcaccacgccctgcatgctccagggcgccaagggcatctacgaggctgttagccgccacctgggcgtggtgtacggccagaccacgccggacaagctcttcacgctgtcggagatggagtgcatgggcgcctgcgtcaacgcgcccatgatcgccgtggccgactactcgggcggcgtggagaagttcacctacacctactacgaggacctgaccccggaggacgttgtgggcatcctggaggacctcaaggcggggaagaagcccaaggtcgggagccagcaccgccacaatgcggagccctcgggtgccgtcgcggacggcaagtgggtggaggactcgcccggcgccaacatcacgctgagggggccccctcccggaccctactgcaggtcggcctgggatggtcgtattatcgtcatgggcggaggggtggagctgtgcgtgaatttgccagcctctgctcagcaaatcgcatactggccatgtgcatcgggtacattgcccggacgggcccagctcctgccctgcgtgtctatcgtggtctccatctccctccagaccgtcaccctctcctccctccctctacccaccacccaggaatctggacgagcccccagcagaggcggccccagcgccaccaaagtagagtctcggcgcgcagagggcaaggcggtgcatgcgctcgttacccccttggtgccctga

SEQ ID NO: 1092 - DNA, 516 bp, Chlorella protothecoides
atgtacaagcaagaggacccccccgggggccctaccacggctccctctccacttcttccatcccaggatgaggtggcagacaggctgctggaccggctcaaggactgcactcgggctttcgagtcggtgctggtgctgggaggggccggccgtcaggtcgcggagcgcctggagcgggaggcgcccggcacccgccacgtgacccatgtggacacgtcgcaggccatgctggacgcactggccaggctgcatgccgcgagcgcgcggtccacgccccatacatatgtgcactggaccgacacccggaatgagaccctgccggtggctcctgggacatacgatggtgagcgggtggggaggctgcggagggcacacctgtgttgggatgccagtccagaaaggaagggcatgcaatgtggggcaggtcgagccgtccagtcacgcccgcccttttcccctctgccacagctgtcgttgcctgcctgggactccactggatcaacgatgttcccgtga

SEQ ID NO: 1093 - DNA, 291 bp, Chlorella protothecoides
atgctgggcggcaccacgctgcaggagctgcgcattgcctgcaccctggcgcagcaggagcgggaggggggggtggcgccgcgcctatcccccctggcgcaggtccgcgacgccggcaacctgctgacgcgggcgggcctcaccatccccgccgtggatgtggacgacatccaagtccaataccggtgcggctgggtggttagttgggggaccggagggaacaggggtgcaggacgcatcttttgccctgcaaccactccgcttgaagcctttgcgggccctgccaaatga

SEQ ID NO: 1094 - DNA, 555 bp, Chlorella protothecoides
atgtgtatgcgcatctggccacggcttcgaggccccccaggcctgcctgcgagcattgtgcctgcggaggcgcagagcggaacaccgatcgacgatgcaccgcttcaggctcccgctcgccacccctccccgccctccgaacctccaggcgtggtgtggttcaggggcgtgtgcgccgcgctgggagcagacccaggccatgccttccgcgccacgatatgcacgctgtgccccgacgtactgcgcggcccctttgaggccggggcccgtgcgcaggtggggctgccacctgagtggtacgacccgggctgctggccggagggggagcgcgagaggctcgctgaggcggtgcgggcgcggaaggagggcgcgctggacgggcgcacggcagcagaggtgcagggcggcgggcgtggggacacggcaaggggaccccagacggcactcttctcgagcaccctgcaagacgcagagaatctgggcgccctgcgtgcccgcctcgagcactttgtcgctggcgagacggcgagggcggcgcctgcgtctgctgcgtga

SEQ ID NO: 1095 - DNA, 618 bp, Chlorella protothecoides
atggagtttgtggaggcctggacctcacctgagggctcacaggtggtgcggttggtcaccagccccgattttggggcctgggtgcccaaagcactgcagagccaggctagcttccagaagctggagtttcacgatgtgcgaagttggacatgcggcagggcgcatgaccctgtggctgggagatgcagatgggtgggcctctgccttgccctgtttggcgctgctgtcgggagtaccccctcccacccccccccccccgccccgctttccacccagatcattgagtacgctccctcggacctcgccaggcccccctactcgctgtccgcccccctactccctgtccgtgtgcaccgagagccccatgctggggcacaaggtgcgcagcatgcggagcaggcctgggaatcacgtgtgggccacgagctcccagccctggacctcagcccttccccccccgacctgcagctggacatccggctgcgcctgacggtggcccccaccagccccgacgcctgccgccagacgctggagggccgcatccgggtgggcatcttcggcctgggccgcatcgtggaggggatcgtgaaggaccagctggccgcgacgtaccggtga

SEQ ID NO: 1096 - DNA, 357 bp, Chlorella protothecoides
atgcagggagagccggagcgggccctccccatgtttgcgcagaccgtccagactgcacaggccaaggggttgctgctgggccagccctcgatcccttgtcgtgatcactccaaagcacccacccaccacgcggaacagacggacgatctgaaggcgcgggccctggtggcccaagcctccgtgcaccaaggcctgggcgaggtgggcgccgccatcgacgtcctgcgcgaggcagcgcagtacgacgacaaggtacgaggagtgggggtggaaagagggaacaccaatctagtgtcatggctgttccgcgctcgtgatggtggtctgatttggaagacggcccgttcctccggctag

SEQ ID NO: 1097 - DNA, 612 bp, Chlorella protothecoides
atgaaccacggctcccacccacgactcccctccccatcaccatgccgcaggctgccctccgacgacgccggtaccccccgctggagcgccccctgcttcctgcgcctggagaccacgggcctgggcctgggctttggccgcgtgcactccgcctccgtcaccgcatgcatgacgcccaagctgcgcgccgaggtgcagcggcgccgccaccgcaccttcaccggcatcgagtctgggatcctgtgtggcgcggcgacgcgcgtgcgccgagacttcctcacctcccccgcggcctcctacggcaccgtgggctccggcgccctgcgcggcgcctccttcgacttctcctatgccatcggcctgctgaccgtggacgaggcggccaacgcggcggcctacggcggccccgtcgccgcctcggcgctgctggagggcaaggtcgaggcgcctgcggagatgcagcccctgtacgaccagctggcggctgcggcgctggctacgccggggctcagcgacgtgcaggttgtggacaaggcggcgggggagcagggcgacgtggagcagggcgcgcgtgaggaggcaccgccggcgccccgcccgggtgagctgtga

SEQ ID NO: 1098 - DNA, 1338 bp, Chlorella protothecoides
atggcttcgccttgcctgacggcatgccatcgggtacaggccagccacagcacctcacgccatagaatcatgacaccgcagttgtttgctccccactctgtgcctgcacacgcgcccgcgcggcgctggtccggtcgccgggtcgctgcccagggcgcgacggtggaggccgtgacggggctggacccctccctcacccccctcattgaggccgccctggacgactgcctgaccgagacgtctctcgacctgcctggcacacactatgtggtgggtcgggtaggggagagggtgcaggcaggctggaagggtcctgccttactgtatgaggtacagtacccctgctcaccgttcgtaccccggctcaccgtccggtctgcgctgtcctcctctggagacctctcccaccccctcatcaccccctccgcccatcccacgccatccatccagggcaaggtgcgtgacacatacgacctgggcgaccggctgctgatcgtgaccaccgaccgccagtcggccttcgaccgcatcctggcctccgtccccttcaagggccaggtcctgaaccagaccagcgcctggtggatgcaggccacgcgccacatcgtgcccaacgccctgctctccctccccgaccccaacgcggcgctgatgaccaagtgcgaggtgttccctgtcgagttcgtgtgccgcggcttcatgaccggcagcaccgacacctccctctggacgcactacgcggcgggggagcgcacctactgcggcaacaccttccccgacggcctggccaagaacgcgcgcctggcgcagtgcgtcatcacccccaccaccaaggccgccacccatgacgtccccatcacgccgcgcgagatcgtggagcaggggctcatgagccaggctgactgggacactgcgagcaccgccgccctggagctcttcaggtttgggcaggcggaggccgccaagcgcggcctgctcctggtggacaccaagtacgagtttggaaaggacggcgcgggcaccatccggctggtggacgagatccacaccccggactccagccggtactggctggccgggagctacgaggcgcggcacgcggcgggccaggagccggaaaacgtggacaaggagttcctgcggctctggttccggggggcctgcgacccttacaacgaccccgtgctccccgccgcgccggcggagctggtggtggagctgtccaggcggtacatcctgctgtaccagaccatcacggggcgtcgcttcgaggtgccggagggagggcgccccctgcacgagcgcctggccgccaacgtggcggctgcagggctctga

SEQ ID NO: 1099 - DNA, 687 bp, Chlorella protothecoides
atgctgcacagcctggcccacgtggagctgaacgcggtggacctggcctgggacacggtggcgcgcttcgccgccgcgcccctaccccgcgctttcttccttgactttgcgcgcgtggcggacgacgagtcgcgccacctgctctggtgcctgcagcgcctgggggagctgggccacgcctatggcgacatgcccgcgcacagcgtgctgtgggagggcgcacaggccagtgcaggtgggtgccttgtgtggcggtggggtggtcgtggggagcaggtgacggacgaggagggggggtcacacagggaccagagcatgcagacaggtgggtggatgccggtcgaggaagggggaccgtggcggggaggagaccaagcgctctgtgcccgtgaccctggcgagggcatggacgacccgcttcaggcgggcccctccgctcgccatgctgcaggggacgtggggtccaggctggccgtcgcgggcccaggccgctcgccatgctgcaggggacgtgggatccaggctggccgtcgtgcccatgtcccaggaggcgaggggcctggatgcggggccacgcctggtggaccgtctggtggggctgggggacgcccgcagcgccgccatcgtgcgacgcatcgcgcaggaggagagcgcgcacgtcgccgtgggtgggtcgggagggggtga

SEQ ID NO: 1100 - DNA, 546 bp, Chlorella protothecoides
atgctttccgttgtgccgcgtcgcccagagcccgaggtgcccggctttcccgtcagccggcccgccccgccaggcgccccttcgctgtccaccccagggacgcgtcgcccgcccccgcccgcctcccactggcgcctcgccgcggcctgggcctcgggcagcaggctcagcgcgccacccgcgcgcatgcccttgagggccaccgggaacatgacgccccgcacgctcaccgccagcaaggaaagagtggcccaccagggcaggcccagcgtggagtgcaccgcgtccagccccgccatgcagacgtgcagggggccccagggctcggctgcggcgctggaggaggtgctggccaccgagagggcgtcgctggccgcctccaatgcgctgctgcccgtctccaggctgggatcgggcggcaggctgccgctggacagccagcggagggatgcattggacacccgctcgctcgagacgtgcctgtggtcgaatgcgatcggtgcaataatgccaatacatggacatctggaagttctggacgagtaa

SEQ ID NO: 1101 - DNA, 816 bp, Chlorella protothecoides
atgattctcctcaggctgcctccctccctgggcagcctggcctgccggcgactgagggcgtcgcgatgggtgagcagcgttcggtgcatgcatagcgatgcaagaattgatctcatatccaccggcccagaggccagtgacaggctcgcggagttcatcgcctctgccagtgctcctggggatgcgtttctcctgtatggcgaagtgggagccggcaagtcgcacttcagccgcgccttcatccgcgccgctctgaaggaaccctgcttggatgtgccgtcccccacctaccttttacagaatacttatgaagatgcaacaggtgttgtgctgtgcggggatgtcgtcttggggctaacgattttgcctcagtatgggctgagatggcccctccttgcgtcgcgccccacacctcctccatgcacgctggaccagtcgtcgcctgtaccaccactacgacctgtaccgcctgacagacccctcctccctggcacggttggacctgccctccgccctcgccgcaggcacctgcctgatcgagtggcccgagcgtctgggcgcctgcgcccctgcccaccccgtcaccctgcgcatcgcctgcgtggcgggggcggccgaagagcgacgcctgttctcgctttccttcccggaccgggacgcggcgcgctgggtgcaggtcgtgcgggccctgagggccctgggccatcgggtcggcctggatgtccaggatcaatccggggacgcccaggcgtgagcccgcggggcactaccgttgcattcatctcccttccttccgtccttcccaccccagcctga

SEQ ID NO: 1102 - DNA, 2952 bp, Chlorella protothecoides
  modified_base (1316)..(1325): a, c, t, g, unknown or other
  modified_base (1416)..(1425): a, c, t, g, unknown or other
  modified_base (2143)..(2152): a, c, t, g, unknown or other
atggtgacgagaggaccaccttcgtatcgggcgcgggaggccccgctggccgcagctacactggcggaggcagaggagaagaaggatgctgcccagactggggtcgcgcccatcccggacgaggtgagggatcttcaccgcgctgcagggggtgtgccctgctgtggtaattttcctgaaccctggaatcgaacccaccgatccctgcaggtgcaagttgggggaagccccctgtatgtagtcgagcgaaagctgggcaagggtggctttggccaggtgtacctgggcaggaggacgcccccctccaaagaccctgagctggcgggagtgaaccaggtgggcagactgggcggagagaggcgcagtatttgggggtgtgggattgagatggcgattggagacacatgggatcatatggccacctctgccgctgactggttccttgcaggtagcactgaaactggagcatcgcagcagcaagggttgggtagaaggagttcacttatgcaaactgcagcgcagagaagtgccgtctctatgaggagtggacacctcttcagtgctggggcacgtctcttagaactacccttcccagacctgccgatgccctcccacccacaacctggggcgcttgccccacgaatgtccgccctctcaatttccccctttcctcctcacccacacagggcactgggggacgtggagggcgtgcccaaggtccacttcaaggggcggcagggcgactactacatcatggtcatggacatgctgggccccagtctgtgggacctgtggaacggacagggccaggccatgtcgcaggagatggtggcctgcatcgcgctggaggccatcgccatcctggagcggctgcatgagaagggctatgtacacggcgacgtgaagcccgagaactttctcatgggcctggcggggacgccggtggagaagaagctcttcctcgtcgaccttgggcttggaagggctgaagtactacgtatttatgtgtggctccctggggagggtggggtgtgggatgtgcgacttccccaagcttgctctgttcatacccagatcgcaactgcagatggcttgaccagtcccatcaccggcccccctcaacccggcgctcccctccgacgcacatcgaatccagttgaatcctttcccccatgtcgtcccctcacgcgcagcgactcgctggcgcggctccgtctgcggtacccatgtggagtacgaccagcgccccgacgtcttccgcggcacggtgcggtatgccagcgtgcacgcgcacctgggccgcaccgccagccgcnnnnnnnnnnccggccccactcaacccggcgctcccctcctacgcacatcgaatccagtcgaatcctttcccccatgtcctcccctcacgcgcagcgaccnnnnnnnnnngtccctggcctacaccctgctcttcctgctgcgcgggcgcctgccctggcagggctcttattaccccctttaatccatgcccccacccacccacccacccacccatcccaacccatatccccagggcgagaacaagggcttcatggtgtgccgcaagaagatgagcacctcgcccgaggcgctgagccgctacgcgcccgcgcccttccgcgtgttcaccgagacggtgatcaacctgcgcttcgacgagggccctcgcgcccagtgctgccgcccacgcgcgtcggctccaagcgctcgcgcgaggagggctcctgcgacggcgccggcggcgagcgcggcggcggcgagcgcgcctcccccgccccggccctggtgccgggccgtcgtgtgcggctgggcatgcccgccacgcagtgggtgacggtgtacaacgcccaccggcccatgaagcagcgctaccactacaatgtggccgacaaccgggtgcgccagcacatcgacaagggtgtggaggacgggctggccatctccaccgtggcctgctgccaggacctgtgggcgctgatcatggacgcagggggcggcttcatcgcgcaggtctatgagctgaaccccgtcttcctgcctaaggactggatcatggagcggtgggaggaggggtactacatcaccaccatggcagcaagctccggtccccgggacgctgcatggacannnnnnnnnngtactacatcaccaccatggcaggtgggtggtttgtggggggatgggggtgccggtgaggggggtggtcctcgattcagcaagctccggtccccggaacgctgcatggacctgcgcgattcatggtacaggaatggcccctcttccccgtctcgcccaacccacccagcccaacacccccccacccccaccccgtctcccaggctcggtgggcggcagctcgctggtggtgatgagcaagggcacggcctacacgcagcagtcgtacaaggtctccgactccttccccttcaagtggatcaacaagaagtggaaggaggggttcttcgtcaccgccatggccagcgccgggtcacgctgggcggtggtcatgtcgcgcaacgccggtttcgtggaccaggtggtggagctggacttccagtactcctccgagggcatccaccggcgctgggacgcggggtaccgcatcaccgccgccgccgccacctgcgaccaggccgcctttgtgctctccgtgcccaagcgccggccggtggacgagacgcaggagacgctgcgcacctccgccttcccctcctcccatgtcaaagtgcgcggcggtctgtttgtgtggtagtggtgggggggtgggggtggcacggtggcgtgattcatggttgggaatgcaggtgcgagtggcaggacaagctgtacagcagggcgagtgtgcagcaatgggaggggtggcacgaaggtgcttggatcaagctcgcatgctaccatgtggcctcaatccacagtgtccttccacaaaggccttga

SEQ ID NO: 1103 - DNA, 453 bp, Chlorella protothecoides
  modified_base (214)..(223): a, c, t, g, unknown or other
atgcgcttcgcctcccagaccgtgctctccggtctcggctccctccagttcgtgctcatccccgtcgcctcccaggcattgctcggtgtgcgtgcggatcgttctgccgcgctgggcgtgctggtggtcgtggccggcaacgtgctcatcgtctggcacggccccggcgacgtagagtactcggtggccgcgctgcgagcgctgtggcaggcgnnnnnnnnnncacggccccggcgacgtagagtactcggtgactgcgctgcgagcgctgtggcagacacgcaccatgcgcgccttcctcctggccatggcgctggcgctgacggcgctgcagctgatctggtgggagctgcgcgccgcggccaaggcccagcgcttgaccgggcccttcgccatgctgggagcgccgacggcgcacgccgcgcgctgggccgacggcgcggcggcgtttga

SEQ ID NO: 1104 - DNA, 1578 bp, Chlorella protothecoides
  modified_base (613)..(697): a, c, t, g, unknown or other
atgtactgtcttctaggctccctgcattccctgggcttcgttcccagctgcggcacacctgccctgcgccctcccattccccgcctgccccggctctcccgaccagctgcggcacacctgctccgcgccctcccaatccccgcctgccccggctctcctgaccaggttacaccacggcctacacggcactcagcgcttcttggccacgcccacggtcttgccgcggcgaccggtggtcttggtgtgctgcccgcgcaccgtcaagccccagtaggcgcgcagcccacggtggttcctgatcttcttcaggcgctccagatcgtcacgcagcttggtgtccagcatggaggaggtcatctggaagtacttgccgtccttgacgtccttctgcctgttcaggaaccagtcggggatcttgtaggcgcgggggttggccacgatggtcatgatggactccagctcctcgggcgagagctcgccggcgctgcgtgggatgtgaggaggacaggcgggtggggcgaggcccgctggcgatccctttcgaacaggaaacccggcaagccttctgggcttcgggtctctgagctcaggagaacagagggaggcggccccnnnnnnnnnnnnnnnnnnnnnnnnnnnnnnnnnnnnnnnnnnnnnnnnnnnnnnnnnnnnnnnnnnnnnnnnnnnnnnnnnnnnntcccctcgctcgcacagccacccccagctcccctcccagcgcctcacgcaccggcgggtcaggtcgacctcggccttcttgcagcagatgttggagtagcggcggccgattccgcggatggcggtcagggcatactggattttctgcttgccgtcgacgttggtgttcagcacacgcaggatctggccctcccgacgtggcgccaccccccgccatcccccgagccagtcctccacccagccacagcctccacgcacccccatggtgttgggtcgatcctccggcctgacagagctgggaaccgagctgagaagagggcgaggccgttgtcgtgttgcctgctagtggcgaaactctataaagccgcccgccccgggacgaacaagggcgccctcagggcgcgcagtgagcattggtcagggaagagattccgatacgagaagagggcgaggccgttgtcgtgtggcctgctagtggcgaaactctgtaaagccgcccgtcccgggacgaagaagggcgccctcagggcgcgcaatgagcactggtcaggggagagattccgatacgagaaggaaagccgaaagcgtctgaagaaggctctggactctttggtgtacctccccacccccgactcgacagaggtcccttcaaaacccgctccagcggccaagggacagacctgggatcgcaaggatctattcactcgccttcagactttcagatctgccacatggtttgcgaagcctgccggcatcactccggctgactgcgctcggcatgggtgggagaacacgggcgtggacactctggcctgcgaggtgagcatgcaagtggggagcgtctgggacagcgcaggatgcacgccctgcatgtctttctga

SEQ ID NO: 1105 - DNA, 1662 bp, Chlorella protothecoides
  modified_base (423)..(432): a, c, t, g, unknown or other
  modified_base (1336)..(1447): a, c, t, g, unknown or other
  modified_base (1531)..(1540): a, c, t, g, unknown or other
atgagtcacgacctgacaccgctcggcgtggtgctcttcagtattgcttccgccatctcgggagagcttatcaactggatcctggtgtaccggacgagttcgtaccgtgccctcaaagagaatctctcgcgccacgcaaagaagctcgaggaggccaagtccagtgggagcgggagcaagaacatcaagaagctggaggcccgcctcgatacatggaagacggaggcctccgcccgtgtggcgggcatcaacatgcgcaccggcctcatcgtgcgtgggttggaggggggcagggcggcgagcctggcagagcagaggggccaccagggctgcggggggtttggacgggcttggacgggcggactagggcgtgtccagcatatgatacatttggacgtgtattgctgcgtcaaagcgatcaannnnnnnnnntgggggcttggacgggcttggacgggcggaccagggcgtgtccagcatgtgatacattcggacgtgtattgctgcgtcaaagcgatcaatccctcttccctgccatcccctcctgcagaccgtggctgtggtcatgctcagtttccgcctggtatcgcagctgtttggcgacgcgccggcggccaccctgcccttccacccgccgcccttcctccaaaagctgacccaccgcggcctcaccgacgccgacccacggcagtgctctgcggtgagtgggactggcgcccattggttggcatccctggcgacgcgctcccgtcaggacgcctgcaaatcactgcgcagctccggtcatcccacctgacacccgccctcaccaccacccatgcagatgttcatcttcatcctgtgccagggatccatcaaggtgctggtcaccaagctcctggccctgggccctgggcgcgagtgggtgatcatcaagcccaacaccctaatgggcctgagcgacaagaagtgactgtgccgtgccggtaccagagcaggcgaggccgcggacaaaaacggggggcgggcctgcctgtgaacagcaggccgccagggaaaggcaagggaggagggggcgccgtggtccaccgaaggaggggagaggggcggcgacccgcggacgaccaggccgcacacttttcaatgcggcgcgggtcgtccagcgcacttgcaaggcgccggcgcctagtcgctcgcggccaggcgctcgtcctcggcagccacgacctcgaatccctcgatgggctggcggcagaaggggcaggccggcaccaggtgctcgcgcgcggagcacagctggcgggcgcagccgaagcacaactcgtggccgcagccggccacggccacagacacgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggagaagctgtcagcgcggcaaacaggaaaggttaggtgcccacagaagctgcagtcagaatcacactcaacacggcgatnnnnnnnnnnaggctgtccaacagcgtgtcaacctggcgctcgcacgccggctcactcgactccgcacgacctgctgtggagtgggggggggcaggggagaagctgtcagcgcggcaagcaggaaaggttag

SEQ ID NO: 1106 - DNA, 453 bp, Chlorella protothecoides
atgctcctggtgaagaccaccgccacaggcatgctggctgccgtgctcgatgcggccatcgagtaccgcagccggcagctcctggcggccgctgaggagggagagagggagggacccgcgccctcccgactagcgagcattggcctgatctcacggcccggggtggctgcctggaaggcacgcctcctccaggccattgatgagatggagcgccgcgcggagcggtatggccttgcattcctcaccccgtcccactgccacgatgtcgtaggaccctcgtctcgccttgctgcggaggcccagacagctgctgcgcccaaggacaagggactggcgcatggaccgcatggctgtggtagcctggcagatttcgaggctgatgccgagacggaggccatcctgagccagaccgtgcagcagctgcaggagctgatgcgccagagcggtgagtga

SEQ ID NO: 1107 - DNA, 258 bp, Chlorella protothecoides
atgaccatcgtggccaacccccgcgcctacaagatccccgactggttcctgaacaggcagaaggacgtcaaggacggcaagtacttccagatgacctcctccatgctggacaccaagctgcgtgacgatctggagcgcctgaagaagatcaggaaccaccgtgggctgcgcgcctactggggcttgacggtgcgcgggcagcacaccaagaccaccggtcgccgcggcaagaccgtgggcgtggccaagaagcgctga

SEQ ID NO: 1108 - DNA, 1011 bp, Chlorella protothecoides
  modified_base (902)..(911): a, c, t, g, unknown or other
atgctggcatgtgtgcagttgattggcagaacgagcaggggaagccagcctccccgcgcagcaggtatctgtcgcggctgcacatcccactcacgcaccccaccacccccggccctcatccaaccccgcgcacaggtgttcaaggcccgcaagactggcagcctggccacggtggcggtgaagctcatcaccaagcgcggcaagaatgagcgagacctgctgggcttgcgccaggagatcgacatcctgcggaccatgcgccacgagcacatcatccagatgctggatgcctttgagacggccaccgacttctgcgtggtcaccgagtttgcccagggtgcggggccggctggtcaggagtctgggagggaggtgtggcgtgctggctgcctcctcgccgccctcccccgcacgctaccgcgtctgtgcacacacccctgcctctccctgggtacccctgcggacccccggccaccacttctcctctcccactcccgcacctgcccaggcgagctgttccagatcctggaagacgatcggagcctgtcggagggggtggtgagggacgtggcgcgccagctggtggcggccctgcactacctccactcccaccgcatcatccaccgcgacatgaagccacagaacatcctgctctccgccgccggcaccgtaaaactgtgcgactttggctttgcgcgcagcctgtcggcccacacgctgatggtgaccagcgtgaagggcacgccgctctacatggcgccggagctggtgcaggaacggccctacaaccacacggtgggctggcgtgggttgggtgggtgggcgacgaaggggggaagtgtggagtcacccatatatttcagcacagcgggtcctggatctgcagggcggcctgagtttannnnnnnnnntgggctggcgtgggttgggtgggtgggcgaagaaagagggaagtgtggagtcacgcagatatttcagcacagcggatcctggatctgcagggcggcctga

SEQ ID NO: 1109 - DNA, 939 bp, Chlorella protothecoides
  modified_base (285)..(294): a, c, t, g, unknown or other
atgtcctctgctcttggtctggctccacgggacgaagtggaggacgcagccggacccagtggcagcgcggcacaagcactcgagaatgctcatctcaaatggcgcccagacttgcgcctgccggtcagtggtccccaggagccaatgctcgctacaagaggagtagacgagctcacgaagcaggtgtggagtgcatgcaaagagtgggtgcttcagcctgtgcatgggatgtacaggcgactggcgacaagcagaggtagaggaacagcatctcacatcaataannnnnnnnnncctgccggtcagtggtccccaggagccaatactcgctacaagaggagtggacgagctcacgaagcaggtgtggagtgtatgcaaagagtgggtgcttcagcctgtgcaggggatgcacaggcgactggcgaccagcagagtaagaaagctcgacgtgcggcgcaggctgccgccccggacaccagtggcaagtcgtggtttgacatgccagccaccagaatcacggaggaggtcaagagggacctccgcatgctgcgcttgaggtctgcctttgatcccaaggccttttacaagaagtttgacaacacgaagttccccaagtacttccagatgggcacagttgtggagggtgctgctgacttctactcaagtgaggctcgtggcaggggatgggggatgggctttgctatggcagctctacgctcttgtgtggtgattcctctaagctggaagagtcacaggagtgtgtacatgcatgggagtagcacctggggtgaggctggcggtttagttacagaatctgcagacaaagatgctaaaatcacccgaacccctccctggtccaccgctgcaggcacgcctcaaacggtatggcaagatgcaggaggagaagtccaggttctcgcgcaaggggcgcaagactga

SEQ ID NO: 1110 - DNA, 726 bp, Chlorella protothecoides
atgcaggtcaagcagctgagcgctgccagctaccatgtctgggtgcactcccccgtcccggggcagccacgcttctttgccagcgatgcactggagtgcctgaccaaggttcagtggtgggtggtcccgctgctctggatcccggtggcctgcgcttggctggcggtggccgtgcgggattggggcctcccaacttcggcctgctatgccgcggcgggcgcgctgagctggcagggcgtggagtacggcctgcaccgctgggtcttccacgcccggccgcactcccctgcggccgtctgcgcacactttctcctgcacggctgccaccacaagttcccccaggacgttgatcgcctggtcttcccacccctgcccgccgccctcatcgccgcaggcctgtactacatgatcaggctcgcactcccagcggtgggtgtttggcgtggggtggggcaagcagggcaaatcggctggtaccttactcggcaagcaccgggtgggagcgacgccttctttgggggcctattgctagggtatgtgcgctatgattgcatgcactacctcatgcactccggtaggctgggcggccgactcaaggccgcacacatgcatcaccactactcgaacccggaggaggcgtttgggatcagcggcggctcattagactgggtgctgggccccccggctgccataggagctacccgcaggagcctcgtggataggtga

SEQ ID NO: 1111 - DNA, 687 bp, Chlorella protothecoides
atgaccccctccgaccttcacaccacgccgcagatgaaggcgtcggacgcggcgcagggccgcgcggcgcgcgtgctgcccaccagcctcgcctcggtgtacgactttgcgctgacgccgcgcgcctccaccggcttggagggcgtgaccttccgcttcgtgcccgagcctggcgaggtggcggcggcgctgcagctgtacaacgccgccggcgtgtcggccggcggcttcatgggcgtgcccctgttccaggctgagggcctgacggtgatgtccgagggcaagcgctgcacccccctcttcttcagcaaggccgacctggatgtggccctaggcacggccgcgggccagaagcacgaggagatgctgggcctgacccggcagcgtgcggaggaggccaggaaggatgtgcagcgcatccgggacgaggttgcgagtgcgggggaggacaaggccgcaaaggccgcagcagagcgccagctgaagccggcgctagaggcgcaggcacggtaccaggcgcgcacggctcagcttgaggacaagaaggtcaaggtgccgcgggtagacctgggcagcctggaggaggtgctgggcaggatggaggcggacgcccggggcgagtgggcggacgtgctcttcatcccctctggaaccatgacggtgacggggaagaagaagggccggtga

SEQ ID NO: 1112 - DNA, 1548 bp, Chlorella protothecoides
  modified_base (55)..(64): a, c, t, g, unknown or other
  modified_base (684)..(693): a, c, t, g, unknown or other
atggaatttgcccaattgcgcgccaggtatcctcggaagcgatatgtgtggctannnnnnnnnngaccccatgacggcgagggacggggcagtgatctgattaccaaatttaatttgcccaattgcgcgtcagtcgtgaagcgtcagaaggaaacgcatccaggctcactcccttgtgaagtcacaatcaccagggcatgtcctgaagggctactgaaggaacaccagtgcaacatggcactcatgcgctcaacaccgggcggtcctcgccgctccattccctggctgatctaccacgccggggcgatggcggcattcatgtacattctgctacaggcagctcagacattgacaaaggacatgggcgcggctgtccaggaaaggcaatcagcaaggtcgagatccgagcttcaggttcaggccaacactggacaggatcgtcattcactgtggacaccttcacctgagagggacgccaaggatcctgagctggcagcattcctgcgcaaggtacggctgttgccaggataccgttatcctgcagacgcaagctgcactccctgtaagctggtgctggtggcgctccctgtggtgcagggcgcttgcccagaatcattgacaccaatttcttcaaacgctccaaaactcctcggcccctccaccacacgcaggttgcgattaacnnnnnnnnnngcagggcgcttgcccagaatcaatgacaccagtttcttcaagcgccccaaaactcctcggcccctccactacacgcaggtcgcgattaaaaacgaggtgctcatggctgtgagcaacatcaactacgcaaggaagggtggcatgctggacatgtggatccagaatgtgctgcgcgccggggtcaagaatgcgatggtgctggcgctggacgacgagaccaagaagaatgcggaggagatgggcatggccgccttccgcatgcagctggaggtggggtgggctgcagagcggggggtgggaggggtggggattcccaaggcacaacaaggcaacggcgacaaccatgcggtttcagcgatgaagttccgcatactgagccacttcctggagctgggctactctgttttcctctcgggtgtgttaccaaacctgcgctgccacaaactcctccccttcctcccagatgtggacatcatcaccctccaaaacccctttggcttcctggcacgtgactcggacgtggagtccatgagcgatggctgggacgccgccaccgcctatggctacaacgatgtcctgggtgggttccggggctgggcgtggcaacgagtgcatggggggtacgccgggagtgcaaggaatgtgagcacgagcaccagcctgcgccggtatctccttccattgtactcgtgggcgagcactcctgctcgcttccatggacgcatccctgcacacctccagacgacgaggagatgggttgggcgcggtatgcccactccatgcgcgtctttgtcttcaacagcggcctgttctacatccggtgcgtgggcggtggctcactgccacaacttgtga

SEQ ID NO: 1113 - DNA, 633 bp, Chlorella protothecoides
  modified_base (37)..(46): a, c, t, g, unknown or other
atgtttatgcaagcttcggcgcgtttgtggcgcacannnnnnnnnntagaccaaggccacaatgacgacgagatcagagtgaatcccttgagatctgtcatgttgatgcaagcttcggcgcgtttgtggcgcacaaatttggtggactggcgcgcaggcttcagcaccaccatgggtcccggaatggtatacctggagtcgctgcgaaatcacgagcgcgagggcgtgccatcaggcgctgccctccctccctcactttcaatcccaccgacgcggtggcctcagaccaagatgcacaggctgcttgcccagctaggcgatcctcaggacgcgtggcaggcagtgcacatctcaggcacaaagggcaagggatccaccgccaccatgctggcgtcgatcgcatcagctgctgggctgaagacgggctgctacaccaggtggattgttatgctctgcttgcccatgcaggcttggagcaccagacctgcccatggaatgaggtttgcatctccatctgaagctgctcaagagctaagcaatgggggcccatgggccagggcatcgatcttacccttgaccgtgatttccaccttccccaccccctcccagcccccacgtggtgtccctgcatga

SEQ ID NO: 1114 - DNA, 345 bp, Chlorella protothecoides
atggaactacactatggggtccattgccctgcacatgccgatgtcccacctccccgcttctcccctcctgctccccctccaaaggacccctctgtgacacgaagagttcttgacttcgagctcttcatgaactccaagacgctgttcaaattcctacggtacagcggccagaagtatatcgaccaccgccccgtcatgatccacgtcaactaccacagcagtacgttggctgtggctcgtgggtggccagggccggccgataagttcgagcgcatgggtgccgtcgtgaagcgatacgtggatggcgacctcaaggccctggatgacttccccgtgaggtcgtga

SEQ ID NO: 1115 - DNA, 600 bp, Chlorella protothecoides
atggagggcgtgcaccagctgtcaaacgccgccaccgccatcacggcagcggccgtcctggcatcggagggaattctgcagggcctgaccctggaaggcctgaggcttggcctctcacgcgcgcagctgcccggcagattccagcgctgccgcctggcggagcacagagccgggcctgtgctgatcgttgatggggcgcacacgcctgaggcgtgcgccgccctggccgcctcgctgcgccgcgctttcccggaaccctcccctgtcgcgctcgtcctggcggcggcggccgacaaggacgccaggtaccatctgggctgtggggttagcttgacctctgcgctcatcgctcacctcccacgaccaccccatccctcgtgcagcggcatgtgcgcggcgctgggtgcgctgcgccccgtcgccgtcttcccgaccgaggtggaggtggccggcagcggagcccgggcgatggcgccagggtcaatcatggcagcgtggcagttcaacggtgcgggcgcgtgggggattggggtcagggtcggcggacacgccctgcaagtcatgcctggatgcctttccagcggtgcatgcggcccgtga

SEQ ID NO: 1116 - DNA, 306 bp, Chlorella protothecoides
atggtgcagtcccccgcagtgacttcccggataatggactacgagctcttcctcaactcgctgaccttgttccgggagctgcgccacaccggccagcactacaccgacttcctgccggccgtggtccacgtcaatgcgcacactggtgcgaaggagaggggggtgaggagaaccatgttgcctctccacagtgcagccactccgccccagggacacaaggcagagaggatggaggccatcgttgaccggtatgtgaagggcaacctcaccgccctcgaccacttgcccctgggatcgggccgctga

SEQ ID NO: 1117 - DNA, 660 bp, Chlorella protothecoides
atggatggcaagcccataacgtccgaggatttggatcaggcactggccgcggtccagcctaccgcccaggggctcagccacgcgtccccggagctgccccccctcagccacttcgaggtcctgaccgcggcggccttcgcccactttgcggccgccggcacggacctcgcggtggtggaggtgggtctcggcggcgcacgcgacgccacaaacgccttccgccctgccggccttgctctatcggtcgtgactcccatcgggtcagaccacctggacgcactggggggcagcgtgcgtagcgtggcggccgccaaggccggggtcttgaaggcgggcaggccgctggtgctggcaccccagcccctgcacgaagcccaccaggaaatcaagcgagaagctcaccggctggggtgccctgtgatcgaggtggctgacgaggtggagctggagtttgcaaggggcggggagcagcatccagctgcccctgcaatcgtgcgagtccttggctccacggtggctgcagcgctcggtcttcagcagggcgactgcataggtgggcaccgtgagaggggagggactgcggaagatgccgggtgtttgaagatgagcgcttacctcccctcccagcaaccgtccgcccctccccacccactcgcttga

SEQ ID NO: 1118 - DNA, 591 bp, Chlorella protothecoides
atgcctgaccgtaccgaggctaaccctaatgagcttaatcaagatgatgctcgttatggtttccgttgctgccatctcaaaaacatttggactgctccgcttcctcctgagactgagctttctcgccaaatgacgacttctaccacatctattgacattatgggtctgcaagctgcttatgctaatttgcatactgaccaagaacgtgattacttcatgcagcgttaccatgatgttatttcttcatttggaggtaaaacctcttatgacgctgacaaccgtcctttacttgtcatgcgctctaatctctgggcatctggctatgatgttgatggaactgaccaaacgtcgttaggccagttttctggtcgtgttcaacagacctataaacattctgtgccgcgtttctttgttcctgagcatggcactatgtttactcttgcgcttgttcgttttccgcctactgcgactaaagagattcagtaccttaacgctaaaggtgctttgacttataccgatattgctggcgaccctgttttgtatggcaacttgccgccgcgtgaaatttctatgaaggatgttttccgttct

SEQ ID NO: 1119 - DNA, 1083 bp, Chlorella protothecoides
atggaatcagagcggtggcgctgtgtcggcgcggtgttcacagggccgccgcacatttgtctcgactgctcagggcaccgccgagaccctccgccgccgcaggtgttcctggggtggccgggggaggcccacccgccggggcttgcggccggccacggcgccgccctggtcgggctggaagatctgcacctgggtgcctcgccggccgagggggcctcgctgtccccccaaggggacggcgcctcgccggcagcgtcgatccgacccccgcccctcccgcgccgcctaacttacgccgtggtgagccgccccgtgcgccacacccgcttgctgagcgcgctgcgccacgtgctggccgctgcgtgggaaagcgcggcgggggggcgaggtcccgcggccgggcctcggtgtgggggagcggctgacgcgcgccatgctcccggcacatgcctgagccgcgcgggcggcgacgccggcggtgcgccgccggcgccctcgccaggtgctcgtgccgccgcgcgggagaggcgcgccggcatgcgcctgctcctggccgaggacaacgccatcaacatgaaggtgggcgggtgcaaggcatcgttgggggtggccggcagcgcgctctgctgcctgagggcggtgtgggttcgggctccagagggagcgctggccgcagtcgcccttcagggagccgcggccaggggctcagggcgatggaatgcctcgctcccccaccgctcgggatccaaacacatgctgccctccgcccctctcaaggtcgcgctgcgcctgctgggccgcatggggtacacccaggtcgagacggcgcaggacggggagcaggccctttcgtccctggtcgaggcggggggccccgacgccttccacgccatccttatggacctccacatgcccggactggtgagtcgggggcaactggcggggccaaggtggactggatgcgccgcgcgtgtgggcggggagggagcgagggggccgcccctgccgccggcggcggccgtcagaatgcggacgggccccacaccccttcgccctcctccgattcacccaggatggaattga

SEQ ID NO: 1120 - DNA, 744 bp, Chlorella protothecoides
atggcgtattacctggccccttcggtgccggcgacggtgatcaccgacgggccacggctgcagcaggtcctgctcaacgtgctgaacaatgccgtcaagttcacggagacgggggcggtgctgttggagatgtgggccgtgccagcgccccaggccgcggggtcacagcagtcgggcgacccggcacgggccgaggtcggaggcacgcggtgtgccccgccggccctcgccgcgcgacagagcttcacgctgcacttcagggtgcaggacaccggcatcggcatcggacaggcggacctgagccgcctgtttcagcccttttcccaggtggatgcctcccagacccgggctttcggcggctccggcctgggcctgaccatcagcatgcgactgtgtgaggcgctgggcggcagcatgcactggcacgctggcctcccacgcccggcagggtgtgctccgcatgcacgcttgtgcacgtcctgccagtgtgagcctccctcgtatcgccgcacccgctcccatgcacagtcccgagggctaggctggggttccaccttccatgggcacatccgcatcgaggcggtgcccgaggaggacgaccatgcggcatcgagtgccaggaagccgagccggacgccctcagcagagcggccccgcagcaaccccaaagggctgcgtgggctgcgtgtcctcctggctgagccatgcctggtggtgcgccaggtgaggaggaggaggttctag

SEQ ID NO: 1121 - DNA, 504 bp, Chlorella protothecoides
atgaagaactacaagcggaacggcgacccctttgtcaactacctctcggtcacgcccatcttcagcgccaagggcaggctgtcgcactttgtgggcatccaggccgacgtcacagacctgaccagccacaagcaggctgccctggcagccacgcacgccgcctccctggcttcggcggccacagaggccaagagccagttcctggcgcggatgagtcacgagatccggacgcccctcaatgggatgatctcggtggggcagatgctggcggggaccaccctggacccgaccttgttgcccctctccagccacacacacgcacccactcggatcctccgcaacacacacccgtgtcagagagatctggtggacacgatcagggtgtctggagagacgctcctgaccctggtgtcagacatcctggacgtctctcgcatcgaggcggatcgcatggtgggcgtggcaggggctgggctggggcggctggatgtgggaaattcctga

SEQ ID NO: 1122 - DNA, 1335 bp, Chlorella protothecoides
atgccctcgggccagctcgcaaaccctttcagcgccatgagcctcgatagccaggcctcgcaggatgtgctgcggtccaggcccgggaaccgcgtctcccctcccgattacgacggaaacgaaggcatggcgacgtgctcccaggcagaggccctcggcacccaggactacatcactcccgtggatcagttcggcacggaagcggatgccgcgccgggggcccgcttggcccgatcgccggcccagctgtctccgaatagaatgaaacgtgctcgaagagccggcacggggcggggcctgcttcgtgctgcccgtgctgccctcccgacccggcctcctcagtaccccaatcttcacctcacacaccgcgcagggaccccaccccggcagcctgggccgggcgcgggtcagcgcctggtgcgggtgcgctcgccgccctgctaccgctgcatcttccgcgacgcggacgctgaggagggcatgtctgcctggagctccaagagggacgcggcctccttccccacctcccgcatgcggtgcggcgcggcggggcagcagccgggcactttgctggacagaaccgagctgggcctgctgggccagggcaactacagcaaggtgttccgcgtgcgccaccgcctggacgggcgcgaatacgcgctgaagcgcagcgcccgcgagacgcgccccgactcccccgacttcgcgcagtacctgcaggaggtgcaggtgctggcgcacacgccgccccaccccggcctggtgcgctaccacggcgcgtgggtggagccggtgtcccccgccggcctgcacacctacctgctgctggagcgctgcgacgtgagcctgggcacgcacctggccctctccggcgagcgccccgccccggccgaactggcgcgcctcgtccgcgcgctggccggcgcgctggcccacctgcacgcgcacggcgtggcgcacctggacctgaagcccgacaacgtgtacctgctggaagggggggaggggcacggggcgggagggcccgccccccccccgcccgagtacaagctgggcgactttgggcaggccgcgcggctggacggcgccgggcccgccgccgtgaccgagggcgacgggcgttacatggcccccgagctgatgaacgccgaccaccgcgacctccccgccgccgacatgtttgcgctgggggccaccgcgctgcagctggccagcggggaggacctgccgcgggggggggcggcctacgccgcgctgcgcgccgggaagctgcccctgctgccggccttgcccgtcggcctggcgcgcctcatcaagtggggtttgtacgggtga

SEQ ID NO: 1123 - DNA, 1119 bp, Chlorella protothecoides
  modified_base (143)..(152): a, c, t, g, unknown or other
atgcacactggggcaggcgccgcctcagacgcaggtgggctgtgcgtgccacgtgctctggcgtggtacaggggtgccctctcgctgtttgcacatcctcccccgcagcccccactccggcctctcgatgacccccgaaactnnnnnnnnnngcctcagacgcaggtgggctgtgcgtgccaggtgccctggcgtggtacaggggtgcccactcgctgtttgcacatcctcccccgcggcccccactccggcctctccatgacccccgaaagtggatctcccgccctcctcacctgcccttccccccccacccacccacacacatcaactcccccctttcctaaaggtcccagcgtgacgcaccgcgtggtgcgcgagttcgcgggcctgcaccgcgagctggccgacgtagccggggtgcgggtgaacctgttccagcactcgctggcgcatggcacgcccgacgccgtgttccccaacaactggttctccacccacgcggcgggggagggcggcggcgccgcgccctcctccctggtcctgtacccgatgaagtgccccaaccgcgcggcggaggcgcgggaggacgtcgtgggcgtgctgcgcgcgctgggacacgccgcggaggtgaacctggcgggcgaggagggcgcggtggcgggcggcgcggggcgcgtgctggagggcaccggctcgctggtgctggaccgcgtcaacggcgtggcctacgtggcgctgtcggagcgcgccgacgcggcgctggcggacgactgggcgcgccgcctgggctacgaccgcgtcgtcgccttcagctccggcgacggggcggggggggcagtgtaccacaccaacgtcatgatggcggtgggcaccgacctcgccgtggcctgcctggccagcgtggccgacgacggcgagcggcgcgcgctgcgccaggcgctggagcgccaccacacgctcgtcgacatcacccgcgaccagatggcggccatgtgcggcaacgtgctggagctggaggatggccggggcctgccgggtgcggacgggggacttgtcgttgggcccaggcatgcgctgccggcaaaccacccgtcgtcctcgtcaggcaccacaccctag

SEQ ID NO: 1124 - DNA, 552 bp, Chlorella protothecoides
atgcgtgggcggggctggatcatactctgtgagagtctgccatgccgccagggtggcatggcccctgctcagcgaggtctatctgcaaccccagttcctccaggaagccaagatgcagcacctccacaaacccctttcccccttttactgcttgatgccaggttcaaggtgccgaggtgggccttctcgccagccccaaaagtgaatggcgctgtagtccaccttgagctgctggcgcctgaggatcggccgcccgtcccctctgaggcagccttcctgactctggtcacggtgcggcaagtggcggatgccgttgcaccgaccccaccaagctgtctgatgcccagctgtcctcaagttccggccgagagaacggggtaccatatccccacccctcacatcacacccgccctctctggacgccggccggctgcaggtgcgattcgccttccaccagcgccgcaagatgctgaagaacaccctggcgccgctctttcccccaaaccggaccgaggcggccctcttgcgcctgggactggatgccggcattag

SEQ ID NO: 1125 - DNA, 2514 bp, Chlorella protothecoides
atgatggtgagactggcgctgtcatacggtatctcaggagagggaggtgcccatgctggtctccctcgcattgcccacccggcggtcggccctccatcagacgagagtacaccggcacttcctccttcttcctcccccatgttaccgtggcgtgcagttccccctgggttcgaagatgtagaggtgaatgaggctgcagccaagctgtcctccgtgcaggtgggcagagtcatggatgccatccaccatgccagtgcaggggagggggcgctcgcagcgcgatcctcgttctcgactgagtcccctccaccttcctcgaaacaggtcagcgaggcagctcctgatgcaggggatgagcctgacacaagcctgaagaccgactccctggtggagcgggatacagaggtcaaaaaggtcctggccgacgacaccctgtacacatcaggtggggtgcctgctgggcctgattccttggtggggccagcctgtcagtcctgggatactgaagctcatgcagtggtgtctgttccgtccagagtgccgcccccttgcccaccgaccagctcgtggacccgccgagacgctgcccctgatcctcaccccgccgcaccgctccctcattgcgcaagcccacaatgggagcgggaagaccacctgcttcaccctggccatgctgtcccgggtggacccggccctgcacgcaccgcaggccctctgcgtctgtcccacccgcgagttggtcatccagaacgccgctgtgctggagcggctgggcaagtactccggcatcaccatgacctccaccgccgcggcagactacgccaccacgcgccgcgcgcgcatcaacgagcagatcgtggtggggacgcacggcaagctgcgcgattggatgagcaagcgggtgctcagcgtcgcggccatgaaggtcctggtcttcgacgaggcggacgagatgctcaaggtgcgcggaacccggcggcgggtggtgacatcgaacggggtgagccggcctttctctcgtcccaccaggaccaccgttgggccgcacccctcgggatggggtcccctggtttggccactgatcccaccagcccaggcgggttctcagcagacagcattgggcacggtgccattgtggtaggccacatgcattccctgctttccaccctcttgcagcaagagggcttcctggacgactcggtgcgcatgatgcggcagctgcaggcggccaacaaggacctgcagatcctgctcttctccgccaccttcaacgagcgcgtgaagacctttgcgcagaaggcggtcaaggatgccaaccagggaggggaggtgcgtcaccgccaagctcttcccctgcgcaacctttccatctctgaacctcccttggcaggtgtttgtccccaaggaggacttatccctggacgtcatcaagcagtatcgggtggtgagtcagcgataagtcatgtttggacagataggaacgctcccacctcgactgtgagcatctcgtcgcgatcctctggtatcacagtcgtttatccacgggccccgcccctcctcccgcagtactgtcctacctccgccgacaaggtcaaggtcctgcgtgacatgattttcccgcagtgcgagcgcctgggtcagaccatcatctttgtgcggacgcgggagacggcacgtgacgtgcacaggctggtgggctggcagagtatcaatggcatggcctcgccggctgtggacaggcacttacagcgcctcgccccgccgcccttccctcccgcacagatggagagcgaggggcataaatgcacctccattcagggcggcatggaccacaccgctcgcgaccgcgtcatccgggagttcaggtgcagggtttggggattgacgtggggcgaggggagtcaagacggcacccacagtccgccctgctacgggggggggcagggtctgagctgcaaagtgggaagccatgaaggggatggcaccaccaaaatcctgatcagcacagacgtgctttctcgcggattcgatgtcactcaagtatgcagggggagggaagggaagtttgccgcttgccgtgcccatttgcagtgcgccgctccagtagattcccctcctcgccacctggcttgcccacctcgcattcccctctgcccactcttcacaggtcacgctggtgatcaacctggaccttcccgtggagaaggacgtgcgcatccccgccttcgagacgtacctgcaccgcatcgggcgcagcgggcggtttgggcgcaagggcgtggccttcaacctggtcacaggggacacgtccctgatttttggcggctcgcaactccccatgcccaccagagtcgtcaccttaactccacaataacacacgccaaccaggagcgtcgcgtgatcgacgagatagaggcgtacttcaagcatcccatccccgaggtgccgtacgacaatgaggaggagtttgtcaacgtgctgcggagggcggggctgacggagcaggaggcctga

SEQ ID NO: 1126 - DNA, 2841 bp, Chlorella protothecoides
atggttgcccagcaagcgcagcaggccgtgtgtacgattctgcagtggggacctcgcgatgttcccattgggaatggcgagctctcagccagtgtgatattacttcaatctttgcgagctcttcagcaacgcgatgagtatcacacgagccacttgttgcatccgcaacagtatataacctaccttacactttgttctcaacatccgtgcctgctctgtatggtcttgagtgaggatgtgcatcccatggagtccgtcgtcgccgccatggccattgccgtccgggctggggacattgcaggggcagcccaacttgccagtcaggcctccttcccgcttgcaatctctccatcagatatcagcatagtatcggctctgacccatggaggccaggctactgtgtggagcgccgtgtttcgggatccctctgcctcccaagaccagccaccctcccttgtggccctcaagcgtcccagcctccgcaccaccaccgacctcgacgccttccgacgcgaggtccagctgctgggcagcctcccccaccccaacctcgtcacccttgtgggggctcgcctgctgcctcccggctacttcatgctgacggcgctggaagccgggggcgacgctgccaggctgctgcacagagagggctggcgcccctccctggccctgctgtgccacctggggtcacaagcagcgagcgctctgtcgcacctgcacgcgcacggcatcgtccacaggttgctttcggtggcgcaggggatgactttggacatgtgtgtcgcgtggggctgggtccctcatgacacccatggcagagccggggggggggcctccctctgccatggcaacgcgaaacgctctgctccaccacatttccccagcacccgtctcccaaccctgctcagggatgtcaagccggcaaacatgctgctggacgccggccgtgccttcctcaagctggctgacctgggcatcgctctgtgctcggggtcgaggcatcatgaggaggccccacgggcccctggcaccggccagccctccggcggcttccacaagctgcacatggtgggcaccctggagtacctggcaccggaggtgctgttgggggcccggcacacccccgccagcgacatctactcgctgggcatctgcctgaacgagctggctaccgcacagcttccctacagcgacgcggagcgggacgacccgctcatgcagacctgcctggagatggggtacagcaggtgtgagaagatgagggagaaaggaataaagtggggtggggaggggacaggggtggcaatgaagtacacccaggctgtccgtgctgtttgggagccactgtggagcagcagccgctgctctctctgggctccctccccttacaccacctcgtgtccctctttcctgggcctcatggcaatgccgccccacacgcacaggcaggacctgcgcgttgcgattgccagcggcggcctcaggcccagcgtggccccagatgccccgcccgagctcacccggctcatcagccagtgctgggtggcaggcgcgggcgagaggcccggcgcggcgcaggtggcccaggatctcgcccgcctcgccattgagctggcaggcaagggggaggaggcaggggccccgcggggcggctcgccaggtcctcccgtacttgtggccggggagaaggccgagtcgttcaggcacactccctctccactggaaagagggactgacgagatcgctaccccagaaaacggcggcctgggtctcgtcccgccatgggtccaggcctacgatcgcgatgggccagggcacgctcagccaggggcgccgctggggctgggagccaaagccgtggccggccggaggggggaggaccggatggaggaccgccacttcatcctgcccgacgtcctgccgcgaggcgccccggggccgccgcagagaagccgacacgcgctgctgggcgtgtttgacgggcaccgggggccccaggcggcacagtacctggcggagcgcctgccgggcctgctggagggcgcgctgcccggcagcagcggcgcggcggcctggctggcggccggcctggccgccgccgatgcaggcttctgctccgagtggggtgcaggtcgtgagaggtctgcgagggggggcgggccttgcccggggtccaccgcgctgctggtcctgctttcctgccgccgcgcggcgctggcctgggtgggggacgggcgcgccgtgctgtgcaggggcgggcgcgcgctggcgctgaccgccgagcatacgccgggactggagggggagcgggcgcggatcgcgagggcgggcgggcggctgacggggcgggaaggaggcctcaggctgggcgcagcggggctcagcgtgtccaggctgtgcaccagaggccgtgggagcaccaaacccaccctattcccacctcgcccttcaatccccagggccatcggcgacctggacctccggcaggacggcctgatccccgatgccgacaagctggaagtggacctccgcccccaggatgacttcgtgatccttgccagcgacgggttgtgggacgtgatgacgaatcaggaggcggtctgcctggtgcaggacacggtgaagcaccccactatgtgcgcccagcatgtccctacttaccagggacatggtgggtgccctgtctttcaagtgccaaaccagggatgtaacctcccgtccccatcccttccccctcaaccttggacagcggctggtggaggcggccctggcgcggggatcgggggacaacatcacctgcattgtggccatgctggggctcggggaggaaagcatgcatga

SEQ ID NO: 1127 - DNA, 747 bp, Chlorella protothecoides
atgctcgcaggcgcccaccacatgcacgcttgtcgatcgcgcctcactcgggcaatggcagcccatcgcagccccagcatgcaaatggtggatgtcactgtggacctccggcacagttccccccccggtggcgccacgtgcgtcgacacgagcgctccttcagtcaccgccccccctccacatccccctacaccccggtttccccaccccccgcgtctcccgctcctacagggctacctccaggccaccgaccacgtgggcctgaagatcctgcagggcacgccctttgcctcgggcgtgttctcctgccaccagaactggctggtgggcgtgcgctggtcggaggtgggcgccagcgaggcggtgttgcgcgccgggttcaacatcgggtcgctcatgctgcgctacgctggcgtggactggcgggacgagggcgtgtggacctgcaaccgcggcatgaacccgctgctggaccgcgggtacgacggcgccaatgcgcacccgctggaggtcatgtttgtgaaggtgcagcaccaccaggtggtcacccgcagccccgcggtggtccccgccctgcagtaccacgtctggcgcctggagaaccggaccgcgggcgcacgcgacgtggcacgcaacgccttccacgacatggcgggcgtgcacctggcgggcatcaccgccaaggggcccgcctgcttcgacgccgagatgtacatcgccgccgcgccggcggagtttgcggggtga

SEQ ID NO: 1128 - DNA, 2955 bp, Chlorella protothecoides
  modified_base (205)..(214): a, c, t, g, unknown or other
  modified_base (705)..(714): a, c, t, g, unknown or other
  modified_base (2578)..(2587): a, c, t, g, unknown or other
atggtctgcccccacaccaccgccgcggacctccccgacccggcgccgacctgcgcggtcctgcgcgcccacgaggcggcgctggaggcgctgcgcacgctggcggcggcgctgcagcgcgccgcgcccccgggcgccctgcgctcgccgccctcgccggccctgcaccgcagcctggagatcctggcgaggccactggatgccnnnnnnnnnnggcgccctgcgctcgccgccctcgccggcctcgcaccgcagcctggagatcctggccatgccactggatgcatcgcgcacgcggggcgccagcctcgccgacctggtggtcgacggggagctgcggagcgaccaggtgggccgaggcggctggccgccgccccctcgcagtcgtcccctgcctcgctccttcacgtaacccctctcgatccccctccccttgcctcccaccccgcgcagctgccatcggagtgggtcgtcaaggcctacacggccaagaccggcgccaaggtggagttccgggtgggcctgggaggcgtccccggcgcccccggcccccttgaggccatgcacgagctgcgtcgggcggccccctccgcccctcgcccgccgagccccgtggcccgcccaggctctacagggccccctccggctgaccctgctctccgacctccaccccaccgcaaaagccccctcctcccctccccgccnnnnnnnnnngcccgcccaggctctacagggccccctccgcctgaccctgctctccgacctccaccccaccccaaaagcaccctcctcccctccccgctcccgcagctgcgcgccgcgtacgcgtgcgggtcgctggaggggcggcgcgcgctggtgcgccagcgcctgctggccagcgcggtctacttcatgtcgggctccacgcccggcgagctggcggcgcactgctccgccgacccggcctttgcgagcgagctggtgggcctgctggcgcccagggccgggggccccaccgtgccggaggacatccaggtgctggcgctgcgcgccgtggcggcgcagatgggcgaccggccgcgccacgcggcgctggtgcccagcctggctgccggcgcgccggactcggtgctggcctcgatactgggcagggtggcggccgcgcttgggggctcgagcgacggcggtggtgcgcgcgacggcggcgcgggcggcatcgtgggcgcaggcgcgggccccacggaccctgcccctgccacgggcaccgccgcaggcccatgcgacgccacccacacaccggccccctccggcgactcgctggcgtgggtggacgcggcgctgtcggcggtgggcgcgcttgtcagctgctcccccggctgcgcagcgctggaggctgcgggcctggtccccgcgctgctgccgctggtgcgcgccgcgccctcggcgctggcgccgcagctggcctcgctggtgcgcatcgtggagaacttcgtggacttcagcccgggcagcgccgcgctgttccgcgcgctggacggcttcgacgcgctggccgagcgcctggccgccgaggtggcgctgggcgtggcggaggccgcggctcgcggtgtgggacctgcgccggatgcgccggggggcggaggagggaatggaggagggggcgccgccgcgcaggagggtgagggcgccgggcccatggaagccgctggggaaggcgcggggccgacgccgggcgacggtgacgcgactggcgtcgtcgcagcgacgtcagccgcgacgccgccagcccctcagcccgccgcacccgccgcccacccctaccagccaggcacgccctccccgcgcctcatcccctacaaccggcgcctgctgctcaaggcgttgctgcgcggcgcggccatggcctcctacgcgccgggcgcggcgggcggcgcgggcgacacgcccgcccacctggccatgtaccgggccctgtgcgccatcttccgcgccgcgccggccttcggcggcggcctgttcagcctggccgcgtccctggtctccgacctgatccaccacgacccgctgtcctaccgcctgctggaggccgcgggcgtgccggaggccttcctggccgcgctggccgcgggcgtggtgcccagtgccgacgccgtggccgccgtgccgcagacgctggtcgcgctgtgcctgaacgccggcggcctgcgccgcgtgcgcgaggcgcgcgcgctggactgcctgctccccgtcttcacgggcgaggcttacctgcgcgcgctgcagggcgagtcggccagcatcctgggcgccgggctggacgagctggtgcgccacgtgccggagctgcgccccgcggtcgtccagctcgtgaccggcatcctcgagcgcctctgcgagctgggcggcgggagatccgtcggcgcaggtgtcgcacgaggcggcggtggcggcgaggcgccggccgccgcgcgggacgagcagcgccacggctccgacgccatggacgtggatgggccccccgaggcccagggcgccgccgccctcgaggcccccgcgctcgccgccggagcctccgccccggctcctgccggcgccnnnnnnnnnncagggcgcccccgcccccgaggcccccccgctcgccgccggagcccccgccccggctcctgccggcgccggcgccgccgcctcccccgacggctacctggtggagtgcgtgaccttcgcctcgcgcatgctggagcagctgctggcgctgaacgacaccgccgcggcctttgtggaggcgggcggctgcgagctgctgctggcgctgtaccgcctgccgcgcctgccgcccagcttcggctccaccaacgccagccacagcctgctggtcaccttccgcgtgtatgccacgcaggggccggccctggaccgcgtcaccggcctgctccgcaccgagctcgtgcgggtgagaggggtgatgggggctga

SEQ ID NO: 1129 - DNA, 1731 bp, Chlorella protothecoides
  modified_base (13)..(22): a, c, t, g, unknown or other
  modified_base (1136)..(1145): a, c, t, g, unknown or other
  modified_base (1562)..(1630): a, c, t, g, unknown or other
atgggagccttcnnnnnnnnnntgacatatttcagtttgattacagttcttttggagtcgtttgagtgccctgagcggcaatgggagccttcatcatgccgcttgtctagtgattgcatgggggggcgcgatgtcggaaaaatgatcatgctcgagagggcgcgccagcccgtactgactccgtgtggtcagcccctagcagctcgcgatccatcgacagatcacccaaagcgtcatcgacccaccatccacatgtcattcgccgagaaggggatgctaagggccccgggccccagcccgtcctcaccatacttcacccgcagcaaggttgtcaatgactacaaggctgccggggtgcttcccatcgccctttatgaggataggatcctggtcctgctcggtgctgagctggagcgcacgggcccgaagggcaagtacctgaagtacctgtggcgcgacttcggaggccagcgcgaggcctgcgacgaggacagcgccgccacagccgcgcgcgagtgctcggaggagacgctgggcctgctggcctcatgcggcgtggacgcgggggccgtggccgccgccgccgccgcgctgtcggccacgctgcgcgacggggcacgcagcgtgcgtgtcgtgcatgcgctgcgccgcggcgcctaccacatgtttgtcgtgcaggtgccctacgtcaccgccctcatgttccgactcgcctccgaccagaacgcggcgaccgcggccgtggcgggcgcggagaagaccgccttcgcctgggtccccctgcacgaccttctgcgggccgtggcgcgcgccgctccggcctaccacctgacctgccgcggcgcggtctgcggcggcaggggaacgccgccctgcggccccgccggagtgcgcgccttccccctccacccctgctttgccaatagcctgagacgggcctggtgggaggggggcctgcgccgcctggccctgcgctggccactatgctgcgacggcgacggcgagccggcctgtggtggaaggaatgggaacggtcctgaggacagacacaatgaatcactcacgcagccggccttagtcccgactccagtgccaaaggatcagatggcaaaccccccggttgccggcagcccagnnnnnnnnnntggcgagctggccggcggtggagggaatgggaagggtcctggggacagacacaatgaatcactcatgcagccggccgtagtcccgactccagtgccaaaggatcaggtggcaaaccccccggttgccggcagcccagccccgccggacacgccctgctcctcggaaagcacaaacatgaggggccgactgaacagcctggtgcactgcctggcgcaggccgacgtcgcggcggcgctggagccgctgcgggaagcgaccatgcgaccactgcccgcccgctcctctggccatgcagcgaggcacgggcagcgcctgggctgggcgatggaggcctggccgttgctgacagcggcgccgccggtcaggaaaaagctgagccggaggcagcgcctcatcaggaagaggcggcggtgggnnnnnnnnnnnnnnnnnnnnnnnnnnnnnnnnnnnnnnnnnnnnnnnnnnnnnnnnnnnnnnnnnnnnncctcctccatagcgctgcgccatgatccagtgggactactggcggactgctatatcgctggccaccctccctcttacagtgccattcccactcccctgtag

SEQ ID NO: 1130 - DNA, 2454 bp, Chlorella protothecoides
  modified_base (767)..(776): a, c, t, g, unknown or other
  modified_base (1148)..(1157): a, c, t, g, unknown or other
  modified_base (1336)..(1345): a, c, t, g, unknown or other
  modified_base (1434)..(1443): a, c, t, g, unknown or other
atggacgaggcagcggtgggggggcacgccgtcctcacggccatgctgcagcgggcggggggcggggcgccggggagcagtactcggcccctgctgcagtacgcagcaggcctgggcaacctcgcggccgtcaggatgctgctgggcgacggcgccgacgtgaacggtgggtatggacgccatgctggatgcatgctgaggggcactgcaaacgacggtacaacggcgctgcatgcggccaccctggcggccgacgcagactgcgtggccctgctgctggaaagcggcgcggccgccagcgtggcagacgccaagggccgcaccgccgccgacctggccgaggagcaggaccgccaggcggcggcgcgcgccaaggaggaggcggaacggccccccctggtgaggcccggggacgcgcccaacccgcccccgctgtctagggcggcgctggcccgggtgagggccctgctggcagacgccggggcgcggcggcagcggcgccccgcggcggcgagcgggagcagcgacgagcaggcggccgcgctggggccccgggaagcattcctggccctggcgcccggcgacaggctccgcaaggtggagcgctgggcgtccctgccgcccgatgacctggacgccgtgctggctgggttcgaggcggccgtgcaggcggaggtgcagtcccgcctggaggccctgcgcaccacggccgctcacctgaacatccacaaggtgcctttggaggggaggtgggagagggagctttnnnnnnnnnncggccgctcacctgaacatccacaaggtgcatttggagggggggggggagagggtggttggattatttgtggtggtccacgatggagggcaatgtgccttcaatcgcacatgggcaaagtatctgagggccctagctggctggcagcaggtcctgggcctactgcatcccgccatccctgccgtgcatggcattgcatactctggctgcccatggtacggggcacctcgcggtgtggcaccatgccagcttcaggcgctcctcggccgtgcagcccggcaatcgacataccgaaaacagggtggccacaaacaaaaggccttggctacttgcctcagcgcactgtcccctcaccaaggacacccccttcctnnnnnnnnnnggccgtgcagcccggcaatcgacataccgacaacagggtggccacaaacgacaggccttggccacttgcctcagcgcattgtcacctcaccgaggacacccccttgcccatcgcccaggccatcacggcactgcacgaggacgaggagttccaggcggacgctgctcgccccgaggtannnnnnnnnngcgcgcatgatgtcgcccatgcccgtgcctcccatgaacatggctctgtgctctgtgggcggggcccgtgcatgtttgacgtgcaggtnnnnnnnnnnccagcctgtacgactcctatgcacgtcagtcagggcccgggtggcagtggcctggtttgggtgcttgaggcgcgcatgatgtcgcccatgcccgtgccttccgtgaacatggctctgtgctctgtgggaggcgcccgcgcatgtttgaagcgcaggctgccgccagtggtccccgccctcgcccaggagccgctgccggcatggattcaggctgacagagccctccccgctttcctcccaggcgaccccgtcatgctgtcggtgctccagaagctgcgtcgcgtgcatgccgtctcctcggccaacaagcagcgcaccgtggacctggacctgctgctgaacacccccggcgagccccgccagccccccgacgcggtcctcctggcgcgcatggaggcggtgcgcgcagcgcacctggccgcggcggccgcagccgtcgtcgcgccggcgaaggcggcgcaggcgcaggcgcgggcgatgtacgatgccgtgctggccggcgcggcggaagcggcgagtggagaggcctcggtcgacggtgcaacgacgggggagagtttggtggggcaaatggccggcacgccaaaggaagccggcgcggacacatccctgcccgacgagggagccggcgcggggcccgaggcggcggcagccccatccgcccggcgccgtgtacactttgccgaggggtccaagccgcctgcgagcgaccccggacccagcacgagcggcggcgaggccccgtcccggccggcgcggctggcccgcaccggcggcgacgacggctcggaggtcccggactggctgcgcgacggcttctcctggccaaaggtctgggcggagctgtggcggcagtgccagctggccctgctcatcctggccgtcttcctggtgacctccagcgtcctgcgtggcaagctgccctgggcagcgcgggaggcgggcccgggagaccgcgatgcgttggacctggccggcctcctcctcggccagggccggggggagctgtag

SEQ ID NO: 1131 - DNA, 429 bp, Chlorella protothecoides
  modified_base (413)..(422): a, c, t, g, unknown or other
atggcgcaggtggaggccctgattgagcggggggcggagctggactgccgggaccgtgccaagctcacccccctccactacgcggcgggtcggggcaggctggacatcgtgcgcgccctgaaggcccggggcgtggacctggaccccgagtcccccgacgggcgcacccccctgcacctggcagccctgcggggccacgccgccgtggccggcttcctggcggggagcggcgcctgggtgggcgcctttgacggcagcgactccacgccgctgcacctggccgcgcggcacggccacgaggccgcggcgcaggccctgctcagccacggcgccgacccgggcctgaccaacaagtttgggctgaggccggtggacgaggcggcggtgggggggcacgccgtcctcgcggccgnnnnnnnnnnggcctga

SEQ ID NO: 1132 - DNA, 777 bp, Chlorella protothecoides
  modified_base (155)..(164): a, c, t, g, unknown or other
atgaggttgtgggaggaagtgacagtggtgagacaacttttcgtgaaggggcctggcctgaaaggccttggaagcacgcatcacacctactcaccccatcctcatcccccatcccccccaccccaccccaccccacccacacacacacacaacgnnnnnnnnnntactcaccccatcctcatcccccatcccccacacccacacccacacccaacaaagcccatgcaaccccggctctgccttcaacctcctccgcctcaccttgggctcacagctgtccaggggcgcggcgcagatgttgaggtcgccgacgacgagcacggcgcgcccagcgcgtgccagcgcgtcccaacgcgcctgcagcgcggcgtagaagcgcagcttgaacgcgaagcgcgccgccgccgcctcgtcgtcgctggacgtgatggcagggccgtagaggttgaagaggacaaaggcgccgtggtcggtgaccacgcagcgcccctccccgtccagctcctgcagctcctcgggcatcagccccagggcctcaagctcggggtggaaagcgaggaggccctcggggtcccccgcccgccggcccaggcagccggtgaggccctcctcgctggcaaagggcagcgcaacgcccgtgcgcacgtaggtggccgtgccgctgtaccccctttctttctgcgtgcacgcgaaaaaagcgtccctggggcaggttgcggtgggagtcggttgagaggtggggagggtgggccgggagcaggggcggcgcttgtgtga

SEQ ID NO: 1133 - DNA, 768 bp, Chlorella protothecoides
  modified_base (672)..(681): a, c, t, g, unknown or other
atgcccgacggcgggacgcgagcgacgctgaaggccttcttcaagcctcggacgccgggcgtcgcatcgggtgatgacccggcgagcaccgatgcggaagcaccggtggagggagacccgggcggccacccagggaccacgacccagccatcaatcgcgcatcctgctctttcagaccttggaaagcccggtcacggcttggcgggggaggagcacggcgccacgccgccccacccaaaccgggcagagacctgcctggcagctgagctggcagccgcccgcgaggcgcacgagcgacacctggcggcagcgaaggaggcgtggtcgcgcatcaatgggcgcatggcggcgccgcggtgccggcatggggagcctgccgccctgaaaaaggccaataagaccggggagaaccgaggcgaggagggatgggaagcccattaccctggctggaacacgctcgctgctgttgaggggcccaggggagatggttttacacctgtgcacggcctgccgggcccccaccacatggcgactgcaactttttccagtgggtggagaagaggggtggatccagtggccctgccatcgagaagcgcttcaagggggcgtaacggcgtgataaccgctgagcactgctggcaggagatacagacagccacaacagggaatggnnnnnnnnnncgttgggggggagagagggaggagctcgaggtggtcgctggcaggatgggaagcccatcaccctggctggaacacgctcggtgctga

SEQ ID NO: 1134 - DNA, 354 bp, Chlorella protothecoides
atgctgtcctccagactgccggccttgctctgtgccagcctgaaactccagcccaggctaccgcacctacacaatgcgttctccctcaccagcctcctgcatgggtccgcatcgcctgaagccctgacagacaacctgccagacagcattgctctccaggacggggtcagcctgcgacgaccgacggagcctgagccttacgagtgctgtggtcgcgggtgtgaatactgcgtctggacgctgtactgggaggagctgaaggagtatcagcaagaagtggccaaggtgcagggccttgaagtcaaagagaaggatccattcgaggagtttgagaagcggctgagggggggttga

SEQ ID NO: 1135 - DNA, 987 bp, Chlorella protothecoides
  modified_base (76)..(85): a, c, t, g, unknown or other
  modified_base (619)..(628): a, c, t, g, unknown or other
  modified_base (714)..(723): a, c, t, g, unknown or other
atggtagccgcacagtcccagaaggctctcggtcgtgctctgagctcaggaccagctcccattgcagccgggcctnnnnnnnnnncgcacggcaccgccgtgggcctgcccagcgacgccgacatggggaacagcgaggtgggccacaacgcgctgggcgccggccagatcgtggaccagggcgccaagtgcgtggacaagttcctggagacgggggaggtgtggagcggggagggctggagggccatccaggacaacgccaggggcggcaccctccacctcatcggcctgctgtcggacggtggcgtgcactcacgctacgaccagctccagctgctgatcgagggcgcggtgaagcagggcgtgcggcacatccgcctgcacgcactgtccgatgggcgagatgtgggggagaacacggtgggtggcaggggtgtgcttgggctgtggaggtgggtggatctgaaggggcttagttttgggctctggctgcagacacaagactggcgaggaccgatcctggggttttactcatgtggggtggaccaaggcgaggacttctattgttgccacccttggggttggctgcaacggacctgcactgagtctcggaatccannnnnnnnnnaagttcaacgccatccacgctgcggagacgccggcgatggacgggctgcgcgccagcgcccccggccgctggcgcctgatcaaggnnnnnnnnnnggagggcgcggtgaggcagggcgtgcggcgcatccgcctgcacgcgctgtccgatgggcgagacgtgggggagaacacggtgggtggggggggtgcgcttgggctgtgggtgtgggtggatctgaaggggcttcgtttggggcgctggctgcagacacaagacgggcgagggccgatcctggggtctcactcatgtggggtggacccaggcgaggacttctgttggcgccacccttggggctggcgccaacggacctgcactga

SEQ ID NO: 1136 - DNA, 642 bp, Chlorella protothecoides
atggccctcctgcatcgagacagggcgcgcgggccaggaggtgcctgcgcgggactcggcactcccagcggctccggccaggtggtggacgtggcgatctcggagtccatcttcaacatgatggagggtgcggtgccggagtggtttacgcacagggcgatccgcccgccctccggcaccacgctgacaaacgtcgtgcccagcggcgcatggcaggcccaggatggaaagtacgtcatcattggcggcaacggcaacagcggtgagtccatgggggtggatcgcattacgggctggggtgcccgcaggggcgcaggagaccctgcctcgcattgcacctgcgacttgagccccgatcagtatcgacagtcgctgccacccccaaaagttacccctcccctcccgtttaaagtgtacaaccggctcgtggcggcgatggggagggaggacctgggcctcaccaacccccgcttcgccaccgacgccgttcggaacgagaacgaggaggagctgaacgccgtgcgtctcgggattgttggcgggtatttgtgggtgggctcggggttgcaggcgggcgtctgtgaggggctgcaggggtctgctcaccttgctcctctcttccccgctccgtgctgcccttga

SEQ ID NO: 1137 - DNA, 480 bp, Chlorella protothecoides
atgagcgttctcagagcggcgcgagtgcccgccgggcccatcctgaacatggctgacattgcgggggaggcgcagtaccaggcacggggcatgttccagccagcttcccctccaggaggtaggccaaaggaaagaaggaagaggatgcaccctgccgctgaccagggagcgccttgtgaggttatactgccctctggcaagctggtcgctggctgtgcttggcacgcggctgcgtgcatctggggcggcgagactcgggctggccggtggcgaggaggtggtgctgccggccatgagccccgtgctgggcggtacaccaggcaggacgcgctgggccgggccgggcctgggccagcacaccgaggaggtgctcagggaggagcttggcatgacgcaggaggaggtagcagacctgaggcagtcgggggcgatatgaatcctgtggtgactgactgggcgtgcttgtccgcaaaactctga

SEQ ID NO: 1138 - DNA, 348 bp, Chlorella protothecoides
atgcctccctgcctccactcaacctcccagccaccacgcacacacaagcaggcggtgaagtgggtgaccaaggcccagggtgacatcgaccgctggaattctgagcacggcatcgacatccgcatcgccagcggagggggcaggatgcacgtcaccatggaccgctacgagtctgactgggccgtggtcaaggccgggtactacgcccacgtattgggcgaggcgcccaacacctacacctcggcgatcgacgctgtcacggacttgaagcccgggagggacacatgggatcatctcaagtctggattatgtgtgcaaagcgcccgccgcctcgcccacctcacctag

SEQ ID NO: 1139 - DNA, 621 bp, Chlorella protothecoides
atgcgggtgcatgcgggtgtttctgtgaagcaggcctggctgtggcaggtggcctttatgcacactcctcatttccaatcccagaatccggcttcaaatgtgagcgtcatcacacaagcgccgcccctgctcccggcccaccctccccacctctcaaccgactcccaccgcaacctgccccagggacgcttttttcgcaaagaaagggggtacagcggcacggccacctacgtgcgcacgggcgttgcgctgccctttgccagcgaggagggcctcaccggctgcctgggccggcgggcgggggaccccgagggcctcctcgctttccaccccgagcttgaggccctggggctgatgcccgaggagctgcaggagctggacggggaggggcgctgcgtggtcaccgaccacggcgcctttgtcctcttcaacctctacggccctgccatcacgtccagcgacgacgaggcggcggcggcgcgcttcgcgttcaagctgcgcttctacgccgcgctgcaggcgcgttgggacgcgctggcacgcgctgggcgcgccgtgctcgtcgtcggcgacctcaacatctgcgccgcgcccctggacagctgtgagcccaaggtgtga

SEQ ID NO: 1140 - DNA, 333 bp, Chlorella protothecoides
atggtggagatcagcaaggccctggaatacgaggagtttgaccactttgaccgcaagcgctggcccaagatcaagtttgcggggatcatgcagtatgacggcgagcttaagctgcccagcatctacctcgtccctccacccctcatcgagcgggccagcgagcagtacctggtcggcagcggggtcaggatatttgcgaatggcaatcggtcgggatacctcgacaagaacctggaggagtttgtggaggtaaatggtgtgggctggtgcagggaagcaatctttggaggaggactacaccatccaattgctggggactttggcctgtgttga

SEQ ID NO: 1141 - DNA, 639 bp, Chlorella protothecoides
gcaggtgtgccaccacatgtgacctgcgtggatgaacgtcaccacagccctgcggggtggggcaggctgatcaggctcacagatgcagctgccagccccgaccggcaccctccagctctgcgaagaccctcccccctggtccccggcgtccaacctgctgcgcgcgctgcgccagtcgccgcaggcccttgccctgggcctggtggagggcgtggcgggggagcgcggcgcgggcgacatcgaggtggaggccaccaaggagcggtccctggcacgcagggtgcaggcgctgtcgcgcttcctcctcgaggccctgcaccgcgagctgggcggcggcgcgccggcgggcccccgcgccagcgccggcacggccccgaggcccgaggccaccccgggccggggcccaggccccgggccggcgcccgcctcgcccgtgcaggccgtgttcggcatgcgcgtcgcctcccagctggcctgcctggacccgccgggccggccgccgcagtcgcgcctcgctcagcgtcaccgccgacatgcgtgcctggttcgacccggaggtgcagtacacggcggtgcgccagcgcaggacggtcaccgtgccgccccgcgtcctcatcatcagctgcggggacgtggtga

SEQ ID NO: 1142 - DNA, 1125 bp, Chlorella protothecoides
  modified_base (96)..(105): a, c, t, g, unknown or other
  modified_base (833)..(842): a, c, t, g, unknown or other
atgtgccatcccgggattgacacacgaagggagcttgtctcaaaggggagagatcaaggtgcagatgtactcagagcaaggacatgtatgctcttnnnnnnnnnncccggggtggagcccaagtcaggcccaacaacatcttccaactgcgggcttcgacaacagcaagtgaaagaaccccaccctatgacaggggagagatcaaggtgcaggtgtactcagagcaaggacatgagccttctagatgtcagtattagatccgtcaagccgcgtgtcgtcggtgaggtgcagaaagagttccacgcagcctgcagcttcgtttgtggctggtggcgcccctcagaccctgcgcgccgcgcttctcgccgacggcttcgcatttcttacaagattctggcggcgcccgtcgctgtcggcgcgccgcgcttcttgccgacggcgtcgcatttctcgctagaacattcatgtaacgattgtcagggctgggtcctgacagcaagtctctgtgttgtgtgggatcagggattctgcatccgaattctatgcatggactggtgggacatacatgtcaaaggaggacccttggttgacatcagcgtggtcgaaacagtcctgggaagtggaggtgccgaccttctttcaccctttcttcctgtgtccgggcctcgaactcggcccctgaaactgttgtggggcgccctgtttggggccctccccccactttccacctgcatccgtgccctgtgccatgccttcgtcgcctggtgcaatgtcttaacaccaaagcccctcaccgtattcgggatctcgtctgtaacattcgtcattcaatnnnnnnnnnngcgtgcagatgccgaaaaggcgtacgtgcgcaccaccagcacggcgtgcctgctgagcgagccctcgtcccgcgtggccgtccagctggcgctgctcatcagcaacctggcgcgctttgacgtcccgcggccctgggacagcctcgtcggcgacctggcagcctcggcgggcatggacagccccacctcgctggagtcaaagctgcgctccctcagggccctcaagcactgcgtccgcggtctcaagggtgagctgcggcaggggagagtgtggggctgctga

SEQ ID NO: 1143 - DNA, 399 bp, Chlorella protothecoides
atggatagcatcaaccccgcctcctttgccatttgcaactcccgtgccacgccggggtgtatggctataggtagcatccagtgcctcccaaacggtgtgcctgcgtgtgccatggacaaggatcacaatatcgggactgggaacactggcaagtataacgtgggcaacaacaatgtaggagatcacaactacgggagccgcaatgttggcgacggaaatgtggggaatgagctgactggcgactcgctcttgtgcaacttcgtccggagtaatgatcaatgctaccgcaactggctgatcaccaaagatacaatcaccttgtacgctgccgtaccgccaccgccacctagccctccaccccctggggagtactgtgaccctcgaaacaagttctttgcc

SEQ ID NO: 1144 - DNA, 336 bp, Chlorella protothecoides
atcgccgcgtggcgacaaaccaacggaatgtccgatcatgtcgggagacacatcgagcacgcaccagcgcacacaaacacgatctgcgggcatctgtccatggcatgtgcccaacctttcatggcaaatcgaatctcctcaacctccacgctcaggaccctgcttcgtgcacggctgtgacgacatcggagtctgcaagcctgccaggcgcggcgtatcgagcctgccctgcagatgaggcggttctccccaccattggcctactcctcacctccagtccccagctgaccagctacattgctgcgctgcgcacagcaggcttgggtaacatcccgg

SEQ ID NO: 1145 - DNA, 627 bp, Chlorella protothecoides
atgggcctgctgcttctcgccgccctcatgttcccttgcatgccccacgatcgaacaggacagagtcaaccctgccctgcaccgaatcacattccccccacccagcccccaccatccctgttcacatctcaatctgcccccctcccccggcaggtgacgcccagctgggagcgactgaccgcggccattgaggcagacacggaggtccgagaccgcctgggatgggtgcgtgaaatgtatgccttctccctggccctggtggagaccggtatcaaggtggagctgcggagcgaggggcagagccccttcatcgcccacctgccgggccaggctgggctgggcgaggcgcacgccttccactacaccctctgcaccatctacaagaccatggacggcggggacgcgtggggcttcgacaagcgcttctacacggagccgcagcacgcgctggagctgacgcgcatcccgcccatgcccgagttcgaggcgggcaagtacaagttcgtggaggggccgccggtgaccctggagaagcacaacgccatcaagcagatgatagaccagatcaacaagggcatggacctggcggtgcccctgcccgaggcagcaaaggcgcgggccttctag

SEQ ID NO: 1146 - DNA, 369 bp, Chlorella protothecoides
atgattgagtccgactatgtcttcatgaagccgctgggcatccccagcaccccgccagagggttatgcaggctgggcgtttcccttcaattacatcaacccaattgccgtcccggtgaggcatctctggggcttgccctttggctctgggaatggtcctgagctgtccttcccagcatggtttctgcactctacctccccccccattttcctccctcttcctcagaatgagatgcagaaactctctccgggtgtggatgtgaagagcattccccccactggacccgcacccattgtgctcagcctgcaagactggatcaaggtgaggccacctgcccagctggctggggcaatgccttcatcagcctaa

SEQ ID NO: 1147 - DNA, 1317 bp, Chlorella protothecoides
  modified_base (267)..(276): a, c, t, g, unknown or other
  modified_base (1164)..(1173): a, c, t, g, unknown or other
atgcaaatgccgccccgccctccaacccctgcgcctcacccgcccattccagtcggtgttttggagtttgccagaggcaagcaccaccaggatggacttgacatccactaccactccaacgggcgggtcttcgtcgctgctgaggaagaccgaattctggatgtagatgttggtcagcttggccgggggttcgccggatgtctgccaaagaacctccttggagctgctgacggcatagatgtgcagggtgggcgtagggatcgctannnnnnnnnnggctcgtctggtgggttatgggttgggagtggcgaacacaaaggccccccccaatcccacccacccccgaatctggcagtccctcgtctaccgagccccatccccagctcaccaccagagccagacgacgccttctctggcaccatgctgctgcaacatgctccccctcgtcctcgaggtcagcaacagatgctggtcggtgaatgtagtgtcgacaagtccttcagaaggcggcacctcccccgcatccaggcattgggggaacccataggggaagtacatggggccgtggaggccagtgccccaaagtcccttctgatctacgcagcaggggccatgatcacaagaccatcgcgacaacacacatggaatatcgtttgtggcgacgcaatcagcacggtttgggcctcgcagcggactgcatcgcaggcgagtcacgatctgggattctggggaattggggatgctcgcactgctgcgctccgctgccaacccttcaaccctgcacctcactctgcgcttcaagactctactcggttggcaaggggctgcgaaattccagctttgacactctcaccttgcaacggtcaccccagaacccttgcgacgtatcggtgtagaggccccacatatcggggttcttcaggggcgcgtagcactcctgacacggccctcccatggtattcatctggttcgtggacgtcacatacctgtttttcctcttccagaacatctcgccctacttctggtcgagcctggggatcgccctgtgtgtgggtctgtcggtcgtgggagcggcatggtgagtctggggccgggatcgcgggtaggatcgcggggagcgcacgggaagggggtgcatgccgcaattcaaggtctcgatggagnnnnnnnnnntggggccgggatcgcggggggatcttcataactggcagtagtctcatgggagcggcacaaagggtgccccgcatcacctccaagaatctgatcaggcaagtgtggggagagccatgggagggggccccatcgtccgtgtcatag

SEQ ID NO: 1148 - DNA, 1098 bp, Chlorella protothecoides
atgtgcccgacccccacatgcgatctctggcgggcgctggtgggtggaagagcgcgccaggcaggccgggaggggatgctcaccccagcgtcccatcctcagagcgaccgtgccccgcccttcccgatccaccacagctacggcggcggccacggcgccccagtctgcgctctggttcccgccgcagaggccggcacttgcctgtcctcgtgcggaaaggagggcacggtgctgcactggaaaggcggcccagaggacggcctggaggtcggcgcgcggcaggagctcaaggcgccgtgggccgcctgggtcacgtgcgccgccgcccgctcccccgaccgcgcctgggccctggggagcatggagggccggctgctcgtcgccgcgacggaccagtctgcaccgagctgctccgccgctggtccccacccggccccgctcctgcaggtgcggcagggctggctcggggcgtgcccggtccacagcccctgcctccctcatgcaggctggaagcatgcctgggctgttgcgcagtggaatgggggcctgtgctttgccaagggaaggggccaggggcgggcaggggccaggggcggtgccgcccaaggcacagacctcgaaacccccagcatctgcaccgattttgctgtgcagttggcctggcacccgcgccggcagcacgtgctgctgagcgccgatgcgaggggcacgctcgcgatctggagcgtcgagtccgcaaaggtgtgcctggtatggtcccgctctgggcctgttgaggcagccgcctgcgtcgcctggcacccactccaaggcacctgctttgctgcgggcggcgcggacggcaaggcttcggtgtgggacctggcgaggtccacccgcttccccctgtcgacctcgaccctgggctgccccgtcacgaccctggcgtggtctccagacgggcgggcgctcgtgtgcgggggcgaggctggcgcaatcacggcgcttgcctggtctgcccctgatctgacagagggcggcagccaggacggtgcagaggggaacgatgcggtgctgagggtgctcactgagtcacgacacgagtcatcaaggatgtga

SEQ ID NO: 1149 - DNA, 816 bp, Chlorella protothecoides
atggccagcggcgcggtgcgcctgcgcgtcggcgaggccaacgatgggcggctggtgctgctccagctgccccccgtcctccccctgctggtgccctccggcgcgcccggccccggcggcgtggccgtcgacccccgccctgctgcgctggcggacctgccgcagacgctggtggggaagctgcaggccagcggcgcggtgcgcctgcgcgtcggagaggtggcgctggagctggcggcggggacgccgtgcctgcacgcgcaggaggtgtgcctgctcttccccgccgcgcggcaggcagtgtcgctgggcagcctgagccagcgcatcgtggcggtgccggatctaggggcgctgctcaggcgagcgagggatgaggtcccgcgctcgatcacttgttgctcgcggaggctgcatggcacagggcctgctgcgcatcccgcgctgcaccccgctgcctcgcgtcggcgccgtatgccaccccgccaagacaccatgtcctgccttcccaccctggaccccccccacccccgcctgcagcgaggagccgctgccggagtaccggaagtcccccgcctgcctggcgcgggaggggaaggaggagggaggccccggcgaggacaggaatggggaggggttgccaggggggagtcacccagctcgcccatggaggtggacctggtggaaggcgacggcacggtcgcggagggcggcgcagccgatgcccaacgccttgttgccatcaagccggaccctggcgccgtcgccagcccacggcgaggcgcgcggaggctcgtgatggacgaagacgactga

SEQ ID NO: 1150 - DNA, 1344 bp, Chlorella protothecoides
atgctgggcccgggccacgtgcctggcaactctggccaggccgccacctgcgccgccttcgaccccgtgaacgccaccctggcggtgggctgcgccggcggccaggtggcgctgtacgcgctggccgagctgctcgaccccggcgtgggggtccccgccccagtgcgcacactgtcccaggacgagtggggcctggatcccaatgcgctgggcgccgcggcctgcctgcgctggtcgcccgacggccgggcgctggcagtgggacaggcccgggccgggctgtccgtgtggacggcctcgggctgtcgcgtgctgtgcacgctgcgccagcacgcaggcgtcgagccgggcatcctggaggtgggtctggtgtctgggtggtggggttttggggatctacggagggatcgccggaggcgagggggccttcgggctgtagatcctcggaggtgtcgcaccgtcgggcaagagggtgggccaggccatactcagtgcagcacgatcacctccctctcccttgctccccaccagggtcccgtgacagccttggcctgggcacggcacggcgcccggctgctggcggcggagggcgggtccccgcagctgctgcaggagctgcgctttgcgcgcaccctggcgggcgaccaccgcgcgatcctccgccggcgctggacgggggcgcaggcctcggggtcggagctcccgccctggctggacccgggcgaggaaggggccgggcatgctctgctggtgggtggggtaggggcggatgatgggcctgaagctgttactgggcagagtcttttgtcgagggcgtgggccctcgggcagcacagtctcaatgccctcggcctctggcctttcggctctcaagcttgctatgccacccagctcccgtgcgtaccccgccaggccgaggatcgggtcctgctggtggggccctgcgcggccgtcgggcgcggggcacggggctcggggccacgccccgagcttgctctggagcacctgcaggtgccggaggcctacctggaggccgcctaccctctggtgtgtgaaggcgccatggggccccgggtgcgtgcgtgtgcagacctccgctcccggccacacgtccgccgagcaggcccgacccccaccgttcacctcgcgcaggtccgtgcggccgtggaccctgcgtcgggcgacgtcgccgtggcgggcggcgtgggattcgcgctgcactcccggtcgcaggcgcgctggcgcctgtttggcgacgccgcccaggagcgcagtttccaggtgggcggtcgatgggcgtggatgctcggtgcacggcgaatcctcgggaggggcttgggatga

SEQ ID NO: 1151 - DNA, 1182 bp, Chlorella protothecoides
gcgcgggcggccgccctggccgccgacggcacgggcccctccgccgcggcgcggctggagacctttgcggccttctcgcgcaagacggcggccgcctcggcgcggagcccggcgggcgacgctggcacggccaggctgggcgccaagtccaacggcaagggcgccgcgtggttgagccgggccgagccacacgacgtgccctcgctggtggagtcggtgctgcgccccatgttcaaggcggggcgcatctccaaggaccagtacaaggacatcgcgcgcaaggcggtggcgcgccttgcgcgcgagaaggtgagcgcgggcgagcagttcctcacgcctaagcgtagggccaaggtggccgacctgatcgagcgtcagccgactgccggacatcttagcggcgtgcgccgtctgcctgtcgaacaggggccgatcagtccaggaagtacgagtcggcctgtgaccaccctcgagcgggggagtgtggcgctcccccgcccgaagctgccggtgcaaaagtgtaggagtcaggccgcatgcaggccatcggcctgtgctgcgtccccttcacagcctgccaccctcccgggcctgcagcctccaccgctagggctgagggaggcagatgaggaggacagggtgctcagtagcacgccggcaggccggtactgcatgcctgtgaagaagcatgcgaatccctgtaaggtctgcgacggcactgggagggccatgtgtggagtgtgcagcactccggccattgttgcatgcacccatctctaccgtgcttccccattcatgaagtggcagcctgaagcccacagcaccggaccaatgtcctttgcatgttccaatgctctcttacatatccacaccataccgctgcaggggaaagggtcgcctgaatttcgcagaggcggccatgcttcccaagggcgcctggcccgtgtggtgcactgcctgccgtgcctcaggaaagtggtactgcgaggcatgcctgggcaccgggatgcacaggtgaggcacgtcgctgcatgctttgagttaccggtatccgataagggagtccttatttgtaggggtgatgtgtgcacatgccatccttctatcccaccacaaccttgcagaggtcccatgggattcaggctaccaaaggctgaagaacgagatgtgaagcctgagtga

SEQ ID NO: 1152 - DNA, 834 bp, Chlorella protothecoides
atggcctcacaggtacgaggacgacgccctccccagcgtggactgggtgctggatgtggccaaggccgccgtgtacaggtgggccagaggggtggggcaggagtgacgcactggaccgcgcttggcgagctcaggttgaggctgcctggtcggcatccgcgcactggagcccaggtcccactgtacggcatccgcggcctggtaatcgacccgtacaatgagctcgaccaccagcgccccggaaacatgagcgagacggagtacgtcagccagatgctgaccaagatcaagagattcgcgcaggtgtgtggaggaaagaggtgcctgttcggtgttggtggaggccatgtgcctgtgtccagtcaccccagcgcgcacggcccatcagcagcggcttgctttctccacgcccccttgcatgctccgtgctcctccccttacccatgggcacaaacactcccccccccgtgtcctcttcccaaacctggccaggtgtcgggcgtgcacgtctggttcgtggcccacccccgccagctgcagcagtggcgaggggaggcccccaacctgtacgacatctccggctccgcgcacttcatcaataaggctgacaacggcatcgtggtgcaccggaaccgggagccgggggcggagaacgctgccgaggtgcagatcctggtcaggaaagtgaggaacaaggtggcagggacgctgggagaggcggtgctggagtacgaccgggtgaacgggcggtacatcgacccgggggcggtgggcgcctcggcaccccagacctcggcgcgcgtgggcaggacgggggcggcggccccggcctga

SEQ ID NO: 1153 - DNA, 1812 bp, Chlorella protothecoides
atgcagtcgcatgtcgcgacgcaaggccctccggccaagttgttgaccgcgcaacagccctccatgtccgacatcacacggcgcatggctccagtccggaccatgatggtgcgatcccaatgcttccaccccgccaacaccccgtcgaggaggtggcatgggggcacaggccggccccgccgctcgccgcgtcggcttccgcccagctgccggtcgagcctcgaacccgaggccggggccggcatgcccttcccggacctggtcctggcagatgtcgagcctgagctggctctggatcagcccgcggcgggcggcagcgcggggtggcccagcacggtggccgacacaccaccccttgagactcctgccggggtggacgggaccgaggcgcccaggacccccccgccccgcttccagctgcccccccgcctgctggaggtgctggcctttgccggccccgggctgggcatggtgctggccgaccccctcatgtccctcatcgacacggcctgcgtgggccacgtctcctccgcccagctggcggccatgggtcccaacgccgccatcttcaacgccgtcttctccatcttctccttcctgggggtggccaccaccaacgctgtggcggcagactccatcctcgacccggccctgagcgagcgcgagcgcgaggcggcgagggcacgggtcgagcgcctggtggggactaccatggtcctggccgtcgcatttggcttcctggcgctgggcgcgctgtggacgcagggccagcccatcctggccaggatgggggctgacgcggaggtcctgccccacgcccttgcctacctgcggctcaggtgggtccgtggtgggttggcatggaagagggtgtccaaatttcttggatgggagcaggctccgccggatagccaatgcgtgttcttgctaggtcatagagcaagatctgtgcggatggatgaagtcgcccatctcccacgcaactccccacttcccacattactcgacttccatccccaatccccgctgaaatcaaacagggcgctggcggccccagccgtcatgctcggcaacgtggccatgggcgtgtgccttggccagcaggacaccatgacgccctttcttgtgttcatgggggcagggctgctgaacctgggaggcgatatcctgctcatcttcgggtttggcatgggagtcgccggggcggcggccgccacggcggcctcccaggtgctcagcaccgcaatcttcatgctgtacctgtggcacaggggccagaccgacagccgccgcctgaaaatccggtggacggtgcggtgggagttgagggggggtggggggggattggggctccgcagagtcacaggcgggagaggatggccagaggccgcggctctgcgccagttccaaaaggtgaggtcagaggttgggcatgcatatgtgccgggtgcggagaggtactgggtggcttatggatggcctgtgatggcttcccaccttctatcaacgtccatgactggtcgtagaggccatcctccgtggcattgtaaccctaaacctcaccggctgctttgcccccccttctccccttcaggtggctgtcaccatgatcacgcgtaccgcctttggcatggccgcgtacttcagcatggccgtcagcgccaccggcctcggcgtgaccgggctggctgcgcaccaggtctccatgcaggtgctgggggcgggtttcacactggaggggtctgtgggctgtgggctcgaccgcttgatcatccatcaggaattgctggtgattgtgtgcacctggcttga

SEQ ID NO: 1154 - DNA, 777 bp, Chlorella protothecoides
  modified_base (663)..(672): a, c, t, g, unknown or other
atgggatcggaggcactaatagcgcacaccgtcacgttgcacctctgtgtgcatctcgacccctcgctagcccctgccacgctcaaccccgtcgtccctcccctccgcccccccgcgctgacaggcacgcggggcccgctggacatgatggaggtgcccagccacgtgttcgagcactatgcgcgcgacgtgcagggcctggccctgctcctggaccgccccgccgccgagctggaggcggcggtgcgcgcgcagcaggcgcagcggcgcaccttctccgcgctcaccatgctgcaccaggtgcaccttggcctcctcgaccaggtttgtccagggggaggtgctggaggtggggctttaaaaagggccatgcacagcagccggccgccggacgaggcacggctggcgggggccacggcagaggtgctgggccggcactcgccgctggccgacctggggccccacctcccggtgtacccgcagctgcggttcgggcacctggtcggctacggcgcgacgtactacagctacctcgccgcgcagagcctgagcgcgcgcctctggcggcggcacatggagggcgagccggcggggcgggccgccggcgaggcgctgcgtagaaacctgttcgagcccgggggggcgctgccggcaggggaggcnnnnnnnnnnctgcgccgcctgctgggccggggcgccggtgaggctggcgaggccgctccggccaccataccagacccgggggacctcatgctggagctgggcatcgaggaatga

SEQ ID NO: 1155 - DNA, 633 bp, Chlorella protothecoides
atgtccaaggccgacagcgagaagacggtgacggcggatgtctatgttgcggcgctggacgtgccgggggcaaagcggctcatcccccaggtgggtgtgagtgtgtgtttggaggtcatggggactagtccaggaaacaaccagcacgctatggtgacagggaaggtggatggtggcttgtttctgctcttgcactccgaaaatcatgagcatggagctgcgctacgacggctgggtcaccgagctgagggaggccagcaacaagggcgaggagcccgctgggctgaacaacctgctgtacaggtgagcggactggattggacgttgccgcggcatgcaattattttagtctgggcatgctcaggacccaagtggtgtaccgtcaagatgagcacagctgaggggacatacatcagcatggcaccccttgacgacccccttcccccctgtctcagcgccgacgcggacttcagctgctttgctgacctggcgctgacgtcccccgtggactactttaaagaggggcagggatcgctgatgcagtgcgtgctgaccccggcagccaagtacatgccgatggagaatgcggagatcgcagctgccgtcgacgcgcaggtgggtgggccgcgctga

SEQ ID NO: 1156 - DNA, 1437 bp, Chlorella protothecoides
atggagggcgcaaccctgagcgggcgtcagtgtgcctacaagatcctggggaacgcacccgagctgctggagggccgcccccagcaggcccccactcaggaggcacagccagaagctgattcagttgctggttggatgtcgcgccttctgcccgactacattccgggaagggccctagcggttcaatcatctgggcagagggaccctgtcttgtttacgcggccactgggcgtgaaccctcccttgcctccccccttgaatgggcgagcccttttacgccacccgcaagctcttgctggacgccacgcttccggatggagtggtggcgagggtgctggaagaggcggagcctctctccccgggcatgaccacagcgtacattctcctctgtatcgtgctcgtcattttctcgggcatcatggccggtctcactcttggactgctgtccctggacaggtgagcgaccttattgtgtactcaaactcgctacgtcaatctgccaatctaagcgcctgtatgttcctggtattcagggtggacctccaagtcatcaagagatccgtctcaatcgtggagggactggtgcatgccagggcaggcgagtcaactaggccggctgcatgggaggtgcttgcaaaaccacactaccttctggccacactcctcctttgtaattctggagccatggagacgctccccattttcttggaccggctgctcaaccccgtggcagccatcatcatttcggtcactgccatccttgtctttggcgagatcttgccgcaggtgcgcaaactgggggtggtgaggtttggaaggtactggctgcaccaagcacatctctgcatgctttttgcccagctggaagcacttccaggccaacccggcatgtccccccccttctcccccaggccgtctgcaaacgatatgggctgcagattggagcatacttttcctaccttggctgctgccgagagctcagatgcccgccaggtgatcgggagcttggcccccgcacatccaatgatgccccgccgatgcccgccaggtggtcaggagcttggcccctgcacatccaatgatgccccgccggtctcactccccagctcgccccagcgagagctgaaggcccttgtcaacattcacgccgagcccgaggaggatggcgcgctgtcggtgctcacccacgacgaggtccaggtgcgtcgagaaggggtggtggggctctgtcatggacaattgatatctgcacgcagaatgctcgccggaattggggggattccctcgttgccgggccgaggcatgatagtttcaggcagtaggagcactcactgggcccctcctgacctacctcaggtgattcaaggcgcgctggacatggcgaccaagacggcagacacggccatgacccccatgagcaaggtgtgcggtgggtga

SEQ ID NO: 1157 - DNA, 993 bp, Chlorella protothecoides
atgccacgctgggaggcctggctccgattcgatggctgtgtagcagcaccatgcatgcagctgttcagatgcactcaggcgcgacgaggacacctgatgccggactggtttcggttggtgccctgcgccgggccatggagccctgcccctcccctcgccgccaatcctcccctccccgcctccacaggtcttcgcggtgtccatcgacgccgtgatcgacgaggagatgctgcgccgcgtcatcgagcgtggccactcacgcgtgccagattgagacccctcgcgcgttcctcgagcctaccacctcaccttcccgatgcccatgcagaacattgtcggcgtggtcctggtcaaggagctggtgctggcggagatggatggccacaagcgcatcaaggacatgaggatacgagaggtcccatgcctcaggtggggtgggagcggagcgatgttggcgagagtggcagtgggcacccggcacccgtcacccattctagggagggcccctttcaccacaggtctgacatccctctgtatgatgtgctgaagatctttaggaccgggaagagccacatggcctgcctgaccaaagtttcgggcaagctggaagaaattctggagctgcatgttttgtgggatggtgttccggctgctccctgtgaggctcaaagcagtcggagcatcagggggcactggcccgtgccacttcatgacacgtgtggcgtgctccgaacatccaccctccccacttcctcagcgtctgagggctccctgacgctcaagggcggctccatcggcatggtgtctggccccggcggcgacaccaccgcctccggcgtgggcccctcccccggcctgtggctgacgctgcgcaagccctcggcctatgtcacggacctggccagctgccccgacatcatcggcatcatcaccatcgaggacgtgctggaggagctgctgcagcaggagattgtggacgagaccgacctgtga

SEQ ID NO: 1158 - DNA, 1419 bp, Chlorella protothecoides
  modified_base (963)..(972): a, c, t, g, unknown or other
atggtcaccgcctgtgaggctgccctggagatgtcgcagggcctcctgcgggaactcaggtgggctggggcaagcgacatcagcgaggaggtccactcggaagcttctgccgcacgggagagcctggtctctcggcagtctgaggcgcccagccatttccacgccctccaatcgtaccggacgaccatggctgtgctgcggagccagagggagtacatatcccagctctaccagcaggcacgttgcaatgttttggtgctgctgctgctggggatctttctggaggccgaggaggctgagcttggaggggccgtggatggcgccatccgaaggctggacgccacaggtggggagcaagatgtgggaaaaccgtttgcccaatctggtctccgatgtggagcattgatggctccatcattcgcctccgagccccagctgcggaggctcctggacgcagcgaggctgcaaggcaagcagggactggttgggtcggggatggccactgagcgtctttgcaagcttctgtcaaggctgctggagggccagccagtgagccccgaccaatcccactcaccctccgcacacgacccttcccattgccacagaccacacgaggacgcagggcgcgatctggagcagcgccgactcggctgccgcccctgcgctgcatgtggtggcctcgggcgtggtgaccgccaccattgcgcacgccggcgggtgggaggcggaggcccaccaggtacgctgcacggccaggttgaggagtggtgtgtctgtcgtggagtggagcagcagccgctgacaaatcgtcctttgataagttctcaggcattgcgggcacccccctgctgccccttctcgaaaggaggcaccgggcaccctcccatcccatcctccctcgcaccaaacacacacctcatgccctgcagggcgtcggcttcgtgtacggcgccctggaccttnnnnnnnnnnagtggagcagcagccgctgacaaatcgtccatgaatgggttctcaggcattgcgggcaccctcctgctggcccttctcgaaaggaggcaccgggcaccctcctgtcccatcctccctcgcgccaaacacacacctcatgccctgcagggtgtcggcttcgtgtacggcgccctggacctcatcatgggcggcgccacctcgccctggcgccgcagcgtcgcccctcacgtgaacgcgctggggcagggcccgcaggtgtacacgttccccgcggcttccttggccgccctgccgcccgcgtgccaggacgacctgctgatccaggccgccgccgaggtgttggaggggacagagaaggacctcaacagggacaccaggtggagagggtctggtagtgggagtggagagctgatctgtgcatctgctggcgacgaaagggattcctag

SEQ ID NO: 1159 - DNA, 3792 bp, Chlorella protothecoides
  modified_base (650)..(659): a, c, t, g, unknown or other
  modified_base (1238)..(1247): a, c, t, g, unknown or other
  modified_base (1318)..(1327): a, c, t, g, unknown or other
  modified_base (1411)..(1420): a, c, t, g, unknown or other
atgaactccacgcaattcaatgaggagctggcgcatgcactgcactccatctggacaccggagacctataggtcgttctacgacgaagcctactgccttaccaacaatgtcacgctcaagtcacggtccaatgccgaagggaatgagcatgtggagcccacggcgcggtctgcgtctgaaccagtaagaccttccccacccgttatcccggtcaccaacccaccctctcctcgtgcagagtctttcaactactgctccgtcccactcgaggaccaagactccatcctcttcctggccctggcggtgctcttcaccgccggcttgtctgggaaactggccctgacaggcgtgctggtggcggggggcgtgctcggggtagtaaactattacgtaaacctgggccacctaggcaacgcggtcagcatctggctgggcatccagccgccagacctcttcctctacgtcttcctgccgcccctgctggccgatgctgcgctgcgcatcaggttctccctctttcgcaaggtgggctggggctttgggagctggggttgcagcggctgcataccctccactgtaggtacctgcaccaagcatccaatcgggtctgggtccgcccgctgccctccactctggaaccccccggtcgnnnnnnnnnntgtaggtacctgcaccaagcatccaatcggatctaggtccgcccgctgccctccactcgggaacccccctgtcaagccaaaactacccttcccgtatcaaccaggtcgcgctcaacatcggcatcctggcctacgccatggtcatcctgaacgtgctggtgctgaccccctttgtcctgcatgccctgggctttgctgggcggggcatggactgggcccatggggctctgtttgccgccatgctggcacccacagacgccgtctcggtgtccgccctgctgaaagccggtgcgggctcggggaggggcaacaatccaaaccctctcaaaacccccatccagccaatggcccggagctgctggtggtgctgatggagggggaggcgctcttcaacgacgcgtcaggtgcgctgaacggcctacatgcgcatccccctgaggttctcctccggaaaagacgacccaacacatcccacccccttccccacccacgtccagccatcacgctgtactccatctttgctgaggtgctggaggagtaccagaaccagcccctgcccccggccacggctctcctggnnnnnnnnnncaacgacgcgtcaggtgcgctgaacggcctgcatgcgcatccccctgaggttcccctccggagaagacggnnnnnnnnnngccacatcgtggtcaagatcctcaagtgggacttggatttggctgtgttgctgcctggaaggatgggagcatgcatcaaaagcnnnnnnnnnngccacatcgtggtcaagatcctcaagtggggcctggatttggttgtgttgctgcctggaaggatgagagcatgcatcaaaagttccttgcatgatgagatggcatgcctgccatgctcacacctgccagccctcgttcctcatcacctctttggatcatggcccagcggatcaccagatttcttttcccgcccacatcaccaggctcaccagcataggcctggccatcgggctggcattcggctacttcaccggctggctcatgcgtctgctgaggtggcgcggcattcccgtgcccctggatgccacagtcatcctggccattgcctacctttccttttacgttgggcaggggcccgcacaggtgggctgcatgcttatgatggctccgggatttggagcagtatggtgcttgagccaaaacgatgcggaaccctgcacgaaacaatcctgctgccaatcatccgcattgttctcatgctggaggatgttctgaccactggggctctgatctccttcgcaccgacccacccccctttgcagtcctcgggagtcattgccgtggcagtctttggtctgtggggtgctgccacctccctctggggcaggtttgcactggaggaggaggaaaaggtgtggtttgcagtctgggatagtgtctccgccgtcgcgaatggcgtggtcttcttctgggcgggggtggcctccctcaacttccttgtcaggtcatccgattacctaatcagccccggctgggtttatggctccatacccatcatcttcctcttcatgttcctgttccgctttgtcaccatcctgctcttcaaccccctcgtcctgaaaggcggaacatgtgagagaagtgtcggcaggagtgccagcaattgtgaagcgcatcatgggatgcaaagcacctatgctgaagggctcgaagcttgcgaacccttccattcaccccatgccgtcccatcatcaacccgtccccatctcagggttgaacctgggacaggcagtgtttgtcatggctgggggcctccggggggcgctatccttgatcctggtggcggacctcatcatcacatcaaacttccactcatcggctgtggttgtgagctggtggctgcagggctgccaaggcatgagctctacactgctcatgtgcaattgagggctttgttgggcaacacccgtaagcaaaggcctgcagcaagccagaatgcccccacacccaacccacagatgtcagctgccaggaagcagctgcgcctgcatggtctgagtctcctgcaaaagtttaccgacaacaagattgcggctctgaggacggaccacagcttcatttcgcaagttgttgatctggtgctatcgcttgtcctcccccccgcaggtgccaactgggagcaggtggcggagatgacgagccacctcgcagccatgacatctttcgagaaggccagcggcggcacaagcaccagtctcccagtgggcgacagggactcatctgcgaccgtcggggcaagcggtggcacggagagtacgccagctccgactctacccgagtcggggggtgggagtgaccggtcaggacgctttgcgtctctacagccggagcaagctggactcaaatcggatgagattttactgccacacggtcagttggcaggcatgtttcctcgatctctgcttttggtgttgacctggttgaatctgtcgacgtccacgggtgttgaggcattctctcacaggtttgctccaaaaatgcttgggctgtgctttgaggcctggactacgcagatccttctttcgctgcccacagacctggaagcagctacccccggccagccccagaagtcaggcatgtccaggctgagaaagctgttctccgcgccggacttcctgcagcactttcacagggctggcgtggccagcgccgtcgtgcctgcccaccatgaatcggaccccgtgccagctgaggagactgtggtgctgctatatgacagcagcaaccctcaagctcccatcgatgcgcaggcttgggaggcagccatgcagacccatggttcccttgcaaagcgggaacatggagcacccgcacggagtgtcgctgtacaccagcgaatgccaagcgtccccggcggcagccgcctcgtctcccagcccaagctcttcccacacctagaccctagcgacctcaagtgcaaggggccctctgtgctgttgtttgcgtccgggaacttggatcatgccagttctgattccgcccttgaacgcaccctgcccgtgccggcaacctcatccctgccgcgctctcctgcctcacccgcagcgccgcgcttggcagcgacgaggcgagccagcgcggccagctgctaa

SEQ ID NO: 1160 - DNA, 474 bp, Chlorella protothecoides
  modified_base (217)..(226): a, c, t, g, unknown or other
atgctgtatggtgagcttggacaggcgaatgggtccgggctctatgtctcgccctgtcgaccaacgcctgacccgggcccttcccctgccccttcgccagtgacggacgccattcccctgttctctggctacatcgcgccgggatcgcagttcattggccccctgctgtcccagctggcggcgtcgcccctcagaagcagcctggagggcttcctgnnnnnnnnnnaaagggggccaggctctatgtctcgcccggtcgaccaacgcctgacccaggccccttcctctgccccttcgccagtgacggacgccatccccctgttctctagctacatcgcaccgggatcgcagtttattggacccctgctgtcccagctggcggcgtcacccctcagaagcagcctggagggcttcctggcctccctcaagagtgagctggctgtggaaacgaggggccgaaactttgggctctga

SEQ ID NO: 1161 - DNA, 2523 bp, Chlorella protothecoides
  modified_base (1594)..(1603): a, c, t, g, unknown or other
  modified_base (1910)..(1919): a, c, t, g, unknown or other
atggcttcgaccccgcgcccctggtcgccgccctccaggagtcctgcccgggatggctggggtctcgagtgggtgccaaatgtagtgcagcactacaggtgtccatttcgagtgtcctgcacccttgaccgcgtcgcatgggctgccattgactcggcacctctcaccgttgcctgcttggccctgcccactgcctcatcttctttcccccaaccaaatgcagagggcagcagggtgaacgtcaggggcctggcgcccgcgcccggcggcggcctggtggcgtccctggccgtgacgctggacgacgcccccgacgccgaggcggcgctggaggaggcgcagtacctcgccgcggttctgcgcctggagccaggccaggtcctgtctccagacacgtttgggcgggtggttgcggtcggggcgccgccggcggcctcgggccacagcccggcgacgcacagcgtggctgccgtgaccgcgggtccctgcgaagtcgcagaggcagggccgggcgtgggccctggtgatggcgctgtcgggagacggggtgatgggagccccggcgaggtagcggcgacctatgcaccggcacacctcagcgaggatgactgggacctgccaggcacgccgatgcccggccactccgccgccagcgcggcggcctcgcccgggcctgccatctccccggacgcctttgcgtcgctgccgaccatggttaccaaggcgcccagaccaacggagggaaggctgcgctggtccgaggaggaagaggcgggtgctgcgggcgtgcacaccccggaaaccagcccggcgctgccgacggcagagccagcgcggcgggcgcggcgcgtctccgtccacgtccccgacacgagcgtggaggcctgggaggcgccgcgcgtggagagaacaggcggcctcttccgccgcagggaggtggcggtgcccagcaggcaggaggagatgctggcctcactgcggtcgcggctgccagacgatgctgtggtggaggtccgtggggggccgggcgccgcggtccccggcgacctggaggtggaggtgagcgtcaccctgccggcccgccctctgctggaaagcgtggcgtccagcgaacagccctcccccgggaccgccgccgtgctggaggccgtgacttcttcgctgccgcggggggcacgcctgctcgatcgggagcggcagagcgccgggcgagccagggagctgcagctgcagcgggcacctgcgagtctcgacaaagtgacgccacaagacggcaccaacaagcaaggttccgtggaaggcggcgtgcctgccgcaccgccatgcaccccctcagcgacgggcgggggtgccgcgctcggcgcgacgcccgcgcgttctgtgcgcggcacctcagcggggacagctggcgctggggtcgcagtcctcggtgagcgggcccatgctgcggccggccgggccgctgcagcgatgcctgctgcgagtcctggagcgggcagggagtcctctggccaggcaaccgcagtcctggaggtcgagcagtcggagggcaggcccgcgcctgccgtcgacagcgcccagggctctccagggnnnnnnnnnntggaggtcgagcagtcggagggcaggcccgtgcctgccgtcgacagcgcccaggattctccaggagaccgtctcgcggagctgaccagacctgggcaggactggagcgggcggaccctggccgaggtggtgagatcacacggaagaggggccgaggggactgcagggacccggtgtacgggaagcgatgcaggcatcaactgcagaccctctcaatcactcacattgcctcctcaccatgcaccccctccaatggccccctctccccccccctttccaggcggagtacagccgggtcctgggcgcannnnnnnnnnggacccggtttgtggactgttgcgcctcacaccgatgtgcatgcaggagggaccctctgccggaggctcaggtgtacgggaagcgccgcaggcatcaaccgctgaccctctcgatcactcacattgccacctcaccaggcaccccctccaatgcccccctctcccccccccttcccaggcggagtacagccgggtcctggccgcggagctgcgccggcggctggcggacggcggcgccaacgttgacgacgtggccgccgtgcaggcggcagtagactccctcccgcccccgccacgcgccgcggcggccctggaggtgggtcaggcgctgggcgcggcagggcgccacgccgaggccctgaccagcttccgggcggccgccgcggcggcgccgcgcgacccgctggcccacttccgcgcgggaaacgcgtgcttcgcgctggcacgctacgttgcagcggcgacggagtaccgcgccgcgctgtccctctgcgcagcggccggcgaggcggagcggcccctggccgtcaaggtccacgtcaacttgggcataacgctggaggcctcgggcctgctcatggctgcctgcgaggagtacgagtga

SEQ ID NO: 1162 - DNA, 402 bp, Chlorella protothecoides
  modified_base (164)..(173): a, c, t, g, unknown or other
  modified_base (307)..(316): a, c, t, g, unknown or other
atgtatgcggcacccaggtttcacttgctcaagcctgagtatatttatgggcgcatgaaggcgttgcagcgagcctaccgactccgtgtgctcctgtgtcatgtagacaccgaggatgctgtcggtcccttgggagaggtgagcgtgggtacacccgctgaacnnnnnnnnnngtttgctgtcgtttgctcgaaggccattcagctttctctccctcccctggctttcctgtatgtgaccaaggctgccattggactggagtgcaccctcatatgcggcttttcgccgcaggagtgtgcgcggtacnnnnnnnnnntcctcctaggtgaccaaggccgccattggactggagtgcaccctcatatgtggcttttcgccgcaggagtgtgcgcggttcattga

SEQ ID NO: 1163 - DNA, 699 bp, Chlorella protothecoides
  modified_base (126)..(135): a, c, t, g, unknown or other
  modified_base (203)..(212): a, c, t, g, unknown or other
atgtacagctttataattaccgattgcaacctcaacagttatgagagcaagccggcagacagcatccagaagtcggtgggctcggactttgtctcgaccgccactgctgcgttgacatccctgcgnnnnnnnnnnacacaatcatggcgcacaatgtacagctttataattgccgattgcaacctcaacagttatgagagcannnnnnnnnngggtaaacaagacagatgtcaagaccctaggagacaggtgccagagggagtgagtgggatggacacatgcaaactgacgcagaaactccggccatggaacttgccttggcgtttaagagttcatcgtgatgggtctcaatgctgtattaggtttggatccatggctgcactcttctctgcatccaaggaggagctcgcactctgtccaggcctggggcccaccaaagtgaagcggctatttgaagcgttccacgagcccttcaggaataccctcgtgccgcaagcagcaccagaagtgagagctacctcgctgggacggccatcgcaagtattccagcttgtggacgcccaagctgcagcggaagtcaaggttgctgtggccgctcctccagatacccaggcgcagcctggtcctgcggtgacagatcctgctgaagatcccattccgtacagcttggaagatgaggatgatgacgacttcgcctga

SEQ ID NO: 1164 - DNA, 3516 bp, Chlorella protothecoides
  modified_base (3191)..(3200): a, c, t, g, unknown or other
atgcatgagcatctagaccttgcctctacccacccctcaacaccactaccctcccccaccatcgcagtactgcccaaggtgctgcactatggcctgaagatcgaggtccccaacacgccctgggtgtttgacaagcactaccactacgactttgacgcgatgatgtgtccgccctgggacctcaatctgactcctgaattgtctgccatggcagcgacagtgctgtctgagggagctgtttgccaccgccacacccctccatccgctcccccccaaccctccacacaccacagcgacccgcccgcgggcaagaagggcggcctcttcccccgcacgccccaccccgattccttcaagggctccgactctgacgtgctgcgggacctgctggccatccagacggtggtggtgctgaacgccgccttctgcgagcggcacgagaaggcctgcccgccctcggagcagctgtccacggagtgcgcggcggcgcggtccaccctggacgccctccagcgccggatgaaggagcaggtggaccgcatgcccgacccctgccgcaacagcgacacgcggtgcgagggctgggccaaggccggcgagtgccagaagaatgagggctggatggcggattactgctcgctggcctgcgccggctgcaagcccaagacgccgccggcgcggccgggcaccaaggcccccgtgctgaccgacggcgagggcgcgggcctgaagaaaggggggggcgtggggctcctacgcggcgcgacggacgccggggtcctggcggccaaggacacggccaaggatgcgggggcggcgacggcggacgccgccaaggatgcgggggcgggcgcaaccgacgccgccaagaacgttgccacgggcgcggtggacgccgccaaggatgcggatgcgggggcagcgacggtggacgccgccaaggatgcgggggcaggcgcaaccgacgccgccaagaacgtcgccacgggggcggtggacgccgccaaggacgcggtcacgggcgcggtggacgccgccaaggaggccaccgcgggcgcggtggatgcagccaaggaggccgcgacgggggccgtggacgcggccaaggacgccgcggccaacatcgcgactgcggccgaggacgccgtcagcggcggcgactccggcggcgccgtccccgcggagagggtggagcgccttcgcgcgcgctgcacgcgccagccgcactggagcatgggcgcggtgaaggcctgcctggccgccgccagcaaggggcgcgagtaccagcaccccagcgaggcctcccgtggcgcgggggtggggtcggagacggttcgcacgctgggcgagcgcacgcgccgcctcgtcgctggcgcgggccagagcacggcaggcgcggcggggagcgtgctgcacacccccggcatcctggccagaaacattcctccccactcgtgcactcacctccccccaacccactcacccaggcttcgtggtgtgggcgctggtgctgctggtgctgctcgcatcgctgccgcgggtgcgcaagtcgctggccacgcccgtggcgctgggaaaccgcaccttcttcgggcggcggggcgacaagtcggggaggagcgagtgaggggctcggatccggcgtcaccaaatctccgcacacccgtggcctaccacgagggcccctctccactcagccgagccttgcctcggatgctttgtgctattccatgtttgcaaccaagtcttcacggtgaatgggaatggcgaggatttgagtggctgagaccctttgcgtggactcggggccggaaggggcaagcacggcatcacacgtcgtatagcttgcgcctcgtgggaagggggcgaatcagcttcgcggccgagcaaaaatgccgcccgccaacagctggggtgcagcatgcgctcccagcacaggcgagcacggtgctcagcgccgccgcttgcgtgggcgtgccgcggcggcggtctcctcgacgcgctccccggcatcacgccgggtccccctgggctgcgtggcgatctctaccgtccccagctgcgtccccagctggtcgagctcggccgccagaggctcttgggcagctgcgtactcgtcctcggctgcacaatgttggggttgggggatttataaacgagggatcggggtggggcaaagcctcagatgctcttcgtgaatcaatgccgccagcacccaccgggccccatcccggcctggcgcgtcggcgacgtggcttccgacgcatcccatctcgccttccagactgctcaccggcacgcagcgcgccccgaccctcctcaaacgcgtcccgggcgcgctggagctcctgcctggcggtcagccatcgctccagcgccgccactcggccggcggccacggcgaccgccgcctgcgcctcctgtggtggggagcgggaagatcggcgggcagccttggcggcgagcgtgaggcatgcgcaggcgagtgctgccaaacctccactccgcccgctccagggggggcacgttgaaccccgaccccgacacgatcccccgccccgtgatgcggcggcagtccagagtcacgatgtccgacaccccgccccgcaggcgccggaccacgagctcgcggtacgccgccgcgctctcaaggctctcgaacaccagcgccgggccgaagaggccgtgcaggagagcggcgcgcgtgcccggcgtgcaggggcgcaccaggttgaacaggtagcccaggcagccgggaggccagatggggatgatgccggcctcggcgggggcgccccgcgctgcggccttggtgtgcggcaggggcacgggcaggggggggtctgtgccagccgacgccgaggcgaccagcgcccgcgccagctcgcctgccgcgtggaagccgggaatatcgccctgggtgggacccctgtgaatggaggggggtacgagggggagggagggatgcagggtgggaccaaagagggcttgcaggaacaaggaggaatgtattgctgggtgtcccaggtgcagggtgtgaaggaaggtctgggtggtgagccaccccaccaccaggcctcggcggcctgggcacccatctgcgccgcgctccatatcatcctccccccctcagtcaacggcaacgacagaatgagcaggccttcacccacgtgcctgtactgcgcggtgtnnnnnnnnnnaccaccaggcctcggctgcctgggcacccatctgcaccacgctccacatcaccctccccccctcggtcaatggcaacaacagaatgagcaggtcttcacccacgtgcctgtactgcgcggtgtgcgactgggccagcatgtctggcacggcgggcgtgtccgccagcgcggcgaccagccgcgcgcgggccgccatgtcggtgaccaccaccacgtccagcagcgagcgaaactgggcggaggcgatgcgcgccaggggcgcgtgctcgatggtggcagcctcggccaccacgcccaccaggccggggtcgcctga

SEQ ID NO: 1165 - DNA, 264 bp, Chlorella protothecoides
atgctgccgcataccagcgcgatcgttgtgcctcggccggtgtccccactatcgccggcatcccaatcccactccaccccacgccacacacaggtcctgctggtggcggcgcacccctgggacgtgtttgcggcgatgcgggaggggctgcagggcgcgtatgtgcagcgggaggcgctggcgcactggccgacgtacctcccaaccacgccgaggtacaccgtcaggtcgctggaggagctggcggcgctgctgaagccgtag

SEQ ID NO: 1166 - DNA, 738 bp, Chlorella protothecoides
atgcggcagccccgcgccagcctggcactggtgtgccggctggcggaggcgcggcgcagcacggcgcgcctgatggggcacgactccttcgccgcctaccagctcaccgacttcagcctggcgcaggcgccgtcggccgcctcaagcttcctggaggcgctggggcggcgcctggcccccgccgccgcgcgggaggcggcccagctcgtggtcatgcgcgacgccaccgagccccgccggcacctggccgggggcgggccggcgcccggtgcaccactggacccctgggacgtggcttacttcaagaacctggccaggatacaacggcgcgaccagagcccgccgcatcggggctcgggcacgacccaaggccccgcgccgacgttcctggatacccctcacccccggccccaggaccggcagcgggaggacgccgcctcggcctgggcgctgtcatgctcgccgcgtcaggcgctgcgcggcctggaccggctgatgacccgcctgatgggcgtgcgggtgcgggacgccgcgttgtcaccgggggagggctgggcgccgggcctggccaagctgcgggtctctgaggcggacggcgcgctgctgggcaccgtctacctcgacttccagccccggccggggaagttcccgggcgccgcgcactttgtcctgcgctgcggccgcggccatgggaccgatgccgtccaggtgggaggtgttcgggtgatgttttcctag

SEQ ID NO: 1167 - DNA, 660 bp, Chlorella protothecoides
atgcgccagcgtctgacgggcggccgcttccgctggctgaacgagcagatgtacaccagcgagggtgccgacgcgcagcgcctgatgcagcagcacccagcatactttgacgagtaccacgagggctttcgggaacagacgcggtcctggccccagctcccagtagagaccgcgctctcctggctggcctcatgccccaaggcctggcgtgtggccgatctggggtgcggcgatgcccagctggcagtgcgcgcagcgcagcgtgtcttcagctacgacctggtcgcacgtgctcctggcgtcgtggccgccaacatggcggacctgccgctgggcgacgccgccgtggacgcggcggtgatgtgcctggcgctgatgggtaccgactaccccgctttcctgcgggaggcggtgcgcatcctgaagccgggggggatcctctggatcgcagaggagtcggggcagggcagcatcctggagcccttcattgctgccgtagaggggctggggaccgagctgaagttcagggacgagaagaacccatacttcctgctgctgcgcttcaagaagaagtccaaggccgctgtggcagatgtggaactggacgaagatgaggcggcctggccgacgctgcgcgcctgccagtacaagaaacgatga

SEQ ID NO: 1168 - DNA, 189 bp, Chlorella protothecoides
atgtacggctactcctacgcagcctccaagtccgacgtatggcaccacgtcgaccactccgccatgctctacccgggctacaacgtcaagggtgcgctggggggcggctggagggggaggtgggggccttgggccagcgcccgctctccagtatggtgggccggcgtgcggtgtgcttgctcgccgtga

SEQ ID NO: 1169 - DNA, 192 bp, Chlorella protothecoides
atggacccggtgcgggagcagcagtggcagaaggtggcgggcctacgccccgctgacctggcggtggtgaccaatctggagtacctgggcgtgccggtgtacaagcgctccaagggcatggtgtccctcggcttcgggcgcaagcgccaccgtgccattcgcaaggtgtgcgatggagggtttgtgggttga

SEQ ID NO: 1170 - DNA, 798 bp, Chlorella protothecoides
atggccggcaccccccccgacgccccatcaagcatgccatctcttcatccgataaccccttgcatacctcctcatgtcacctccacaggccagtcccctgatgtggtgcggcagctgaccccggtgatcgagcagctcctgcccatctacaccgacatcgccaagggcacccgggaatttgtccccagcccggccgagtgcaaggacatgatccgcgaaggcaagggagtcaatggggaaaggatctcagtggatccctggagggcctttggtggccatccatggtggcgctgtggcgtccctggctcgaatcgctatggcgtggagcgcaacctcctgattcgcttcgccagcgaccccatcgacgacacgccgcagctggctgccacgctggagatgtcgagcatcgcggacttgctggacctgcagcaggtcaccctgcccggcacgcatgtcaggcccctccagcaggagtttggccggctgacatcagacgtcggcaagtatgcgcaggcggcccgcacgcagagcgaggcgctgatcgaccagctggcgcagatggcgcggggggcgggcgtgcccgccgaggccaccgacgggctcagcggcttcgcccgcgctgccacgggctttgccggcgcgttcggggaggccatgctttccagcacgacagagctggacatctccagcctggccgacgagtgcggggtcttcatgggcatcgtggtacccccgccggccacggctttgggggtcagccccgatgcggggcgtgccggtttcacacccaggacatga

SEQ ID NO: 1171 - DNA, 369 bp, Chlorella protothecoides
atgctgcgcggtcagcaggcagagctgggtttcagtctccacgtcccagataggggcattgtctggggcgtgctgtactacttccccttccaggatggggcagagaccgtcccgctggagggcccctccgctggcccccgcccggatgctgggccaggcatgacgcagcagtacggcgtcaatccctcgcaggctcccacccagtccctggcgcccatggctgcggcgggttccttggcgtcgcaggctgacctggaagtgggggcgtctgacgatgacaccgacggtgaactggaggggggcaggggtttggataccgtgcttggggggcccaaatggacgcaaggaaacgcatgcaccatggcttga

SEQ ID NO: 1172 - DNA, 960 bp, Chlorella protothecoides
atgctggtgtcaggcacacctcgcaccccgcgactcgccctggtcagatggctgcattcccccggcttcgcggggatgggcctggtcgcctgtcccaaggactgggagactctggcgcgcccccgaacgtgctttgccaccctcgagttcccactgcctctgccgtgtatctcaaggcacggagctcgagtcccatgcctgccggccaccccgccgtctcacctcctccccacctccctgcagctctgccaggtgctggacaccgcggagttctgcaggaacgtgcacacagacccagcctggcggcaggccgccaccgcggcctgtctttccctcggctcctacgtccagggcctcaacacccaccgcggcatgtatgccgcgctctcatcggccctgcgcgcgccgggtgcgcgcgctgggccgccggagacgcgggccgtgggcctctcccttgctcgcgactttgagcggtacggggtgcacctggacgccggcggccaggcccgcatggcgcggctcacggcggaggcccagagcctgggctacgagctggggcagaacctggtcgaccccggcgccctccagggcttcgacctgccctccagcctagcaggtgtgattgtggttggggcacagggtgtttggtttttgttctgggaggtgccggggtggagtctgagtgaaggcccagccctgccagtgacatctgtttcgacggcagcgtccgctgagcagtgtaccctgttccctggcctggggagtggcgtcgtgaggggcctgaacttgggtgctttattggcccaggccatcgagtgcctgaaggtcactcacctccaccttctccccttcctctgcgccctttgccagcagatgtccccggcaccctgcccagcggtacgggggtgctggcgcgcaggggctcgcgggtcacggtggcggcggatgacgccagcctga

SEQ ID NO: 1173 - DNA, 276 bp, Chlorella protothecoides
atgcaggagttccatctgacagacttcacccgaccgctggaatccgacgttgacttgcgggctgtgccagctgacacgatcctgcacgtgatgggccactctggggccctggccgcaccagggcaggagaccgtgagcttccagccccaccccaagaccctcaccatggctggggattacgagtactttgccgcgcaggtgagtggagtggctctggatgcaggcgtacttactttcttttccatgctcattgacgctcaggcccagcaactctga

SEQ ID NO: 1174 - DNA, 1545 bp, Chlorella protothecoides
atgcctgagctactgcacctccacgcgccgcccggactccagggcagcaatgcagctgggggcacccgagaggcgctgccacccatcaccgtcctgctggccgaccagcacggcaacacgctggcacctggccccggggacgatcacgccctgccccagccggcgctgcgactcctggcgggggacggggaggcagagctgccggtggagctggagtcgagctgcagcagggaccaggaccccctgcgcatcgtcgacctggtggccgtgccacggcagtcgggcctgctggaggcccaggcgcccggcagccccgacgcgcccgtgcagggcggccagggcgccggcgccttgctgcgcacgctggatggcgtgctggaggtctgtgtggcgagtggaggagcgccgggcctgaccgccaggctccccctgcgcctgcgcagcggccctcccatcaccctgggcctgctgccgccccacccttgggaggggctgggcgagggcgcggggctggaggtgaccgcgggagcgaccctgcccggctttgaggtccaggcctgggacgcctggggcaaccggtcgcccgcgctgcccggcctggaagccgcggtgaggctggcggggccctgctgcagcgatgcgccggcggcggcagccgtcttcccactggatgacgacggcgcggcgaccatcgcagacgtggcgctgatctgtgcgccgggcacggccggccaggctcaggagctggagctgcggctggaggcctcggccgccacccccaccctagaggccgccctggtacgctgccgggcgggtcatgatgccgaggcgccggccctggcctgccccgtggtcgcgccggccctgggctgccccgtggtcgtgcaccacagcctcgccccggcctcgctggctctggagctccatggcgaagcattgcagcggcggcccgatccgcgcggcaccggccccgacctcctgctgctgccgggcctgcccgccggctcctccctccccggcctgcgcctggcgctgctggacggcggcggcgggcgggtcgagcggtcggtggcgggacgtgtgaccgtgtcctggcatcgcggcagcaagcgcctggcctggaagggggaggcgcggtcggtggcgggacgtgtaaccgtgtcctggcaccgcggcagcaagcgcctggcctggaaaggggaggcggtgcgcctgcccactctgcctgtgccggagactgccacagctctgggcgaagcgagtgtcctcgacgcggctggcgatctgaacgccgccggcgcccaggacgcgacgccggcttcgacggagtgggtgcgctttgcgtccgacgacggcacgctgctcctggaggtggggttgctcctgggggtggtgccggggccgcccaaggcctgggccctgagcctggtggagggcgaggcgggcgaggcgtcccaggagggtggagagggcgtcggcgcggtgcgctgtggccagcctttcaccctggagatcgaggctctggacgcccacaacaaccggtga

SEQ ID NO: 1175 - DNA, 441 bp, Chlorella protothecoides
atgaaaaccctgcaggactaccgggtgcatctgaagcatagggacggccacttcgaaaaagtgccctacttctccctccccgccaatgacctgaacgacgtcatcgcgccctcctgctacgcctgcttcgactacgccaatgccgccgcagatgttgtggtggggtacatgggcgtgccctcgctgggagtggacatgactcagcaccttcagagtttggggccctgtcctgatgcagtgggcctgccttggattctctttggaaacccctcactcacccctcccaaccttcctccacccatcccatcaccagtatgtcactgtgaggaacgagcgaggggctgccctcctcaaattgatcgaggaaagagtggagaggaggcctccggtgtcggcgggcaatcggaaggcgctggtcctccagaccgtcttggccgatga

SEQ ID NO: 1176 - DNA, 711 bp, Chlorella protothecoides
atgttgccgctttcggtgcggtccaggttgccggagggcttgctgcgcgcccagttgcccgtcgtgcgcagcgtgcgcgccgaagcgacgccgcccatcatcgatttgggcgtggcctcggccgaggagggcgcgcggctcgacccgggcgagctggggggctgcacccaggggtactcgtcggtcgacaggcggttggcggctgggcggcaggggtggagggaagggggtggtgagggcgaggatgggagtgccagactgggcaccttcaaggactccctggggaaggtcccaactctccccactctccttgcctcccctgctgtgggccaccctgggcccctgtactgcctccctgccctcacatcaatccctttctctcacacgaacctgccacccagggagcagctgtccaaactgggggcgcatgtggagctggccacgcgcctcactgccagcgtggacgccagccgcctgacggagtttggaaagctggaacaggatctggtgtacggcgacgccacctccaaggaggtcatcgccttgctgtcccagagcggcagcattccccccgccgagaaggtcggtggggattctgagagaacacgaggtgatcgtctccccgccaggactgacctggtggggagggggcctctgtgcgacatgctgcagcggtcgagcaccagggcagggccggtcggtgtcagctag

SEQ ID NO: 1177 - DNA, 456 bp, Chlorella protothecoides
atggggttgtcattcatcgacggcatgcaggatgctgtgttgacaccggcagaatgccctgtgcacccctccaaagatgggataagacacgtcccgccccgcccctccgcatgcaggcccaacgtcccggcggcggtggacacggtgatggcggccctgacggccgcccaccccttcccagacgtagggcctggggtcaatgcgctgcaggccgccggcctccgcatctccgtcatgaccaacggctccgccgcgctggccaaggcggtgctggcgcgggcgggcgttgagccgggcgcgctggggcccctcatggacatcaacatggcggtggcctggaagccggcgcccgccgcctaccagtttgccgtggagaagctgaagctgcagccgtacgaggtgagcgcgaatcgctggagggaacggcaggaaaggatgcgcgggtggtgcgtgtga

SEQ ID NO: 1178 - DNA, 393 bp, Chlorella protothecoides
atgcaccatcccacaggtgcctggcggggtcgggggagacgctgctccacagtccagatccatgcgatccgtgatccacccccgccgccgccggggccgcccgcccagccccccgtcttcaacagaatggaggacatgatccagaaccggttagggagcgatggcccccaggccggatcgcgctggagggaggtggctggggcctgggtgctcaatccgccgggcaacgagccctcagtggtggtgcactttgtgggcggtgcctttgttggcgcggccccccagctggcataccggcccttcctggaagccctggcggcccgtggcgccgtggtgaggaggctggcggcactggtgtggaggatgggtagggaaacacgagggtgcctttga

SEQ ID NO: 1179 - DNA, 1173 bp, Chlorella protothecoides
atgctgaggcagggcgcagactgggacgccatctcgcagatgatgtcctacatctccgacaaggccgcgcaggcatgtcgcgccagggcgcctgtgtgcatcgggcagggggatcgagggggcgtgctcgatgatgggcagaagctcactacatccgtggcgacccccacgccccagagccgcggcctcttcagccgtgggctgggcagcagcaggccggcaggcggcgcgaacgaaaacacaccgcctcatccccaaccacccccaccacttccaccgcaccagtctccagccaggggcgccagcagcgtgaccctgggggcccggacgccccgctcccagctcgcccgcctgggttacgatgtgaaggccgtgaccgccgccgtggacgtgccggtgctgcagcacctggcgcccctcgccggggtcaagccgggggacctggtggcgcaggcccacgacggcaacgtggcgagcctgaagcaggtgcaggcatggtgtctggcgacgctccagacattgggtgatgacattgcggcggggtcccgcgccacgccctcccttgccgccatcagcgtccaccatccccccctccccccctcccacaaccacactccagggcaagcagctgaggctgacgcgtgcagaggcgctgctgcgcggcgtgctccacgccacgcccgccgcgcagttccagcacatgatgcgcacgctgaactcgagggtgctggccccgctcgaccccggcaggaccgggcacgtcgacctggccatgctgctcatggtccttgcggccctagggaccgggctgggatgccgcaagggactgggccgcaggcccccgcctccctttccctccatgcacccatgcgcgctgaccccccgccgtgcaggaacggcggggccagggggcgggtcatggcggcctttgacattctgagctggaagaaagggagcgcgggcgtgacggtgcaggacgcccaggcctacgtggcgacgctgcgtcgcatcttctcgcccggccacgaggagggcgggcgtcgggactctggcgatgaaacctccgactccccgaccctcgacgaggccggctttctggccgcagtgacgaatgcagagtcaggttttgccatgtacgaggtgctgcctgccctgtgccactccctggcgtag

SEQ ID NO: 1180 - DNA, 537 bp, Chlorella protothecoides
atgtctcaagcagggcacctcgctttggtgaccggaggcaccgggtttgtggccggagagctggtgaaacagctactggaaaagggttaccaggtgcgcaccacagtccgacctggcacggatgcctctcgcctgcaacccctcaagctgctggcccaggcactcccagagcaggccttccaccaggccgtggctggggcggaggtggtcttccacgtcgcctcaccctttttcatcgaggccgacgacccgcaggcggccctggtggagccggcactgcgcggcaccgcctccctcttcgcggctgtcgccgcccagggcaagggtgcggtgcgccgggtggtcctcaccagctcctgcgctgcggtgaagggcatgcaccccgccccgcccaaggacgggcgccgctacacggaggccgactggaacacgacctccaccgtggagggcggccaggcctactgggtggggaaggtgaggcaacagaatacgtgggtgtgtaggggaaagggagatggggtccagctggctgactga

SEQ ID NO: 1181 - DNA, 1221 bp, Chlorella protothecoides
atggcggcccgcgcgcggctggtcgccgcgctggcggacacgcccgccgtgccagacatgctggcccagtcgcacaccgcgcagtacaggcacgatgatatggagcgcggcgcagatgggtgcccaggccgccgaggcctggtggtggggtggctcaccacccagaccttccttcacaccctgcacctgggacacccagcaatacattcctccttgttcctgcaagccctctttggtcccaccctgcatccctccctccccctcgtacccccctccattcacaggggtcccacccagggcgatattcccggcttccacgcggcaggcgagctggcgcgggcgctggtcgcctcggcgtcggctggcacagacccccccctgcccgtgcccctgccgcacaccaaggccgcagcgcggggcgcccccgccgaggccggcatcatccccatctggcctcccggctgcctgggctacctgttcaacctggtgcgcccctgcacgccgggcacgcgcgccgctctcctgcacggcctcttcggcccggcgctggtgttcgagagccttgagagcgcggcggcgtaccgcgagctcgtggtccggcgcctgcggggcggggtgtcggacatcgtgactctggactgccgccgcatcacggggcgggggatcgtgtcggggtcggggttcaacgtgccccccctggagcgggcggagtggaggtttggcagcctgggcggcggacaggcttgcgtcctgcctggagcaagcagggcagagctgaggggcacactcgcctgcgcatgcctcacgctcgccgccaaggctgcccgccgatcttcccgctccccaccacaggaggcgcaggcggcggtcgccgtggccgccggccgagtggcggcgctggagcgatggctgaccgccaggcaggagctccagcgcgcccgggacgcgtttgaggagggtcggggcgcgctgcgtgccggtgagcagtctggaaggcgagatgggatgcgtcggaagccacgtcgccgacgcgccaggccgggatggggcccggacgagtacgcagctgcccaagagcctctggcggccgagctcgaccagctggggacgcagctggggacggtagagatcgccacgcagcccagggggacccggcgtgatgccggggagcgcgtcgaggagaccgccgccgcggcacgcccacgcaagcggcggcgctga

SEQ ID NO: 1182 - DNA, 657 bp, Chlorella protothecoides
atgggcgtgacaactgaggtgctgtatgcccgggtcaagcccccagtgcccggggctcaatggacaggcgtcgtcacacaggtgcgaacaagggagccatgggttgtgcgcaggttatcccatgagtcttgcaaggcgtcccctgtggcttcgctgtccccttcactgcccacgaaaagtactgtgcagatcgcagtccaggcgctggagacggggctggtggaggccgttgtgtgcgtgcagagcgagccaggcgaccacttggcccccttgcccgtgagtggtggcatcagagggggaactgaggagggggaactgaggaggggtgtgcgccctgggtcggcttccgtccaactctcccaccctcccactggctcgcccacggaccaggtggtggcgcggagcgtggcggacatcgtggcggcgcgtggcgtgaagccctccctgtcccccaacctgaacaccctggccctggtggagagcctgggcatcaagcgcctgctcttcatcggcgtggggtgccaggcctgggcacatgccattcccaccatgaccatcctggcaatccccctttcctcccaaggtgcaagcgctgaggcatgtggagaagcacctggggctggaagcgctatatgtccttggcaccaactgcgttga

SEQ ID NO: 1183 - DNA, 1194 bp, Chlorella protothecoides
  modified_base (773)..(782): a, c, t, g, unknown or other
gcccggcgccctggacggcgcgcgcgtgctggagccgcacgcgccgctggaggcgctgcagcagcgccgcctgaccgcgcgccggcaccgcaccacctacgcctacgacttccccgccgtgttcgagaacgcgctgcgcatggcctggctggagcgcgccgcggcgggcgaggccgcggggccggggcccgatggccgcctggtcaccgccgaggagctggtgccggacgccgagctgaacgggtacgagggtggctccgggaggatctcgctggtccagcgcccgccctcgcgcaacgacgtcggcgtcgtggcctggctgctgacactgcgcacgcccgagtgcccgcgcgggcgccagctggtggccgtggccaacgacatcaccttcaactcggggtcgttcgggccgcgcgaggacgccttcttcaaggccgccaccgagttcgcgctggaggagcgcctgcccctggtgtacctggccgccaactccggcgcgcgcgtgggcctggccgaggaggtcaagcggtgcctcagggtggagtggaacgttacgggggagcccacccgcggcttcaagtacctgtacctggacgaggccgaccacgccgacctgctggcgcgcgcgccccccgacgcgcccccccttgcgtccatgccgctggaccaccccggcggccggcgccacgtcctgcgcgacgtcgttgggctggaggacgggctgggcgtggagtgtctgtccgggtcgggggccatcgcgggggcctacgcgnnnnnnnnnncggccggcgccacgtcctgcgcgacgtcgtcgggctggaggatgggctgggcgtggagtgcctgtctgggtcgggggccatcgcgggggcctacgcacgcgccttccgcgagggctggaccctgaccctggtgtcggggcgcagcgtgggcatcggcgcctacctggcgcgcctggggcggcgctgcgtgcagcgccgggagcagcccatcatcctcaccggctacgccgcgctgaacaagctgctggggcgcgaggtgtacaccagccagcagcagctgggcgggccgcgcgttatgggcgccaacggcgtcagccaccacgtggtcgaggacgacctggcgggggtggcggcgctgctgcgctggctggcctacaccccggcgcgcctgggcgacgcgccgccggcgctg

SEQ ID NO: 1184 - DNA, 498 bp, Chlorella protothecoides
ggccgttccggcgcaggcggcgacgaggacgacggctccgacgacgactacgagccgggcggcgggcaggcccacggcggcggcggcgccgtgcccgacgcgggccctgcctcggggcgcatcgtggtggaggccatcctgggttggcgttgggcggcggaggaccaggcgctgggcgacgcgcgccgctcccccggccccgcgcccgagtacctggtcaagtacagcgggcgcagccacctgcacgacgagtgggtgcccgaggcggtgctgctccagatcgccaagcgcaaggtgctgaacttccgcaagcgcgcgggcggcgcacccgtggtcctggccgacccggcctggtgccggcccgagcggctggtggcgcgccgcgcctcccccgccggccccggctgggaggtgctggtcaagtgggagggcctgggctacgaggcggccacctgggaggcggagggcgagccgctgctgaccgcccccgaggccgcg

SEQ ID NO: 1185 - DNA, 795 bp, Chlorella protothecoides
atgaccccgcctttgtcccaggcgcgggagctgctggagcgcatcgaggcagaccagaagctgctggtccagtttgcggaggagaaggtccagctggcgatgcagggctacgacctactggacactcaccttctgtccctggatgccgacgccgccgctctggccgaggagctccaggccaacgccagcctgaacgacgcctttggccccgacgccggttttggcgggaatggtggcgcgtttgacgacccggggacggcgccgcggaccgcccgcctgcgggacctgtcctcctacgactccctggaggccgtcaccgatccccgctggaacaaggagcaggctggactgatacaagcccaggcccggtgccaggctcacagggcgtggtggaatggaaacgctggcatctgtcgaggctcagcagggcccagtctcatcgcctctcaatccctaatggacccttccaccgctggcctctctgtgcacaggccggaggtcgacgctgggcctctcccgccagccgtcggaggacgccatgacgccgctggcctacgacggtggcgctggcatggcgggtggccggcggccgctgtcctcggccggacgtgcgtgtggaggggaggggtggaggtgctgaggaagcggggtggcgagaggacaggagggaagacctactgctggcagggggctcggcagacagaccgggtcgggtgcaaagtctgcggccgcaccgctgcgtgcatgtctcttcgccctacgttggatgcctaccctggcatgcccgcaccctga

SEQ ID NO: 1186 - DNA, 3060 bp, Chlorella protothecoides
  modified_base (1095)..(1104): a, c, t, g, unknown or other
  modified_base (1969)..(1978): a, c, t, g, unknown or other
atgcatcacatcaaacagaaacgtcagtacccttcagatggcacccaccacagcagggatggcttcccccacgctctcaagcgtgccatacagcagcctcctccccaaagcctcagtgaacactgcagcagcctcctccacgcctacattcgcccgacccagctcggcggcaatgctggtgacgcccttgtctcgaaagccacagggcacaatgtgccggaaccaggagaggtctgtgcagacgttcagggcgatgccatgcgaggcgacgcctctagagatgcggacccccactgcagcgatcttccggtcgcccacccagacaccggttccaccgggcacccgaccctgttgttgggtggcatgggagagggcattgcgttgttgagacttggagagggaagcagtcattcagatctatgcaatgcatttcaccactcagtggacaccgtggacaccggtgatccaacacgtctccacctggaaaaatgtcgcgcagtatgcccgacccatcctgaaaggcacgacctctcccacgctaccacatgcagcgccatttgcacccaccctggctttgatgccgtactctctcaggctgtctatgagggcatcctccagactttccacatacgcacgggccccgagttgccggtctctcaggtgcacgatcgggtaggcaaccagctgcccagggccatggaacgtgacctcaccgccgcgtggcgagctgtggatgatggcgcccaggtcccgaatctgatccggtgtcgagcggaagtccctgctgcttcccctcttgccaatggtgtacactggtgcatgctgggcgttggtggtggggcaggatgtaagcatgacggagattctgagatacgcttgacaatgaacgatttacgtggggctccaacaggagcagctggtcaggtgtggctcgacgtgctacggcctcggcgagggcatcctgaagctccaggccacgagaataaggagtcaatgtgctcagaaggaggcgaacttgcagcaagccgcgcgctacagcggcagtcatgccgacgctttccaaaactgcagaggcctactgccgacatgcacgannnnnnnnnnaaatgtgctcagaaggaggcgaacttggagcaagccgcgcgctacagcggcactcatgccaacgctttccaagactgcagaggcctactgccgacatgcacgacacaacgacatctcggatagggatggatggaaaggtgtaaagctcagagtgagcctgtggaggaggaacagaggaggaacagggttccgggcgcgcgactccgcgcgccaggacgagctccgaaagctcagcaactctcgccagtaacatcagaaacaccttcgcatgcatacattactgctttacatttgcgcggcatccatgctgccatacgacgcgacgtcagccacgcgcttctgaaggccgagctgctgtggtttacaatggcacccccccttgaggcagcattgctaggccgcccaggggcaatggtggaggacaactactccacagatgcatactctacgttcatgggtggcgtggataggcccttgcctggggtccaggtgaccgccaccaccagttcctcgcccagtacgcctgagacactgttttgccaggtgctgcttggcgctggacacagacacgcacgatattgcaacagctctgagcctttaaagggtacagagctagtttgtagatgtaagcgcttcagactatccccacacagaattctggaggtcctcatggaacctggagggcacttcggtgtcagagcatcccggagcagcatggagctggtggatctgggacaatctcggtgcgacagactggccctcccatgcccgccgccgcagtaccagcagccattgattggggtgcagcgtcgacagcgggacacggagaagccaatgaggaggacgaccccttcaactttgacgnnnnnnnnnncctcggtgcgacagactagtcctcccatgcccgcagctgcagtaccagcagccatcgattggggtacagcgtcgacagcaggacacggagaagccgatgaggaggacgaccccttcaactttgacgacctggatgcgtccctggatgctctggaggccgagaggaaggcgagagccccatctgacatgtcacacgggccgccccacgaaaagagtagcgctgccctcgactcccgcgaggaagcgccagcgggtgcttctgctgctcgtgctgaccgggtcgctgctccgctcccgagaccgggccaccctgacgcagagcctgccaccccgggcaccgtatgtggcgttcagcccagagcccagcttccttgtttctacctggtgtgcgaggaggacggcgcggcagggcaggcgaggcagcaagggcatggcaactcggtgcccggcccccagtctgacagcgaggagggaccggcggcatgggagggtgaggcctgggaggcggacgcggtgctccggccgggaggcccagacgccgcttacctgcgcttcaccaaggtcctggggcgctgcggcgaccagtgcatacgatatgggtacgtgggagggcatggagggaaccggctgggctggcctgtctcaagggggtgtgggaatggtggcttcacacaacagtggatgagcacgcatgggcttgcagtcgagccatttgggggtcgtgtatgtggatggatggtaatgacagtgcctcctatctgtgtctgcccacatccacatgtttgggtgctgcacaaacttcatcccaggttcaacggccagctggagtggccagaggacgcccggccccagccaccgccctgtcccctctgcggggcggagcgagtgtttgagttccaggtgatgacgccggctctcgtggccctggacgaggcagcgtcctggtcgggtgtggcgtccaccattcccatcagctggagctggatgacagtggcggtcttcacctgcagcgcagcctgtcagccttccggtggcgaccagcaaggctgctgcgaggagtggactgccgtcgccctggaatag

SEQ ID NO: 1187 - DNA, 705 bp, Chlorella protothecoides
atggggtcgtcttgccctgcctcgctgcccacttgccatcctaaccctgacatcatgcagctcgcttgctccagcagtgtgcggctgacggggcctcggcccttcagtgccaccccttcccgtcatgggaggtctcgtgccccatgcccccggatctacgccgaggatggcgctgccgccaagaaggtcgcggagaagaagccagagtcgaagaagccctttagcccgcccaccctcgaccccgacacgccgtctcccactttcgggggaagcacgggtgcgcgtcgtgagagacgcggtgacttaggtttcacgatctcgccacctctcctgccaggtggcctgctccgcaaggctcaggtggaggagttccatgtgatcacctggaactccaagaaggagcaggtgttcgagatgcccacagcaggcgcggccatcatgcgtgagggccccaaccttctgaagctgtcccgtaaggagcagtgcctggcgctcctcacccagctgcgcaccaagttcaagatcgacggtgccatctaccgtgtcttccccaacggcgagacccagtacctgcaccccaaggtgcattgggctgtgcagaggttggctgtgggtgccgggcttgcaacgatggcaggcgatcatgggggggaggcattgcctgtgatgtggtggcgggcatgcgcacgtgagctctgcacttga

SEQ ID NO: 1188 - DNA, 1206 bp, Chlorella protothecoides
  modified_base (379)..(388): a, c, t, g, unknown or other
  modified_base (738)..(747): a, c, t, g, unknown or other
  modified_base (922)..(931): a, c, t, g, unknown or other
atgccgtactttgcgacactggtctgggtggctggtctcctgctcaacccggctcctcggtaccctcttcccaaggatggcgtgtaccccgagaaggtcaaccctggccgcaaggaggtgaacgccgtcttcaggcgaattgggtccaacaccaaccccgcaaaggtcaagttcaccggcaaggtaggattatgcatgcccccgggagcgactgttctgggtggccgggtgtgctcgtggggatcgctcgctgtgggtttgtggggaaggacgggagggcgggcagctgaccttgttcggggagcgctcttcctgtggagcaatcattctggtcgagtctgttctggaatgcacggccccccagggctgtcttttgtcnnnnnnnnnngacgccccggggatcgactgttctgggtggccgggtgtgctcatggggatcgctcgctttgggtatgtgtggaaggacgggagggcgcgcagctgaccttgttcggggagtgctcttcctccgacgtacgaggtggaggcatgggggcagtgagtcatcaggaacagggtggagcctgtgaggggatgcatctcagcggctcaagccgaggacatctgaggccggaacctccacagtttctgctctcccccctgggcgtgcaccgccaggcatctgcatggtgccgagtcaccagcatgtcagaggcagctgctattggggaaagggcttgggatacccggggtttgttnnnnnnnnnntttgcagccgacgtacgaggtggaggcataggggcagtgagttatcaggaacagggtggagcctgtaaggggatgcatctcagcggctcaagccgaggacatctgaggccggaccctccacagtttctgctctctccctgtataatgagcagctgcacgaccctttgtcgagaannnnnnnnnngcagcaagccgggtctggtcagggaaggcttcctagggtccttgagatgggctttgccacatccagtcccctgcacgcctcgaccccgggccctggggcccgtccacctacccctcttccccaaactcggtcgtgaacttcttgtacgtctccaggtcgtcctgagacactgtcggccgcgccctgagcagcaccttttcgaaatcccggaacgtgatcttgggagggtgcacctggcgggggaggagagcagcggaggtgcctgggtgtcctga

SEQ ID NO: 1189 - DNA, 744 bp, Chlorella protothecoides
atgccacaagaccgcgccccagattggttttacgcgacttgtgagggatgcatggtgccgaatgaccttgtcaggccattgacgtggcgaacgcgtcgggacctgcggtcggagggtgagccgagcgcgccctggaattcaggattatacgccattcgtgctgagagcagagcttcgaggtcacaccgaggacatacgagtgatatgcgtgtgcgatctgggaatcctcaccggctccagggacaagaccatcaagctttgggtggagggcgacgatggggagtacacagaggcatcaatgtttgtgagtctccagggcttgtcggaaggtcatgggagccggctgcggcgcatgacaagctattctgtctgaagtgtgcggttgcattcctggcagcacgagcaacatcccctgattcctcccgaatgcaggtgggacacaccgactttgtgtctgcactggcctttgctcctgcctcctcgatccaccccgacggccttttggtgtccggagctcgggatgccactgtgcgcctgtggaatccggttcgtttcactgagctgcagatcctggagggacacaagtaccaggtgggaggggggaagatgggtgtgcaggccgggcagctggggacgcctgcactcgcatcgcagctgtctcattcttcgcattacagctgttattttgcagacctgcgtcctcatcttcttctccctcagcctctgctcttgcctcggctctga

SEQ ID NO: 1190 - DNA, 1026 bp, Chlorella protothecoides
  modified_base (188)..(197): a, c, t, g, unknown or other
  modified_base (268)..(277): a, c, t, g, unknown or other
  modified_base (386)..(395): a, c, t, g, unknown or other
atgtctgggttttgtgaacacccctcaccccgagccccggcgagcccagtcagacacacgccctcggctcgccacatgggcgcaggccctgccacaccctggctgtgtgtggacggtcgagttcctgccggacggcgacctggtcacggggtgcgcagacggcgtggcgcgcctgttcacgcaggacnnnnnnnnnntgatttcctgccggacagcgacctggtcacggggtgcgcggacggcgtggcgcgcctgttcacgcaggacnnnnnnnnnngtcccccgtggaaatggggcgcccatcgtgtggcccagtcaggggtgctgcatgcaggcgtcagcatctctgggcattccaccgtcggcgcttccttctcacacggcgnnnnnnnnnntcctcacgggcggcgggggccgaggcggtgcaggtgcgccgctcggtctggaggtgggggagggcgggtcctgggagaagcctgcgtgctgcagtgcccgtggaaatggggtgccatcgtgtggcccagtcaggggtgctgcgtggaggcgtcagcatctctgggcatcccaccgtcggcgcttccttctcacacggcgcatgccatcgcccccctgattccctcattctcccattgccaggtgtttgaggccacgctggccgctgcagccgaggcggcggcagccaaggagggcgccggggagggcggcgccgctgcgggcctcaagctggaggacccctctgtgctgcgggagccggggacgcacccgggtcaaacgagggtggtgcgtgaggggggcaccggcatggcatacagctggaatgcggccaggtgcggcggtggggtggtggaggggggaggtgggtcggagggggtgagcatgggtggtgaagaggacatgtgctgggtggaccatcggagtgtggggagagccaggcgaggggcaggctgggggagtcggggtgtggagtggcgctggcggcctgcaggcgctgccccgacttgcaaggctcgacgggccgaggggtga

SEQ ID NO: 1191 - DNA, 186 bp, Chlorella protothecoides
atggtggatgacatcatcgccggctgggcaagcgagctggaggcgcgctccgcgtccttcaccaagcacgccgccgcgctggcggagtgggacgccgttatcctctcaaaccgccgctccctgctcgctctggagcaggaggtccgcaaggtgaggggagaggggggagggggcaaagaattgtga

SEQ ID NO: 1192 - DNA, 669 bp, Chlorella protothecoides
atgctgggcgccaccaacctgccctactccctggaccaggcagtgcggcgccgcttcgacaagcgcatccacatcccgctccccgaggcgccggcccgggcctccatgttccgcatccacctgggggacacgcccaatgcgctgactcagcgcgagtttgacgacctgggggagcggacaaagggcttctccggctccgacgtcgccatcgtggtcaaggatgtgctcatgcagcccgtccgcaagacgcaggtttgtggtgacagagttggggttgaggcgggtgggaggcttgagaggtcctggacttgtgcagtgcacaggagtgtcaaaggggatgaagtgaagcgtctacttctgcgaccagcctgcagcaccggtgttgccagcaatgcatcgctggggttccctgcaagtctgcccctcccatcgccactccatccccttcccacacccgtgttccaggacgcgacgcacttcaaaaaggtacaagaagggggcaaggtgatgctggagccctgctctgcgggtgagcccggcgccttcccggccacgctccagagcttggcagacaagggccaggcgcagctggtcttgcagcaggacctgctcggtttgcacttcatcggccgtcacgaaaggtcccaccggctgacatcagtggcctga

SEQ ID NO: 1193 - DNA, 633 bp, Chlorella protothecoides
atgcttacatcctgccccaccaccaacgcccagcatgcaccagtgtacaccattggcaagaggggaagcagcagggacttccgctcgacaccggatcagattcgggacctgggcgccatcatccacagctcgccacgcggcggtgaggtcacgttccatggccctgggcagctggttgcctacccgatcgtgcacctgagagaccggcaactcggggcccgtgcgtatgtggaaagtctggaggatgccctcatagacagcctgagagagtacggcatcaaagccagggtgggtgcaaatggcgctgcatgtggtagcggtcgggtgcccggtggaaccggtgtctgggtgggcgaccggaagatcgctgcagtgggggtccgcatctctagaggcgtcgcctcgcatggcatcgccctgaacgtctgcacagacctctcctggttccggcacattgtgccctgtggctttcgagacaagggcgtcaccagcattgccgccgagctgggtcgggcgaatgtaggcgtggaggaggctgctgcagtgttcactgaggctttggggaggaggctgctgtatggcacgcttgagagcgtgggggaagccatccctgctgtggtgggtgccatctga

SEQ ID NO: 1194 - DNA, 483 bp, Chlorella protothecoides
atgtcaaggtggggtggcggagtcgttacgtgggacgacgtggcggggctggagtccgccaaggatgcgctgaaggaggcggtcatcctccccgtcaagttcccccagttcttcaccggcaagcgcaagccctggagcggcatcctgctgtacggtccccccggtaccggcaagtcctacctggccaaggcggtggccacggaggccgactccaccttcttctccgtctcctcctccgacctggtgtccaagtggatgggcgagtcggagaagctggtgtccagcttgtttgcgctggcgcgcgagaaggcgcccgccatcatcttcatcgacgagatcgatgcgctgtgcagctcgcggggcgagggagagagcgaggccgcgcgccgcatcaagaccgagttcctggtgcagatgcagggcgtgggccacggcgacgacaagaagcgggtgcggggatgcggggcggggacggcgctgtga

SEQ ID NO: 1195 - DNA, 246 bp, Chlorella protothecoides
atggcatatcatcacttatcggccgaatgtatcctcccacccttgttcctcttcctgcaggtcctgcatgcccaggaggcgctggagcggaagctggccatgctggacacacatcagcgcggcatccatgagacgctgacggggatggagcacgaggccgccaggctggcgctggaggaggccggcctccaggacgaagggacgcggtgcgaggctggggaggggattttgtggaaaggaggatga

SEQ ID NO: 1196 - DNA, 285 bp, Chlorella protothecoides
atgcaccttggggtgcaggtactgggtctcgccgttggggaagacacggtagatggcaccgtcgatcttgaacttggtgcgcagctgggtgaggagcgccaggcactgctccttacgggacagcttcagaaggttggggccctcacgcatgatggccgcgcctgctgtgggcatctcgaacacctgctccttcttggagttccaggtgatcacatggaactcctccacctgagccttgcggagcaggccacctggcaggagaggtggcgagatcgtgaaacctaa

SEQ ID NO: 1197 - DNA, 2457 bp, Chlorella protothecoides
  modified_base (693)..(702): a, c, t, g, unknown or other
  modified_base (1795)..(1804): a, c, t, g, unknown or other
  modified_base (1976)..(2057): a, c, t, g, unknown or other
atggatcgaacagtgaaaggccagcgaggacgcatgctggtgtcgccttccagagtcctcggcttgtgggggggcctcctgtccagccccagaagtaaacacctcacacgcgcacctggggcggcacacaggtccaggcacgacctggagctggacaggaagtcatacttgcggttgagctggatgagcttaaaggcggcgcgggaccggaaacctgcagcgaggagggcggtgtgggttaaggctggggcttcagccggcaggaagaccctgcagcatgcgccccgcaatatgcaaccatgcaccaaatgcgcagtttcacacatggaagggcaatggcatgcatctcgcttcctccctcgcgccgggccccgtcccccgccactgcgcgccttgctccttggcgaggtagtagaacttatccaggcgcgtctttcccagcttcttcttctgccccatggtgtctcagtactagggtgtggggctcaacaggagggcgccacagagtggctgtgcggggcaggcagggcgagagggggtatttcatgccggcaggcgcgcgcccggggcggagcccgaagatgcggcgcctgctgcgggtgttggtgtggtgggggagggacgcacgcaggcatcattcgaacaccctcagcgcgctcatcgctcttcattcaccattcaaatgagtcgtgnnnnnnnnnnatcattcgaacaccctcagcgcgctcatcgttcttcattcaccattcaaatggatcatgccttacaggctcagcagttcattcgtccagggtgacgcacaggaggcgcaggcacgggcgctccgcccctcgcctgcgctcagcgtgccgcagcggtggcggcggtgtcgtagccgtcggggttgttggaggcccagcgccactggtcctcgcacatatccttgaccgtcagcttggccttccagcccagctcgcgctcggcggtgtcggtggcggcccacaccgcctcggcgtcgcccggccgccgccccaccagcttggtcttcaccttgagcccgctggccgcctcaaaaccctgcaaagcagatggttgaaggggatgaaaggagggggtggggtaaatacgcgtgggtcggcggtgagggctgccactcgggatgcctgcttcgacagacgctcaaccccgcgtgggtgcctggaagccccccaggcgcacactcccacctcacccacagcgtggcctcgcgatgccgcccctccgcgcccaccccaccgccttcctccccctcgtgccacccaaatcaccctcatgcatcactcctctcccactcacgtggaccatctggaggacggtggtgcccttgcccgtgcccaggttgtaggccacggtgcccaggccctcggtctcctcggtcttgcgcaccgcgcccacgtgaccctccgccaggtccatgacgtggatgtagtcgcggacgcaggtcccgtcctcggtcgcgtagtcggtgccgtacaccgccagctcggggcggtggcccagggccacggcctgtacccagggcatcaggttgttcagcttcacctggtcctccccgatgcgaccttgaggaatggaagacggggtggtggggggtggggggggtggaggcaaggggcttccccagggggaaaagatggggcaagcggcgtccgtggacagatgggggccgcgagctcgacacgtgcgcatcagggtgcacaggacacccgtgacaccaccgcccatggtcttgagcccaggcatgaccgccccacgctccctgcacgcccccatggcnnnnnnnnnngggcttccccagggggaaaagatggggcaaacggcgttcgtggacagatggcgggtctcaatgaccaggcccagaccctgggtgggaatcaggcggcaggcagggatgacctcgcccggagatcatgccgcaggcgagagcagccgcgacgcaagcactgtcccgggtgccnnnnnnnnnnnnnnnnnnnnnnnnnnnnnnnnnnnnnnnnnnnnnnnnnnnnnnnnnnnnnnnnnnnnnnnnnnnnnnnnnnccccccttcccccctcaccagaggggtgtgcgccgacggggttgaagtagcgcaagaggacgatgcgccactccttgtcgctggcgtgcaggtcacggaagatgtcctcgttgatgatcttggtgcggccgtagggggagacggcgcacagcgggtggctctcgtcgatggggacgcgctgggggttaccgtacacggtgcaggaggaggagaagaccagcttcttcacgccgtgcttctgcatggcgcgggccaggttcaccgtgccgcaaacgttgtggtcgtagtatcgaagcgggtcctccacgctctcgttcacatacttgcgagccgcaaagtgcaccaccgcggtgaacctgggtattttgggggtgggaagggggcaggggagtgtggatga

SEQ ID NO: 1198 - DNA, 1923 bp, Chlorella protothecoides
atgccggtgggcagcctggtgctgggcgtggacctggtgcccatccgccccgtgcgcggcgcccgcacgctgatcggcgacatcaccaccaccgagacgcgggccatgctgcgccgtgaggcggcgggcgcgctgttcgacgtggtgctgcacgacggcgcgcccaatgtgggcggcgcctgggccagcgaggcgtacagccagtcggcgctggcgctggaggcgctgcgcctggccagcgacacgctggccccgcgcggcacctttgtgaccaaggtgttccggtccaaggactacacgcccctcatgtacgccatgaagcagctgttccgcagcgtggaggccaccaagcccgccgcctcgcgctccacctccgccgagatctttgtggtgtgccaggggtacaaggcccccgcccgcatcgacccgcgcctgctggaccccaagcacctgttcaaggacgtggcggaggctccgcgcaacgcgggccccgacgccctggtcaagcagaaggtcacgcagcgccgcttccgcgagggctacgaggacggcctgtccagcctgcaccgcacgctccccgccgccgactttgtcctgctggacgcgcccatcgagctgctgggcaagtacaccgtgctggacctgggcgccgaggccggcgccgggggcgagggcgaggggcgcgagctggcgcgcttcgtcgccgaccaccccgccaccacgcccgaggtcaggctcctgtgcggcgacctgcaggtgctgggccgctccgagttcaagcagctgctgaagtggcgcctgaccctgaagcgcgacctggccaagcgggcgccggcggcggccgaggccggggcgagtgtgaagggggccgaggacggtaagaccgcggaagacgaggaggaggatgcggagacgcgtctgctgcgcgagatgggggagatcaaggaccgcatggagcgcgtggccaagaaggagaagaagaagcgcaaggagctgcgcatgaaggcgcggctgcgctccgcacagatggctgaggcggagggcatcggcgaggataatgggccggagagcatgttctccctggcctccatcaagggcagcaggcaggccgtggagcggctggcggcggcgggcgtgccggataccgaggatctggactccgggtccgaggccggggacgtggcggaggaccccggcaccgagtccgaggtcgactcggaggacgagcagaggcgctacgacgccgtcatggacgagtacctggagacgtcgtaccagtcgtggaaggagcggcagcgcatccggggcaagggcggcgcggcacgcaagcggcggcgccgggtgggcatggagggcgacctgtcggaggaggaggaggagggggccgacgccggggacgagcccgtggtcctgggcgggtacagcgacgacgacgacgacgatacccccggcgacggcggcggtctggtcgtggagctggacgagagcaaggtgggggtggccaccagcgcggcggctgccgccgcgcagtggttcagccaggacatcttcgccgacgccgacatcagcgcggcggcggagggggacgatgcagggggcgcgtcgggagacatgagtggcgtcgaggccgcgccggcgcccgctccggcggtgaagaaggcggggcagcagcgtgcggccgtgcccgccgcgcccgagccctcggatgctgacccggagcccctcacaggcgggcgctctggtggggcatctagggcggggttcgaggaggtgcctgccaaggactcggactccgactccgactccgactccgactccgagaacgagttggagctgctagacgacgatgccaaggtggggcgagcatcatttgtggagtgcggcagtctcgtgggattggtgtacaagctcctgtgtgggtaa

SEQ ID NO: 1199 - DNA, 3720 bp, Chlorella protothecoides
  modified_base (210)..(219): a, c, t, g, unknown or other
  modified_base (273)..(282): a, c, t, g, unknown or other
  modified_base (506)..(515): a, c, t, g, unknown or other
  modified_base (644)..(653): a, c, t, g, unknown or other
  modified_base (1147)..(1156): a, c, t, g, unknown or other
  modified_base (2700)..(2709): a, c, t, g, unknown or other
  modified_base (3357)..(3366): a, c, t, g, unknown or other
  modified_base (3431)..(3440): a, c, t, g, unknown or other
  modified_base (3505)..(3594): a, c, t, g, unknown or other
atggcgaagcaccccatggagggctttgactttgataccgacaaggaagacctgcatgagatccgagagaagctggacggtgggtccccagacgtcagcacctccagcctggacccggtcgacctgaatggcggcaatggcctggagaagaacgggcaggggagcatcaaggcactgcatgtggtggcagaggagggcgggcagggaggnnnnnnnnnntcctggtccccactcatctatcaatcagatccgagagaagctggacggtgggtnnnnnnnnnncaccggtggggggcttcctacaaggaccagctcaagatcctgttccagcgctcgatccggacccggcgctttcaggtgcgtgattgtgttcctgtcatagcggttgatggtgttgtgcagtttgaggggggtgggaaggggttcctgcgtcatgctgtttttgtatgtggcatgttgccaatgcatcatcatgtccctttggggaaacgtgtacaacttgtgtnnnnnnnnnngatggcggttgatggtgttctgcactttgaggggggtgggctggggttcctgcgtcacgctggttgtggatgtggcatgttgccaatgcatcatcagatccctttggggaaacgtgtacaacttgtgtnnnnnnnnnnggcagggaatgtggaacttctccgtgcaagacatcgcccagctgatggtgatcgccgtgctctccggcctcttctggctgcagaaggcccaggacgacaccctcctgtccgctcgaaacaccattgctgctgtcagattgtgtttgcgcacagcacaataaaaagcccgcccactccacaaactctctcccactccccaggactgctcttctttgagatcatgttccttgccttccgcatgctgtttgtggcgctgttcaccttcccggaggagcagcggatgatgctgaaggagcgtgccagcggcatgtacaggtccgctgcccggcagagtgtcgtgggaggggtggacgggaggtgtagttgtgtgttgatcgaggatctgggggttcgtggagggtcagtgacgcaacaacaccgtggacggcacctggtgggccgtcctcagctagggacatggagaacgagatccccaacccacttctgtctgccgnnnnnnnnnntccggcagagtgtcgtgggaggggtggatgggaggtgtagttgtgtgttgattgaggatctgggggtgtgcggagggctgtcagccttctactttgccagactcatgtccgactggcccatggacttcaccattcccaccctcttcatcatcgtcgtctacttcatgggcgggctccggtacacagctggcgccttttttgccaactacttcactgtcatcctgtccatgctggtggcccagagtctggggggagtttaccgaggggttgcgtgtggtagtgtgactgctcattggcacgatggtcatgaaccccaagacggcacagacctacgccaccatcatcatgctggccatggtcctgacaggagaggtgcatgtgctgcttgtgggcagccccaaccatttcaccccatcccacactgcaaaggcttcttcgtcgtgggcctggcggactggatcggctggctcaagtacctctcattcatctactatgcgctgggcatggtgctgtactttgagttccaggggcgcaccatatacagctgcatggagcagggcaccgacacctgcgtgctgaccaaccccagcgaccctagcaccagcccggaatgcaccccggtcaccaaggaaggagctgctttctggaacatactgaagctccttgtccaaggcgtcctcccgaccaacaccaccccaccaccaccacctcgtcatgcaaacacagcctgcaggactcgctgcagctgctccaggaccccaacagccagggcgaagccatccgcaacgggttcatcctgctcggcttcctcatcttcttccgcgtctggtgctactatgccctgcggagcaagactgcggggctgtgagggccctgaggctcgtcccactcttcacggaactgtcggagcaggggggtcagcacgccgcagccgcacctgcagcgtgggcggtgcaacccccgttcatcccaactctacacgtgttctcaaggatgtattgatccatttgtccaggagggacacctccgtacctcaccttgatatcccatcctgtcacccaacccttgtaccagagacttctgcgcatgccagtgctcatcaatgcatgtcgtctgcagaacctgtgtcacctaggcaccctgcagcccgccttcatgatgatgttgaaaacatgaaaattcaccggcagctattcttgaaccttgcagtgtgcaaggttcagtggttatttggttcgttgcctgggttcatcctgtttggtaggtcaggggtatggcaggagcaagaggcatgccatcccatcacagaatccagtaatggaaaatcttgtcggcctgacgagcttccgttatatcggcgcagtgtacatcatgcacccctttcacagccgcctgcatcggcagtgccacccctgggcttcagtacctccagagcaggcgtagccctgagatacttgagcagccttggacagcaacaagggcgactggttgcactggttcctcaaggcagcgtcctctacatatttggctcaaccccaccccgnnnnnnnnnntcatgcacccctttcacagtcgcctgcatcggcagtgccacccctggggctcagtacctccagagcaggcgtagtcctgagatacttgagcagccttggacagcaccaagggcgactggttatactggttcctcaaggcagcgccctctacatatttggctcaaccccaccccggaagggttgcatgtagatggtgcagtatcgagggacatagatgagctgtgggagtccaagacaaaatcttatgggtatcataacacgttgccgattgaggaggctgccttgattgatttattcaccgagtaccatggcaaactgcccacgtgcgggcgcctcgagttcaaaatgcatccagatcgtattcggaccccaccccagggaagcttcaagatcgagctgcaggagggaggtggatggtatcatctaggttgtggtgtgcgatctccagcatcagggtctcatgagatccttcgaaggactggttgcgacagagaagggcatttcatcggcgttaaagatgtcaggaagtgccagaatatgccgccagaccttgcggaggcggcctgccatatcagaaactctggccacatggagaagcgtccctatagctatttgttaccggctccgccgctgacagccctggtacannnnnnnnnntcagacgctgggcccagtaccacagggcaatgctggtgctgcaactgcatcatcaccgcaaatannnnnnnnnnccagacgctgggcccagcaccaaagtacaatgccggtgctgcaactgcatcatcaccgcaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgccgccagaccttgcagaggcggcctgccatatcagaagctctggccacacggaaaagcgtccctatagctatttgtcaccggctccgccgctgacagccctggtacaagcagcaagcccttga

SEQ ID NO: 1200 - DNA, 768 bp, Chlorella protothecoides
atggagaccccccatctgtccacggacgccgcttgccccatcttttccccctggggaagccccttgcctccaccccccccaccccccaccaccccgtcttccattcctcaaggtcgcatcggggaggaccaggtgaagctgaacaacctgatgccctgggtacaggccgtggccctgggccaccgccccgagctggcggtgtacggcaccgactacgcgaccgaggacgggacctgcgtccgcgactacatccacgtcatggacctggcggagggtcacgtgggcgcggtgcgcaagaccgaggagaccgagggcctgggcaccgtggcctacaacctgggcacgggcaagggcaccaccgtcctccagatggtccacgtgagtgggagaggagtgatgcatgagggtgatttgggtggcacgagggggaggaaggcggtggggtgggcgcggaggggcggcatcgcgaggccacgctgtgggcacccacgcggggttgagcgtctgtcgaagcaggcatcccgagtggcagccctcaccgccgacccacgcggttttgaggcggccagcgggctcaaggtgaagaccaagctggtggggcggcggccgggcgacgccgaggcggtgtgggccgccaccgacaccgccgagcgcgagctgggctggaaggccaagctgacggtcaaggatatgtgcgaggaccagtggcgctgggcctccaacaaccccgacggctacgacaccgccgccaccgctgcggcacgctga

SEQ ID NO: 1201 - DNA, 531 bp, Chlorella protothecoides
atggccctggccaagaagatgctgcggcgcagggtcaaggacgacatcgtggaggcggcctacaacagatacgcgttccacgacacgggcctgcccaagtggttcgaggaggacgagaagaagttcatgcgccctgcgccccaggtcacgcccgcggagtacaaggaggcgcgggaggcgctgcgcagtgtggacgctcgccccatgcgcaaggtggcggaggccaaggcgcgcaaggccaagcgcctgggcgagcggctgagccaggcgcggcagaaggcagaggccatcgccaagtcggaggacggcagtgcgggggccaaggtgaaggagattgagaagctgtacaaggtggcgcgggggcgggggcggggcaagaagaagccctcccgctctgaccagtacaagaagaaggggccgcccctggacgcccgcatgcgcaaggacaagcggggtaccgaccgggcggccgcccggaggggggagaagaagccgagcagagggggtagccgtggtgggaagaggcggtag

SEQ ID NO: 1202 - DNA, 1143 bp, Chlorella protothecoides
atgggaatcgacgaggatcagaaagcccgggaggctgggactccacgggtggtcccgtcggggaccagctacgggtccgacggtcacaggaacgcctccttcctggagcgcacgcacactgtgaagctgcagatcggccagacagatattggaaacctgtccattatcgagtccataccaccgaacaagcgcgtggtggtgcagatcaatgctgtgagcgcacatgtccccaacttcttctcggggccctcctggacctccaagctgaatcccgctacatggcggaagagcagcgcggccacgcccgtggatgaccgccccaccatgcgacaagggcgcatcgagccaggcgaggtgctggcgctgatgggcccctccggctcgggcaagacctcgctgctgtccatcatgggcgcgcgcgcgcagaagctgatgaaggtcagcggcagcgtgactttcaacggcgcgccgctgaccaagcgcctgaagcgccaggtgggctacgtcctgcaggacgacctgctgtacgagtcgctgacggttgaggagacactggggtacgccgctgcgctgcgcctgccacgcgagatgtcggcggcagacaaggccaagcgcgtggacgacgtgatcaccgcgctaagcctggaggggtgccgcaagaccaccgtcatcggcggcttcttccgcaagggcatctccggcggcgagcgcaagcgcacctccgtcgggcacgaactcctcatcaacccctccatcatgttcctggacgagcccacctccgggctggactccaccaccgccatgcacctgctccagatgctgcagttcctggccaagggcggccgcgtcatcgtcaccaccatccaccagccctcctcccgcatctaccagaccctggataacctcctgctcctgtcccaggctcgaggccctgtggacaacaacctcccgcccatcctaccacaaaacccactcacagggcactgcatgtaccacggcaaggcacaccacgccgtcgactggtttgacgcgttgggttacaccctgccctaccgcgtgaacgccgcagacttcatcctggacctggcatccgccgatgtgtccacggagggcggccgtgacggcgaggagacgcgcaagtga

SEQ ID NO: 1203 - DNA, 2529 bp, Chlorella protothecoides
  modified_base (568)..(577): a, c, t, g, unknown or other
  modified_base (2332)..(2341): a, c, t, g, unknown or other
atggaagatgagcaagaaccaccacctgcagaccctgcatgtgctagacgccctggcatttgtgcaatcggtgcaggcacgggtgctcccgggcaacaccctgttcatggacttcccctatttcctccacccaacatgcactcactggcagcacactctgcctttgcacaaggcaagcctgcatgcccaccgggtgtcttgcccttggaagtctccgcaatcaattcctcagcgcaccccttgtcccagatggccatcggacactggccggaggtcttgttccctgccttctcctcgctccagcttcagcccggcttccggccggcccgggtgctgctcatgtccctgaagcggacccacttgatggcctgggccaggacattcatgggcgtagccttgtcggggacacagccgacagatgacctggcccccatcgtgtttcagtccgagtctgactcggtttggcaccagatacgtgcgtcaggaagaggttgtggggagtgttcattgcggctaccacccatgcaagggggggacagcagggcccttgcactgcggagcttgtcgnnnnnnnnnnagatacgtgcgtcaggaagaggttgtggggggtgttcattgcggctaccacccatgcagggggggacagcaggggccttgcactgcggagcttgtcagactggtggccagcccggtggacaggccattcacagccttgcctgtctgcccctggtcgcaagtgtcgagcctggagggactggaggagtcagagtggctctgcatcagcaagctcctggttcccctggagatggacctcgacggccgccgcaccttcttcagccaggcagacggacaccttttccgccagcgcctttatgcacaggtgcgtcggaaaggggagaacacattgtgggtagggggttatcgcccagcctgcggtcagcgctcaaccatgcctccacatgcctaggcatggctgtggtacgcttgtcatggcatagatttggggcacttcttcatccatcaaattcctgtgcagtttgggttgaagcctcccaccccgcacagtcggcatgcggtgcccaacatcaccctgcaccgaaagacctccaatcgccgaatcctgaatctggaggagctcgtcgccatgctgcgcacgctggggcatgtccctgccagggactgggttggcactccgctagcctcctggacccctcaaccctcctccccactcaggtgaacatggtcgaacacagcaacgacacgcccatggcagagcagatgcgatccgtggcctccacctccgtcctcgtcagcgtgcacacctcggccctggccatcgcccccatgctgcgtccggggtcgatcgtggtggagctcctgcagcgcaactggcgctaccagcacctggacgagagcttcaaggtgcgcgtggtgggtggtttagtgggggttatgggagaggtggggggttggctggagagaggcgcaccgagtgtgggtggatcttgtcctgctctacaacaggctttgataggatgcactgcatgcgggggcttgcgtggaaacgctgtgccttggaggccgcagttccatccatggtgcggtgcctggctgtgtttacctgcgttcagtgtgcccaccgcttcccaggtttctccacgagtcactggcagtgcattcggcgcctcgcctgcatgcactcctgtcccaagaacctccagcccatccccctccaagcctcaacaggcacagacggaggtgatgggggacatccaccactttgcctggcgcgccacgcagcccaaccagacggtgtacctcaatcccagggacgcggtccgcttcggggactggaccacggagatggtacgcggtgattccaggaccttgctggactcggtgtggttttggggcctcgtgggggtgctgtggcgacctgtaaagcaggaccttgctggactcggtgtgggtttggggcctcgtgtgggtgctgcggcgacccgtaaagaagctgcatgcctccaggcctggcgtgcctggaagcttgacattgctgcttccgccccgcatgtgtggaaaccatgtgtgcgacacggaggagtgcgtggaggcgcacaccacagtggacgtggtggtcgacgtggaggccgtgcggcagctgctcaccgaccgactggccctgatacaggccggggcaagcgtggaggaggcaagcctcccctggccccagcggtagcaggttggtgtggacgatggggtgtcaggcaagaatcttcgcgggacggcccggccattgccccctggccatacctgtccctctcatctggacaannnnnnnnnngttggtgtggacgatggggtgtcaggcaaggatcttcgcgggacagcctggccattgccccctcgccatacctgtccctctcatctggacagggcactggctggctccagggcctgctcaaagccctgcatgagctcacctgtgcatcacaacagaatcccctgtaccttcccagcacaaggggataa

SEQ ID NO: 1204 - DNA, 936 bp, Chlorella protothecoides
atgaagttcggcggctcctcggtggccaacgcggagcggctgcgcgaggtggcctccatcgtgtgcagcttccctgaccacctgccctgcgtggtgctgtctgccatgggcaagaccaccaacctgctgctgcaggcgggggaggaggcgctgcacacgccggcgggggaggtcggggcgctggcccccctggccgccatccgcgacctgcacctggccaccgccgccgagctgggcgtggacgcgcaggccgtgcggggcgtggagacgctgctgacccagctggagcagctgctggtgggcatctccatcatgcaggacctgacccaccgcgcgcgcgactcgctcgtctccttcggcgagcgcctctccacgcgcctcttcgccgcctacctgcgcgcccagggcgtccccgcgcgtcagcacgacgcctttgacatcggcgtcatcaccaccgacgtcttcacctcggcggaggtggactacgaggcctcgctgcccgcgctgcgagaggcgctgcgcctgcccgggtcggggggtccccgcccgctgcccatcgtcacggggttcctgggtcgcgggcgggggtcgggggccatcaccacgctgggccgcggcggctccgatctcacctgcaccctgctgggcgcggcgctgggcctgccggaggtccaggtctggaaggacgtggacggcgtgctcacctcagatccgcgcatcatccccgccgcgcgccccgtggcccagctcaccttcgaggaggccaccgagctcgctttcttcggggccaccgtgctgcacccgcaagcaatgcagcccgcccaggaggtgggcggcatgggcgtacgcgtgaagaacagctacaacaggtggcgctgggattgttgtgggtgctgggtgctgggtggtaggttgtgtggcaatgggggaaaatga

SEQ ID NO: 1205 - DNA, 705 bp, Chlorella protothecoides
  modified_base (244)..(253): a, c, t, g, unknown or other
  modified_base (676)..(685): a, c, t, g, unknown or other
atgccccgctctctgaaacagttcctgcacgagtgcactcccttccctcctttctccaggagtacaacgacctcgtccccaacagctggcgcatcgtcaacaaccaggatgcagtgtgctcggtccctcgcctcatggggtaggctgtcgggagcgggaaggataccgaagaatggctgttctgaatgctccccgacccccccgccttgcaccagccaccgcagaaatacataccccggtactnnnnnnnnnngtctgggtgtgggcatgaccatgccattgcgtgcatgcgtcttcctgcaccatcttgagctatccttcgtccgaatcgatgagctcaggataccgaagaatggttgttctgaatgctcctcgaccccccccggccttgcgccaaccgccgccgaaatacataccccggtccgcaggtactgccacgtgggccacgccgtgcgcctgctgggcgacggccgggtggaggtgcagcgggacaccagcctggcgctgggagagggcacggccatgcccgacatcatgcccgccgtcgctggcatgatcacggccgtagtgcctcagttcacctccaaggcagtgagtggggattggcggggaggatgggtacacaaggtcattgtgaggagggtttctggtcgtgagtctcccaaagagatggagnnnnnnnnnngcccgccgtcgctggcatga

SEQ ID NO: 1206 - DNA, 300 bp, Chlorella protothecoides
  modified_base (13)..(22): a, c, t, g, unknown or other
atggtcctctccnnnnnnnnnntggttcccttgaaaaccaaggtgacccctgccatgttcgttgcgctatgcgccctgtggcatggtcctctcctcctacacacccgtgctccaagacctcttgtccacgctggtgcagggcacgcctactacttcctggaggacgtgtaccctcggatgtccggcggacggcggccacttcgcacgccagggatcctgcgtgccctgttccctgccaaccaggtcatccctgctgcagcggtgcaacagcctccagctgcggccggaccagagggctag

SEQ ID NO: 1207 - DNA, 1938 bp, Chlorella protothecoides
  modified_base (158)..(167): a, c, t, g, unknown or other
  modified_base (1321)..(1330): a, c, t, g, unknown or other
atggtcgctcctccggcgccacaggtattcctcggccggcccctccccgcttctgtgacgattgtagaggtgtgggcatccctctttgcgggtcttggtcgctatggcgtggaaggacatcctccaccttgcatcccattcattggcgccccaaaacnnnnnnnnnncccctctttgcgggtagggccgcgcgatggcctgcagaacgaggccacccccatccccacggcaacaaaggtcgaactcatagagcggctggccgctgctggcctgcccgtggtggaggcgacgtccttcgtgtcccctaaatgggtgccccagctggcggacgcggcccaggtgctagcacaggtccggccccgccccggggtcaggtacccagtgctcacccccaacatgaaggtgcgcggttgttgtgtaaaccgggctttgtattgcgggtgtcctgccgccaacctccagcctgcagcgcttgggcgggagactgccagtctcccgcctgctgcgttctctagggatcaaagggcgaaaaacggtggtccacccgcttgcagcacgcacaggatccctgcgcccaccctcaccccctgccccgcattctatctattctacaccccgcagggtctggagaatgcgctggcggcgggcgcccaggaggttgccatcttcacggcggcctcggaggctttcaaccgcgccaacaccaacgtgggcatcgatgacagcctgcggcgcctggccgacgtcgcggccgccgcccaggcggagggcgtaacggtgcgaggctacgtctcctgcgtggtcggctgtccctaccaggtgactcagaggggcagatttcggtttgtaggggtttccgcaggccgtccgtctggtaatgcctgcgtgtggcgcggtggttgtgcggcgagggcccaacgcaggccccccctccctgaagctcctgatgccgggcgggcctgccctctgttgcagccgaccggtagtcgaaaagatgcccgccttgctgctcgacaccaacccccatcttttacaaccctgcgcccaccccctcgacctgccccctcctcccaggggcatgtgcctccccaggaggccgcgcgcgtcgcccaggccctggatcaaatgggctgctaccaggtgtccatgggcgacaccacgggcgtgggcacgccagcctccgtggccgccatgtttgaggtggggcgcggtgcctggggcgtcaggccagggtgggtactgcggacggctccgattccccctttcatcctcaccgtcatggggagtctcgctcgcctcgcatgctcccacccaagcgctnnnnnnnnnntctgcggacagctccgattccccctttcatcgccaccgtcatggggagtcttgctcgcctcgcatgctcccacccaagcgctcacctctgagttcctccctcaagctcacccccacccccacccctcctcccctttcctcccccgctttccaggcatgcaccaaggcatgcaccaaggtggtgcccgtctcccgcctggccgcgcacatgcacgacaccttcggccagggtctggccaacatcctggcagcgctgcagctgggcgtggccaccctggacgcctcggtggcggggctggggggctgcccctacgcgcggggcgccacggggaacgtagccaccgaggatgtggtgtacatgctggaggggatgggcgtggcgcacggcgtggacctgcccgcgctgctcggcgccgccgactttgtgtgcggcgccctgggcagggccagcggcagccgggcgggcaccgcgctggcgaggcggcgggacaaggaagcgggggcgcctgccaccgcagcggcctgagaaaggggggaaatgtggggtgtggagtaggaagcggatgtgagagagccaggcgggttgccgtgccactcacggatctctaa

SEQ ID NO: 1208 - DNA, 795 bp, Chlorella protothecoides
  modified_base (6)..(15): a, c, t, g, unknown or other
  modified_base (235)..(244): a, c, t, g, unknown or other
  modified_base (397)..(406): a, c, t, g, unknown or other
  modified_base (577)..(586): a, c, t, g, unknown or other
atgccnnnnnnnnnntcagcgcttgagctggtttccaccaggccacgcccatcgccacctctccattcaccttcaaaccctgcacaccatactgcagcggagggaggctccttccagtggtgtgcgccggaggccatcctgggcgagcccagcacggtccagtccgacatgtacagctacggtgagcagcgatggtctgcgtggataaccagggtagtgtgcaagcaaggtggcnnnnnnnnnntacccgcgaagtcaggtaaggcacgggtatctgatacccccgctgctgccgcgctgtcaagtgtgctggctgtgtgcacccttcttgtgcgagcctttacacgcgactcgagcagacgcggatgtttagcatgtccttcaaatctagcgacgnnnnnnnnnncgcactcctggactttgaacaaggggcgcagcatcttgtatcaaacgtcaaccaccctccacatgccaggcgtcgtgctgtgggagctgatcacgggggaggtgcctgtcaggggacacacccgcgaagtcaggaccccagaggagtgccctgctgaggttgcagcattcnnnnnnnnnnccttgacgtatgcttcaacgagcgcccgcatgatcaccgcactaagaacaagtttgcaactcgcgctcccctgcaggaccccggaggagtgccctgctgaggttgcagcattcatggagcagtgctgggagaggaagccatcggatcggcctctcgcccaggaggcagtggccctcctccgccgcctctactgcccggatcaggagtga

SEQ ID NO: 1209 - DNA, 2358 bp, Chlorella protothecoides
  modified_base (1944)..(1953): a, c, t, g, unknown or other
gcccgccgcccgcgtggcggctggccgactacgccacccccggcggcgcgctggcggggcggagcggcgcggcggggagcggggccacggggaggaaacgggcgcgccaagcgagcatcgcggccttcttcacctcgcccctgcggagacccgtcatcgacctcacctgccaggcccccggctgaatttttgatgggtggcccatgctccattctcaaccctcccgcccttgacaacccctttcctccctccataactactcatgttgatgttggctgccttccctacagcggcgtgagccagggccgggcaaacagagctttgacagtgtatgcgagattcaacgggcggttgagctccaggaaatgccgtacagtcgtggacatgcttcctggttcctttgtctgcttcttcttcaggagggcagccggcgcggctcagcgatactggctctcgttgcgaaggttgttggcgatctccacctcccagcggtcaccgatagaccacagccctgcagccgacgctcgattgtggccatggacagcgacgccgcgctctatctcctcgctccctttcccgtccaaccctccttctgcgctaccccctatacaacccccaacttccaaccccgcccacctcgtggctctcggtggtgtactcaaagttgggcccctccacgatggcgtccacggggcatgcctcctggcagaagccgcagtagatacacttggtcatgtcgatgtcgtagcgcgtggtccggcgagagccgtcctcccgctcctccgtctcgatggtgatggcctgggcggggcagatggcctcgcacagcttgcaggcgatgcagcgctcctcgccggtggggtagcggcgcagcgcgtgctcgccgcggaagcgggggctgatggtcgtcttctcgaaggggtagttgatggtcaccttgggctcgaagaagaccttgagggtcatggccagcccacgccacagctccgtgaggaacagggtctgggagctctcgtccagcacgcctgccaggtcacggggggcctcgcgctggctggtcgcgaactctttggagctcaggccggcagtccctccaatgcctgtccagagttggaagaggtgtgggcatggggtcgaaccgcaggcacctggatccatactcagggcaaccccacaccacatgaagcgctggcgctatggaaggcgcccccgcaccctgatgcgcatgcaggagcggcccttgggaccaatcggcttcccaactgccgcagcatggccaggttgtgcgggaatcggaaccgggacctgcagaacgcgaccttcggcgctcaggccaagactgggccctcggctggaattgagcaccgaatgccgatcgcccctgaatcagccaatccactgatgcaaaagaggtggagcaggtgtctgtaccttttagcaggggttggagggtccctgtgctatgccaaattgcttgacgagggtagtaccagtcttcgccacgatggcttcgatcgccgtgtctgcgagcccaggttgggcccccacacagtcgctgtggtctcgagcaccgcgaccacgggctcccttcgtcccgcatgccgcctccaggctggcattccgacgcgtgagctctgtacgagctcaagtcgcagaaagcatttcccacgggcagtcggatgtgggggcgcctgcggccccgaccttcaccgtgcagctcgtgaagtacctgggcaccaagtacagcctggcctccatccacaacgtgcggaccaaggccagggcgatagtggccctcatgaaggagatggggctatcggagccctttacaatggagcagcacatctacccccagaaggaggtgcgtcggctgccggtgggtggggagggtcgtctgttgttcgctggacagttgtccctcccgtgccccccttcctggtgcgnnnnnnnnnncagcacatctacccccagaaggaggtgcgttggctgccggtgggtggggagggtcgtttgttgtccgctggacagttgtccctcctgtgccccccttcctggtgcatgtcctccatggccccgccctctccaaatttcgcagctcctggactcgattcacgacggcctggcggtggccgtgctgtctcgctaccctcgcgagttcttccaccccgacgcaatggacacctggcacgtcttcctcgcctttctacactccctcaacttctcgcccgccatggtgagcagggcctgcagtcgccatgcatccctctctgcctctgttttggccgacttgtgggccctccctccgctccgtgcctgccatggcctgccctgcctcccaccaactccggagtcgattga

SEQ ID NO: 1210 - DNA, 276 bp, Chlorella protothecoides
atggtcgtcactgagcgcatgatgggtggggacctgtggcacgctctgcgtcgcggcgaggtggcctgggcggagcgcggctggcgcctggccatggacatcgcctcgggcctggcatacctctccacccgccgcatcgtgcacaacgacctgaagagctccaacatcctgctggacggggaggggcgggccaagatcagcgatgtcggcctggcccgcatcatccccgactcccggtcctacctgccctctagatctggtgagtccgggatgtga

SEQ ID NO: 1211 - DNA, 777 bp, Chlorella protothecoides
atgctgcggcagttgggaagccgattggtcccaagggccgctcctgcatgcgcatcagggtgcgggggcgccttccatagcgccagcgcttcatgtggtgtggggttgcctgccacccccaaccccgagcgcttggacgagagcggtgaggcgcgattggtggagggattgatgatacatcttccgcatcctggctcgggggcatggaccctgagtatggatccaggtgcctgcggttcgaccccatgcccacacctcttccaactctggacaggcattggagggactgccggcctgagctccaaagagttcgcgaccagccagcgcgaggccccccgtgacctggcaggcgtgctggacgagagctcccagaccctgttcctcacggagctgtggcgtgggctggccatgaccctcaaggtcttcttcgagcccaaggtgaccatcaactaccccttcgagaagacgaccatcagcccccgcttccgcggcgagcacgcgctgcgccgctaccccaccggcgaggagcgctgcatcgcctgcaagctgtgcgaggccatctgccccgcccaggccatcaccatcgagacggaggagcgggaggacggctctcgccggaccacgcgctacgacatcgacatgaccaagtgtatctactgcggcttctgccaggaggcatgccccgtggacgccatcgtggaggggcccaactttgagtacaccaccgagagccacgaggtgggcggggttggaagttgggggttgtatagggggtag

SEQ ID NO: 1212 - DNA, 387 bp, Chlorella protothecoides
atgcaacggttgttacctcaccatatcctcgccactccatccacaatcgccttccaggtgtttgctggccggctgttgaatggcgagcctgtggccatcaagtgtgtgcgaggcccttcgccaggtgcaccgctgcaactggtttccgaggggtgtttggcagaggaggcccgcatcctgaagcactgccgctcagcctacgtggtatcattcgtcgggatggcggtggatcacaccgccggagagctctacctcctcacgcaacgcatggtcggtggcgacctccatggcgcaattcgaaaacggcgtgttgcctggaaggatggaggctggcgcatagctctggacattgcacgaggcctggtgtacctggcatccaaacggtga

SEQ ID NO: 1213 - DNA, 513 bp, Chlorella protothecoides
atgcaacccgctcttgcacagaggttcagcgccctggaggagctcgagcaaggcagcgcgacttcggggagcggcggcctgagtgctggcgccatcgtgggcatcgttctggggagccttgccctggcccttgccttggctgctggactggtcttggcgggaaggagtgagaaggctcgacaggtgtttgctggtcacctcatgaacggcgagcctgtggccatcaagtgtgtgcggggtccttacccggggaccccgctgcagctggcctccgagggctgcttggcagaggaggccagcatcctgaagcgctgccggtcggcgtatgtggtgtcctttgtgggcatcgccgtgaaccctggtgctggggagctgtacctcctgacccaccgcatggccggcggcgacctgtatgccctcatccagaagaggcatgtcacctggaactctggaggctggagaatagccctggacatcgcacgaggcctggtgtacctggcatccaaacggtga

SEQ ID NO: 1214 - DNA, 573 bp, Chlorella protothecoides
atggaggcccttccagcggtagcagagacggtgctgcccggagggaatggcgaggcggaagcgccacttgacaagaatccgggactcaggcactatgatccgcacagagacgtcatcctgcgcgtggaatggatcacagatcaggccatgcagatcctcgtcttgacgggcgctgtcctgctggctgcagtcgttgccctcaaagaagtcaaggggaatgacttggtcttcatgcccaccatccctaccatgaacctggtgtttgggactgggtgcatgctggagctgctgttcacttgcgcgatattctacgcgcgagtggtgatcgccaatcgctccgggaagcgctggtgggtgcagactggggagggtgggaggggttctgaaccgatgcagcccgccacacttgcatgcagggaccccaaacggcggcgagcggtggtcctcactgagattgagctggggacgcagaccctcaacatggccgccttcctgacgacaaatgcgatccagctggcagacaggtgtacattcttccctcgctccatcgtctggcttggactggtccagtga

SEQ ID NO: 1215 - DNA, 861 bp, Chlorella protothecoides
atgtccaatttgcaggtggagatccgcacatcgatgcatccagacagagtggtccctgccaagttcctcacgacctcctgctacagcaccatgtatgcgctggatggcctgctccccctgtgggacaggtggcaagacattccaccgtcggagcccgcccatttcccacgtgtaaatgaggacctcctcttcagcgtcgatccgacttgcggggccggcgatgccatcgtggggaggtacagtggcctggaggagctcgctggggacagcgccttgacggggagcggcggcctgagtgccggagccattgtgggcattgtcctcgccagcgttgccctgtcgcttgccctggctgcggggctggtcttggctgggaggagtgacaaggctcgacggctggcatccgaggagagtctggcagaggaggcacgcatcctcaagcactgccggtcggcgtatgtggtgtcctttgtgggcatcgctgtcgactccggtgctggggagctgtacctcctcacacaacgcatggctggcggcaacctctttggcatcatccgaaggcaacgcatcacctggaacgacggtggctgggagattgcactcaacatcgcgcaaggcctggtatacctggcatccaaacggtatgttgctgaccagggtacaggccttctctttgtggatgtggagcgtgaatctggtatgttcttcctgcttgttggttgtgtagattgcgagcgtggcatcagccaggcggtgaaattatctgtactgcgcttttgcgatgtcaagcacaattccagaatcacagcatccccacaccctcgacataacattcccgcagcatcgtgcacaatgacctga

SEQ ID NO: 1216 - DNA, 918 bp, Chlorella protothecoides
atggcggcggcctgcctcttcctggccagcaagatcagcgacgagccgcgcagccaccagcagatcgcagcggagctgctcaaggagtggtacggccgccccctcgcgcgcgcgcgcctgcaggccgaccccgactggactgcgcgcctgtttgccaccgtgctggacggtgagtgcctgctcctgcacaccgtcggcttcgacttcgacgtcgacctggtgcacagccggctggtgggcctgctgcgctcgccgcgcttccgccacctgctggcggtgcccgcgctgcaccagcagatgctgtcctcctgcaacgacatcttggtgcacgactccggcctgctcctggagtacagcgcaggggaggtggcgctgaccatcctctactttttcctgaagctgcaccgccagcagggcggcgaggcggtcgcggtgctggagggcaaggaggacgcggaggggcggccctggttcgtgcaggacggactcgccccggagcgctgccaggccatcgtcaaccgcttcatggagaagctgtacagcagggtggggggcgggggggcggccgagcagggcggggccgccggcgccgacagcgccgcctcctcccaggcggacgcgaccccggggatggcgggccacgactctcgcggcagcgccgcggcctggccagggcctgaagcccgcgagggcgacggcggggatggggcggccgccccggggcaggcggccacgggcctcaagcggggcggtggggcgccgggcggcgaggagcagccccccaagctccgacggacgggcgactcgccgcagcaccgcccaggcgtcccgccgcgaataccgccggggcccctcccacacccagggccgcagcctgacccggagagcagccccgaggagggggagctgccctgctga

SEQ ID NO: 1217 - DNA, 558 bp, Chlorella protothecoides
atgcaggtggacccggatgctgaccttgtcaacggcatcctccacgcctccagcttcacattcgacctggaccccgagacgaagcagcgcatagtcctgggggcgggaaggtttgggcaggtggtggcggggcgcctccagaacagggagcccatcgccatcaagtgtattgaggcccccccgtccgggcccagcctggccctggagcctgggtccctgctggcgcgggaggtgcagatcctgcgtcattgccgctccgcctacgtggtcaagttcatgggcatcgcgattgaccccggcgcgcaggaggtgcagctcatcaccgagcggatggcggggggggacctgatgcggctgctgagcgggaggcgcattccctggaggagccgggggtggaagctcgccctggacgtcgcccgtgggctcgtgtacctcgcctccaagaggtgggttcggtcgaggccctcccgacagggccgggcatgggtcagtccgaggggaactccagggttggggctcgttggaagctgggtgtgtcgtcctcgccttgcatggtga

SEQ ID NO: 1218 - DNA, 813 bp, Chlorella protothecoides
atgtcaggggtgttgatcgtcggggccggcttcgcggggctcgcggcggcccagacgctgaggcgggcagggatgtcccccgtcatcctgctcgaggccgggtcgcacgtcgggggcagggcgcgcaccctccgcctggatcggggcctggcgctggagatgggggccacctggatccacgggctggagctgggcggcggcgagggccccaacccagtgctgcgcgccgcgcagcgtgctcagctgctgggggcccggccccggttgtcggtgtgggaggactcccacttcctcgtgcagggggccagcgggctgctgacccaggagcaggcggcctgtatcatgcacagcatcgccgcctttgaagagggcttagatgcggctgggggagccgaggagggtgcgaccctgggtgatgtcctgcaggctgcctgggataagcggtcatcaggacagaaggtggcccagcacgctgacctggcgcgcagggtttgggcgtggcgggagtccctgcagcgcgccatcgacggcacagactgcagcggggatctctcggcgacggccgccgccaggtacgccgctgcagttcagaacaccaacgcccccatccccggcggcttccaggcggtggccgaggcgatggcggagggcctcgacgtgcgcctgcaccggcgggtgactggcctggactggggcgcggagggtggggcctgtgccacctgcgaggacggatcgcgccacgctgccgccgccgccatcgtcaccgtctccctgggcgtactcaaggtgctcgagggggagggggggggatga

SEQ ID NO: 1219 - DNA, 456 bp, Chlorella protothecoides
atggcccagctcaggatggggacggtggacaagctgttcctggagttctatggtgcagaggacagcgctcttgaccaggaagatggcgccgcacccgcagcagcccccgactcgggcgacggcgcagacgtggtcacctacgccctgctctgggacccggcctcgacggcttcagccgactccgccctcccggactgggcgcagggggtcttctccatcggtttcggaggcgcggaggtcaagcagggggcccaggagcctggcgcgtcgccccgacccgtgggcgtggtgtggctggcgggcgaggcggcccgcgccgtcgaggccgcctccgacgaggaagtgttgggcacgctgcgtgccaccttccgcgccttccccggcgcggtgctccccgctggcgccagctggcggcgtgatggggactgtggacaagctgttcctggagttctatga

SEQ ID NO: 1220 - DNA, 1017 bp, Chlorella protothecoides
atgctgctgggcgaggacctctccctagactttgagccgggccccggcgacgaccaggtgctgatcagcatcccggccaggccagacctgccccccgtcgccggcaccttcctcaccaccgcctgcttcagcaccgtcatcctgctgaacgacacgctgcgcatgtgggaaagcgcggcagacatcccccccagccccaccctggaccctgtgccggcggtggaccaggccgccctgttcaacgtcgggcccggctgcggcggcggggcccccacggtcgccgtgctgagctcccaccgaggcgagccggaggggacgctggtggagcagagcgtgcaaatgccggcagacgactcttcctccggcggctcctcgctcagcgcgggcgccatcgccggcatcgtgatcggcagcgtggcgggcgcggccgccctcgcgctccttgctgtcttcctgatccgacgccgcggacgggggagggcgcccgccgcgcgtgatgaggcatggggcgatgccgcctctgcaaagggcggcctgaccgaccacagcgatgccttgagtgagcagtgggcttgggggaggtggaaagggcggactgggggctttcgtgggccgccttgggatcaggtccacgctcactggagcgcaggcagtgcctcgcgcccctcgttgtgcgcgagcggggccatggtacgcggaggggctctgccgcctgtgtgcgccgcagaccgttgcgacctccgctccccacccacgaggcccttgcctctcacaccagttctaccctccgttgtccccactcgcagcctcctgcgacaagcagtcgctgtccagctcggggacgctgctgagcaccccctctggggcctccgccttcagcctgggtttgctgccggcgtccagcctaacgttcgaccgcgcctccggggagctggtgaccctgggggagggacgattcggcaaggtgtatgctgggcggaccgcgcaacacgagcaggtggccatcaagtgcgttga

SEQ ID NO: 1221 - DNA, 303 bp, Chlorella protothecoides
atgtcgctagacactgtttggaagcggggcttctcctctccgcctcactcctccgccccctccatcccagacccttttgctgatgctggcgacaacgacgttaagggaaaggacgccaaggactacgtgcatgtacgcgtgcaacagcgcaacggcaagaagtgcctgacgaccgtgcagggcctcccaaagaagtttgatctcgacaaaattctcaaggccctgaagaaaggcgagtgccggcatgcggttggggcggcgggtcgatacctcatacaagaatgtgaacatgcatcgcgctga

SEQ ID NO: 1222 - DNA, 1374 bp, Chlorella protothecoides
  modified_base (657)..(666): a, c, t, g, unknown or other
cgacttgatgttgacggtctggatctcgttgtgccgcgcccagaccaccttccccccggcgtccatggaggccacgggttcgtcgcggcccagcttgaccatgacgcagccctcgtcgtagccgatggcgatggagttggagccgcgcgtgtaggccactgcccacacccgctccatgccgtggtccaggctgtgctccaggcggtaggtggtggagtgccaggccttgacgctgccgtcctccgacccggtcagcagcagcggcagctcggggtggaaccccaccgccgtgatgttgtgggcgtgcccgtccagggtctggatgcaggccttggtctggtagtcccacactttcaccaggcggtcgtcggcgccggaggccaggtacgggcggtcgcctgcggcaaagcccatgatccatgcgttggcaagcgcccccgcatcatccacacccccttccacacctccggtgtagtagtccacgcagttgacgcccttctcgtggccctccagcgtgaagttgggcatgtggctgccgatgccccacacctgcttggggaggaaagagggaaggggcttgggatccacaggctttattgcatggttggcaccgtgacagggcccttccgaggcttggctagtgccaacccccccccnnnnnnnnnnatccacaggctttattgcatggttggcaccacgacagggtccttccgaggcttaactagtgccccccccccctcctcaaatgacaggcagctccccggcgaccagcaccgcctccccatctatttccccccagcgtcccagcagccacgcgccttgacggtgcgatctagggaggcggaggcgaagcttgatcagcatgtcgtccgagcaggtgagcaggtagggcagcgtggggtgcaccgccaggtgcctgggaatcaggggtggggatcgcttggatgtctggatggctggagcgaggagtatgacagggtggtgtcaccacagcgcacacagaggaagaccattgacgagataccgacagtccagctgcccttccccccgctcccgcacccatcaacctgcgacgtccgctcacctgatgtagtcggtgtgtgcctcgaactgcttcaccttgtccatggtgttgtagttgtacacccggacgtgcatgtcgtcggcgccgcagaccatccactgcttgcgcgggatgaacttggcggtccgcaccggcaggtctgtgatctcaaaggacttgaccagggcaccctccacgtagttccagatgtacacattgccattgtacagagaggcaaggatcctggaggtgtgggagaggcgagggttggggatcctcacccagccaatgcccatgggtgcccttcctga

SEQ ID NO: 1223 - DNA, 834 bp, Chlorella protothecoides
atggcacatggacctgcagcgggtcccggcacgccctcgccggctcacgaaaacatgctgcccagcccccaggccgtggccggggccgcgctggactgcttcgcagcgctgcccaggaccgggaagccccaggcgcacgagcacacggtgctggcggcgatcgtgctttccacccctaccccccattgcccccccacactctgcgtcgcggccctggccaccggcaccaagtgcctgggggcgtcggcccgcgaccccggcggcgcggccctgaacgactgccacgcggaggtgctggcgcgccgcgccttcctcctgttcctgcatgcccacgcccgggacctgggctcgcagggcgctgtagacccgctgtgtcgcgatgaggaggggggaggagggtgcggcgccccgcgcctccgcctgcggccgggggtgggggtgcacctgtacgtcagccagccgccgtgcggggacgcctgcgtgcacgacgccgacggacgggaggcggcgcatggcagcgctggcgggaccctgggcgaggccaggtcacaggagaatgctgcttctgcctcggatgaccgcgaggtcttggggaaaacagggtgcaccctgagtgaaaagcacaagcaggacaacccgccgcccacccgacgacccgtcgcccacccgtactctgccccgcaccggcgccaagctcctgggactggagtcccaggaacaggccctgggcgccgccccggccaccatccccgagcctcacacccgcgcacaggcctccgggcacctgcgccgcaagcccgggcgcggggagggcacgctgagcatgtcgtgtag

SEQ ID NO: 1224 - DNA, 483 bp, Chlorella protothecoides
atgcccaacttcacgctggagggccacgagaagggcgtcaactgcgtggactactacaccggaggcgaccgcccgtacctggcctccggcgccgacgaccgcctggtgaaagtgtgggactaccagaccaaggcctgcatccagaccctggacgggcacgcccacaacatcacggcggtggggttccaccccgagctgccgctgctgctgaccgggtcggaggacggcagcgtcaaggcctggcactccaccacctaccgcctggagcacagcctggaccacggcatggagcgggtgtgggcagtggcctacacgcgcggctccaactccatcgccatcggctacgacgagggctgcgtcatggtcaagctgggccgcgacgaacccgtggcctccatggacgccggggggaaggtggtctgggcgcggcacaacgagatccagaccgtcaacatcaagtcgctgggcgacgcgcacgaggag

SEQ ID NO: 1225 - DNA, 504 bp, Chlorella protothecoides
atgggcattggctgggtgaggatccccaaccctcgcctctcccacacctccaggatccttgcctctctgtacaatggcaatgtgtacatctggaactacgtggagggtgccctggtcaagtcctttgagatcacagacctgccggtgcggaccgccaagttcatcccgcgcaagcagtggatggtctgcggcgccgacgacatgcacgtccgggtgtacaactacaacaccatggacaaggtgaagcagttcgaggcacacaccgactacatcaggcacctggcggtgcaccccacgctgccctacctgctcacctgctcggacgacatgctgatcaagctgtgggactgggagaagggctgggtcaacacacaggtcttcgagggacactctcactacgtcatgcacgtcgtgttcaaccccaaggaccccaacaccttcgcctccgcctccctagatcgcaccgtcaaggcgcgtggctgctgggacgctggggggaaatag

SEQ ID NO: 1226 - DNA, 255 bp, Chlorella protothecoides
atgctcccggggtggaccgggaactcgggcccaggctgggccaggtcctatgtagtgagattcactcttcatcctgtcctgcccgctccccaccttcccacatcctcagagtactgctgcaacggcacagtggtggaggacaaggagctgggcaaggtgctgcagctgcagggcgaccagcgcaagaacgtgtccgccttcctcatcggcaacgacctgactaagaaggacgccatcaaggtccacggcttctga

SEQ ID NO: 1227 - DNA, 729 bp, Chlorella protothecoides
atgaactctgccgcaagcctgcgcttgctctccgatctcaaggctatctcacgcgagcctccggacggctgcagcgcttctcccatcgcagaagataacctttacgtgtgggtgagtcggtcggacccgttggcctcccgacgccatgccctgtggctgcaccggttacatgcacctccccacctctcccccacacccacagagcgccaccatcttggggccagccgacaccccctggtaggtattgtgcatggatgccatggcctggcccacctcacgtcctccgtgtgggagatcaacaccgccctgagccatgatgcctgcagggagggcggcgtattccagctccggctcacatttggggacaggtaccccgacctcccaccccgtgtacgcttcacctcagagatctaccacccaaacgtctatcgggcatcctccctgcggcgccacgaccctgtcgatgctgtgcccctgctctggcccctcaccgccccctcttcccccttctctgctcaggcggacgggacgctgtgcatggatatcatccaggaccagtggtcgccgtgccacagcgtctgctccatcctgacctccgtgcagtcgctgctcactgaccccaacccccagtcccccgccaacccggaggccgcgcagctgctcactcaccacttggcggactacaacaagcgcgtccgtcgcatcgcgcagaagagcacggaggagtga

SEQ ID NO: 1228 - DNA, 2031 bp, Chlorella protothecoides
cccccaccctcccccctccctgcctccccgcagcgcaagtgcgacgcctactaccgcgcgcagctggagcggcgctgggagcacggcaggatcgaggagtacgagagcgtggacaacgccgatttccatgtcggcatcatggggctgggcgtgctgggcggcgccctggccgaggcgctgctgcgcaacggctaccccgtcagcgcctggacgcgctcgcgccgcaccgagccccggttcccatgccacgcagggcgcggggagctgcccgccttcctctcttgcgtgaacgtcctagtctgcctcatgcccatcacggcagagacggagggcatgctgaacgccgacctgctgcgactgctgccgtgcggggcctacctcattaacgccgggcgtggggccatccaggtggaggcagacctggtcgccgccctggatgaggggcaggtgggtggctgtgtggattttttgggggccctcttggcgacgaaggtgctgggtgtggcgggagccgctggaggaagagtcgccgctgtggacgcacccaggcgtccgcgtgttcccccacgtctcctccttcacgcccagggacgccggggtcaagcaggtgctggagaactgggcactggtcaaggccggcaaggaggtgcccccggagcggcacatgcagcgccagagggggtactgagggcgaggcctggcagggcatggcctggaggaagggaaggggggggagatcccgcatcccgggttgacggcaccagagtccgtgccccggtgctgcctggtgggacgacgacacccaaccaccctgcatccggatgcacatgtgtgacctcgtctgcttcctgtccattgtttgcccagtgtggattgctgagcgagtttgcaatggcagtttgggctgatggccctgcctcccatgcacgctatagattcgttctactccaggatgtgggcaaatctaagaagcaggagctagatgcatgtgtgtattgccatccggccagctgccgttgtccagggggtccaaactggtgtgagccagagaaggtctctgttgcacaagttgggcctcaagcggtgccccatccgacagccatcacgccgccgcccggcactccgttggcctaccacgcctcgtccacgccaatcgcatcggtgtatgccgtgccctgggccatcacctgcccgagtacatccccctccgtcagcaggaggagcgggggcgggggggcgtcgggcgccggggccgggccggcggcggtgatgcggtatgcgactgccgtcagcggcgcgctcgcagacttggccacctggacgtacctcgaccctggcggggtcgaacagtgcctccagactcctgcgctcacgaccgcccaatggcccagcggacactggcaatctcgggaccccctcaaaccccccggacccctcaccaccctccagctggtggagcatgaggcgcgtgttcacggcgtgcgcccacagcgggcccagcgcagccgccacgcccccgccgcccgcgcccgccacctggttggtgaccagcaccgggatgccgcggcgccgggacagggccttgagtcgcgccgcgacggccgccagctgctgctgccgggcaacgacgcccttgaccccggggccgtggtcgaggcgggccagctgggcgacgctgtccacgaggacgagggagagggggagggggctggcctccagggcctgcagccgggccaggagctcgtgggaatggcggggtcgcagcaccagcaccgactccagcagccgctccttgtctccgggggcgagccggccctctggactacgctgccgcgcgatctcctccaggctgcgtgcatgtgggagggtggagtggggcgggttggtgggcttgggcatgccgaggattcggcctggggaggggatggggatctggagcgccgtggcagtgcaggccatgctgcagcagtctgctggtacccacccaaggcaaactttttgggagtccgatcagagggcagatgtgcatag

SEQ ID NO: 1229 - DNA, 615 bp, Chlorella protothecoides
atgctgcgccaacagggcgacgcagcgcaccccctgcccacgcgtcttcccgacctggatcgtgctctgcacggcggcttcccatgcggcagcgttaccgagatcgtggggccagcgggtgagcaggtgccctgcatctcactgcttgtgggctgtacaaggaagagggttgtatcccccttgccgttggatgctgacatcaagtgcattggcaaggttgaatgcaattcccggccctcctcctgcaggactgggaaaaacgcaggtatggagaggaaccgggagaccaagaaatgcaggctgtgcctggcatggggaggcaatctctctgaagttgggggaggcctcgctcagtcactctgtccgattgatagactgcgtggtttcctgctgggttcaaataattttctgaccgggaggccgctgggaacagctggtgaaaagtgttccccatgcgacccagatcaactgcatcctacattgccccgtcctcgctccacagttttgcctggcggctgcggcagacatctgctgctcgacccccatcctcgctggagcccaggtcctgtacatcgacacagagcagaagttcagctctcttcggtaaggtgctga

SEQ ID NO: 1230 - DNA, 2523 bp, Chlorella protothecoides
atgttcttcacacgtccaagtctgcctgcgggttcggcgagcccagtgcagcgaagaggagcgcagacaccagctgctgactgctatcggataaggtctaatccttcttggctgacacctatgctccatgtattgcagaatcaggcggggatctcttccttctcaagggtagtagtgttcagggactgctggatggtgtcgatggtcgagttgagctgcgcaatctggtctgccagcgcgaaaaagagcaccacagcccgagattaccctcctcccccgccacatccacaacatccaaacccctccccccctagccttctgtcccgctccagcctcacctgggtccacatcctgctcctccaggaaacgtggcaggcgcagcttctggtcttctcccagcagcgccttggagatctaacgagaacgggagaatgtgttaatgtgaggtatggcgtctcacctggggtgcaaaaacgtagcccagagccccaaagactgcgccccctacgaaaacgccagaccagaagccgccggcaccgtccctctcagctctgggagaagggatgtgcgatacatgttggatggctattgaaatgggtgttaaaggggaacaacagcggccagataggcataccttgggtgactgccaaccctgccaccaggccccggtgcctcgagcatcatcccgttgccgccacgcccatctttcggctcgcccaccttgagacaatatgggaccttcggggggcgggtgcgggcctggagagcgcggcgggcctagcgccgaagacgtgggactgcttgcggaagcctgcagggatcaccggaaagggaagcgacgagaccagggatccctgggctgggcagatgttcagtttgggtaatgcctctgacaccagtatgagcctttgggatggtgggcacggagctgataccgcactgcatcctgccagattgtcgtgcgtctcgggggagcagcatgcacgccgtgaggtcatgttgggtctcggcttcagatccattccatcggacggaacagggtcctggagattgtgctgccttgcgagtcggcgtggtgctttgccacctgcgttcagctgcatccccccagcggtgctaggggcccgggagttcacccgcaggctcaccccagcatccctccgcatgacggcgacacagaagccctccacccatgtggatctggatgagtgcatgcgggtggcactggaggcggcaacagcggctggcagcatcatcagggaggcctgggacaagcctcgccagtacgcgctccgcacagccagcgtggatctggtgacggagacggacaagcagtgcgaggaggagatatactcccgcctgcgggccgccttccccgaccatgcgttcattggggaggagggctctgccagccaggggttcaccgcggagctcacagatgcccccacatggctggtggaccccgtggacggtgagtcggcgatttcgtttgggtatgtgaggtggggcagtgctcactcgacaaccaaccctggtcgatgtctggccaccacgcactgctgttggcgtgtgggctggcacgttctttgttgtgctcaaagtgcatccatgattcccctgtttcctcctcagaaccctcccccttcccccttcccttcttgcacacacacaggcacgaccaacttcgtgcatcgctaccccttcacctgcgtcagcatcggcctggcggtgggcggcgcccccgtgctgggcgtggtggccaatcccatcctgggcgaggtgtaccgcgcgatgcgcggcggcggcgctttcttgaacaacgagcccatccacgtgtcggccaccccggacctccagtcggcgctgttcgccacggagctgggcatccggcgcgacgacgccttcctggacgcagcctttgcgaggatcagggagctgctgcgcggcgcgcgcagcgtgcgctgcggcggctcctgcgccctcaatctctgcagcgtcgcgcagggcaggcgcggcaggcggggatcggcggtggcgtggttgtgtgtgggaggggggggatggagggcagggccttaccgtttcggtgttgcgctggtggtgtgcattgacccaccgctggacgccttctttgagctgggcttgggcggcccgtgggacatggccgctggcgccgtcatcctggaggaagctgggggaaaggtgctggacccggcaggtgagggacattcaggggtcatggggcaacatccaggagtgctgcaagggcctggcaccattcctctgtttcctgcatgcagtgatttgcggccgggggcatgctgcgtcagccagccaccgggtgagcaggcgtgtcatgccgggtcctgcgtcgaccgccctgaccgcggcatccccgcaggcggccccttcaacgtcatgagccggcgcgtgctgggtaccaacgggcacctggcagcgcaggtgagctccatcctcgcggcgtgccctcttgccgagggcgagccgcgaccactggactga

SEQ ID NO: 1231 - DNA, 558 bp, Chlorella protothecoides
atgcccaagcccaccaacccgccccactccaccctcccacatgcacgcagcctggaggagatcgcgcggcagcgtagtccagagggccggctcgcccccggagacaaggagcggctgctggagtcggtgctggtgctgcgaccccgccattcccacgagctcctggcccggctgcaggccctggaggccagccccctccccctctccctcgtcctcgtggacagcgtcgcccagctggcccgcctcgaccacggccccggggtcaagggcgtcgttgcccggcagcagcagctggcggccgtcgcggcgcgactcaaggccctgtcccggcgccgcggcatcccggtgctggtcaccaaccaggtggcgggcgcgggcggcgggggcgtggcggctgcgctgggcccgctgtgggcgcacgccgtgaacacgcgcctcatgctccaccagctggagggtggtgaggggtccggggggtttgagggggtcccgagattgccagtgtccgctgggccattgggcggtcgtgagcgcaggagtctggaggcactgttctga

SEQ ID NO: 1232 - DNA, 390 bp, Chlorella protothecoides
atggtgtcagactatcccgggtttgccctgctgcgcatgcccagggcccctccatatcaaacgcccagcatcgccaagcactgcctgaatcttgcccatgacagtgggaagtctgctgcgggccagaaactgagcactgccctgagctactgctttttcgacaccgatgacatgattgtggccctgtctggcaagagcatcgccgacatcttcagggaggaaggggaggaggcatttcgcaccaccgaaacggccgtgatacaggtgaggaggcagcattgccaggggttgcggaggtgcttaggtggtggagataggccttggggcgtaggtgagctcccgcccgcccacacgtccctatgtgcgtcggtgcaattcaagcacagatga

SEQ ID NO: 1233 - DNA, 474 bp, Chlorella protothecoides
atggattctcgccagctcgaccttctcctggcaggcctggccggggcgctggtcacctatggtgggacgcggcttttgcgcagggttgcaggcgagggagtcccaactcctccagcgagagacgccaaggacatgaatggaagcatcgctgcgctgcgctccaccactccacaccctcattggacacccccaaaccctttgcccgcccccttcagcgacaagtaccatgaggtggaccctgcaaccactccgtcagcagtgatctaccccctcgtcatctcggccattgtccccaggcccatcgccttcatctccacactgaatgcggcaggcagcgtgggtaatcttgcgccatactcttacttcaatgcggtggcacatgacccacctaccttggcgattggcttctgcgcgagttccattcgagaccaccgacgcaaagatagcttggtcaacattgtcgaaactgggtga

SEQ ID NO: 1234 - DNA, 1149 bp, Chlorella protothecoides
atgcccccctccctatcccatcgcctttctttcccctccctcttcctgcagcccgcacgccagggcctgcgcctgctgtcccacctggccgcccccgacacccgctggtaccgcttcgaccccgagtcacgcattgcgctgctgggcttcggcccgggcggcgcgcgcctgcagcccctccagttcctgcccgccggccccgcccgcctgcccatgctggacctgggcccgccctgggtctcctcccctgtgcgcgggtcgggggaggaccccatgccgcgcgccggcgcctgcgccgcccatgtctggctggtcacgctgtacggccaggtgcactgcgcgcaccacgaccccccgcagcgcagcctgcgcctgttccgaatgtaccgcgacgccagctccctggcggccgagtaccgcctgccgggcgggggggggcccgtcgcgctcagcgtggtggacaacctgctggctgtccacctcctcgccgcccacgtgaccctgctctacgacgtggcggcaccgggggcggagccgctgtgcgcgccgctgcccatcggcggggcccgcctcgcgcccggcggcggggtggcgggtggtgatggcggcgccggagggggtggcggcgtggacgacggcgacggcggcgccccgcgccaggaggttgggccccaagccgccgaccgtggcctgggcgggagggcgctggtgccgggcacgcactctggcggcgtgcagggcgggacggccctggcggatgcggcgcaggagtgcggcgaggggtacgcgccggactccgctgagggcctggccgtcccgcacgagcacgatggcaccccctcccccgctgcctcctgggacgggtcggagccaggcaccccggggcaatcacccccccggggcggtgcgcccggccccgcgctgagcgcgctgcaactctacctccccgactgggcgctggacgtggagcgtggggcagtgtaccgcctgacgctggacctggcggccatggcggccatgggctcggcctgggacctgcccgcgctcctcgccttcctccagcgcaggcacagcggcggggccggcgcgcgcgacgcgcggcgcatcacgctcgccatcatgcgggtgggacggggcgcgcggggatga

SEQ ID NO: 1235 - DNA, 261 bp, Chlorella protothecoides
atggagtgtaaggtggtgcacagctatgaagtgaggaatgcggctggcgctgtgtccaccaccgtcatactggcccaggtggtcttgatgcacgtggccgatggcgtcgcagggaagctggttgtggacctggcaaagtatgcacccatctctcgtctggggggcaacacgtatggcagggtgaaggagacgtttgatctgccccgcccagacaggacccccgcccagaaacacatccaatacaccagtcagccagagtga

SEQ ID NO: 1236 - DNA, 348 bp, Chlorella protothecoides
atgcagaccggggtggtggtgtggctgaggggcacaccagagcttcttgcacagcgagtggttggagacgggactcagtccaggccgctgctggcaggggaacaggccgcggttgccaagctggagggcctcatgaaggcaagacaggccctgtatgagcaggcagacatcgtgattcccctcgacagccctggctccagcacaggagcctcgctggaggaggtggtctggcgcatgctgtgcgcactgagggaccgattgcgcgatgacgccgccagcaagcccactccgcccctgcaacaggaccactcagggatgagctcaagacaactgcaagctgaggagtga

SEQ ID NO: 1237 - DNA, 729 bp, Chlorella protothecoides
atgcaggcctacaccctcccaccaaccctcttcctttgtaactgctcagatcccggacagctggtttgtggcaccacaaccgtccgccctaggctggtgtcctctgccatgtctgccaccgagctgtctgggtcagtctttgccgaggcggaggaatcctcgcccgagggtcagcctcgacctgcttgcaagaaggagggcccaatgaaggcttacgaggagggtgtggcctgtggcgctctccgccaggtccgccagagccaaactatgtcgtatgggcgggcctcgctcgacatgggcggagcctgcaagtctgggcaacggtgctctgacccgctatttgtgcccgcggctgagggcatggcccttgccgctcaccctctccactcccccaacccctcctctccacaggacccgcgccaggcgctgacggctcgacgcctgcagcgcgtgtttgacgacctgtgggacgttcggggcctgcccccaagcggctccaaccggcgcgggcgaggcctgaccctggtgcacgccgccgagcccacgcctgcgccgcgtggcggcggctggctgtcagggttcttcggcgggcaggctgcttcgccccccccgcaggcccccgctccccgcggcctgtacatgtatggcggggtgggggtgggcaagaccatgctcatggacatctttgtctctgtggccccgccagagttccaggcaagcaggccatga

SEQ ID NO: 1238 - DNA, 1260 bp, Chlorella protothecoides
  modified_base (230)..(239): a, c, t, g, unknown or other
  modified_base (325)..(334): a, c, t, g, unknown or other
gccgggcgtgcgcctgctggcgctgtccggcggcgacaagcgcaacgccatcccgcgcgaggccgggttccagctggccgcgccggacgccggggcgctggaggccgccacggctgcggtgcgcgccgcggccgacgccttccgcctcgagtatggcgcgctggagatggggctggccctgaccgaggaggaggtggggtccgaggcacggcgtgcggggctgaccccannnnnnnnnngccgggggttggggtgggctctgggagacttagagcccggagcgtcgaatgcacgacaggaatcggcccttttccatggcctggannnnnnnnnnccttccgcctcgagtatggcgcgctggagacggggctggccctgactgaggaggaggtgggggtcgaggcgaggcgtgcggggctgaccccggccgccgccgaccgcctgctcctcctcctcctcatgctgccgcacggcgtcatcaagcacagccacaccgtgccgggtgggagggaggtgttggtgggaggcaaggaggggccgggggttggggtgggctctgggagactgagagcccggagcgtcgaatgcacgacaggagtcggcccttgtccacggcctggtgtgcgactgagagcagccccatatgcaccacgaagctcaggacaccttccgctatgcttggtggagacgagcagcaacctggcgtcggccacgatcaagcggcgcacgcccgagtcgctgaccgtggagctggtgacctgcacccgcagtagcctggacagggcgctggaggacgtccggcagggcatcgcgcggctgggcagggcggcgggggcgactgttcaccaggaggggagggtccgcccgccagggcctctggatctcggacgtgggaagaaccagggtcctcgccctcggcgacagaccagagtgggaccccacccacccaccgacgcacaaacaggacgccgcctaccccggctgggtgcccgaaccggacgcgccggtggtgcatgccgcggcggcggccatccagggggtgacgggcaaggcccctgctgtcaaggccatccacgcggggctggagtgtggcatcatcgggcagaagttgcccggcgtgcagagcgtgtcctatggccccaccatccgcggggcccacagtcccgacgagagggtggaggtcgccacggtggcgcccttttacgaggccaccctggccctgctgcgacggctggcgcaggccgcctgagcggggcgtga

SEQ ID NO: 1239 - DNA, 564 bp, Chlorella protothecoides
atgcatgccgcgcacggctcagagctggcccgcgacgggcctgcctttgaggcggcgctggagaagtacgcggcgctggagaagtacgtgacgcgtgcggtgctgtccggtcgcccgcgtgaggagtggcgcgcggacgtgggcgcgcgctaccgcgcgctggcggcctcctcgcgcgacgaggcgcaggccggcttcctgcgcatcatccgcagcctgccctacggcaacgccgccttcttcgccgtgcgcaagatcgacgaccccatcggcctgctccccgccaagctcatcctgggcatcaacaagcgcggcgtgcacttcttccgccccgtgcccaaggagtacctgcactccgccgagctgcgcgacatcatgcagttcggctccaacgccagcgcggtgttcttcaagatgcgcgtggcgggcgtgctgcacgtcttccagttcgagacgcgggccggggacgaagtgtgcatggcccttcagacccacatcaacgacatcatgatgcggcgctacagccgcgcgcgcgccgcgcaggacggcggcgacgacgcgccg

SEQ ID NO: 1240 - DNA, 429 bp, Chlorella protothecoides
atgtcttatcctggtccttttaagactttcaccatgaacaccctcaacccagccacctttgccatctgcgacgccatcgccacgccggggtgtacggctataggcagcgtccagtgcctgccagatggtgtgcctgcgtgtgccatggacaaggatcacaatatcgggactgggaacactggcaagtataacgtgggcaacaacaatgtaggagatcacaactacgggaacaataacgttggctctggaaacatcgggaatgaactgactggcgactcgttcatttgcaactttgccagggaggatcactgcatccgcctctggctggtgacgggagacacgctcaacttgtatgctccccctccgccaccgccacttagccctccgccccctgggcagaactgtgaccctcgaaacaagttctttgcc

SEQ ID NO: 1241 - DNA, 1317 bp, Chlorella protothecoides
  modified_base (283)..(314): a, c, t, g, unknown or other
  modified_base (506)..(515): a, c, t, g, unknown or other
  modified_base (590)..(599): a, c, t, g, unknown or other
atggcatgcaccagccggaaggaggcactcccagggatcggtgctgaggtggtggcagggtacgcgtcagtactcttatctgaaaggaggcactcccagggatcggcgctgcggtggtggcagggtaggcgtcagtactctgatgcatgcctctgggcaccatgtgggcctgaaagccagggcgcatgggtctattcgaccaaaccctcgcctaggtcgggaccgggtcacccacacgcatcatctactcgaagcaatccccaggcccacgccagcctcacannnnnnnnnnnnnnnnnnnnnnnnnnnnnnnnaagtgcctgccggaagtggctgggccatcgtggtggccgcacagggcgccggcgtgcatcgtggcgaggtgcggcacgtgacgttcttaccttctcctgctcattgccagttttgatgggggacggggtgtgcggggtgaggttgcatgtggggtgctcggagttggcctacgtagccctctcagggttttnnnnnnnnnnacccagtcgaagtccctcgcttaaccctctgacacccagcgacactgtcatggtggctcaggtgtccgccatccnnnnnnnnnnccccagtcggagcccctcaccaaaccctctgacacccagcgactctgtcatggtggctcaggatgtggccatcctggaggccaaccgcccctggcccggcgcggcggagccctccgggcattccaccgacagcgcggccacaggtccccctgcaaacggcctggccaatggcggcagcgcccactccactccccactcccaccaccgccccgccgaggccacctacagcgtcttcgccgtgtttgatgggcacaacggcgccgcggccgcgcagctggcgggcgacaaggcgctgggcctgctggaggaccggctaccgtggggcgcgccccccgccgacgtggcgggccccggcgcgcgcgcctggcgctgcgccatccagcgcgcgctggtggagacgctggtggagctgaactggctgtttgcggggcacggtgtggtggcggggtgcaccgccaccatcgtcctccaggtgggctggctgctcacggcggcaggcgtgggcgactcccgcgcgctcctggatctggggtccgaagtggtgcacctgacggaggaccaccgcgtggccagccacaagggcgagcggcggcggctggagggcgcgggcgcgcgcgtcgcgcccatccacgtctcgggtgagccaggggtgtgggggagggcgagggagggagggggaggggtgcgcgagagcagggaaggggagtggaggtcatga

SEQ ID NO: 1242 - DNA, 564 bp, Chlorella protothecoides
atgtgggggggtggggctgccctcgctgcgctgtgcccatcgtacctggagcctgggccagtgcggtacggacccgccgcctcggccaacgagggcattgggcccctccgcgtgtggcccggcggcctctgcctgtcgcgggccgtgggcgactttgacgtgggcaaggtggtcctgcccttcccccacgtcaagcaggtggggggcctctacaccgtgggtggggtgacggtgtggaggggcacggaactgtcgagaatgggatcgggtggcgatggcaaggaggggccaccaggcaggtcttccatgcagtcccatcctgcggtcccccagacgccgagcgcaaacttccacacacaccatgtccatgtcttgcagtctgctcatgctgcccctccattcccaagcactcaccctactcccactcatcccaggtcctggtcccagagaccggcgctcgcctgtatgtggcctctgacgggctgtgggacgcgttcgagcgcgacaccaaggtcgccagcatggcacgggcctggtccccggacgccgcgccgagccgcctga

SEQ ID NO: 1243 - DNA, 366 bp, Chlorella protothecoides
ctggctggcgcggcgcccgccggtgccggaggcgaaaagcacgaccccgcgtcgccgcccgcgcccgcgctcgccgacgccgcgacggcagtgctggcgcggctgcgccccgtggatctggaccaggaggtgaaggagggggccatcgcggccgcggccgccctgctggcggcgctgggcgacgcgctgggcctggagacgcaggcggtgggggagctgacgcgcgagttcgctgccatgcccaaggcccgcacctccaagcgcgccaagctgtccggcggcggcgcggaggttggcgcggcgggcggggccgccgccggccccagcgcggaggtgcgggaggtgggtttcttgggaggaggttga

SEQ ID NO: 1244 - DNA, 435 bp, Chlorella protothecoides
atgtggagccacccatccctcaaacactccttggtccatttgccagtgctggagaagctggtgcgggacctcactcagctcctgaaaaagtcaagccgctcgctgcgcctggcggccctgaggaccctgaagagtccacggccgcccagacaaatccacctccgcatgcaggcgctggtcgcacgggagggggcctcgctgccggccgacgtgctcgccgaggtcgtggcggaggccggcactcagctgagcgaggcggagctgatgcacgcggggctggcgctgcagctggccgtggtggctctggagagccagcccgaggccgcgctggaggcagcccgctcaaaggtacgagggatgaggggaggaaggcggggcccatggggggctgaccgcggggatgtgcggtgcccaggaaggacacatcgcgtgtga

SEQ ID NO: 1245 - DNA, 1071 bp, Chlorella protothecoides
atgaactcattgcctctctgtactcgtgtccaggtgctcccgggggcgctcaccctggcggcctcccccctgctccagccctcggtgctcacggcgctccagtccttcttcgcccgcctggcgctggccagcggcgacgcggccgcctttgcggagctgcgcgagtcgttgatgcagaaggggctgacggcggccggcgccgccccgggcgggcacctcgcgctggcgcgctgcgtcgcagcgctgtgcgcgctgtgtgccaccgaggacgagcgggtgcagggcacgctgcagcacctgctgcacactctgcagggtggcaggagcgaggcggcggcgaggcgcctcgcgctgggcgtgctgggcgagatcgggcggggcagggacctggggcagctgccacaagtgctcgaggccctcctctccgccctgtccgccgaggacgtggcggacgccgctgccacagcgctgggaagtgcgcgagccctggagggaggcaggggaagggggcgaacgcgccagtcccgtgccgccctctgccatcgtcctgttcgcacctgctcacatctccctcccccctcctgctggccccccgcccacggacccgcccccactcaccgccccccccaccctcaaacaggcgtgacctctggcgcgctgggcgcgcggctggacccgctgctgggcctggtcagggacgccgcggccacgccgcgcctgcagtaccagctgttcagggcgctggcggaggtactgcactcagaggccgccgaggagctgaccccctcccagcgccagtccgtcctggacctgatcctagcggcggtcgcggaggagagggaggagagcaacgcggtgctggcagagtgcctggggacgctggcggccctgggcgccggcgcctgcaccgccattctgacgcagcccctgcagagctcttccccggggctgagggcgctggccctggcggccgcgcgccacgccacggtgcacctgggcgctcgagccacgcccagtatggacggcgtggcggggcccatgctggcctgcctgaacgaccctgacttgtga

SEQ ID NO: 1246 - DNA, 1113 bp, Chlorella protothecoides
  modified_base (101)..(110): a, c, t, g, unknown or other
  modified_base (800)..(809): a, c, t, g, unknown or other
  modified_base (956)..(965): a, c, t, g, unknown or other
  modified_base (1089)..(1098): a, c, t, g, unknown or other
cgcgaggctgcactggtgcgtcgggagggtgggggtagcacggaggagggtggggtgggaggctccgagcatttgtggtgtgcgcgcagggcgcgcgggannnnnnnnnnttccagcgcgaggcgggcgccgccgacgcctacgtggccgctcgcgcagcggagctgggcggcgctcccggcgcgaggctgcactggggccgagctgatcccctccctcgagtcccagcagcacccaggggtgctgccccccccagccgcgcctctgaactggcgtcgtcgcacgtccctgacccctccgctcagtcaccttccacgccccaaaaactcaaacatcaacaggctgcaccggccacggacgctggcggtgtgggccgagctggagcggcgccgcgtgaagctgacctgggacctgcccatgctgcgcggcaagctgctgcccctgctgctggactgggacctggcgcatagcggtgaggaaaacggggccggggagaggggggcgggcgaaacgcggcccgagttctgggcgcgcgaggtgcagaaggtccagggcggcgcggcggcgggacccaggaaggcggccggcgccgcggcggcgccgccccgcggctggcgctatgtcgtgcgctgggagcgcgtgcccagcgtcgcggcggaggcctacccgccgctcctggccgtgcggccccgggagcggaggggccggggcgccggcggcgaggaggggcctgaaccggccagccagagccgggggagccagggggcggcgagccaggcggagggcgccgacgctgcctnnnnnnnnnnggccggccagccagagccgggggagccaggaggcgccgagccaggcggagggcgccgacgctgcctccatccccatgacggtgcgcggtggcgcggggcagcgagtgggcgtctcaacgcccgctgcatggctgcgcgcaatgcatnnnnnnnnnntgcggtggcgcgggcagcgagtgggcggctcgacgcccgctgcatggctgcgcgcaatgcatgcagcgccaggattgtgcacggacgcatgcgcgctcccgacacacactcacacacacacacnnnnnnnnnncgtgctgatgtttga

SEQ ID NO: 1247 - DNA, 723 bp, Chlorella protothecoides
atggcgtggactgggcgcctcggggtctggacgtgggaggtacttgacattcctcatgcctccatgtcgtggcctgtgcactccctgctgcccctcctgtgcagcagcacaccgggatgtcaaccatgtttgtcgcgctactttgagaaggtgctgaccggcaacctgcagcagcaccagcaggccatcgccaacgcggctgcggccggcgcgccgccgccgctgcacgaggcgccgcccgtgctgctgacgggcctgcagatcgcggacatctacatgaagacccagccagccaacttcgtggcctgcggcgccaaccagctggccctcatgctggagccggcgctgacctgccgccagagccggaaacctgcgaccctgctcgcgtcgtgcattggggagctggtgcagcggtacccaacgcgggggaccgccccgctggaccccaccgccgagctggcctacaagctgctggcgcgcaccaacgaagtgctacacaggttcctggcggcgctgtccaactcctcgcaacagctggtgccagagctgtttgtgtacgccagcaactgcctgctggtcatgaaggctgccgtggaggcgcgacccaacagcatgcagcccctgatcgggccgctgctggctgccatgcaccgcgtcgccaaggaccacaaccagcagccggcggccggcatccttggctccaagtccttcccgccctcgtga

SEQ ID NO: 1248 - DNA, 2400 bp, Chlorella protothecoides
  modified_base (516)..(525): a, c, t, g, unknown or other
  modified_base (944)..(953): a, c, t, g, unknown or other
  modified_base (1354)..(1363): a, c, t, g, unknown or other
  modified_base (2232)..(2335): a, c, t, g, unknown or other
atgccgggctggttcagagggaatgggagcagaaggttgaagccccagatgaattctgaaccaaggccgatgagcagggggatggtgaaaccttgcaacatgataccgatgcgtcctccaatgcgtcgagaaataattaaatctgtccagagatgcgcttcacagcgtgcatcgattgaggattttgctgtcttgggaaaagtttggcaattgccgagagcatgcagggcaacttctacatccaacagctcctggatgattggggctctgcgtgccgcgacccgtgtggcccgtgtggccaagcagacccggcagttctcgggcaaggtcaacattgaggaggaaatcaaggtcaggagagaagtttgtatgctggtgtggcctggaggcactcttgaacatgtgcctgcagcctctcagtgccctcggcactcttcacacccaccttcaggaaatgaacaagtggaagatcatcacctatgtcgccatccccgtgtgcatcgccaagggtgcttnnnnnnnnnncactgcacgtgttgccgtcatcttcattgcatccccgctccccctcctcgtcccgtgcagccaagggtgcttacgacctgtcccaccccgcccaccatgacgctgagaagcccgactacccgttcctccacagtaagtggtagatggggtgggagtgcgtcagaaaatgtgttggcatgtagggattgggcaggcacgacaaccttcttctgcatgcctcaagtgcctccaccctggccatcctgtgcagtccggaacaaggagtttccatggggccctgatggcctgttcgagcagcgcagccccgatgtggcgcctgggtatgccagcggcgcgtggcactcaatcatgttcattgccagcacagtgggtcgctcatggcaggcctgttgtgtaaaactgcaccctaggaaattctnnnnnnnnnnctatgccagcggcgcgtggcacccaatcatgttcattgcaagcacacgagaggttaagcttgcagaggtcaggttgtttcagccagcctatctctctcgcactctgaaaacaagatacgtggccaggcgtattgtcatcgtggattggctggggggttgcacagtgcccatcttgaagaggcagttctccttatttctaaggaattggatcctcgcagttcatctgctggacgattgccctccaaattcagcaccgacagcgacgtggggaggcagcgccattgcaactccgactgatcattcccccatcacgaccttagtcctgcacctcgagatctcacccctgtgttgccctcctcctcttgatcgtcgctccaccagcgtcatcaagatgcgcaggnnnnnnnnnntcgacagcgacgtgggaggcagcgccattgcaactctgaatgatcatttccccatcacgaccttagtcctgcacctcgagattcactcctgtgttgccctcctcgtcttgatcgccgctccaccagcgtcatcaagatgcgcagggtgctcggcctcagcaccggcaccttgctcgcccggatctggatcgcagggcgcccgatgtggctgtcgctgcctgttgtgcggggtgcaccagggtgagcagccaggtttcgacctgctcacggacgtgatagcccccatgtatctcacagaggcagaattgcacgctctgggcctacccctggcgctgtgcatcactcccttgggcaccagccggtccctgcccacagcccagccagcgccccggcaggggaatgagggcgacgggcagccccacgcccccggccgctgcggctgctgcggcgcatacgtctgcgccgcggtgggcttccgccccgagggctgggtctgcgccctgtgcggggaggtgaacgacttttcccgtggcgacaactggcggtacatgccgggcccggactccaccagcccagttccgctcccagggctggatgcctccccggccgccatggacctggagcacacgggcgccggcgcggtggaggtcgactgccggcccatgctcctcgcgctggtggacgtgggcggcccggcgccctgcgtcgccgcatcgtgcgcagcgctgctggcggggggggaggccgccccagccggcaccctctttgtgctgatgacctacgcgggggaggagcaggaggcggtgttctgcgctgacaattctgcaggccaggaggcgctcaggccggcgcccctgcgccagctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggagctggagctggcgcactcggcgcctgcctccccaggtgcctgccggggttacctggtga

SEQ ID NO: 1249 - DNA, 948 bp, Chlorella protothecoides
  modified_base (110)..(119): a, c, t, g, unknown or other
atgccagtccccaaaccatcagatggtggacactcagggcggcaggctgccgttgacaggggaaagaccacggatcaggggaatatcgaaatcttgccgttggggatggnnnnnnnnnncaaaccatcagatggtggacactcagggcgacaggctgctgttgacagggtaaagaccatggatcaggggaacatcgaaatcttgcctttggggatgattgataaggttgcgcccagagttgttgctttccaacgcataccatggtcgcgccacctgaccaccgctgctcctcatagcgagggcttcaggagacggtcgtcgtatttcgattcgccagtggagccatatgatgagcgctcagactggaggggctctcgccctggtccacccgatacctaccgggacaggggccaaggatacaaaggagagaggaacgacggcccaccttccagatacaaacgaggcagtcgggataataggtacacggatcggcccccccgtcgctccaatggttactcgggagcccggcaatcgtcacccggtgggataaactggcgggagaggaaggaggaggctcgacagggcatgccgccgtccagcggcgccctcctcaaggagggttggcaaggcgaggtgctgtatggtgtctctcctgtgctggcggcgctcacggcgggcaggcgggagatccatgccctgcacgtacaacaggacattgatggatcggcacgcaaggtgggcagcgtgctcattgggtggctggctgtggccgggatagggagaggtggcttagcattgacagggcaaccgacggcaccctctttggactcggtggtgctgaatcgggccagagaagcagcacaggccatcgggtgtcctgtcttcctggcttccaagcacgatctcaacctgctggcagacaacaggccgcaccaggtgccaggatga

SEQ ID NO: 1250 - DNA, 498 bp, Chlorella protothecoides
  modified_base (75)..(84): a, c, t, g, unknown or other
atggctgtgaggggtgacggggtcagcatccgcgcggggcaccatggcactcgacaagacgttacattgcgattnnnnnnnnnnagtccatgtgacgggagggaccgatggctgcgaggggtgacagggtcagcacccgcgcagggcaagacctcgctcttgaggtatgtgctgcagagcagcggcctcaaggtggcctgcatcgtcaacgatgtggcagcagtgaacatcgacgccaagctcattcgcggcgatgctacccgcgaccccaacagcaccaccgccgacctcacggacaccatcgagctcgccaacggatgtgcctgctgcagcattgccgatgagctgatggcgagcttcgctaacttgctagagctctcagacaagcgcgggacctcgtatgatagtgcatggggccagaaaccagggtgcacaagtggaatgttgtataggaagcatccgtggacgtatgcccctccgtctcaaaagcacagttga

SEQ ID NO: 1251 - DNA, 783 bp, Chlorella protothecoides
  modified_base (449)..(458): a, c, t, g, unknown or other
atgggacccactccccacccacccaaccctcaacccctcaacccccttcaacccccaccccccaccgctgcagacagtctaccccctgaaccggctgatgcaggggctggacatgcccgcaccgcccctggaaaacgacaccgccctgccaaccctcaccacggtggcctacggcgcatcccccgccgacgcctcgctcctgcgctgggagctggagctggggctggtggaggcggggctgggcatggtcaactgcaccggcgccgccagcgcctggtcctttggcgaggagcttgcgccggtccagacccagggggtgagccgggagggaagggggagagaaacgggacggttccctgcaagctgacctggccaccaatgtcacccatgcacccacagcctgaccttgtacatcacccccacacccatcctcccacccacccaaacgnnnnnnnnnnggttccctgcaagctgacctggccaccaatatcacccatgcacccacagcccgaccttgtacatcaccccacacccatcctcccacccacccaatcaacacagggcttccctgcccacctgacccgattctcaacggcgtggggatccaaagctctgaggttctggattgacgccgctccaggccaggtgctgagtctcaccacccacgtggcacacctggacgcgaccccggcaacccaggagttcctggcgcagctgccagactgggtgagcccggtgatcatgaccaccgtgcagcagaagtggaacctggagttcaggtag

SEQ ID NO: 1252 - DNA, 636 bp, Chlorella protothecoides
  modified_base (20)..(29): a, c, t, g, unknown or other
atgggaagattttcatcgtnnnnnnnnnntggagccagcctgatgagactcggaggcttgttcttgcttctgatccacaatcagtgctcggccaatgggaagattttcatcggcatgcagcccagcctggcagacacccttccctgccctccgatcactgccgcatccgcatcctcctcatcccaagccccaccagctttgcgacaaaacaccccgtcccccgaccacagcttccaccccttgccgtgtgcaggcctgatccccgccgacacagactaccggctcttctcctacaggcgggcaggctcgctgccgggcatcgacgtggcgcaggtatttgacggactggcataccacaccaaccaggacgtcgctgaccgtgtgcgcccagggaccctccaggtgaggtgggagggggcgctttgtgggaggtgtgaccggatggggtgggggctggatggccgtcggaaaaaccaggacactcagtcttccccttctacaccacgctgctccatccacacccacgcagtccatgggggaaaacacgctggccgcgacgttggagtttgcgagggtgctggggtccgggcagcccccgccggcgtcagcacctggcgacggctacgttgcctttga

SEQ ID NO: 1253 - DNA, 459 bp, Chlorella protothecoides
  modified_base (182)..(191): a, c, t, g, unknown or other
atgtgcacacggcagtggggagagggtggtggtggcctgctcggccctcacgccagagtacaggcagtacattgccggagccctgggcgaggccgccgcccccctcctcttcgtgctcttggaccctggagcggcgacgctggaggcccaggttgcgcggcgggcgcaacagggctcccatnnnnnnnnnncctcctcttcgtgctcttggaccctggagcagcgacgctggaggcccaggttgcgcggcgagcgcaacggggctcccacttcatgcccccctcgctcctggccacccagctggccaccctccagtacgccgagtccgagtggtacctccacatcggcggcgatccatacccccagcttgaggccatagcagaagccatcgtggcgagactggaggccgatgggctgatcctggaaagtggggtccatgagaccctggggtccgagtga

SEQ ID NO: 1254 - DNA, 828 bp, Chlorella protothecoides
atgctcaagaacgagacgggcggcacctcacgagcgccgcaggatcaggaaggcatgcatggcgccgggcgccggtcgacaacctggtggcctcggcaagtcacaggccccccgccattccaagtgctccagcatgctccagggaagggaccgggcatcggccgggcacctggctccagaattgtcgcacagggccccaaatcaaccacttcctcggatggaatcgcacctgctgagcatgctccaggggaggcaccgggcatcggccggccacctggctccagaatcgccgcacagcgccccaaatcaaccactttttcggatggaatcgcacctgctgaggtggcgccgagcgcagctggccaggctctcgagccacggccaccggtcctcgtcggtcaagggcaccccggccgacatcgtggctgcatgagggggtggaggtctcgtcgtggcagggtgataatcgggtcgacggactctgccccggcgctcgacagctccagagtgacacgtcgggcttgggcattgaaaagcgcgtcatcccatcgcctggctcaccaatgttggctggggggtgaaagtcgtccccctccaggaaggtacagcacagccgctcggacagcatgcttcccaagggcattgtttggggcattgtttggggcattgtttgggggcattgtttggggcattgtttggggcattgttgggggcaatgtttggggcaatgtttggggcattgtttggggcaatgtttggggcattgttgtttggggcattgtttggggcattgttggggcatgcaagagcatcgctcatctcgcttag

SEQ ID NO: 1255 - DNA, 324 bp, Chlorella protothecoides
atggagctcttccccgtgcactcctgccgcaacctgccggccacgctggcggcggcgcggggggcgggctggcgcgtgctgggcgccgacggcggggccgaggcgcaggcctgcaccggggtcgcgcccggcgcgcccaccctcctggtcatgggcagcgagggcgcgggcctgcgcaccaacgtgcgccgggcctgcgaggcgctggtgcgcatccccggcggggcgggggcggcgcaggtggaaagcctgaacgtcagcgtcgccacgggcatcctgctgcaccacctgctgcagcccggggccgctgaggcggggcaatga

SEQ ID NO: 1256 - DNA, 819 bp, Chlorella protothecoides
atgtcaggcatgcgctccaaggttcgcgctcccatcgcctggtacggccggtactggcaggtgtactgcaccttcttcccggccgccctggccggcctcctgctgccctacgtgctgtgcacgcgccgctctttccagcccgacgcgatggtccagtcgcttggctccgcgaccttccacgccgccgtggcctccatcctggctgcccacggcatctacgccggctacctgaacgccctctgggcgacgggcaccatcctggcggtggtcctggtttgggccaggccggggcccgtgaccagcctgctcgccgccgcgctcatggctcttcccctgctcggtgcggagctggatttcggcggctgggggaagcaggggcatgggattggactggcgggcgccgccccgggcctgctgggattagtcatcggcgacgtggccatcggcacccttgcgggcgtagcggtctacctctgcgcgggcacgctgaccccgcacctggccgcgcggctggggagggcggggcgcccagccctgctcggtctgctggccctctcggccgccgccggcggctggtccagcgccgccggcggcgcggcaccctacacgccatgggcgcccaagcgcctgttcgtgcagcaccaccacgcgccggcgtctgcaccgggccaggggctggaggcgcggtggaccgtgtcggccattgacggcttcccggtggcttccacgctgccgccgcacctgctgcagcacgcgcggcccaccacggagccgtactgggaggtgaggggtgggggaggggtggcgcgaggatattga

SEQ ID NO: 1257 - DNA, 546 bp, Chlorella protothecoides
atgcccgccttggggtgcccgtgccgagcagttctcgtggtcttccaccccgccccccttccccccccctcccctcaggcccggggctccgacctccgcgtgcacttcaagaactcccgtgaggccgctgcctccatccgcggcaaggacctggccaaggccaaggcctacctgcaggccgtgctcgagcacaagcgcgccatccccttcctgcgcttcaacggcggcgtgggccggacttcgcaggccaagaacgagggcaactccattggccaggcccgctggcccaagaagtccgtggacttcctgctcaacctgctgaagaacgccgagtcgaacgccgaggtgggtggcgggggtgctggctcaaaggcggcgccaggagggggccggctgggagaccagggatcggcagggtggctgtccgcgtgcgggagcgtctgcatgcctcccaaaggcatggaccggtggcccttgggctgcaggacaccaagccctccgctccccacaaccccttccccctcccctcttttcccaacagcttaa

SEQ ID NO: 1258 - DNA, 657 bp, Chlorella protothecoides
atgtgtgtgaactgcctgcagggccaggaggacatcacccgagacatcaagaagcagatacacatttcctggtgcaagggctgccagcgctacctgcagccgccaaaccactggatgcatgccgagccggagagcagggagttactcaccttttgtatcaagcgcgtcactgggctgaacaaggtcaagctggtggacgctgggttcatctggacagagccacactccatgcggctgaagaccaagctcaccatccagaaggaggtgcatggcgccatcctgcagcaggtgctggtggtggggtctggggggttgacgagggggagggtgggagcatggcctaggctgaggcaacatgtgacgcacaagcggactttcttctacctggagcagctgatcctgaagcacggcgcagacgagaactgcgtgaacataaagaacatccacaatggagtggacttttacttcggcagccgcgcgcacgcctgcaagttcatagacttcctgcaaagcgtggtgccgctgcgataccgccacgacaagcagctggtcagccacaccatccacacctccgagtataactacaagtacacctttagcgcggagatcgcccccatctgcaaggtggccaggggtgtctggtgggaatcatcatga

SEQ ID NO: 1259 - DNA, 624 bp, Chlorella protothecoides
atgcggcgccctccaagggtcctcgtcctccgtctctacctttcctcccccccaccccccaccccacacactcccacgcaggacgacctggtctgcctgcccgccaagacggcgctggggctgggcaacctgggcccggtggtgctggtcacccgcgtgaccagcgccatcacgctgaccgacccccggaccatgcgcagcgcgagcctggaggcggggcagtactggcgcgcgcccttccgcccgctcatgcacgcgcggcaggcggttgagtttgtggtgctggactgcgagcccgtgcagagctcccacggcggcgggtacaaccatggcgggcgctggcagctggcggaggccacggtggccaaggccgcagacctgggcgccaacgacaaggtctccattacgcgcacccacctgggccacctgctgaaggcgggggacacggcggcagggtacgacctctcctccgccaacgtggccgacgacgcgctggaccgcgcgctggcggcggggctggccccgccggagatcgtgctggtgcgcaagtcgtacgaggagaagcggcggcggcgcgcggcggcgggcgcgcgccgcgcctggaagctcaagcgcctggacggc

SEQ ID NO: 1260 - DNA, 348 bp, Chlorella protothecoides
gggccgcaagcgctggatcctgagtgtgccctccaagggcgagatctgggtggacgacggcgcggcgcgcgccatcaagaagcacgccagcctcttcgcggcgggcatcaccaaggtggtcggcgagttccagcaccaggacgcggtcaagctgtgcgacgcgcaggggcgcgagctggcgcagggcctgaccaactacagcaacgtggaggtggaggcggccaagggcctgtcctccgccaagttcctcgaaaagctggggtaccagggccaggaggaggtggtgcaccgtgccagcatctgcctcctggtcaagcgggagcagggtgaggcttgttcttgggtttg

SEQ ID NO: 1261 - DNA, 1554 bp, Chlorella protothecoides
atgggggcgtattcttcaataggcatctttctgagccctcgcacggcgtgtgggccgtgcttgggggggttccagcccccgtgcgtcgccgtgcgtggccggcgccggccttgctcggcacccggtgtggccggcgctccggcaggtcgcctcgcacactcgattgcaatatcatggcccacccgtcgctcaggccttgagcaggctgggctccatgtgccccggcgcctcgtaacccagcaggttgaagatggttgcggcgacatttgccagccccgccttgggctggtcctcccggaaggccaccccctccggcagccccgcgccgccgaccgccagggggacgggggccagggtgtggctggtcagggccacggtctgccccgcctcgtcgcgcagcggggccagcgtcttcttgtgccgctggaccatgtcgtcggcgttgccgtggtcggaggtgagcagccagcgcccgcccagctcgtcggtcagcgccaggagctcgccgacggcggcgtccacgcaggcgcaggcctccacggtggcggccaggtcccccgtgtgccccaccatgtccgggttggcaaagttgatgcgcacggtgtcgtagcgcccggagcgcagcgcctccttccccgcctcgcagatctcgcgcgccttcatcagcggcagctggttgaagggcacgcggtcgctgggcacctccacgtacgtctccagcgcctcgtcaaagtaccccgaccggttgccgttccagaagaaggtcacgtgaccgtacttttgcgtctcgctgcaggcaaaggtgcgcaggccgttgcgcgccagcacctcgccgctgaccccggagatggcggggggcgggaccaggaagcgggcgggcagcttcaggtcgccgtcgtactgcatgagccctacgaagcgcgtgcgcggccagcgcacgcggtcgaacgcggcgaactcctcgtactcgaaggccttgctgatctggcacacgcggtcggcgcggaagttgaacaccgccaccgcgtcgccgtcgcgcacggggcccaccgcctcgccgtcggcgcccacgatgacaaaggggtccagccactggtcggagacggggtcggcggagccctcggcccgcagggtggtgatggcggtgaccgcgtcggggaaggtgtgaggcgcctcgcccagcacgtgcgcggcccagccgcggcgcacgatctcccagtccgcctcgtagcggtccatggtcacgcacatgcggccgccgccggaggcgatcagcgcgtccacgccgcggccgcgcacctccgccagcaccgcctccagctccttggcgaagccgacgctggagccgtcgggcacgtcgcggccgtcggtaagcacgtgcacgcggatgcgcttggcgccgcggtccgccgcgccgcgcacaagcgcgaagagctggtcggtgcgggagtgcacgccgccgtcggagaggaggccgatgagatgcagggtgttctccgcaaaggcctcggagatatgggcccagccctcacctgcaagggtgggaagtggtga

SEQ ID NO: 1262 - DNA, 672 bp, Chlorella protothecoides
atggcggccttgcggctttcacaagtgcctcttgcgaggacccgcgcaacccccatgtgtagtccaggcaggagacttgctccacgccatgactccctcccatgcagctgcatgagccccagcaccgcttttcaagctgctaccttggctgtcatcccactgtatggggcgatggtcacagccccacgcagtccgagggtgtctcaggtacttgcatcccccgtgataccagttgctggagctgccatgtacattgctctggccctcggctggggcgcctggtcggagttgtgtcagctccagttgtggcatcaaggcagtgggcccctggcatggctaccatcaaatgagggtcttgccatggcattcacacatgccaatctggccgccttaacctggattcatatcatcaccctggactggctgcaagcaagcaagggcacccctagatgctgttcacagattacccacaaccccctatgcccgagtgctactgtcatctcatcaaactgcagatgggtctacttggatggtcttcgatcccacattcccacattacactctgcgattctctgtttcatggttggcccactgggagtgctgagtcacctgctgaccaagtacatagttggaatgcaccgtagtagcaatgcgcagccctctgctgcttag

SEQ ID NO: 1263 - DNA, 342 bp, Chlorella protothecoides
atgcggatgagggcacgcgatcatgccacacggctgcaaccaggccagatcccacccataatgcaggccccgggacggctgaccgccaccatcgcccaccagcctgcggcaggcagaagtgtcaaggtcgtcactcccagctgtcccctcgccttcggagacgagcttgtcgtggtgggcagccaccagggctggaagcctgaggctggcacggtgctgacctggaccgagggcgacacatgggtcggtgagctctccaaacaactcactgacccagccctggagttcaaggtgaggctggcgctggcctcgtggcatctgtggggtgggaggtcgccatga

SEQ ID NO: 1264 - DNA, 1638 bp, Chlorella protothecoides
atgcccccccccgtcctccaaaaccctttccccgtggtgtgtcccggcaggggcgtgaacgtggaggatgagtacaacgcggtacacgtggcggaaacccccacatacgacgcagcgaggaaggtgcctggacgcttccgctccatcctggcgcacggcactgccgtgggtctgcccagcgacgccgatatgggcaacagcgaggtgggccacaacgccctgggcgccggccaggtgatcgaccagggcgccagcctggtggacaaggcgctggcctccggatccatctacgagggtgagggctgggcccatatctccgaggcctttgcggagaacaccctgcatctcatcggcctcctctccgacggcggcgtgcactcccgcaccgaccagctcttcgcgcttgtgcgcggcgcggcggaccgcggcgccaagcgcatccgcgtgcacgtgcttaccgacggccgcgacgtgcccgacggctccagcgtcggcttcgccaaggagctggaggcggtgctggcggaggtgcgcggccgcggcgtggacgcgctgatcgcctccggcggcggccgcatgtgcgtgaccatggaccgctacgaggcggactgggagatcgtgcgccgcggctgggccgcgcacgtgctgggcgaggcgcctcacaccttccccgacgcggtcaccgccatcaccaccctgcgggccgagggctccgccgaccccgtctccgaccagtggctggacccctttgtcatcgtgggcgccgacggcgaggcggtgggccccgtgcgcgacggcgacgcggtggcggtgttcaacttccgcgccgaccgcgtgtgccagatcagcaaggccttcgagtacgaggagttcgccgcgttcgaccgcgtgcgctggccgcgcacgcgcttcgtagggctcatgcagtacgacggcgacctgaagctgcccgcccgcttcctggtcccgccccccgccatctccggggtcagcggcgaggtgctggcgcgcaacggcctgcgcacctttgcctgcagcgagacgcaaaagtacggtcacgtgaccttcttctggaacggcaaccggtcggggtactttgacgaggcgctggagacgtacgtggaggtgcccagcgaccgcgtgcccttcaaccagctgccgctgatgaaggcgcgcgagatctgcgaggcggggaaggaggcgctgcgctccgggcgctacgacaccgtgcgcatcaactttgccaacccggacatggtggggcacacgggggacctggccgccaccgtggaggcctgcgcctgcgtggacgccgccgtcggcgagctcctggcgctgaccgacgagctgggcgggcgctggctgctcacctccgaccacggcaacgccgacgacatggtccagcggcacaagaagacgctggccccgctgcgcgacgaggcggggcagaccgtggccctgaccagccacaccctggcccccgtccccctggcggtcggcggcgcggggctgccggagggggtggccttccgggaggaccagcccaaggcggggctggcaaatgtcgccgcaaccatcttcaacctgctgggttacgaggcgccggggcacatggagcccagcctgctcaaggcctga

SEQ ID NO: 1265 - DNA, 519 bp, Chlorella protothecoides
  modified_base (402)..(411): a, c, t, g, unknown or other
atgcacaggatcgggattatggctcgggggaggctgcggtgcataggcaccagcctgcggctgaagatgaggtttgggtctgggtacaggatcagcattagggtgcaggggggtaccagcagctctggcagcagctcccagactgaggagggggcgctggatggggacttcctcatccccgccacccccaccaccgaggccgccgccgactcggccccgcggtgcaaggagcagcagctccgatctgggtccggggaggagcagcgcagcaccctgggcaggctgcaggcggcccgcatcaaggccgtctttgcggatcgcctgggcgtgacggcaggtgggccgtgcatggggcggcgcggggagtcagaattggggtgtatctcaggcagccttcaaggnnnnnnnnnnctgggcgtgacggcaggtgggccgtgcatgaggcggcgcggagagtcaaaattggggtgtatctcaggcagccttcaagaatggggatggccgggtggaacccactga

SEQ ID NO: 1266 - DNA, 1596 bp, Chlorella protothecoides
  modified_base (835)..(844): a, c, t, g, unknown or other
  modified_base (1264)..(1273): a, c, t, g, unknown or other
  modified_base (1430)..(1439): a, c, t, g, unknown or other
atgccgaggatggcgtccgcgggagcctgcggacgggtggcagggtcaagtccgcggggtgagacgcaggaggccaggacccttcagacattgggaacgcttcacaacccttgtagcatgccaaattacattgaatgtacctcggggacctccgagaagatggagctcatggcgcgtgcttgggacggggagggggcgacggaccgtgtgcggacaaaacttccgagatgtgcagccaaattcaatagacgacggtgtgccatatccgccatccaagctcttgctgactcaggaggtccgggtggccggcggactcggtgctacctaccgggggatactaccttggctgaaatgagcctagtcaaggcaaggcgggcaacggccacccagcctcggcgcacccacaacaaatttcacggtattttattgtgggcgattcctgcactaggcgctatgggtcgtccagacaagacagatcactctcactcgtgcacacaacttcagtggtcacgtggccaaactgtcttcgcctcgataccatcaaggagcaggcatgcgggtgtcgaggggtccctccctcccacagaacgaactgttagactctggcaatatcctgaaaactgggccaaagtctctggcatcgagtgtcgcacaggggtcagaggacatctcgagccccggtgtcccggaaggactcgaggatgccagtacagaacaaggcgcccctcatcacggggtggcgcctgctggggactcagtttgcagccctggttcgcaagaaccttctcatcaggtgaccagagctggttcaggcagttccacagcgcctcgtcgnnnnnnnnnncttctcatcaggtgaccagagctggttcagtcaggtctacagcgcctcgtcacttgggcttgcgcctgatcatcataatctcacaacgaccacccattgatgacctgccaaacaccaacacaaccgttggcagggccctggcatggcgcacaaacgtgctgctcctggcgcaggctgtgctcttcatcctcctcatctggggcgttgaccgcgcgcttactgcctcccgccagcgacagccagcctacagctcccagacgactgccgaggctgttgatattgggcctatcccagactgcgccaccaacatctacttgaggcaagacagggcctgctacaccattgcctatgcacccaagataggtacatgcgacgcccgtggggatatcttcccgccaaaggctgcaattcttctcaatnnnnnnnnnnataggtacatgcgacgcccgtggggatatcctccccaaaatggctgcaattcttctcaatcccctcatctcgcagggcgttgcactggtggaagaggttctggcagcggtggcggacaacaacagcccccccatcccacgaacccacctcaagggtnnnnnnnnnncgttgcactggtggaagaggttctggcagcagtggcggacaacaacagcccccccatcgcacgaacccacctcaagggctttgccagcgaaaccgagatcgacgactacctgctggccaatccggaaacggtgagggagcagcggtcgacgttctag

SEQ ID NO: 1267 - DNA, 1323 bp, Chlorella protothecoides
  modified_base (41)..(64): a, c, t, g, unknown or other
  modified_base (150)..(159): a, c, t, g, unknown or other
  modified_base (385)..(394): a, c, t, g, unknown or other
atggggccagcgacgctgccatggctgcagtgcgccgccannnnnnnnnnnnnnnnnnnnnnnnggtctgccccaccgcccgtgctcacacactttggtttatcctacatcactcaagcaaaagggtcctgcgagacccaggggatgggnnnnnnnnnnagtactttgggtgcttcgtgtactcctggcgtaacagggatggacgctgacaagcacaggaggccacagaggggcgacctcatggtcacggcgctgcgcaatgcctttgccacaatgcgggcggcacactcagcagtctctcacgcgggcgggtgcgattggagtctggctcgaccgtgttgtgccatgcagacatgtagtaaacgggactggtgcggcagccgannnnnnnnnntctggctcgaccgtgttgtgccatgcagacctgtagtaaacgggaccggggcggcagccgggcgtgccgggggcaggctctcctggagccgaaccccacctcccccaccccaactcagccgaccacggcgcagccgctcagtcggcgtagttgcgcaccgcgtcgtcgatggcggccgcgaggtacttgcacgactccggcgacagccccgccatggagatgcggccatccagggtcatgtagacgtggtgcttggcggtgaggcagtccgccacctggcgccgcgtcaggccggtgtaggagaacatgccgatctggtcctggatgtggtcccaggttccgggcgtgccccgctccctcagcgcggcatgcaggtgctcgcgcatggagatgatgcggtcggccatgcccttcagctccgccttccagagtgcgtagagctcggggtcggacaggatggccgccacgatctcggcgccgtggcgcggcgggttggagtacctgcggtggaaacagaagggaggattctgatacaacgagcatgttcctgcggcctgggtgggcaggggagattcatcccacattcccctcttggcagctcacatggcgcggatgaccctcttgagctggctctccactcgggcagaggtgtcggcgtcggcggagaccaccgtcagcgctccggcgcgctcgccgtacaggcccatgttcttggcaaaggactgcgccagcagcagctccagccccgcctcggcaaacatgcggatggaggcggcgtccccgtccaggtcgccgctcgcaaagccctgagcggtgagaggggggagaggaactacactggaaacgaggaaaccagccaggtggagaaggatggtgccgtccagcccgtgcgcttttcaagggcgcacactggccctgcacggcgatga

SEQ ID NO: 1268 - DNA, 1131 bp, Chlorella protothecoides
  modified_base (480)..(489): a, c, t, g, unknown or other
  modified_base (871)..(880): a, c, t, g, unknown or other
atggtgcacgactacgtccccgagatgatcaagatcatcaacaccatgccccccggagccgtctgcgcgaccgtgggcctctgcgactcctctttcgcaggcgtggccaccgacgtcaagcgcagcgccggcgcccaccagacggcggcctaccgccggctgctggagacctacgcccccggccacgccgcgcagtcgagcactgtcgggagctggggcatgcccagcaacggcgatgcctgccagatgtgccagtttgtggtgcagtacgccaaggtgggtggtgctggcagcctggtactgggtgggaggaggcggatgggttgtttcctgccttggggcaggaggggcccaagcagaaggatggctggagcacgaccgtctcgtgcaagtggcgtgctggatgtgtgggcaggcaggctacgcagtaaactctttgcatcaccaggcgcacaatcttctgtcatgtccacactgctnnnnnnnnnncacgaccgtctcgtgcaagtggcgtgctgggtgtgtagggcaggcagactgcgcagtaaactctttgcatcaccaggcgcacactcttttatcatgtccacactgccggcccccactgctctccctgcatccatcgcaggtggcgctggccaacaacgagaccgccgccgagatcgtggacagcctggacaccgcctgcgagtcactgtccctgggcagcggcggggagtcatagctggtggtgtacgagaggagagtgattgtttgggacagcggcatgttcttgctgctggagctgtgaaaccaggagtctctgacggcagtgtacaagcaccaccccctgtcagtaatcgctgtaaccttgtgcaccctttcttcgatnnnnnnnnnngcagtgtacaagcaccaccccctgtcagtagtcgccgtgaccgtgtgcaccctttcttcgacctcctccccgcagtggtggactgcgccaagctgcacaccatgcccgccatcacgctgaccatctccggcaaggagtttgtgctcactccggagcagtacatcctcaaggtgcgagggtcggacttgagaatgatttggatcatttggatcgtaagatcaagcatgatgccatgcgttggtgtgagatga

SEQ ID NO: 1269 - DNA, 1764 bp, Chlorella protothecoides
  modified_base (325)..(334): a, c, t, g, unknown or other
  modified_base (1021)..(1030): a, c, t, g, unknown or other
atgcttccagtggaagcaggaccccgaagaccccttatcccatcagtcaccattgcggcctcaaaagcctgcctcctccccacccctcttcagtattatggcgagatcgggctgggcaccccccctcagcccttccaagttgtgtttgacactgggagcagcaacctgtggattccctcctctaagtgcagctacttctccattgcctgctacctgcactcacagtacaatgctgaggcctcctccacctacctggtacttgagtggtggggtgttgttttgatggcagccctgaccacggaggatgtcgacaaagggccacttnnnnnnnnnnggggtgttgttttgatggcagccctgaccatggaggatgtatacaacaggccactttactgctgccttcatgcgattccctggcagcagtgtagaggctacacttctgcgtcagggcccaccgatcctatgattacagccctatctctcaccttacctcaacattgtctctcccaggaggacgggcgtgactttgccatccagtacggctcaggcgccctcactggcttcctttccaacgatgttttgaccctgggggacctcaagatcgaggaccagatctttgccgaggccgtgaatgagcctgccctggctttcatcgcggcacagtttgatggcatcctggtaaatgtacctgacttgtgggccatgtatagatcagcacccaatgtgaatgtcacagcctgctcatcctgtgatcaagaagctggactgggtttccccgagattgccgtcaacaaggtgccaccccccttccagcaagccctgaagcagaagctgctcgacgagcctgtcttctccttctggctcaatcgcaaggtgctgaggtggtctgctgaggtcttggaatgtgtggggcctggccatggaagtgtggggttggggtccgagcgcagtcccttttgcagcatgacaggacaccatagaatggcagcgctgcgagttgtcgcacacacccttgttgacnnnnnnnnnntcttctccttctggctcaatcgcaaggtgcggaggtggcctgctgaggtcttggaatgtgtgggggctggttgtggcagtgtggggctggggcccgagcgcagccccgtttgcagcttgacaggacaccgtagaatggcagcgctgcgagttgtcgcactcacccttgttgaccccacgcgctccaggtcgaggacggcgaggccggcggcgagctggtgctgggcggtgtcaataaggaccactacaagggggagcacgtctggtgaggggcgaggttgggccacttgcgtgcagggacggggctacgctgcacactctccggggtcaacccccaccccccctgggttccccacctgcagggcgcccatcacgcgccgcggcttctggcagttcaagctggatagtctggaggtcgagggcgtcgccctgccggcagtggattccctggaggctctgagccaaggaccctccccccacctcccttggcagggcaagggttcttgcgaggacggttgccaggccatcgctgacacagggacctccctcatggtgggcccccccctagccatcgacagcatcaacaaggcgaggcggctggctgggccttgccttgattgtttactctatgtgccaggatttggcatgtggttgggaggacatggagtgaagttccggctcccttacagctccatctcaggccggggccgatctgcctccccaaggctaccgtaa

SEQ ID NO: 1270 - DNA, 258 bp, Chlorella protothecoides
atggctcgcacccggcccatcatgggcgtctgtccacagtttgatgtgctctgggacgagctgactgggctggagcacctgcatgtgtttgcagccatcaaaggtattcctgcggcgaccagggccgcagaggcagcgaagctgctggaggaggtcaagctcaccgaggctgggagcgtcagggcaggggcctactctggaggaatgcggcgccgcctctctgttgccatggccctccttggagaccccaaggtgtga

SEQ ID NO: 1271 - DNA, 678 bp, Chlorella protothecoides
atgtgcgagatgttcaaggaggcctgggcccgggtgcaggacgtggcacagctggcccagatcgagatcgccatcaagctgcaggtcagcgctgaccgtgctggactcggcggggcgccagtcgctgccacaggagggtcggtacgcgtccacagcggtgtattgcctggcgctggccgccggccccgcctccgtccccgacccgccgcgcgagacggtcttctccaagaggtgcggaggtgtgggggagggggcgttgaccctgtgtgggcgggtgccggccgggctgccaatttttacgtgtcagggaaacccatcccttgcccttcgacgcacgcgttttgcatccctcatcccatcccttccagggactacgtgcgcctgatggtgaccagcgtgcgcgcgggtctggactttcaccagtccatcgccgccatggcgctcggcaatgtgcaccccacctgccagtcgctggtggtgcaggagtgcatgctgctcaccgaggactacctcgtcgaccgccaaatgcagcgcagcatcagcgtgtcggtgcccggcatggggcgtgcgcacaagctgcgccgggacgacgtgaggctgacgcatgcccacatctaccgcgtactgtgcgccaacctgccccccatgatcctgcagaccaaccaggtgggcgcttga

SEQ ID NO: 1272 - DNA, 870 bp, Chlorella protothecoides
atgccgccccaccgacctcagtctcctcaatcccccgcaggtcctgtcggctgtcattctgtcagtggatggagagagaaatgtggctttcaccatccaggtgaacagcagtgtgcagtggttcaagggcgactggcaacaccccaacacgtacgtccaggtgaggtgtccaaaggctgggggtgggatgggggagaggaccaagttcattaccgcgagcgggtccagctccccagagcgtccacccacccacccctccttcctgtcttgcggccacagctgcccctccaggcggcggtagagagggagctggtacgccgcgccgtgagcaacccagacctggagtggagccctgccctgacccagttcccccacccagcggccaaggtgagctttggatgtggtgtggtgctactgcgccgtgcagcggggcagggattgcggcatcgtttcattgcttggaggcatgtttcccgccctccgagggccctcacaccagccatcgccgcctccccgctgcagtcgccctccatgatcggcaccattgcgcccaccttcctctttgccagcatcatgtttcaggtggggactgtgaccacgtcaggagggcaggggaatgtaatgcatgcagcctggcctgcccatggcccctttcatggatgcaacctccatgctgagaggacgacagcaaaccagtcacctccctgctcctcctcaccccctacctccgccgcacagtttgtcctgctgctgcatgatgtcgtgcatgaggaggagagtggggtccggcgtgccatggccaccatgggactccgggacacacccttctgggcctcctggttcctctatgaggtgaggacccagttgtga

SEQ ID NO: 1273 - DNA, 771 bp, Chlorella protothecoides
atggcggtcaccctccccggcttgctgtgcaggagttcagggcgctcaccaccccaccaccctctgcccatccgaaaccaggtcatgaccaaggcggctgagctactgggcgtgctctcggccaccagcctggacaacatcaccgcgcgcttcctgaaggaggtggggtcccgcctgcaggccgactccgcgtccttcatcaggcaggagctgctaaacttgtgcaacggcctccgcttcatccggctcagggccggcacctccgaagaggtatgcatgaaaagctggcttggatgggtcgagattggggcctgcagcgctggtggctcgatgagcatggcgggacatgcaggggtcctcgctgcagctggacgccatccctcgcaacccctcacccacacccctctttgctctcagctgcgtgcatccatcgccttcctggaggccgcccacccgctcaagcacgtggcctccgacaagaagtctcgggtgcagcagagcatctgcgacatgctgtcctgcatcctgcagcccatcgtggacggcgccgacgcagggtgtgttttggggggtggagcgctgggccaaggatggggaagggggggcgcagggcgtgctccaggcgctgcgacagcccaagcgcttgcgcaggatctactgcccggcgcccacccggcccctgtctctcattcccttgctctctacctaccccttgcccctccttcaacaccacctgcaggtcctttggcgccggctgcgatcagggcctga

SEQ ID NO: 1274 - DNA, 1233 bp, Chlorella protothecoides
atggtgcaggtgcagcggccccggactgcgggcgctttacagaaagacgcaggggcacaggccggggcgccagtggcgaccctcggcccccatccaccaccctccccggtcaccatctcgctgaacgactgcctggcctgtagcgggtgcatcaccagcgccgagacggtcctgctccaggcccagagcacggcgcagctgctgggcaagctggaggaggccagggcaggggggcacctgcgcgtcgccatatccctctccccccagtccgtggtgtcgctggccgtggcggccggccaggcccccgcgctgacgcagtcgcgcctggccgcggcgctccgcgcgctgggcgcccacgccgtcttcagcacggcgccggcacgggacctagcgctggcagacgccgccgccgaggcagtggggcggctgcgcgccgcggcgcggtcgccccgtgcgggagaagaaagtgcggcgccgcgcctccccgtgctggcctccacctgccccggctgggtgtgctacgcggagaagacgcacggcgcctgggtcctgcccttcctctcccgcaccaagagcgcgcaggcagtcacggccagcctgatcaagggtagctgggcggcgggggagggggtggcgcctgaggacgtcttccactgctccatcatgccctgcttcgacaaaaagctggaggccagccgcgaggacttcaccctcggcattgagggtgagggtgtggtagggggtttgggtgctgtgctggacagacagacggctgtgctttttgggagcaaaggccacaccaaaccagggacggtatgccataacaaccaactcctttcccccccttctttcctgcccttctccatcgcagggtccagccggcgcgtcgcggagacggactgtgtgctggccacggcggaggtggcggccctgctgcaggagcgaggcctgcgcctggactcacccctgcccggggaggaggtcgggctggacaccgtgccccgcccgggctcgcccgggcgggggcttgtcggccgggcggggtggatgggggccgtccacgccgggtcaggaagctacatggaagccgtgctccgtggtgtggcctcagagctgcatggcgtagagctggaagagggcacgctggtcacgcaggccgggcggaacccaggtgagctgggcggcagggcggggtggggtgtttgctcaggttcctgtgagcacggggtctaa

SEQ ID NO: 1275 - DNA, 927 bp, Chlorella protothecoides
atggtcatcttcagcctcttcccctggagcctgctctccaagggcgtgggcgacctcgctgcggcagcctctggtgaggcctatgcacttgctggcgtggctcggggcagagggtcaacccccggtggcatcccctggtccatgcgtggggcctactgcgtgagaggctccctgtcccccgagcaatctagcagtccgctctactaccaggacgactgcgtgatgcccctgggcactatcctctgggtgctggcgctgcagtgcgtaggctactgcctgctcgccctctactttgacaacgtgctcccagactgcaacggggtcaggcgggcgccctggtacttcctgcagcccagttactgggtggcaccttacttactgggtggcgccttacgtgagacgggcaggggttccggggcggggggcggagggaggctgccggcccagggtttctgcggagagcacctgggcgacccctgcatgcacgtctcgtgtggcactcgcgccaatctgcaatccacccctattctcctgcagaaacccagtctggaaagggcgcagcgggcctacgaggcatccacgcaggagtccaccggcctggtggtggatgctgatgtggcagaagagatggaaaggatgaagacgcggtgcctcacctacactgggaagctgagcggcacccaccaccctggggcggcaggcgtcgacacggcggctgccactccacagcctgcctatgcgatggagatgtacgggctgaggaaggagtacgggaggggcctgttccggcggaaaccttttgtagccgtgcgcagcagttggctgggagtcctggaaggtgcggtggggagctcgggacggatgcagggcttgggggagggcaggcaactgtacaagggtggtgagagattgatggggatggattga

SEQ ID NO: 1276 - DNA, 408 bp, Chlorella protothecoides
atgctgcgcggcaagctggtgcagtttgtcgcggagacggcacggcacatcaacaccctgcccgagctgtcgccggagctgcagcagctgcgccactgcctctgcaccgtggcgcggcagtgcgccatgcagctggcagacgcgctgccgcaggacttcacggccgacacgcggcgaaccctcttcgacatgttttccaactactgcgaggaggggacaccaggtggatggcgggaggcgggtggctggggcgtggggagggagattcggtgctggagaggggaggagtttgcaagtaggagatcgtttcgaagaaggggtctgctcgcctatacacacacccatgcccccgctccggccttcaagggttccccctgccaaatttcacccaacaaactccccacataa

SEQ ID NO: 1277 - DNA, 615 bp, Chlorella protothecoides
atgtcgacttctgggatcgcggaggctgagagcactgaaattgcccccccacccaccgagcccatcgcagacccctttgtgttcaatggcgagaccatgcccggcatgcgcgatcaggtcgtgaccgaaaccgtggagaccagggtttggaccgaggaagtgggtgcagccgaagggagccctccccggagccccgatcgtgacccgacctaccggtgcgccgtcgtcgtgggggggaatgaccctgccacccctccatactcggccgcctcacccggctcgcctcctcccgagtcgcagcagctcagcgacgcgggggccatcatccagggcactctgcactccgagctggagcgggtgcagctggcgcgggaggtggacgtgcgggccgcctttgccggcctgccccgcgtccactcccactggacgcaccgctacatgaagatcctagtggtgggcgaggcgggcattggcaagaccaccttcatcaagaacctgtttgccgcgtacgccagcgaccccaagttccccgtcgccgacacgcctgccaggggcgcgcgcaaggcgagtttgcagtcggtgaaagggggagcgagggggatggacggcatgtag

SEQ ID NO: 1278 - DNA, 405 bp, Chlorella protothecoides
atgctgcatgtcacacataaaacctttcccctaccacccgaaaagcgtgcaccctgctgctcctaccacacccaccccccagaggagtttgggcaggcgctggtcaaccagatggaccgcagcttcctcacgcgcgccggcgccctgggcaggggcgccagcaggcgcgagcagaccgcccagctggtgtcggcgcgccaggccggcccgtcctacctcgtcagctacaccgtgtcccccgtcgaccttgcgccccgcgccgtgacgtccgtcgtgaccccgggcagccacaagcgccgcagtcggctgtacacgctcaacctctccgccccggcagaggagagggagcgctgggagcccgtcttctctggcgtgctccagtcgttctcggtgccccgggcctga

SEQ ID NO: 1279 - DNA, 813 bp, Chlorella protothecoides
atgcaccccggaccccccgcccctccctcccccccctcgcaggagctggtgcgaatgctgtgcgtcaacatcaccaagcgcctgccagagcacgggtcggcgctcatcaccgacctgctgcagtacgatggcgtgaacatgaactgggaggcctgcatgtctggcgtgtccgccatcctcaccctcctggccgaggtgccggcgcgcctggccggcgccaacgaccccgtccacctgccggccaccgccggggtgagactcgatggggcagggatgtgggaatgggtgtctgggaatgacaaggccatcgtgcatgggacaagaggtgaagggaagaccatgcagccagggcattgcatcgcatgggaccccaaaccctcggcgccagatgagctggagcggctgggcggcaccgcctggctgccggagaattacgacctggaccgcctcctgcccctcattgagcagggctacaactgcctggatgccctgagcatggggcccgccctctccgctctgtctgtgtccctcagcaaggtcatccagcaggcgcacaacctgcacggccactcgcgcttcagcaccaccaacagatcctttggcgatgtgcccgggcgggagcgggtcggcgcgctgcccgtctttgtggccgccctgcagtgcctgccgtttgtcgtgccatcccactgggccgacggccgcctttgggaggacctgccggcctatgccatccacggcgaccccgccatgcgcaaggtggcgtggggggaggagctttgtgtgaatacggaggccgaggcaccccagggctga

SEQ ID NO: 1280 - DNA, 582 bp, Chlorella protothecoides
atgcagcactatgccagagacgaggcaggcggctggactgggtgtcactgcgagggcggcatctggtcgaccttcttctccctgctcctgtgggaggcgctgtttgcccccgtccccgacgtgttcaggaccccgtttcagtcctcacccctggacctcaggaccgagagcttctacattggccgccaggacctgatcgagcggatcctgggggagatcgcggcaggcggcgtggaggagcgcctgcgagccgtgtgggatgcgcactgcggggagctgtgcgccggcattcggtgggaccgctggccgcttgaggagctgctcaccatcgcagcctgcgtcgggggcagaggcttagcggtggtgtgccggctgctggctgaggatcactccggctgggcaggaggtatgccggacctactcctctggaacccagctcgcctgaaagccaagctggtggaggtcaaggggcccagggaccgcctttctgagcagcagcgggcatgggcgcatgcgttgacgcagggtggcctggaggtcgaggtgctcaaggttgtggagcccaaggcttccaagaaataa

SEQ ID NO: 1281 - DNA, 1065 bp, Chlorella protothecoides
atgccccgcagcctccgccggcgcaccaccagccacaacccctaccgccacgtcctgcgccccaacaagaagctggaggcggtgcgcgcggccgcggatggactcggccccaccaaccggcgcatgcggcgccgggcggggcacctgaccgcgcgggccgtgcagtcctgcgagtggcggcccgaggacctgggtggggatgtgctgcgcgccgccgcgcctgacccccaggtcgagggcccgggggccgactgccagccagcgacggatgcgcgtccggcgcccaagcgcctggagacccacgtctggcacgccaagcgcatgcccatgcagcgggcctggggctgggtcctgccgctgcggcgcgcggggcggggcaggggccagcggtcgctcgtcgcgaggctgcgcgggggcgcagtcctcgcgcacgacgccagctactgggcggcgctggctctggggctggataagggcagccggtttccctgcatgggccgcctgctggggcctgggtgcatcgccgcctgccaggcgctcctgcacgcgccagcgggtggggaggtcgggctcatgctctacgctcccgatggcttcccggcggccgccatagcgcctgccatcctcacctgcgtcccggggactgctgccgccgaggccccttccccttcctcgcccgggcacggcgccgtcgccgtgctctgggtccatgcggcggccgtgcgcggggcagcggccgcgctcgcccaggctggagctggtggggcgggggtgcgacgctctgctgcgggggctgtgcccgagcgggccccggcacggcgccccctccccgcccgccccacctgccgcggacggcgcgctggccgtgctggccgtctgggacccccgcctcccgcgcgacgcggcagagctggatccgtcgggcgcacgaggccatcccgagggagtggctggccaggggctctcctgggacgcccatgcacccccatgcccggcctcggagctggccgagcgcatgaaggcgcggcgcggcatggggagggccgaggccagtggattccttga

SEQ ID NO: 1282 - DNA, 471 bp, Chlorella protothecoides
gcggcggctgccggcgcgctgctgcgccagacggggccgctggtgcgcgtggcagcggcggcgcgggcagtcgtgacccgcctccagcgcctcttcttcctctccgaggaccagggcctgtcgcacttcctcgccgcgcacgctggcgcgctgcagtacccgcggtacctcgtgcaccgccagcaggccgtgtggtccagccgccggcagctgctggagtacgaggcggcgctgcaggccgcggcgcgcctcatggacgcgctggaggtccgtggagggtggtggccccgggccctgcagcactctgccggggatgaggcggccgcggaggcagagctggagggcatctggcgcagcctggacgccaaccgccacaagcagctgcccagccctctcaagcagtccttttccaagcagtccagcctcctcttcctgtcccggttccaggcaggcaagaacgagagggtgtga

SEQ ID NO: 1283 - DNA, 198 bp, Chlorella protothecoides
atgaccatcaaggtacccattggcgccgacttcatccagtccccctcgggcacactgtaccacatccggtggtcacaggacggcgagggccagctgcacatcctcgagtactgggcggaccccgtctccaagctcctggccgccgtgtcggggcccctgccgctgtccttccccgccactgccgccgcgccggcctga

SEQ ID NO: 1284 - DNA, 567 bp, Chlorella protothecoides
atggaggagacggtggcaggcacggccaagcaccgcatgctgctctactcagggcatgactccacgctcatgccgctgctggtggccctgggcaaggaggtggagacctggcccgcctacatgtccaatctggtgtttgagaactggaggcgtggcgacggccagcgctatgtcaaggtagttttcccctttttggggggggaagggggctgggtttggggaaaggggctccgagaaatggtcatgcctgttatggctggccttgggtgcaagggtggaggcctccaagacgctcacatgccagagtggctggggcgcgccacctgtcgcacgggatcggtgctgtacaacggcgaggcgttgggcctgcaggagctgtgcggcactcccgagtgcccgctgcaggacttccggcgcgcggtcatggcgccgctgcagctggactcggcgacctacgcggaggagtgcgtggtgcaccccaagcacaccgggcctgccgggacgcgggtggagacgcgccagcggggagtgagcatcggcagctccatgcaggaggaggacgagtga

SEQ ID NO: 1285 - DNA, 837 bp, Chlorella protothecoides
atgcccctccaccgcctcccccccaccccccaaccgcactcgccttcaggtgcccgcacgcccctgagccaaaagtactggcccgagctggttagggagtgggacgcgtgcgggcaggcctacacgccagtccccctggatatccgcaccgaggacgggcagccccgccccgccaaccccgacgacgtgaaacaggtggagacgcgcttccccggcggctgcagcaagggcgagctcacccggctgggccagcgccaggccctggccttcgggcggtggctgcgccgccggtacgtggacaccctgggcttcctgccgggggaccgcgagcaggacaccctcctcccccgcaccaccaactacgcacgcaccgtggccacgctggccggcgacaccctcctcccacgcaccaccaactacgctcgcaccgtggccacgctggccggcgtgctgacggggctgtaccccggggacgaggggcctgtgcccgcgctcaccacgccggagatggacgaggtgctgtacgccaacgtgcgcagctgcgcgcgcctgaaggagctggttggggggctgcacgccgaggcgcgtgccagcgcgaagggcgatgagggagtgcaggcgctgggccgagagctggcggcggccatgggcctgccgccgggccaccgcgtcagctggctcaacctgcacgacgccctgacctccatgcaggcgcacgacaagcccatcccagaaggcgagatgattaaaagagggcgagaggggcaggggtatctgatggggatcgggtatggcactggcctcagcctcgcggctgggcgtggcagtggggaatag

SEQ ID NO: 1286 - DNA, 492 bp, Chlorella protothecoides
atggagaccgacaagcagatgctggccaacgtggacggcatggtggacctcctccagcgccaactcaaggtaggtggtgaggtcagggaggtcttgaaggagatgcgtgacgaccagcgacgcccagacttcccacacggaccccacaccgcgccccgagactccatcttaagctcaaatctcttgcaggacaagaagaatgccggcgtggccgcgctgtgtatctgcaggtgcgtctgcgcctacgtgctcagatttgcggggcgctgggacggcgccaccgtctccaagtgggtcgcgcgagccaccagcctggtcctgcaaaacttctccaaaggaggcctccccggcccggagatgcaggtgatgcgggctggcctgcccacattggcgcgcccggaggctgccaacctcatgcctgaggtcgggtggcctgagtggcaggatcatgctccgctcgtggtgcaaaggccagaccgcgagggtccttga

SEQ ID NO: 1287 - DNA, 1092 bp, Chlorella protothecoides
atggggtccctgcttgcgcccatcacagcgcgccaaatccttcgccctctccgacgacccgcgcaggagtacctgggccaggcgggggtccccgccttctgtcggggctcggccaagctggctttcggagaggacagccccgtgctgaaggagggcaggaacgccaccgtgcagggcctctccggcaccggctccctcagggtcggtgcggagttccttgcgggcttctaccccggcgtgaagcaggtgctgatccccaacccctcatgggcgaaccacaaggccatcttcgaggccgcggggctgcagactgcgcagtaccggtactacaagcccgccacgcgcgggctggactacgagggcctgctggaggacctgggcgccgcgccgcgcggcgcagtggtgctcctgcacgcctgcgcgcacaaccccacgggcgtggacccgacgcgcgagcagtgggccggcatcctggacgccgtaagggaccgcggcctgctccccttcttcgactccgcataccagggctttgcgagcggcgacctggacggggacgccgcctccatccgcatgtttgccgaggcggggctggagctgctgctggcgcagtcctttgccaagaacatgggcctgtacggcgagcgcgccggagcgctgacggtggtctccgccgacgccgacacctctgcccgagtggagagccagctcaagagggtcatccgcgccatgtactccaacccgccgcgccacggcgccgagatcgtggcggccatcctgtccgaccccgagctctacgcactctggaaggcggagctgaagggcatggccgaccgcatcatctccatgcgcgagcacctgcatgccgcgctgagggagcggggcacgcccggaacctgggaccacatccaggaccagatcggcatgttctcctacaccggcctgacgcggcgccaggtggcggactgcctcaccgccaagcaccacgtctacatgaccctggatggccgcatctccatggcggggctgtcgccggagtcgtgcaagtacctcgcggccgccatcgacgacgcggtgcgcaactacgccgactga

SEQ ID NO: 1288 - DNA, 1164 bp, Chlorella protothecoides
atgcagtggcaagggggggccctgctgcgctcatccctgccacccccccgcacccctctcccctcccctcctacaccccattcccaccaggtcctgggtgccctggcggcccaggtggcggccgaggaggagtcggcggcgccgctggcctcggcgggggagtgcgtgtccagcacccacctctgcgacagcagcatctgcagcccggtcggcgacacgctgtcggcggtgctcggcgacaccctgctgggcctggtgctgaccatcgcggccacgctgccctccctccacgtccacatcgccgccggcacccacaccgccgacctctcctgcttcgtggagattattcccccgacgctcccctggatgatggagagcaccaccaggatgggcaacaacagcttgtcccctttccccatccagtcgctggcgctggcctgcgaggcggtgggctggcccgaggtcgcctgcgcctacatggccgtggcgcaggcgctgcaggacccgacgtcacgcgacgtgtcctgggcgccggcgctggtgcgcatcgtggcgctccgcgccttccccgcccacggacgctgggtgctgcagcgctttgtggagaccgtggagcgggggagcgaggaataccaggcggcgggcctgctcatcctcagggccctctttgaggtggaggagctggacctgggatccagcttcggggaggcggaccaggcccgcttcgctggcgtggaggagctggacctggggtccagcttcggtgaggcggaccaggcccgcttcgctggcgtgctgtcccccttcatctgcacctccttgggatgctgggccctgcacgtcatgaaggccgcggcaagggtcgactggatggagggtaggaggggtgggagggatacagaccgcgatgacagcggcgtgtgcctcgtggctcgcctgccacgtccctcctcaaaggtcacatccaccatcctcgtgacagcgcgggcggcgcctgcgcagcagcaggatcaggacggccccggggtcgtgctgggctggccccactccatcgacgagctgggcacctccaacaagctgtgcagccagagcctggagcgctttgtcacggcctgcgcaggcatggaccggaacgcgatgcaggtgctccccttcatcaagtaa

SEQ ID NO: 1289 - DNA, 603 bp, Chlorella protothecoides
atggcgacggcgggggtgtccctgctggagaaaaagcgggagtatgtgctggccatcgagcgcctccagcagctgctaggtgggacgccacggaagggaaggggtggaactaccaagaggagtggagtgcatccccactcgccacaccaaggcgcccacctcacacccctgcatcctctcgtttcaggcggcgtgtactgcgggacgagacggggcgactggtggatccggctgtccatcaacctcgagcacctggggagggtgggagaggcgctggagatggcggaggccggcctggccgacgactggctgagccacggcgaccgcctggccctgcagcgccgcgtcctgcgcctgggtgggtgctcggtctgtgatgggcggggggtattcaggatgccacaagaatgggaatgggagtctgggaagctgggaatgcgcgtgcagcgccgccaagccgccccggcgctggaagaggcctgcctgggcggggagcgtggcgctggagcccagggaggtcaggatcgtgcagcgacccatggccagcatcgtcgggttcaagagcagattcatgggcctgaacggcgagccgtgtacggttga

SEQ ID NO: 1290 - DNA, 645 bp, Chlorella protothecoides
  modified_base (398)..(407): a, c, t, g, unknown or other
atgaccgagacccagacgctggccgcccagcacccctacacccagacccccagtgcgagccagatggggcagtgggcctcctgcttctgcatcggagccgtgctgggcctcttctgcgtgaaccctgacgcaggggactacggagcttgggaggcacaggctcatgccctcattcaacgatttggggctgcctttgcagctcagggctgcaccctgaccttggaaagaactaggtgggtggtcaggatattggaggcccggaactcatactccatctctgtctcctatgatggatttgctgctaccacactgatcgcaaagaggtttccatgctcccttggtgaggagcgatattcgcagccctatgtccttgagagagccttgcatcgatcccagannnnnnnnnncacactgatcgcaaagaggtttccatgctcacttggtgaggtcctggtggagtatcatcatctccggccttttgtcaccatggggggtgaagctgctcaagttgcgggtttggaaattgtgctggtgggaccgaattttacagacttgccacgcaagcctccgagagacaatggtcagcaccgcaacccggcacgcccatctaatttgattgtgcaggccatcggcattgccctctga

SEQ ID NO: 1291 - DNA, 609 bp, Chlorella protothecoides
  modified_base (115)..(124): a, c, t, g, unknown or other
  modified_base (593)..(602): a, c, t, g, unknown or other
atgcagtctgtgatccaggctgccgtagagcagcaggtgctgcgagcagcagaagagatggagacagcactagacgcgcagcttcatgccatggacaacctagatcccgatgatnnnnnnnnnnccatgcagtctgtgatccaggctgccatagagcagcaggtgctgcgtgcagcagaggagatggagacagcgctagacgcgcagctccatgccatggacaacctagatcccgatgatattgaggctcttcgccaacgccgcgtacaagaaatgaaaagtacaaggcagcttggtcccatcagagcgcgcggtgtgcatctcgtgctcaaagtggcatatgatgctgggtatcctgccacttcgctatgttgtgctccccacaggcttcaacaaaggaaggcagagtgggctgcacggggccatggagaggtgcaggaagtggaggagaaggagtttttcaaggtgaggaaggtccagagtatgatcagggactactgctgcattctgactgagcttcattgccagcatggcggctttctcctgctcatgagcgacttgaaggctgcggcctccgtgcttgctcagggggnnnnnnnnnncgactga

SEQ ID NO: 1292 - DNA, 300 bp, Chlorella protothecoides
atgtgggagctgggccccaagcactcggcactgctggtgtttgcagagcaccggtactatggcgagagcaagcccttcaagaagaggacgcggcacagcatgcactggctgacaaccgagcaggccatggccgactatgcggagctgatctgggaactgaggaccgagctgggcgatgtggacgcccccgtcgtgggatttggggggtcctacggcggcatgcttgcggcctggttccgcatgaaatatccgcacctcctggacggggccattgccggatcagcccccatctggacgtga

SEQ ID NO: 1293 - DNA, 846 bp, Chlorella protothecoides
atggcttcctacggcacttccggcactcatgacgtcaaggagaccgtgcggcgcgcggaggtggtgaagaccaccaaactcgagcccaccgtgccggccccgccccgcccaagtgagcgcgaggtggatctgaatggcgtgcttgtcccagggggatctgaccaggccagggtgctcccacgccgctcactcaggcctaaattcctttttgaatgtaccacaggcggcgatggcagcgtccccaacaacagggaggagtggaaggatctgctcgcccgcgccgcgccctggctgatcgccgccgccgtcgtggccctgggtgccggcgccctgaacaaggccgaggaggaggagggctccgtcggcctctggggcaggaagaagggtcgccaggctggcgacgccgcgcgcgatgccaagaattccgccaagcgcggttggttcgggctgaagcgcgaggccggcggcgcaggcgaggacgccaagggcaagtggcaggacaccaaggccaccgccaaggacaagtggcaggacaccaaggccgcggccaaggacaaggcggggcaggccaaggacggcgcctccaatgctggctcctacgtggcggacaaggccgccgacctggccgaggcctccaagcaggcggcactccgggccgagcacactgtggccaaggccgggagcaagctgggcgccgccgccagcggggccgaggagactaccgggcgcgcgctcaaggatgcggggagcaagctggagagggatggcagtgagggacggcgtcagtacaagggtgacgccatcaagcatgacctccagagcaagccctggtggcagttctggtga

SEQ ID NO: 1294 - DNA, 318 bp, Chlorella protothecoides
atgctgaacggcgacggcgagcttcctgcgtaccccgtgcgggtggcctgtcagcacctggcggatccacagctgcccaaagacccccaggcgctgttgaggggcctgggtcttgcatccggcgtgttctacaaccactctggcaacctgccgtgcttcgactgggaacaggtgggctgtgttgggtgggattggttggggagcggaccttttgcaatgatgcctgcagccagcatctgtgctcccagccaacactgtgatgggctcgccctccccctcggctcagcagtccaccactctccctggaccccacaataa

SEQ ID NO: 1295 - DNA, 891 bp, Chlorella protothecoides
atgcaggggggcgacatctatgtgtcaagagcgccggggcgcctggatgtgatggggggcatcgccgactacagtgggtccctggtgctgcagcttcccctgcgccaggcctgccatgtcgcactgcagcggcaggcatccgcgccgggggagggcgagcccatgctgcgcatcgtcagcctgggcgccagggacgggcagcgggcgtgccgcttcgagatgcccatgcgcctgttggtgagcgggcaggcaaatgtgggagtaggggctgagaggctgcactctggttcgatcacagccaggctgggacagcctcggcacagagcacccccgcaatcacctccaggccgcttacactgctgccccccggggcccaaccctccctcacagggcacgacggagcagccgctggacctgcaggcggcccgcgctctcctgacacgcgaccccgccacctcctgggcagcctacgtggtgggggtggtgctggtgctggcgcacgaggcccccgagtccagcccgctggccggcggtgccgggctggccgtgctcatcgagtccgacgtgccggagggtcggggcgtgagtagctcggcggcggtggaggtggcggccatgtccgcgctggccgcggccttcggtgccacacgcctggccagcgacggcgcggcgctggcgctggcgtgccagcgcgcggagaaccgggtggtgggcgcgccctgtggcgtcatggaccagatggcctcggcgctggggagagagggcgccctcatggctctgctgtgccagccctgccagttccagggcaccgtggaggtcccggaacacgtcagcctcattggcatcagctcgggtggggatggtggggatgggggagtgctgggtgtgtga

SEQ ID NO: 1296 - DNA, 513 bp, Chlorella protothecoides
atggtcacgcagcaacgctggttcgaggcccacttccgcctggccgccgaggtccagctgcccatgttcctgcacctgcgggccgccgcacctgctttcctcgacaccctcgccaggcagccaggtggtgggctggggaaatggggagaagggggctttgggggggggagggatggcagcgctgtctcctcagggacaaatggccatgctatcgagggtctggacaaggggatgggtgtctgtgaagcagctgccgggaggggtggcggtggctcacaaggagctttacttcaacgctcctcgtcacctgttgcagcgggtgctctgcggggcgtggtgcactctttcgatgggacgctggaggaggcccacaaagtgctgtcctacccgggcctcttcataggacttaacgggtgcagcctgaagacaggcaagtgcctgaggctgggtgtgggggcatggttgcagggccgtgggagtggggcatacatggtcttgggaagcggactatag

SEQ ID NO: 1297 - DNA, 276 bp, Chlorella protothecoides
atgcgacaaggatggcctgtaacgcctcatgcccctgtccagcacccagcagcccctcgctacccctcttgttccccagcacatgttcacgtccagaccaggctccaggtcagggacaagaagaagtgggacccagacgcagcgatcaagtcgaggaacgagcccgccaaccttcgtcaggtcctggaggcagtggcgggggcacgcgggatggaggctggcgccctggcagcccaggtgcatgcaaatgccctcgccctgttcttctccggctga

SEQ ID NO: 1298 - DNA, 783 bp, Chlorella protothecoides
atggggctcaagctggtgcagcaggcgtgcgagggccgggggctgccgcagccccggtgcctggcgcaggtgagccccgaggcgtgggacgccgggctgggcgcgctctgcccggcagagctgagcggcgcggagttcctgcgcgcccacggcgagcatctggacgacgtgacggaggtggaccccctcgagacctacgccgtgcgcatgcccgccgagcacgccgtgcgcgagcacggcagggtgtgcgagtttgcgcgcctgctggcggcggagcccaccgaggaccggctggagcggctgggggagctgatgctggccagccacgccagctacggcgcctgcggcctgggcagccccggcacggaccggctcgtggagctggtgcgggaggagcggcggcgcgtggcgcgcagggggcagcgccaggtgctgcacggcgccaagatcacgggcgggggcagcggcggcaccgtctgcgtcctggccagcggtggggaggagggcgtgatggcggcgcggagggtggctgacctgtacaggatggagaggctcggacgtggaatggagtccgatttcggggcgggcatcgggaatggtgtcggaggggcgcctttgacgggcaaggagcaggacggggcggcagcgccgcccacgcaatgcagcatcctcccggaggaggcccgccccggtgcagctttcctgggcagctcgaatggagccctggagtttggggtggtgagactgaggctgcccagggcgccaagtgctcggcgagggtga

SEQ ID NO: 1299 - DNA, 930 bp, Chlorella protothecoides
atgggcctgcacagcgtacccggggggggccgcgacgccttgcccccggcggaggtcatgcgcagcgtggaccccgacgagctggaccgcatcttcgtgcacagcagccgcctgaacaggtggcgggggtggttgggacctgtggacgtgcctgcgtcgtgcacgaccggcactcgctctcctggccacccccactgccgatcccgcgtccatgctcagccccctgtgtcgtgcccccaccatcccccatccaccgcacccgcaccgactccatcccggacccgaccccgcagcgacgccatcgtggagtttgtgaccacgctctgcacgattgcccgtgaggagctgcgccccgtggacgcgccccgcgtcttctcgctcaccaagatcgtggagatcgcggcgcacaacatggaccgtatccgactggtctgggcccgcatctgggccgtgctctccgacttcttcgtggaggtgggctgcgcccccaacctccaggtggccatgtacggcgtggactccctgcgccagctggccaccaagttcctggagcgcgacgagctggccaactacaccttccagtccgacttcctgcggcccttctgcgtcgtcatgcgccgctccaaggccccggagatccgcgagctggtcatcaggtgcgcggccggaccggggcgtgggtgtcggggaggggaggtgcgggctcatgcgatggagacccagggcgcgcccggggcgcggggcggtccagcgggtgtctgggtgggtggtgcgacgactcgagcgctgcaggtggtggagtgcaggggatcacaggccgttgcgcctgtcggggggtacagccgtcggcagggacccgaggtgctgagctgcggggctcagctccccagccgcggccggagcttgccgcgtgaccgccgtttgccgtga

SEQ ID NO: 1300 - DNA, 246 bp, Chlorella protothecoides
atggtgctggcccgggtggccaacgtcaagtcggggtggaagagcgtcttcatggtcttcaccaccgccgcggcggacgagtccccccagatcgtgcgcctggcctttgacaccgtggagaagatcgtgcgggagcactttcactacatcaccggtcagtggatgggccggaagggtttgggagggtggtggagcgtgcggcgtggcgtccccctcccatgtgatgcagcatgtgtcacccgctga

SEQ ID NO: 1301 - DNA, 1011 bp, Chlorella protothecoides
atgctccatcccccccgccaaacctcctccccctccattctccgcttcacagagacagaggccgcgaccttcaccgactgcgtcaactgcctcatcgcctacaccaacaatccccactctctggacgtggccctgaactccatcgccttcctccgcttctgcgcactgcagctggccgccggcggcatcggcgacgtggagaagctgccggagggggccgtggcccgaacctcctccgccgccttccgcatccggccccgcggcgacgccgcggccggcgatgtgacgagcgcggcggcggcggcggcgacgagtctgtcggcggcgacgagcgcgtcgaaggcgtcgaccaccgcacccggcgacgtggcgcactccaaccacacaaccagcgccacagtcggttcgctgcgctttacggacaaggagcagcacatgtactactggttccccctcctggcgggcctgtcggagctgaccttcgacccgcgaccccaggtccgcaccagtgccctggacgtgctgttcgacacgctgcgcttccacggcggctccttcacccccgccttctggctgcgcgtgttcgactcggtcctgctccccatcttcgacgtggtgcgcgccgagatcaccgacaccaccaccttcaccgacgagcggcggcgcgcggaggcggaccgctggctgtacgccacctgcacgcgcacgctgcagtacatcgtcgacctggtggcgcagtaccacgcgggcgtggagccgctgctggcccgcctcctgcacctgctgctgggcttcgccacgcgcccgcacgccgagctggcggcggtgggcgtggccgcgctgtcccgcctgaccctggccctggcgccgcggctggacgagcccggctggcgcgcgctgctggacgcctacgccgaggcggcgcgcgagacgctgccggacgtggcggggctgatgcagcgccgctccgcgcgcttcaagaaggacgacgcggaggggcgcgtcggcgcg

SEQ ID NO: 1302 - DNA, 840 bp, Chlorella protothecoides
  modified_base (122)..(131): a, c, t, g, unknown or other
atggcatcggttttcgatctcggagattgcgcactcgggataactcgtcaggagatgggcgccctgaggcggattgaggcagaggagcacgcaaaggtgttgcatgcttgtatctcatcacnnnnnnnnnnctcgcgggctggactttgctcatgggtaccgctccctgcccagcttgaaagcccgactgctgcgctccatcgctggctcgtcatgggctcgctcccgcagcctgtcctcaccgccagacccactttgggcatctgcatacgccgatacaacctcgaaagagtttgcaggtatggcttgagcttgaggcggattcgctcaagcgacctaacccattttccttttctgcatgctcatgttgaaggtgcgcgagtcggggccatgatccccgacaccttcactcgccatcgcagaccagggcggtggtgcccttcccagctgccccagaggcccaccacctgcgcttcagtgggcgtgcatggcctgagcggggcggccgaggacctggcagctgcggccacgtctcgcgcggtggcgcaggacaacggcctgctggagcccctggtgcagggcctggagtacctgttgcagaccttccagtctgggctggaggccgcgcacgtcccccactccttcggctggtccattgtcgccctgaccgccgtcgtcaagctgtgcacctttcccctgaccaagaagcaggtgattatttgctgggttgtgtgttgggggggatgggtggagccaggggatcaggtgtatcgtagcgatctcaggtctcctgcacatgggaatggaagacgaagggctgtgaggcttctggggaagtga

SEQ ID NO: 1303 - DNA, 1002 bp, Chlorella protothecoides
  modified_base (271)..(280): a, c, t, g, unknown or other
atgagggggtccagcattcccgctggggtgcaggcggggtgcctacccccggccacccgcccgatccccaaatcttcacggcgcagccacaccccgaggcctttccgcaacagatatacgtgtagggcagccctcggcgcctttggggtggctgagctcgagagtcctttggccgccctctcggctttggggctggcagtggcagggtgggatgggggtggaaagggtgcgatggatgtggtgcaatgtcctgacactgttcctccttgtnnnnnnnnnnggaaagcactcttgtcctgttataattccaagtgcaatgcccaatgggctttcctgctcttcaggcaatgtcctgacactgttcctccttgtttaacgcctctgcgcagcgtctccgctctgaagcttgtggcgcacctcaaatccgaagccgagatagccaggctgattgccaaggtccataaagtggggaatgatgaatctggacggcctggtcacctggtgcagatcggaggcaatgtccgcagcctctactactaccccagcaaagcttatgccgccatgactgttgttggcaagggcctggacccgggcatttggacgacaacggctgcaaagaataagctgccactcaaggtcgagagccaggcctctgaggtgcctgacctcagcttcctgccagcatccagcatcgacagcgtggtgctgctgccaggctgtgcacccactcccgagctcgtcgcccagattctgagggcgctgaagccagggggtcgtctgggcttggcccttagggccaaagggaagggtcccattccctctctcctccaggcacttcctctgggacctgggcccctcgaagcagacgagctggagcgctactttccggacactcagtgggaattcatggaggcagggaccgcgaatgcgggactggaccccctggttgtcgcactggcctccaaatccatgcaggtgggcagtgcgcctgaggcgctgtga

SEQ ID NO: 1304 - DNA, 477 bp, Chlorella protothecoides
  modified_base (379)..(388): a, c, t, g, unknown or other
atgttcttgtacccacccctccccctcccatccaccccctgcacacagtccttcatgcacggtcggggctgcggcatgcaggagcaggtgttggagctgctgcgcatcctgctggaccccgacaccatggatgcgtccgtggagcgcgacgccttcatcgactccttctatgaggcgcacgcggggaccctggtgggcgccctggtcgccgcgacgaggggcggcggcgtggcggcagagagcgcaggtgctggcgcggcgggcgcgggcggggaggtggccgggggtgccgccggcgcgcctgacaccgccgcaggggcggccgacaccggcgacgcgccgacgactagcgcacacacgctgggactgatcgtggagnnnnnnnnnnggggggtgccgccggcgcgcccgacgccgccgcaggggcggccgacgccggcgacgcgccgacgaccagcgcacacacgctgggactga

SEQ ID NO: 1305 - DNA, 3024 bp, Chlorella protothecoides
  modified_base (214)..(223): a, c, t, g, unknown or other
atggtcaggtcagaggccgtcacctggggatggagcaggctcgcacgccgtacacggtgtgtgcactggcatgggtcgggaaccagcattgaatgggtgatgcgtcggtgctcgataatcgagtctgggaccccctcctgcatggggtgtgcggggggccgtagtcagggtgcaagccatgctggggaggcgattgacacaaagagtagggagnnnnnnnnnnctgggggaacaggactggcatggaggcggtcatcgaaagggtgcaaagcccttcccagatccctgatcagcccccacctcaatggcctcgcaggtgctccggctgctgcacaggaaggaacgctggctggtcgtggctgccatccgcttcctacgcacctgcctgggaatgaaggtgcaggcgtggggtgggatggagggcaaggggtgactgccaaacagggttgtcccccccaagcaccacctcggccctccctcgcccctcaggacgagttttacaaccggtacctggtgaaaaacgggttgctggaacctatcatcgctgtgttcctggaaaacggcaatcggtacaacctgctcaactctgtggtgctggagctctttgagttcatgtggagggtgagtggaccttgctgtgtcgggtgcatggtagcctgctgcgtgggtgtgagtatgcctggtgcacgacaaggtctcacctgcctgatcggggagaggttgacagagggtgagggatgctgtgcttcaggtccagcagcgtccatccacttggttgacacgaatccatgtggggtttggcaagccctgaggggcaggcactgccggggtgagggatgctgtgcttcaggtccagcagcgtgcatccacgtggttgacacgaatccacgtggggtttggcgagccctgaggggcaggcactgccgtgcgcccagatctgatcccccctgtgtatcgccgaggcctcttcacccaagaaacttcctcccttcttcccattcccaacaggagaacatgaagggcctgctggggtacgtggtggagagcccgaggtggccagagctccaggccctggactttgcgcccacattcaggaggctgtcgatgaagcatgaccagaaccaggtggtgtgccgcctggggcaggaggtcttgtgtacctgggctgcctgtcccatccctggctgtgtatgggctttgagccttggtcattgctcgaagaaactcaccttcgtaacctcacaccaacaggaacggagcaccggctctgcggctgcgccagcggggtcgggccctggcagcgaggccggggggggagtgttccttgggcatgcccgggcagcagccgccgctcagcagcggcgaatacgactgacatctgtgccgcaggtgatccttggtcccaacagccgcatgttgatgtggtcgattggccttggcaggtcaagcctggcgtgttcctccaggcaatcctctcctcacacgctcccatcgacaacaggcggcgaaaaggaggaggacgaggacgaggagaactacttcaaggatgacgaggacgatgaccgggggggcagtgccgctgctgcagaagtctccgaggtgagagcgctcagggatgcgccggcctccgtctcgcccagccctggctctccgagggtggttggcgcttcccctcccagcaacggtctgccaccctttcccggccgcctggtggactatgacgacgatgacgacgatgccctgcctctgggaggtgagcgccatgcatgcgactgcctgtgtgatgcaggagccctaatgcagcacagcatccgcaaatatctgtaccatggtcctccctgccccgtcccccatagttgtgcaccgaggtgggcccggtggaaggcgcggctcatcgcccccgcttcagaagaggttccggccggccagcccctcccagtgacacccaaaccaagcttcctgaccacgcacaacgtgtcccctgcattgtttctggctcctcccgtctcatgctcttcgcccctgaacagctccacgctctgtgaacgacgagccggaaggcaggtccgtactgcagcccgctctcccgcagctgggcgtagagctggacagtgtcgcggggcaccgtggcactcgccctctgggcatcgatggtccgctccgccatcgtacggttcagacgctcctgacgcttcttctccgtctacaggggcgcgatggcatgatcgtcgttgccgagcacgacctcggcaacctccggctccttctcaatggcctctagtttcgcggggtcggccttcagagctgcacggaaagctgcggggtccttggcagtcccatcgtcgttcaacgcatagggatccgacatcctgtgctgcagtacaggatgcactggaggggtggaatgaaggaggacgtactgactgtgatccacctgccaatgacgctcgcggagtggagttgcacggtgcaagggctcctgcccgaagcgcatcccgtgagcggtccagcttgcacccttcatgcctatctgccaccgctcttgtcatgcagcaagacatactcgcggctggagttccccgtccggatcatgtcctgctccagaagctcatagaagcgcttgtcatccaggcgctcgccattcagaaatgtgccgttggtggaccccaggtccatgagataggggcgcaccgcagccaccatcatgccatcagcgccctccttctccgttcgcctggtgatcgtggtcatggaggctttgtaaggaattatgttgaggatcgcgacatgccacccgtcatgaagcggagtccatccacagggattcaccctcctgtctcccgttcatgtatctggcttggaaatgattcaagagcagcccttacatcggccctggatccacacggtgcaccatgcagcaaaaacctatcccttcacctgtactgcagcacacagtgctgcttggagcaggaagggtggtcggtgggaatgtcgaccaccgtcctgtcacgtccaaagaggtag

SEQ ID NO: 1306 - DNA, 1389 bp, Chlorella protothecoides
atgcagagtgccatgtgccgtgcgatcgcacggctcaccccagtctggacagccatgtggtctgggagtggcaaatgcgtggagttgtgcgtcgcacataactctatctacctcatccttgcaccgccaatgccaggcatgagcggcgctgagctgatgaacgtggtgaacgaggcggcgtttctggctgcgcgccgggatgccgatgcagtggacttgccggagctggtggcggctgtggataggacaagaaccgcatcagaattgccttccccaatcgcccctgcacaggaatggagtcaatggcggtgctgccacgcctctgtcggtgctgggatctcgattgtcgaggggcatccagcggttgatcggcggcggaccagacgccgccccagccctgccggcaggccggtcagggcagctgaccaccaggtggacagactcctcagaccaagctccggacacagggccgtgcgcgacagtggagaggcatgtggggtggcgatcctgacatgcacacgtctcaacgtgtcgaaactagatgataatatcgttgcaatacttcacgaagtccttggcgccgacgaaggagcaggtcccgagaggccaggcgacgcagtcgctcccccccccccggagatcgcagcagatcgcgggacaggagacgtcacagggactcatcggacaagaggcggcccagtcgctctccagtacggcgccagtggcaggaggggagcaggtcgcctgacagagcagggggcagcagggaggggcggtggggtccgcacccctcacagcctcgagacaggcggcggcgggacgacgcagacattgcagggtccagtcaccagagcggctcctttgctcccagaggggcctgccatagatgcggggaggaaggacactgggccagagagtgtcccagcgcgccgccggggggtgccagaggccgtgggcggcgggaaggcggtgagggcgacgggaatggcatgtcctggggcaggccaggggagattcaggtatgctacagagcgaaagttccgaggttgctttgggtctcacgaatgcagaggagctgccagacaaggaagtgaagccggatttcgggcggatcccgctgagttgctgcattgcgccatgttggcagtgattgggcattgctccgccttgcaccccgttgggcgcatccctgattcccttccacccatgaccaactccacagcggtgtggtactactctatcaggagccacctgaggcctcgatgcccacacaacagtggaggctatacaccttcaagagcggggagccacatgggaagcccctctttcttcacaggtgtggttgcatcgcatgctgctggtggctgtccggctggggcggcatcgtga

SEQ ID NO: 1307 - DNA, 747 bp, Chlorella protothecoides
atgctcggcgccactgtactctctggcgcagtgcgcaccctgcaaggaaggctcttggaaaggtggcaggctcctagatctggggaagcatgcttggcgccactgtactctgtgacgcagtgcgcaccctgcaaggaaggctctggtgtggaggttgtttttgcgctcatgccatgcaccagtcccactgccacctgtccaccgctcccacctgatgatctcactctaggtgtggagcgtaggatgcgtcatggcagagcttttgcttggctcgccccttttccctggagagagcggtgtcgaccaactcgtcgaaatcatcaaggtgggaggggaggggagcaccgagctaccctggctgacgtgggagcccacccgtgtcacattgtggcagatgtacatgctgcaaactgcccaacgaaaggctctctgccgcatgagagatcactgcgccgaccagcatttgcggagggggcgtgtttggtgctccagccatggcgccattctatggagcgtgaaggatggtggctcgtactggggacacccacacgggaagagatccatgcgatgaacccaaactacaccgagttcaagttcccacaagtaggttggcggggtgatcggatggtcttgacacggagcaggatgcagtgtgctgtgtcgcacggtacatcatgtcatgctgggcccctgtgcacatgttgggcgacggttccgctgctgtgtgcaagagctggtggtagttag

SEQ ID NO: 1308 - DNA, 474 bp, Chlorella protothecoides
atgccgctcattctggtgaagctgtacacatatcagatgctgcgagccctggggtacatccactccatgggagtgtgtcacaggtactgggtggggggtgggtggcacagggagttccgcgaacagtgttgttttatcgaaggcttggttcagtcgccggctggatgtactggagattccagcgtcacagactgtcatcgccgtcacacccagccctcacctttcaatgtgtccctgacctctctgaccagggacatcaagccacagaacttgttggtgaatgtatccacgcacgccctcaagctgtgcgactttgggagcgccaagacgctggtcaggggcgagcccaacatctcctacatctgctcgcgctactaccgggcgccggagctcatcttcggggccacagactacacctgtgcaatcgatgtgaggatcggtgatgcgcaccggggtggggagggtgactgttga

SEQ ID NO: 1309 - DNA, 507 bp, Chlorella protothecoides
atgcgcttcgggcaggagcccttgcaccgtgcaactccactccgcgagcgtcattggcaggtggatcacagtcagtacgtcctccttcattccacccctccagtgcatcctgtactgcagcacaggatgtcggatccctatgcgttgaacgacgatgggactgccaaggaccccgcagctttccgtgcagctctgaaggccgaccccgcgaaactagaggccattgagaaggagccggaggttgccgaggtcgtgctcggcaacgacgatcatgccttccaggaacttatcaagtcggtctaccatgtgagtgccgggacggagaagaagcgtcaggagcgtctgaaccgtacgatggcggagcggaccatcgatgcccagagggcgagtgccacggtgccccgcgacactgtccagctctacgcccagctgcgggagagcgggctgcagtacggacctgccttccggctcctgcgcaacgtgcatgtgcccgacattgctgcctga

SEQ ID NO: 1310 - DNA, 423 bp, Chlorella protothecoides
atgagctacatcattccccgggtctggcgccaattattcccgacagcagtatctgacatcacatgctcctggccctcatgccgcaatgcagcaagggccgtggcgggggaggcgggcgtgcccttcttcgtggtctctgcctccgagttcgtggagctgtttgtgggacgaggggcggcacgcatcagggaactgttctccgaggcacggaagaaggcgccctgcgtcgtgttcattgacgagctggatgctgtgggtgagttgtggggctggtgttggcgcatggcgactgcctgcgggaggcctggctcgcctgggatgcccaatgagcgggcaggccacggctcgtgcgtgattcccccgtttgtgcacccaccacatggaacactactgccacaggtgggcggcgcggcatgggcatga

SEQ ID NO: 1311 - DNA, 501 bp, Chlorella protothecoides
atgcagcgcctgaagccggccatggacgccatcaaggccaagtacaaggaggacaagaaggcgcagcagcgtgagacccaggccctgtataagaaggcggagatcaacccgctggcggggtgcttcccctccttggccaccatcccggttttcatcgggctgtaccgctcgctgacgggggtggcctcgctgggcctgctggacaaccagggtttctactgggtgccctccctggcggggcccacctccgttgcggcgcagagggcagggctgaaggcctgcgctgaaagggttgggagtccatgcccctgcacaggaccaggggcgtgggatacaggaggggtctgggctgcggggtacaggagcccggcgtgttgtcccccccctcctccctctctgaccctggcctccaccatccgtctctttccactcgcctgcaggcacggggatcagctggctctacccgtttgtggatgggcacccgcccatcggctgggatga

SEQ ID NO: 1312 - DNA, 402 bp, Chlorella protothecoides
atggttggctactttgcgctgtgcgtgccctccggcctgtccctgtactacctgtccaacacggtgctgacctccggccagcagatcttcctgcgcaagctgggcggcgcgcgcctgaccgagctggacctgggcccgctggagctgggcacggcgcggcgctctggtactgcagcggtactggacctggcgggcatggcccaggacacacaccactccgccgacgggtcgggggtgctgcaggccgtgggggccgcggccgacgcgttcaacgtcatggaggacgcctcgccccagctcatcgccgcgctgagcgaggaggaggaggaaagggaggcgcgggcagaggcggcgccggcgctgaacaggcggtgcaagcgcaggcgcttgcccgtcgcgtga

SEQ ID NO: 1313 - DNA, 225 bp, Chlorella protothecoides
atgaccacgatcaccaggcgaacggagaaggagggcgctgatggcatgatggtggctgcggtgcgcccctatctcatggacctggggtccaccaacggcacatttctgaatggcgagcgcctggatgacaagcgcttctatgagcttctggagcaggacatgatccggacggggaactccagccgcgagtatgtcttgctgcatgacaagagcggtggcagatag

SEQ ID NO: 1314 - DNA, 948 bp, Chlorella protothecoides
atgcagcgcgtcagggtgtaccacttgaatgaaaatggacactgggacgacaagggcacgggcgtcatcaaggtggagacagcagaggtgcgacatgcgctggggatccgatgtcgtgctccatcggctggcgaccagggtgatggttcatcggtgtgcaccttgaagctcgtctgtacgagtgcctctccccggcctcatcatcgaccaatgctccccccgcagcaccccacttccgatgtgcacctcatcatcgaggacgacaccgatgcatcccgcctgctcaaccacaccgtcacccagggcacctcctaccagcgacagaagggtgcgcattttgggatgtatggtcgcgcagggagatcagagggctgcaggcatgcgcgtcgaccccctgtgcatctctgcatgtggcttggatgctgcgacagggggcaatgtgactgtgggtggcacacatccgtgcaaacactatttgttcgcgcagcgtttgcatcctacaagcagctgctccagcgtcgccccgcccctcgctccgcagacgacagcatcatctcctggacagaggcgtccagcggcatcgagatcgcgctttctttccaggaggccttcacctgcacgcaggtgtgggccgagatccagagcgtccaggacgcgggcctgagtcctcgagctcaggctgcaaaactgcaaggttcacgctgggtcctggtccgtccatggcctcatgcccgcccgcagcgacatggtcttgagccgtgtgggttgtttcgtatgagtgctgcatcagctggagacttgggcccgtcggcagggtggtgctgctgtgcacagtgcagcaccagccctgcccagcttcccccacattcgtctgtcgcaccgtgtgctgccctcgcattcccgagcagatcggcagtggcggacggctggggggacggaggcttatga

SEQ ID NO: 1315 - DNA, 762 bp, Chlorella protothecoides
atgcaggacggagactacgagcgcgctatcgagcttctgggcaacgccctgcaccagcgcacctccactcatggaggcgtggtgaaccagcgcagtcaatggctcatgctgcctgatccgcggatcccagatctgagcctggaggcagctgcagtctacttccagcttggccgggccctgctcttccaggcccaggacaccagcgacttcctgtccggcgagcgggctgaggctgctgctccaggcaccctgcccgcggatgacatgggcaaggcgtctgtgacaaaggaggaaactgtttctggcagcaaccaagatgccggtacgttttctcgtgtgaagcagcatgggcttgggctcgcaccaaacaacaggctccacccctggtcccctgctgtggctttggctgagtggctgcctccgatttttgcacccgccgtgcaggtgacgacggcaaggatggtgatcaaagcgaggaggaagaggaggacagtggggaggcttcagatctgcagctggcctgggagcatctggaggccgccaaagtcatctgggccaaggatggcgcaaggaacgcggagcgattggcaggtggaggggggatggacgggcggtcgggggcatggagccatcatctgggcccctgcacagctcccaagcctcacctcgcctccccatcccacggagctgcatcatgcctggtcgcttctgtccatcgacagaggtgcactccctgctcggggacgtgggcttggagaatga

SEQ ID NO: 1316 - DNA, 1218 bp, Chlorella protothecoides
  modified_base (213)..(222): a, c, t, g, unknown or other
  modified_base (575)..(584): a, c, t, g, unknown or other
  modified_base (1086)..(1095): a, c, t, g, unknown or other
gggagggcggggcggtcctggttggggcatttgggaccggcagagcacctcgtcactcggcaaggttggcggtggcaagtatacggcgcgctggggatcgccgcaggcccttcaagatatggagcgggggaggagggaccccagttcgtaccttttctcagatttggccaccctgatcctgtaccctcaccgcccccctccttcaccaccacnnnnnnnnnncgggggaggagggaccccagttcgtaccttctctcagctttggcccccctgatcctgtacccataccgcccccctccttcaccaccaacacctccaaagaccgccccggagatccagaggaccagcctggcaggggtggtgctctacctgaaatccctccccctcaacatcgacgtgctggggtttgagtacctggacccgccagcggtgcgaccatggcggcgggcatgtttggtgctcggagggcttggggaacttgtcgatgtgcaatccatcggcgtgacaatggtaaggagcactgaaggtactggcatcattccagtgttgggaggtgtgtgtgtgcgcaggggatnnnnnnnnnncgctcactccatctccccacagaggcccgccctggaagcagcgctgcgcagcctgtacgtgctggacgccatcgacggcgacggcgtcatcacaggggacggaggggtcacaaggtataaccctgccaagccaccaatcgcttgcggcgaggctttagccaagatcaggtgcgggcactctgatcgcacccagtccccgctggacacttgcacatccgaatcccctccaaacccactctctcatccagacatcgggcgccggatggcggccctgcccctcacgccgtccctctcccgcgcgctgctggcggcggaggacggcgggtgcctcggcgacatgctgagcgtggcaggcatgctgagcaccgagtccagcgtattcctgggtgggcgcgggcctcagcagctcctcgcaagcgatgctcccgggccggcgcccagcggcaggccgcccagccggcccggggccggggctccaggctcggcgccggcgccgctcgcnnnnnnnnnncgggcgccggatggcggccctgcccctcacaccgcacctctcccgcgcgctactggcggcggaggacggcgggtgcctcggcaacatgctgagcctggcaggcatgctgagcaccgagtccag

SEQ ID NO: 1317 - DNA, 735 bp, Chlorella protothecoides
  modified_base (445)..(604): a, c, t, g, unknown or other
gcggcggcgccacgcacgccgcggggcgctgcgctggccgcgcgctcctgaacggggcgggcggggtcggggatggggcctgcgcggccggcgacggcgcgcgtgaggacacgatgcacgatcgcatggacgccgacgcctctgctgacgaggcctcctcgtccggctccgactccgactccgagtccgagtttggtttccccactctccagcgccggcacacgctgcgctccttctccgcctacgccgactgggcgcgcgcgctgcacttctcgggcgcaggtactcgtgcgccctcggggcgaagcacgccggtcggggagggagcaccggggaccggcgcggcccccacggactgcgatgccgcccctgctcccaccgccgccgcacgctcctggcagcgccggccgcgggcgctggccggcccggccgcgggcacggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaggacgcggccctggagtccctgtacggccaggacctggacagcggcctgcacggctccggcttcccgctccccgcctggcgccgcgcgctgctggaggcggccctgcgcgcgcgcggcgcgtcggcg

SEQ ID NO: 1318 - DNA, 495 bp, Chlorella protothecoides
atgggcacattgtgggtggcgctgggcggcgccctgctgtacctggggtcggaggtgctgcatgatgccagctcacgcctggcctacctcgtcctcgccgtcgcctgcctcaccatggccgccttcaccacctacggcctggccgggcacctgcgccatgccccggccctcgccgccggcagcgacgacgacagcgactcggggcggcgcgcccgcgccccgccctccgcctggcgcttcttccagcccttccggggcggggcctggtttgtggcgacccaggccctgggctggggcctcttctcggcgggcctcaccctcatgctgtacctcattgcccaaggcgcagcgggtgtgatggagggcgcccggcgctacacctggacggcgggcgccatcatggtcaccgcccagctggtgagagatgttgggaaaggggggagagtgggaatgggggatgaggtcccttggcggccagggggggctccggaatga

SEQ ID NO: 1319 - DNA, 1518 bp, Chlorella protothecoides
  modified_base (225)..(234): a, c, t, g, unknown or other
atgcaggtgatcgtacctgggcgcttcatcaagtctgggaccccacggggtcgtccgacaccccctggacggaggatgaccgccgtccccacccccgcggttccccggctaaaggacaccatgactgaggcctatttcaatgagaggctggaggggcagggctggccccgcttcgatgccgagaaagcgaatgccgtggccagggaggcgtggcaggcgctgcannnnnnnnnntcaggttgttgggttgcggagggggtagtttcgacaaagttggctgggggacatgaatggcgccttctccgcaccattaatctcccccctggcccccaactcctacccccccagaaagcgaatgacgtggccagggaggcgtggcaggcgctgcagcacatctacgggctgggcgtgctggagaccccgctgctgcgctcgcccaacttggaggcggcgtgcaccgactgccgcgtgcacctgaagctggagagctcccaggccacgggcagcttcaagctgcgtggcgcgacccacgcgctggcttcgctgggcggcgctgggcgcgtggtcaccgcctccaccggcaaccatgcgctggcgacggtgcaggcggcgcgcgcgctggcgtcccgccctgaggcccccgccctggagcccgtcatcttcctgcccaacaccgtcaccccgggaaaggcgcggcgactggaggcgctgggagcgaccctgcgctacgcgggcgacgattgctgcgacaccgaggccgcggcgcgcgccgccgcggcggccgagcgctgcccctacgtcagcccctacaatgacctgcgtgtggccggtggccagggcacggtcgcgttcgaactgctcatggccttgccccgtctgcacgctgtgtacgttcccgtgggcggcggtggtctggtctccggcatcgcctccgtgctcaaagccgtggacccgtgcatcaaggtcatcggctgccagcccagcgcctcggccgtcatggccgcctcagtggaggccggccaattgctgcaggacgttatcagcatggagacgctctcgggagcgacggcaggtgcgtgctcaggagtggctaggggcgggacatgggagcgcaatggtggctggggtaccactatggtggcaggactcttgggcctcccgcctggccctgtgtactcccagcttgccacggccgccgtttcttcttcacctaaatgcggtgtagagcccggcagcctgaccttccctgtctgccgggatctggtggatgagtgggtccaggtcagcgaggaggagatcgcggcggccatggtggacctcgccagctggcacgcgctgagggtggagggcgcggcgggggtagcggtggccgccctcctacggcatgtcccggggctgagaggaaagagcgtcgccgtcgtgctcagcggcggcaacgtcagcgacgacctgatggaagaggcgcacgggattgcaaggcggagccgaggggccgcgccagctcagccgaggatctag

SEQ ID NO: 1320 - DNA, 1461 bp, Chlorella protothecoides
  modified_base (806)..(933): a, c, t, g, unknown or other
atgtgccacccggacgtcgacttcagccgcacggtgagcaacgacgtgatcgagatcctgcaggtgctgggcatcgaggcggcgcgcaatgcgctgctcaaggagttgcgcggcgtgatcgagttcgacggctcctacgtcaactaccgccacctgagctccctggtggactccatgacgcggcgcggctacttcatggccatcacgcggcacggcatcaaccgcgacgaaaccgggccccttcaccaggcctccttcgaggagacggtggagatcctgtgccgcgccgcggcgtacgcggaggccgacgacatggcgggcgtgtcggagaacatcatgctgggccagctctgccccgtgggcacgggggcctttggcctcatgctggacgaggccaagctggccgacgccatcgagctggactacgcctttgccgaggaggcggcctggggcggcgggctgaccccggggcgcacgccgctcatgaccccgggcagggcctcgccctccgcgctcatgtcaccctcccagagccccttccacgactccgtcctcttctccccggcgggtgacgtcatgttctccccaggaggggccagcccggggtacagggggatgggtctgctgagcgcgggagggatacaagggattgaaatgacgggcagggcaggggaccctggacagcatcagagcgtgatgggacgatgccctgaacctcccccccctcatccccctgtccacctcgcagccccaccagccccggctactcgcccaccagccccggctactcgcccacgagcccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctactcacccacaagtccagcctactcgtaagtcacgttgtcctgggtatgcctggttcacctcagcagtccgagaaggggggtctgatcatggatgcacatgatgctcctagggttttgaatcaacaacttatgtcatcaacactttgcaggcctacaagcccgcaatacagcccgaccagcccgcaatacagcccgaccagcccgcagtacagtccgaccagcccgcagtactccccaaccagcccgcagtacagcccaaccagccctcagtactcccccaccagcccgcagtactcccccaccagcccgcagtactcccccaccagcccgcagtatagtcccaccagcccgcagtatagtcccaccagcccgcaatactcccccaccagcccccagtatagccctggtggcaacggagacgcctcaaagctcaggggaggttggcctgtgcttcaacggtgtccttcctcataccacagccccagagctggcgaaggagtgaagaaggaggaactgcagtga

SEQ ID NO: 1321 - DNA, 873 bp, Chlorella protothecoides
  modified_base (139)..(148): a, c, t, g, unknown or other
atgcgggaatgggattcgatgggtctccgccttccctggatcccagctgcgcccccagcctgctcctcgaattcccatgctctggcacccgcaaatgtccagatccttgatctcacccgcctccctttgcatcacctgnnnnnnnnnntgatggtcaggtgcgtgtgtgtgcgtgtgtatgagtgtgtgggagagggaggaataaggatgccggcatggggttcgatgggtctccgccttccctggatccccgctgcgcccccagcctgctcctcaaattcccatgctctggccctcgcccatgtccagacccttggatctcacccgcctccctttgcatcacccccatccctcgccaggtacgacggcacggtgaggaatgcggtgggcgaggtgatccagttcctgtacggcgaggacggcatggagggcacggccatcgagagccagcgcatggacttcctgcgctacacgcccaagcgctttgccgccgccttcgcctacgacctggaccgcgcggcctgggcccctgactggctcgaccccggcgagctggaggcgctgcgcgccgacctggacgcgcgccaggcgctggacgccgagctggcgcagctggccgaggatcagcgcacgctgcagcgcgaggtcatgcgcggcggcgaggcggcctgcaacctccccgtcaacctcaagcgcctgatcgagaacgcgcagcgcaagtttgcctgtcggccctacaggccggggtccaccggtgggtggtctctggtgtgtgtggaggatgggggggttgaagcgcgacagggtctcgtcggtggcatccaccagaggcctgtgcagcacgagccccagggggggggcccacacatgtga

SEQ ID NO: 1322 - DNA, 813 bp, Chlorella protothecoides
  modified_base (304)..(313): a, c, t, g, unknown or other
  modified_base (440)..(449): a, c, t, g, unknown or other
  modified_base (671)..(717): a, c, t, g, unknown or other
atgaccatcatcaacgacattatggaacgggccaaggaggacgtcaagcgcctgatcggcaaggtgcagtccaacgatctggagcagcagccggggcgcagcatcatggagtccttcgagaaccaggtcaatcaggtgctgaacaaggcgcgcgacgacgcggggaaccaggcccagggctcactgcacgacaccaacaacgtcgtgcgcatggtgaccgcggggagcaagggctccttcatcaacatctcccaggtagagtggtgtgggtgtctctgtgcgtggcaagggggtgatggtttgnnnnnnnnnnaacatctcccaggtagagtggtgtgggtgtgtctgtgtgtggccagggggcgatggttcatgatccttgacactttagcctctgccatgctgacggtcgtgttttggatcgcatcttggatactcannnnnnnnnncactttagcctctgccatgctgacggtcgtattttggatcgcatcttggatactcacgtttacacaccagaacgtggagggcaagcgcatcccctttggcttctcccagcgcactctgccccactttaccaaggacgactttggccccgagtcgcgcggattcgtggagaactcctacctgcgcggcctgacgccgcaggagttcttcttccacgccatggnnnnnnnnnnnnnnnnnnnnnnnnnnnnnnnnnnnnnnnnnnnnnnngaagaccgccagcacgggttacatccagcgccgcctggtgaaggccatggaggacctgatggtcaggtgcgtgtgtgtgcgtgtgtgtgtgtgtga

SEQ ID NO: 1323 - DNA, 483 bp, Chlorella protothecoides
  modified_base (202)..(211): a, c, t, g, unknown or other
atgtgccggtcacctaccatgcaagatgccgatgtttggggcgacgactcgcccacggatgccgggcagctggagagagaatggcaatcgagacgcgagggacattacaatgctgggtttctcgaaggtctagaggtcggcaagcaggagtctgtgcaggccggattcgactcaggattcatggccggggctgaggcagggnnnnnnnnnncagacaggtggggattcatggctggggctgaggcaggacgggcgtggggagagagggctggagccctccttagtctgtctgtgctgggagcttcatcaggtccggaacaggcagctctggagtccttggtgtccagaacgacccacgcagctctggctccgctggtagtgcccactctagttgattctcaggaaggcagccaatcttcggagcttgtagcacttcaaacaagggtgacagctgtcctggaagcaagatccccgggcgcatga

SEQ ID NO: 1324 - DNA, 300 bp, Chlorella protothecoides
  modified_base (131)..(140): a, c, t, g, unknown or other
atggccttgccccccggcgccttggtggccgacgtgggatgcggcaacggcaagtattttggcctccgaagcgacatttttgtcctgggcaccgacaggagcacaggtgggcgtatatgcgtggactgctnnnnnnnnnngggagtgaggggatgcagacagggggatagcaggggagcatgtcggcattgtctggaaagggggccactggggaaagaaggggggggattgctgcgctgcacacagaagaagccgagccgagcgtctttcataatgcggccttatcccccatcctcctag

SEQ ID NO: 1325 - DNA, 729 bp, Chlorella protothecoides
atggcagcaaatcctccgctggtggaatctccccagggtctcgtgccggccccatacgccagcgagtggatcggtctggcgcgatcaggcgtggagatacgtatagatggccatccccagggcccggaccgctgggatcggcggggcaccatcttcatcaccaacctgcgcatggtcttcgtggccgaggttccggatgctgccacggggctggtggcctacgacctgcccctgtcctacatcacccaacactccttccatcagccgatcctgggatgcaataacctgaaaggtgggcttggctgtggccgggaggttgagaggtgggggttggacgtgctgctgtggcaacatggcaaaagagctgagactgccctgcctgcaaggcctttcccccagtgtgactgccatccctcacttccatctccttattcagtccgcaatggtttcccagctgagaatctaagccgacaccgtaggtcaatgctggacggtggagcagggtcccgggcaagggacctccatcaggtggactatttacttcaagaaggggggcgtgggcaccttcctccccctcttccactcctacgtgcgggcctacgcccagcagcgccgaggatccgagccacccgcgcccgcgccggccgacgttgccagcgcgccgcccgaggagacctccgagccaaccccgccgaccttcctccgcacagcactggtggaccccaatga

SEQ ID NO: 1326 - DNA, 501 bp, Chlorella protothecoides
atgcagtttgccacggtgttcatggccatcaccggcgacgctttctttgccgcggggcgacgcgtcaccgacctcctggcacgcaacctgctggacgcctttgcctccaccatctggtttacgcccatggtcattcagctggcggccttcagcatggcggtgggctggggcttcgcctctggcggtgtctactacctggcccaccgcggtgcagcggcgggggtggaggcctcccccggcctgaatgccgcggtgctgggtggcatggtgggcctggcttcgctcttcctcctcaacttcctgggcggcgtgctgctggcggtgctggacgcggccttcgtctgctgggcgctggaccgcgacgcgcagagtgtgagccacccggagatcgcacaggcctttgacgccgtgccgcgcaagggtgcggtggtggagcagcccggcggcgggctggcctacggaggcctggcgcacgaggcccccgcccagcagcgcgtgtga

SEQ ID NO: 1327 - DNA, 1785 bp, Chlorella protothecoides
atgctcgcgcgaggctgtcactggggtggagggggagcgaggcaactccgtacacaggctcccagctcgcagtttttcagggcagcaggtcatcgcaggccacccaggtcacactcgacatgcataaaggcagctagcccctctgctgacattcatgggccccccacctttgccaggcgcggagccgctcatggtcagggcggctcgtggagaggagctggagcgtcctccatgctggccatgcctcctcctcctcctccacgggcattggtgtgcctggctccatcgcccctcccacccctccccaaactcacctgcaggatgatgcgacaagcgggccggtaccagaaggcctaccgcgacctggccctgcagtacccctccttccgccagcggtcggagaacaccgacctcatcgtggatatcagcctgcagccatggcactccttccgccccgacggcgtcatcattttcaggtgcgcttccctgcagggctgtgcagcgtgcgcagcgcagcgcagcgctttcggcaacgcgggagagccttgcggcgctgtccctcatgcagctcctgccccgccggctgccttcccccccacccccccctacatggggcccgccacagctcccctgacccctcgcttcccaacccgcgttcctcctttcctccttcatcgcagtgacatcctcaccccgctgcccgctctgggcattccctttgagatcgacgacatcaagggcccgctcattgccaaccctgtgcggagccaggagcaggtggacgccctgcggtcgttggacacagatgccgtgcactttgtgggcgagtccctgcgtgcacttcgcgcggaggtggcgcccgaggccgcggtgctcgggttcgtgggctgcccctggaccctggccacgtacattgtggagggcgccagctcctccacctacaccaccatcaagtcgatgtgctacaccggtgggtgtggggcggtgggcgccgcgcctgctggactcgctgctgagccacctggcagaccagatcgccgagtacgccatctaccaggcctcctcaggcgcagactgcatcatgctcttcgactcctggggaggccagctcccccccaaggcacgttgggtgtgggggttgggcgatccgctggcttgcgggggctgcatgctcgatgccggcagcctcgtccagtgcaagggcctcccacccctccttcctctggtccgaacgcactcccaacaaccctctgcactctcaacccaggagtgggatgtgtggagcgccccctacatccggcgcctggtgtccaagttcaaggccgtgcaccccctggtccccgtgaccctgtatgccaacggctccgccggcctgctggagcgcctgccctccaccggcgtggacgtggtgggcctggactggacggtggacatggccgacgcgcggcggcggctgggcgcgcacgtgcccgtgcagggcaatgtggaccctgccgtgctgtttgggcccgcccgtgcggtggaggcggcggtggacgactgcctggccaaggccgggggctcggggcatgtgctcaacctgggccacggcgtgctggtgggcacgccagaggagaacgtgaagctcatgttcgacctgtccaagcggcccctggcagggcggggggggagggggcagggcctgccagccgccgccgcgggctcgctgcgcggctgattgtgtacagagccgggcgttctggttcggtaacatctcatgcaagggaacaccagggcgggatgtga

SEQ ID NO: 1328 - DNA, 1518 bp, Chlorella protothecoides
atgtccaactatgagagccacagcacggccccagtgcgcaaggtcaagcgcctgcagttcggcatcctggaccccgacttcatcgtgcgcctgggatggtgctggcggtgtggctgtgcgcgtgacttctggatcgtgacggccttggcctctgcgcgcatggctgggtggtatttcgatgcgatccatgggagtgatggaagcccgcttgggagggctgctcgtctgcgacggtgcgtgcgtcggtactccgtggccaagatcgagacctcgcagaactatgacaagggccggcccaggctgggcggcctgagcgacccccgcctgggcaccatggaccgcgccttcaagtgcaccaccgacggcgcgggcgtgctggactgccccggctactttgggcacatcgagctggccaagcccatgtaccacgtgcactttgtgcgcacggtgatccgggtgttgcgctgcgtcagctaccacaactccaagatcctgctcatgccggacgaccccaagtacaagatgctgctgcgcatccgcaacccggagcgacgcctgcatgccttcacctcgctgtgccagagcaagcgggtttgtgagcacacgggcggcccgcagcccatataccggctggagtccggcacgctgcgcgtgctggcggagttccccgcgcccaaggcctctgacctggacggcgcgccgctgctggagagcatggagcgcaagcaggagctgacggcggagcgcgcgctggagatcctgcgccgcgtctccgacgaggactgcgccgcgctggggttcgacacgcgctacacccgccccgactggatgatcctgcaggcgctcccggtgccgccgccgccggtgcgcccctccgtccagatggactccagcgcgcggtcggaggatgacctcacacaccagctgggcgagatcctgaaggccaacctgcgcctggcgcggcaggaggaggccggcgcgccgcagcacatcgtctccgagttcgcgctgctcctccaggtgcacgtcacggggtacctggacaacaccgtgccggggctgccccaggccaagcagcgcagcgggcgccccatcaagtccatctcccagcggctgaaggggaaggaggggcgcctgcgcggcaacctgatgggcaagcgcgtcgacttctcggcccgcaccgtcatcacgggggaccccaacctcgcgctggacgagctgggcgtgccctggggcatcgcgctgaccctgaccttcccggagagcgtcacgccgcacaacatcgagcgcctgcgcgcgctggtggagaacgggccctacccgccccccggccagacgggcgctcgcttcatcatccgcgacgacggctcgcgcctcgacctccgcttcctgaagaccgagcgggaccggcacctccagcccgggtacaaggtggagcgccacatgatcaacggtgacgtggtcatcttcaaccgccagccctccctgcacaagatgtccatgatggtgggtgggtga

SEQ ID NO: 1329 - DNA, 504 bp, Chlorella protothecoides
atgtcgcagttcagcctgctgccctccgcacggggcgctcccacacctcggtccgcgggtctcacccgggcggcacatggcccctctgttcggacgggactggcgcctcgaccatttgcacggccaggtcttgggaagggatcgcgactgaactcgaggtctcaggccccattggcctccacgggaggtggtgggtatgctggtaatggcgggggtgcggggtacggcggcagcggcggctctagctggggcgatgagggctcaaaccagcccgagccggagaagagggttttgtggaaaggatggtcggaccgcgtggccgccgacccccagttcacctacaaggtcgccgtggagcaggtcaggagcgatgcctgctgggtcagggtcggggacgtgccgggctggccgggctgggtatttcctccttgtggcaatcaacacatttgtatcctttcatttttatcccaaccccacagatcctgggcgtgggatcggccgtga

SEQ ID NO: 1330 - DNA, 288 bp, Chlorella protothecoides
atggcccggaagctggagaaatgggcgcccctgcccgggtcggagtcggaggcaaacgactacctggtgccctggcacgtccccatgcaccgggccgaggcggcggccgccgctgcccggcccagtgcggtgctggacggcaagaagagcacagtgtgcttccagcgctactaccacctcttccgcccgggggagctggaggggctggtgaggcaggtgccgggcgcgcagctcctggatgccttttatgacaaggacaactggtgtgtggtgtttggaaggttgtag

SEQ ID NO: 1331 - DNA, 579 bp, Chlorella protothecoides
atggcggatgagggcgtcgtgatcaagttcaagtggagaagcacgatctacgacatcgtcacccacccccaggagtcggtggatggtctgaggcgcaaggtggaggcagccaccagcgtccagcccaagcgccagaagctgctgggactgaagggcaaggatggcaaggcccctacagatgccaccctggtcaaggacctggctctcaaggccaacgtccccatcatgatgctgggggcacctgaggagaacattgctgccctggacgcgcaggccgaggtggcgccggcggtgcaggacgactttgacctggacccccccgcctccagcctggacccacgcgacatccgcgacgagcccggggtccgcgagcggctggcccggcgcgtcgcccgcacagaggtcaaggtgctgcagccccccaggcctggcaagaagctgctggtgctggacatcgactacaccctcttcgacctgggctcctccgctgagcgagccgaccaactggcgaggcccttcctgcaccacttcctgacgctcggtgcgcagagcttggctgggaggggggttggtggctag

SEQ ID NO: 1332 - DNA, 1347 bp, Chlorella protothecoides
atgcaaccctcccctccccccctccaacccactcccagtgctgtgcagcgggtggaggagctggagatctccctgcaggccgcccatgaggtgaacgcccacctgaacggggaggtggagaagctcacggcccgggtgacggcgctggagggcgagcgcggggccttccagcagagaatccacctcctgtcccgcaagctggccgccgcccggcgcgatgcggggctgggtgtgggctcaggcccggcgggggagggccccttggaggcaccgcctgacgccgggccgctggccgggccggggccgggcgccgccgacgccgcgcccaggttcgacggcgccaggtcagcaaatgacgaccccgcgcttcgggcctggctcccgggcaccgcgtggcgcgaggcagaggcccgcgcccgcgagcagggctggctggtggacccgcgcgaggtggcgctgggccccctgctgggccagggcacctttggcaccacgcatcgcgccacctggcgcggcgcggcggtggcggtcaagcgcgtgcgcgtggccgacgcggaggggggcgccatgttcctgcgcgaggtggaggcgctgcgccgcctgcgccacccgcacgtcatgggcctgtggggcgcgtgcctggcggaccccggcgccgcctggctcctgtgcgagctgctgccggggggcaccctcgccgcctggctgcacggcgcgccgggcgcgctgcgcgcgccgcgccgcccgcgccacgcgcgcctgcaggccctgctggacgtcgcgcggggcatgctggcgctggaggcggcggacccgcccgtcctgcaccgcgacctcaagccctccaacgtcttcctggacgcgcacggcgccgccaaggtggccgacatgggcctggcccgcgtgctggagccgggcgcggcggcctgcctcaccggcgagaccgggacctacagctacatgagccccgagtgcgtgcggcacgaggtgtacggccctcgcagcgacgtctggtcctggggagtgatggccgtggagctgctgagtcagcgcaggccctacgcggacctgcacctcacccccgtgcaggtagctatggaggtgggggcgggcacgctgtgcccggagatacccagcgactgccccgaggagctggcggggctgctgcacgccgccttccaccccgaccccatcgagcggccgtcctttggcgccatcgtggccggcatggcgcgcgtggtggaggccgaggcgcggggcggcgagggcggcgggggcgggggagactggctggcgcagggcaagtgggggctgcccactcggctcaccggcctgctgcgcggctga

SEQ ID NO: 1333 - DNA, 1185 bp, Chlorella protothecoides
atgcaggcatctcaggtcccggatgcccccctcccgctgcagcagggggaggaggtcgccctccagggcggggcatcctccagcgacagcgtggtgatccacccattcctgcactccccgctgcccatgctgccggagcccctggactttgggattgagctggatgcgttcattgcaccgtctcgcaagaaggccgggcgacgcggtctgcgcctgctcacccaggcacggcaggacctgggggcggagctggcctcctcggccaacctcggcagctccatgcgggttgacgtggtgcaggcgcggtatctgggcctcctactggccctgattggacagcaggatgcggaaaaggggggaggcctcgacccagggagccctttccggtccgcggcccggtatgtctggcgcggcggtccccgaccccactgggcctccagcgacgccatcctggaggtcgtggccgcgctcatggcgaggtccaccgccctaatgcgcgcggcggcagcagcatgcgtcgacgctgcctcgggtgtgaggacgcctgccgcgatgcaggtgggctgggatggagctggtccaggacacctgttctgggcgaggacatccatggacatgggtacagcatacaagtacctgttggctgctgccgggcagctggagacagctaaggaccgcctgctgccccacctcccgcctgaggatccctccgtcgccgcagaggcggccgctgtatccgccctttcccagcactgcctagccgaggcgcagtacctcaccaccctgcgtgccatcgccaagggcaccagccccaccctcatcgccagcctggcggccgaggcggcctcgctgtacgccgcatcgagcgaggcgctggcgcaggccggtgcggtcgcccccaagctgggcaggtacgcggagtaccgggcgggcacgctgcgcgcgctcagcctcaccttcatggccctggtccagtggcggtcgccggggggggcgggcggcgcgagggcgaccgcagcagaggccctcagggtgtgggccgccgcaaaggcggcggccacggcctatgatgccgcagagccacggacgctcaacctggaccatcgccgctcggacgaggtgggtgcggggtgtgttgtgttggacttgagtgggtgtgcatgcacgtggcagaaattatggtaa

SEQ ID NO: 1334 - DNA, 327 bp, Chlorella protothecoides
atgactgcgtcgctgtcgtcggcggatcacctcgcaaaatactatgggttacacggcaaaacctgcctggtaaccgggggcaccctcgggatcggccgggccgtggtagaggaattcgcaatcctgggagccagggtcttcacgtgtgcccgcaaggccgatgctctggagagcctcctgtcggactgcaaggccaagggctggagcgtggaggggatcacggcggatgtggctacacccgagggcagggagtcggtcatgaaagcggcgtcagcagcattaggcggacgcatcggtgggagcaaggcatttggttgtttggtgtag

SEQ ID NO: 1335 - DNA, 240 bp, Chlorella protothecoides
atgcagaacggcctggtcatccgtccgtttcgcaagtcccaccgatcccgcgacaccgaccgcgagctgctcttcctgggagcctatctccagaagatcgcggcgctggagagcctgtccggcctcgaccatggggcctgggaggcgtacgccgcgcaagagatccgggcggcgctgcgggacttccgggacgcccgcgccgccgccctgtcctcagcgccgcccgggcccgaggcatga

SEQ ID NO: 1336 - DNA, 408 bp, Chlorella protothecoides
atgaagtggatcgaggtgaagatgcgggagctgggggtctccacccacgagcagtacaagctgacgttcatgctagaccacatggccatggtcacggtgcaccatgagaagcacgggtcctgccagtgccgcaagttggcccccacccccggccgcgaggcgtgcagcgaagaccgcccaccgcccctccctgcgcaccctgcctcaggcgtgtttgactgcaagccactggagtttgtctggcagaaattcccgggcgtgtacacgcccgagaacaccatcatgatggacgacctgcggcgcaactacatcctcaatccccaggtgcagtggggcggggcctctgggggcggggggttccttctggggctgctgtgggggatgcatagtagacggcatgtcggatga

SEQ ID NO: 1337 - DNA, 534 bp, Chlorella protothecoides
atgcgcgacccaccagatggagagcgccatgaaatcttctgcaggccgcaacacaaggagcccacccgccacctgcgcctgagtgggtgtgggccaggcctgggctgtgatcctgagagggtatacgctcagcttcttgctccactccattgcgtccgcgtggctccttcagagacaggacaggcccacatatacgccacattccctgaccctgagacggccaatgctgctcttgtaaccttgcatggccaggagtacaatggcaggacattgggcgtgaagtttgctgagacaaagaggatgaaaaagggatctgcgccatcccatctagatgctttgatgtcggcttcccaggctggcattccaggactggacctcatcttggaattcgtcagtacccaggaggaagtcgagctgctggccctcgtggatgcccagccctgggagtacctggccaagaggcgtgtgcagcaccatggcatgcgattcgagtatgctgtgagtgggggtggggcctgttgcagtgcgatgtga

SEQ ID NO: 1338 - DNA, 651 bp, Chlorella protothecoides
atgcatacctaccactccgccctcctgctcacccacccaggctcggacgaccacctggcctgcgtgtttgagctgcggcccggtcctggcgtcggctcgctgggctcctccacccccaacatcgagaactggcggctgaaggccgcgctgcggggccacggtaacaacgtggtggacgtggcgtggagtcccgatgacgccctgctggccaccgccagcctggacggcacggccgctgtctgggcgattgccagtggccagcgtgtggcccgcctggacgcccacaccaactttgtcaagggcatcgcctgggaccctgtaggctcctacctcgccacccagtcggacgacaagtcggtgatcgtgtggagggtggaggactggagccaggtggctcggatcgtgtcccccttctccatgatgatctcctcaacctttgccctgcgctgctcctggtcgcccgacggccagtggctgctggccggcaactccttccagggcgccacgcacgctgcggtcctggtgccgcgcgagcgctggacccgccccaaggactacctgctcatcagtgggcacagcggtgcgacgatgggggatgcgggggggggggatcggttgaggacgaggtggcggcgagggtgcgcagagtga

SEQ ID NO: 1339 - DNA, 342 bp, Chlorella protothecoides
atggcctcccgccccaactggggcctggatgagctggactttgtgtttgccaccctggtcgtcggctccatcgtcaactttgcgctcatgtacctgctggcccccaccggggccgggggcaccgccgccggggcgagcctggtcactaagctcttcagcgaccactaccttaaagcctggggggcgccagcatatcccgctgtgaacaggctcgacctttgctgccggcacccatccctggcgccacagataagagtagacttcaaccttgaaggcctgcgccgcccaccaacccgtgcctccctgcaggtggccacatgtttgagccgggctttgccgtga

SEQ ID NO: 1340 - DNA, 669 bp, Chlorella protothecoides
atgtctctctctaaaacgagcaagctgctgcagtacataaacttccgtgagtccctcggctcatcaccagccccggtggtggtgggaggtggatgtctacagtcgaatctgcttgctggttcgcgatacccactaagttttcatcccacaaccaaaatcgcaggcatgcgggtcactctcagtgacaagcgccaagttgtgggacggtttatggctttcgaccgtcacatgaacctggtcctgggagatgcggaggagtaccgcaagctgccacccaagaagggtatcccagaggaggaggtgtgtgtgagggatggtatgcgcaagcgcagggagttgtgttttaggacgagctgtgcagcgcgtcgcgcgtgggagttgaggtgctgggtggtgttccaagagggcgactgcatgctttgcaggtcctctctcactgcggctgtgtacatgttgttgccgctcatcttacccctccccctccaccttcccaacggtgcagcgggagcagcggcgggtgctgggcttggtcatcctgcgcggcgacgaggtcatggacctgacgatcgaggggccgcccccggccgacgagtcacgcgtggccaaggcggcccccggcggccccggcggcccgggcctgggccgcgcggcggggcggggcatgcccgc

SEQ ID NO: 1341 - DNA, 855 bp, Chlorella protothecoides
atgcagggcctggactggtcagcgctgcgatgcttcagctccacgggcgaggcctccgcgccggaggacagcctgtggctgtcggcccgtggcggctacaagcccgtggtggagtactgcggcggcaccgagctgggcggcgccttcatgtcctgcaccctggtccagccccaggcgccctccaccttctccggccccgtgctggggtcccagctggtgctgctggcgcgcggcggcgggctgtcgccccacggcgaccccacgcgcctggcgggcgaggccgcgctgggcacgccgtccctgggccagtctcagacgctgctgaaccgcgaccacgccgccgcctaccacgcgggcatgccgcccgggccgggggggaggtacggcctgcgccgccacggcgacgaggtcgagcggctggggggggggttgtaccgcgcgctgggccgcgccgacgacaccatgaacctgggcggcatcaagaccagctctgcggagctggagcgcgccgtgacggcgggcgtggagggtgtgatggaggccgcggccgtggcctgccccgcgccggggggcgggcctgacctcttgtacctcttcctggtgctggggggggatgcgaggggtgtgacgagcggtgcgagcgttgggagcggcgcaatgggggccaccgacaacgacccggcgagctcgaaacacctggcggccgccgcgcagcgtgccatctcgcagcggctgaacccgctgttccgggtgcacagggtgctggtgcgccaggcgctgccccgcaacgcggccaacaaggtcatgcgccgcgtgctgcgcgacgagctgatggccacccagtccaagctctga

SEQ ID NO: 1342 - DNA, 381 bp, Chlorella protothecoides
atggacgagcagtttgagctgctgcaggcctggcatgcctgggtctcccgcgaggtgggccacttcaagtccaagttcaggggcgcggcggccaccgtgctgggggcggccaactgccgcggcttcacgctgggtgagcgagcggagggggtgggcaggggggtggagaatggggagtacgagggacccctcaagctgcacctgcccgtcaacatggagctggaccccgacggggccttctcctttgacgcgcccctgccttcgcccaccggcaagatcggggaggtgaggcccagagatcctgtggtttacgagtgcttggcgtggatgaggcggggcgtgtggaggtgtgccccaccgggggcgtgcatgcaagcctag

SEQ ID NO: 1343 - DNA, 234 bp, Chlorella protothecoides
atgcagcacccacccccctcccgcaccgccgtgcagttcatggacattttcaaggcgctgacggtgccgtcccacctgcgtccgccggccgccgccgtcaactgggtgcccctgagcggggaccccgccctagacatggccatgagggagcaggtggcctgcggcgtcgccctcatcgccaaggtcctggacaggctgggcgaggcggcgcagcgggaagggaggccggggaag

SEQ ID NO: 1344 - DNA, 519 bp, Chlorella protothecoides
  modified_base (362)..(371): a, c, t, g, unknown or other
atgccaagcccccaagcctccactcctgcccgctcaggtggtgacggcacagtgttcgaggtgctgcagggcatgctgaaccggcctgactgggaagccgcgcggcagctgcccctggtccagatccccgctggctccggcaacggcctggccgcctccacaggtgcgtgtgcgcctggcacctgtgaggcgccttctgcaggctgcggggtcgggaggagcaggcggcaggatgcggccggcggggcagcagcggcgaggctgggcgcacttccaagccccgctgccaattgcgcagggccttcatcctgcggagggacgcatgcacatcggagcggcagcactggcccagctgcacgagnnnnnnnnnngaaagcgcagggccttcatcctgcgaagggacgcatgcacattggagcggcagcactggcccagctgcgcgagcctgcctctcaccatctgtatcctcttcgaccccaccctccgcaccccacccatgcgcaggcctgtgggacgtga

SEQ ID NO: 1345 - DNA, 1062 bp, Chlorella protothecoides
  modified_base (367)..(376): a, c, t, g, unknown or other
  modified_base (648)..(657): a, c, t, g, unknown or other
  modified_base (1039)..(1048): a, c, t, g, unknown or other
atggacgtgtcttcggtgctgcagccccctgcacgccgcgtcttctccttcctctccctgacctacggcatgatccccaacctggacatcggcacggaccacttacgctggatgggcagcccgcgctttgtgctgggcgccatccaccagatcatgaagcagggcgcctaccccgcgcgagtctcctttgtggatgtgcggcacggcgtggtccagggggcagggcacgtggaggaggggacaaacggcgcgggccccccaatgcggcacatcggcgccttccagcgcctgccagacggtgcggggcgcgcctgtctggagtacaggagcccaggctgggaatgggcgcaggaggcctcgggggcannnnnnnnnnagcctgccggacggtgcgtggcgcgcctgtttggagtacaggagcccaggatgggaatgggcgcaggaggcctcgggggcatgctgtcgaggcttcattgtcaagcgtgcggtgtcgtggatgctgcactttcaggctcgggcctcagacctgacaccgagtgcctcctgcaagccccacactccccacgccgtcaaccctctgcacgcaggctgcagtggcattgcctccctgggcctgacggccccctggcagcccctgctggcgggggnnnnnnnnnncctcaggcctgcgcctcagatctgacactgagtgcctcctgcaaaccccacactccccacgccatcaaccttctgcacgcaggctccagtggcattgcctccctggacctgccggccccctggcagcccctgctggcgggggaggtccagttcttcgcggcctgcaacattccctggctggacaccaattttcacgtcgcgccgggcacgctgctgcacgacggtgggtcacgagctggggcgaggcgtcggtgttgggtccgcaccttgacgggccctgaatgtgtatggctggcatgccactggacaagagcttttccggatttatcatcccaagtgtccccccatcggcagggcacctcacgctgctgtacacgctggnnnnnnnnnncgtctgcaccttga

SEQ ID NO: 1346 - DNA, 513 bp, Chlorella protothecoides
atgtgggccatggcagtcgagcttgcgcgaagaggaggaggatatggcctcgtcggcgtaacgatgtattacgcatgggatgccttgggagatgcggcaatatatctgacgactaaacggcatgtcatggacgccgcacagtcccacaatcgcctcctctcgaagcttgggacacctgtgaatgccgggccgtggtatgatagttccgtcgtcattggccgaggcggacacactgcatcagtgacgctccccctcaagggacctgagaggggctcagacgtgactgtcaagctggtccgtgccgggggattcgcttcctctacgctcttctccctgctacaaggggatcagtgggaggggatgctcatggatgcggccgttgggatgggccctggtggccgccccgtcctcatgagcctgctggaggcggaggagccacagctgaaggccagtgacgcacatggcaacgcagccctggcgcgcagggcagctactgttgaacgaaagcaatga

SEQ ID NO: 1347 - DNA, 1422 bp, Chlorella protothecoides
  modified_base (30)..(39): a, c, t, g, unknown or other
  modified_base (514)..(523): a, c, t, g, unknown or other
  modified_base (932)..(941): a, c, t, g, unknown or other
atgccgcgcgcgcgcgttgggacgaagcannnnnnnnnnctgggcgcacgcgaggcgtggggcggcggcgacgcgctgctgggtgccgccgacgccggggcggcaaccggcgactgggagcgcattgtggccgagaggcgcgacggcatcgcctacgaggcctggcgccggccgctgcgccgcggcctctacctctaccgcacgcgcgcggtgctggagggcgtgcgccccgccgacgtccgtgccttccacctggacgacgccgcgcgcgcgcgttgggacgaggcggccaccctcgtggcgcgcgtcgcgccggaggaggcggcgcccgaggccccggagtcctgcctgcagaagtatcgctcgcgcttcccccggcccatggtggggattgcagagggagggtgttgtggcaggaaaggatcatggaggattgcagtgatcatgctcgtgcctgggtcgcaccagccagtggatcccccccgttgcctcaatccaatgtgcctgcctccgnnnnnnnnnngggattgcagagggagggtgttgtggcagggaaggatcatggaggatggcagcgatcatgctcgtgcctgggtcgcaccagcaagtggatcccccccattgcctcgatccaatgtgcctgcctccaccaatcccttgcaggcctcccgcgagtaccactacgcgcgccgcgtctgggacaggccggccgacggcggctgctatgcgctgtgccgcgacgtggagttgcccggaggtgagaagagcgggctggatgcgggtgcacagactcgctctgagtgtgtctgtggggcgccagggtgtcggcagggaaggggcaggttgaggcgggcgttgcagcaagtactttgcggcgtgtgccccttcaaacagccctccgatcctttcggtcactctcttacaaccccatnnnnnnnnnnctatgcgctgtgccgcgacgtggagttgccaggaggtgaggagagcggggtggatgcgggtgcacagcctcgctctgagtgtgtctgtggggcgccagagtgtcggcaggggaagggcgggtcgaggcgggcgttgcagcgagtgctttgcggcgtgtgcccctttcaacagccctccgctcctttcggtcaccctctcacaaccccacctgcagccgagggtgcggtcaagggtgcggtgcgcgtgcgggaatacgtctcgtgcatcgccataaaggcgcatgaggttggcaccgagctcctcacctgctactttgaggactcccaggtccggccctccattgtgaagatggtggtgcccaagagcctgtggtcgctcgtccagaagtacgaaagcgccctgaggtgggtgcagagaggggctgtgcgttggattcgagcgaggacagggggtaggagggaaattgaatggcgcacctag

SEQ ID NO: 1348 - DNA, 2025 bp, Chlorella protothecoides
  modified_base (871)..(880): a, c, t, g, unknown or other
  modified_base (958)..(967): a, c, t, g, unknown or other
atgcagcgcatctcccttcagccctgcttcacagcatgtggcgagacccccctcgcccacatcctgcgactaggcgacgtgacattgctgctggatgcgggttggaccacggagtacctggaggaggaccttgctgagctgaggtcagccctgcccagcatcgatgctgtctgcaatggattcttaaggtcgcctcttccctacccctgcccaccacactccctgcccgcagtccttgtcagccacgctgatgtggcgcacctgggtgcgctccctgccctgctgggccagggtgaccggaccctgcccgtgtacatcactggggccgcccacaagatggggcagatggagctgtacgaggagtgcctggtccggtccggctgctcggagttcacggcgttctcgctggaccacatcgacgcggcatttgatgggatgacaacgctgaactacctccagcactgctcctttgttgggaagcctgcacaaaccttgcacattatgccatattcttcaagggatccatcgcaccatgggcttacaattaaatgcatctgcatcgcagtcagggacactccggtgaggatcgtggcacacccggccggccaccggctgggcggcgccatctggcacatccagtggagcaacgaggacatcaacctctcccctcgccgtgccgaacaaagcatcgcctgccagtgcttaccgccctctggccccactgctcaatgttcggctggtattcaaactctcaagcgcccactccgacacaatacatcctcctcctgtctcaggaaggaacggcacctggcgggggcgcagctgccgggcattgtctcccgccccgccctgctcatcgtggacggggcannnnnnnnnntagaacctctcccctcgccgtgccgagcaaagcatcgcctgccagtccttaccgccctctggccccactgctcaatgnnnnnnnnnncggaagcgggacatgacaaccagtcccagaagggccaggagcctggagccgaggtagatgcatgccaggatgacgcagttgaccgcgatggacaacccgttctggatctggctggggaccagggtggaagccgccacgggggcgccctccggggtgtacagggtcagatactgggtctcgttctggaccagggcggtgtaggcgtaggtgagatagctcatcttgcccacccacttgaagtagaccgggatgctggacaccaggaagccgctgaagctgagcaggatcagcaggacaaagcactcaagctccccagtctggcaggcttagctggctgctcacgcgtagacccacgcttctctgctgcccacccttttccagcgactttttggaagctgtcgtggccacactgcgctcagaaggcaatgtcctcatccccgtggacgccgccggccgagtccttgaactgctcctgctcctggaacaccactggtgagggtgatgcgggggttgcggggggatggtgccggggattttgggatgcggagtcctgggtgcccttgctctggaattccaaactcaaggcaggctttgccacacaccctaatccccggcagccccccccgggcgcgctctcctgcccatcacaaccaatcctcaatacagatccaccgcctcacccctcggcccctgaccccctcactcctgccctccagggcccagcaccacctgccctattcccttgcctggctgagctccatgggcgccagcaccctggaatttgccaagacgcagacggagtggatgagcgagtcgctgtgctggcacggcggccggctgcaggacaatccctacctcctgcgccatgtgcggccctgcgccgacgccgccgcactggcgcgcatgggccccgggcccaaagcggtgctggccagcctgggggacctgggtgcggggggcgcgcgcgagctgctggccgcctggggcgccgccgagcgcagcacggtcgtcctgccctgggtcgcggcgggccggcgctcgctggcgcgcgcgctggc

SEQ ID NO: 1349 - DNA, 192 bp, Chlorella protothecoides
atgtacatccgggaggagctggagcgatctggggagttcaaggcgggggagtacgagggcagcctcgtgcacgtcttccaccgcatggacgacctgatgcgctccgccgagggcttctcccagctggagtccatccgcaagagcctggacaaaggtgaggggcggcgtagcggcgcttgctccctgatctag

SEQ ID NO: 1350 - DNA, 327 bp, Chlorella protothecoides
atggccgacttctacgccatgatgtccagcgaccccgcgcgcgctttctacgggccaggccacgtctgggcggcgcacgagctgggtgccatcgccacgctgctcatctccgagggcctcttccgcaccagcgacgtggcggcacgaagaaagtatgtcgcgctggtggacgaagtcgcggcaggtggcggccaggtcatgctgttctcggacatgcatggctcaggccagcagctgcaggcgctgaccggcctggcggccatcctgaggttcccccttcccgagctagaggacaccctcatggacgagggtgtggctgtcatatga

SEQ ID NO: 1351 - DNA, 660 bp, Chlorella protothecoides
atgcaccggggtgccgcagatctctcagcacgcacccacaatggcgagcccctgccccgccctgcccctggaggcaggggcatcctgcacgggcgcccggccccaggcgcaccacatgccgatccgaggatgccgatgccgacatgtgcatgcctgcgtgagtgtgctggccttgcaacggtagtacagcctggtccatgtacgcaggccgacctgttgtcctcctggcctgcatcttgcgatgcacctgccgtgcccacctctccccgcagctttgtgacggtggacaatgagcgcgaggagagttccacggtgctggaggtggagatcaaggactaccccggcctcctgcgcatcattgcctgggtgttgaatgggctggacctggtcgcggagaacgccgtggtgagcacagacgccgagggcatagcgcacaacaccttttggctcaccagcctcagcggtgagcgggcgcagggtggttgtggggattcgcatatgggacggcgaggcagtgagccaggatcatgtgcgcgaggccgcataggagcagccgctggggggcagttgagtggtggtgtggcacgcaagatagcaggggaccatggccacaacccgatctcccctgcattctgtcccctcatgcaggcaataaactga

SEQ ID NO: 1352 - DNA, 840 bp, Chlorella protothecoides
atgtcatttcgacccatccaagcaggcgaggacctctggcatgtctttaaccttgtgcggacgggggacaaggtggcggccacaacctaccgcaaggtccagcgggacacggggatgggcacagacagcgaacgcatcaagctcaggctcatgatccaggtggaggacatcgactacgatgcagcaggggaggagatccggctgaagggcaggaacctgacggagaatgagcacgtgaagctgggcgcctaccacacgctggagctgcggcgccaggcagccttcaccctggagaaggaggtgtgggacggcgtggacctggaccgcatcgccgccgcctcagaccccgccgcctcggccgacctggccgtgctgctggtgggggagggtctggctaacctgtccctggtgggggccaacgccacagtcctgcgcgctcgggtggagaccagcatgcccaggaagaaaggggcggcggccgcggggcgggacaaggcggtgcacaccttccagagcagggtgtaccaggtgccgcgggttgcgagggtgttgctggcatgccaggggctggggtgggcatgctggggatgcatgtgtgttgcagggtactgcgtgctggctggctggctgcggaggactgcgtgcatgctagcaacattagttatatcccggcggccttccctctccattacttgcaacaaaccttccttctcgcatcaacttcaccaggcagtactgcagcatgtcgactgggatgtggtcaagtgcctggtggtggccggccccggttttgtaaaggaccagttcctggagttcctctttgcaggtggggtgctgtaa

SEQ ID NO: 1353 - DNA, 345 bp, Chlorella protothecoides
atgacgcaggcggaggagaggacaaaggtggtggtgcgtcacctccctccatccctgtccgaagacgccttcaagtcggccgtgcaggagtggctcgacagatccaactggtccgcctactaccagggcaaagtcaggtgcggcgggactgctgcagcgatgactctactgtctcgctgggacgcaccagccaactgcgcaccctgcccctcaacctgcagcgccaaggagcatgtgcattcgagggcgtacctgaatttcaaggaccccgcggatgccctccgattcagtgctgcattcaatggcaatctcttcgtttcggaccgaggagcccacacgaggtga

SEQ ID NO: 1354 - DNA, 945 bp, Chlorella protothecoides
atggggggcattcgtgcttgggcgatcgcctgggggcgccatgctcccacagtgtgccccacccgcgaaagcgcaaccagctggtcccgtgctcaccagtcctcccttcatgagctggtgtccgctttatttacacccttcatcaaaacccacccccgctcagcctccgcgacagaggacgaggagggcgacgacacgtacagcatgcttcgcaagctggtgtccctgcagcgcatgcagaacagcgcggcggccgcggcggccgcggcggccggcaccgccaacggccgcgctgccccgctcgagtccggctccggcaccaatgttgccgaccccggcgcccccgccccccgtcccctgcccggcgtggaggccacggtgcaggcggggtgcacggcggtggtggcactgctcaagggccggcggctgttcgtggccaacgcgggcgactcgcgcgcggtgttggcgcggcgcggcgtggccgtccccctctcccacgaccacaagccttcggcggcgggcgagcgcgcgcgcatcatggccgccggcggcttcgtgtccgaggtgggcggcatcacgcgcgtgaacggcaacctgaacctctcccgcgccatcggcgacctgcgctacaaggccaaccccgcgctggaggccaaggaccagatcatcaccgcccagcccgacctctgcgtggaggccctggtgccgggggaccgcttcatggtgctggcctgcgacggcatctgggacgtcatgagcaaccagcaggtggtggactttgtcggcgcgcgcctggacgaggggctgaccccgacgcaggctgccagcgagctgctcaacgcctgtgtggcctccgacccgcgcgagacgcgcggcatcggctgcgacaacatgactgcctcggtggtcgtgttcaagggcctcgatgaggagggcgcggagtga

SEQ ID NO: 1355 - DNA, 528 bp, Chlorella protothecoides
atgaggacattgccttctgagcgcagtgtggccacgacagcttccaaaaagtcgctggaaaagggtgggcagcagagaagcgtgggtctacgcgtccttacctttgtcctgctgatcctgctcagcttcagcggcttcctggtgtccagcatcccggtctacttcaagtgggtgggcaagatgagctatctcacctacgcctacaccgccctggtccagaacgagacccagtatctgaccctgtacaccccggagggcgcccccgtggcggcttccaccctggtccccagccagatccagaacgggttgtccatcgcggtcaactgcgtcatcctggcatgcatctacctcggctccaggctcctggcccttctgggactgggcggggcgggagacaatgcccggcagctgcgcccccgccaggtgccgttccttcctgagacaggaggaggatgtattgtgtcggagtgggcgcttgagagtttgaataccagccgaacattgagcagtggggccagagggcggtaa

SEQ ID NO: 1356 - DNA, 753 bp, Chlorella protothecoides
atgttggggtactgctctgaggcctgcgcaggcagccgagtcagccaacttgttccgcggggcaccacggatgcactcaacccttatttcccgccgaaaaccacgtgggccgaaatcgtaaggggaggtgctttcacgggagctcatatgcatgggcagcctgtggtgggttggctggtactatgtgtctgtgtggtgagaaggttaccactccgatgttatgatggtcacaatgagggtgacagctctcctaggatataccatggggtaaaggtatcctcctctgggtggggcgcgagtggatcaggtgcggggggagtccgcctttctctcgcacagacaccctaccagctgagaagaaacacgacgcctgcaccactcagaattagatatagttgggagcagttgacattgagcaccatgatgtccgctgtgagtggcgcctttgctaacctgcacatttcgagccggccgagagcccagcttagtttcagggcgtcagtctgcccgggatctatgctagtgctcccccgtcccggtgtggctcgctcggccctcgctttcctggtcgaagccaagcagaactccctcagacgcgagcgtacctcggaaaaggcgcggctacgaaacaaggggcggacctcggagatcaagacccgcatcaagaaggtggggcctaaagagggggctaaagtggggggcgtggagcaacacagggagcggggcgacacactggtgcaagtccaaatctag

SEQ ID NO: 1357 - DNA, 687 bp, Chlorella protothecoides
atggtggcaatgggggacgcggacggcatggtgtctggcgccacctgcaccacggccaacaccatccgccccgcgctccaggtgctgaagacccccgaccgccgcctcatctcctccgtcttcttcatgtgcctccccgaccgcgtcctggtctacggcgactgtgcggtgaacgtggagccgaccgcggcggagctggcccagatcgccaccacctccgccgacactgccgcagcctttggcgtggagccccgtgtggccatgctctcctattccacactggggtcgggcgccgggccgcaggtggacctggtgacggaggccactgcgctggcgcgcgccgcgcgccccgaactggccatcgaggggcccattcagtacgacgcggcggtggacccgggcgtggccgccaccaaggtcaaggggcggtccgaggtggcgggtcgggccactgtgtgcgtgttcccggacctcaacacggggaacaacacgtacaaggcggtgcagcagtccacgggggccatcgccatcgggccgctcatgcagggcctggcgaggcccgtgaatgacctcagccgtgggtgcaccgtggccgacatcgtcaacaccgtggcctgtgagtgggaatttggtggagagggggggttaaacggggggtggttgggagcaggggctgctcccagatga

SEQ ID NO: 1358 - DNA, 1326 bp, Chlorella protothecoides
atgggtgttgcaccatatgtgtggtggcagcattttggtgctatcgtcttcgagacttgcggcacttgggcacaatctcaactggttccatacaaaatatggacacgggccatcgcatcgccgcgctccccgatgtcccgcccagcacaagccacacctccagctgtccccacccctgtccagctcaccgcagcgggtgcccatgaccaggccctccagcggatgccgctgtacggaatgtggagtcactcacttccctggcatccacccatgtatgcagcatcatcctcatccggccccccccgggctcccttctccccgcgctgcatacctagatggcaaatgatggcattcaggctctccacgggcttgcccagcgtcttggctgcccgtgggaccaggactgctgccccaggcaacccaccggggtcccaggcaactccgcagcacacctcaccattcctgcactcacagacactggcgacacccccctccacccctcccctccacctcctcttggggatagtgaaggcctcacctcctgaccgcttgctcatcgtacagctccttgggcagggcatacatgtaggcagcgggggccatggtttggtggaaggcggtgtcaaacacggcgacgtggggggccgcggggaaggtggccattgcagcctcgataccctggaggccggcggggttgtgaagcggggccaggctgatagccttcttgatcacggccttcaccccatcgtcgatgaggaccggggcgctgatgtccaggccatgcaccacacggtggcccacgctgtgcacgctgcgggtaaagctggaggaaaaggtgtctgccaggaagcgagataccagccccagggcgtcctggtggtcgttgaagccctcctgcagggtgacactcccgccctccgccgtcttggcctgccagggcagatgacgtggggtgagatcggcgatcatgcactgcacgacgaggagagagtcttgagaatcgacgtagatttcagatcgtatacccatcctaccttcatcctagagttggcagtgtcgccgatgcgctcgcacagtccggaggcgagggactccaactgcccattgcctagcgcttggaacaccttgaatttaagggacgagctgcccgcattcataaccatcgtcagattttttgcgggcgccatcgtgcgggcccacggtctctggggttctcaaggggggggggcaggtgaaaggagggcggtgcatgcagtctctatgcaagataatggagcaccccgctgtgaatcatccaaggcgaggaaggaaggaaacagtcgctga

SEQ ID NO: 1359 - DNA, 954 bp, Chlorella protothecoides
atggatcaccactgcatctggttgaacacctgcatcggcacccgaaacctgcgatggttcctggccttcctcgcatccactgctgccatttgcatctatggtgcgcgtggtggctggcgtgttgcatcggcatgcgaggtgtctggcccagggcccttgctctctggccaggctgtgcctggcgatgtgctgcgagtgacgcacacctggtcagcgtgccgggtatgcgacaggctgtgtcccagccagccagcccgttcctccaccctcgcaccccaaggcgctgtgctgggcgccaggatcatgcatggacacatgggtgtcgaaggcgcatggaagctggccagggtacggcggggctctgggcgtctggagtacgtctcggactccgcgctcaccacgctgcgatacgtactggagcgctacccggtgcaggtggggcttcgcgggtgggtggatcgtgctatgctgttgtacaacggcgcacgggtgggaaggagccatgctcgtcccgaactgcgccggagcacgtcactccgaggcctctcatgccagtggagggctgtgtcgtacacgaggacaccctggagaacactgggcgaggtcgcactcagtccagtgcatgatagtacaacaccggggcccctagttcccgccttccgacacaccccaccactgcagttctgcctcaccttcttcctgggcgtcatgggctgggtgctcacaggtttcctggggtaccacatcttcctcatcctcagcgggaccaccaccaacgaggcatccaagtggcgggcgctgcgcaaggacctggcgcggcaggcggcgttcgacccggccggcctccacctggacctcgctcccgacaacgcctacgactgggggccggggcgcaacctgctggatgcactcgtgccccgcgtgccctgcacaaaggactccaagctgtgctga

SEQ ID NO: 1360 - DNA, 303 bp, Chlorella protothecoides
atgcccacgcccctcttgcagattgcgtatgtgggcgacggcaataacatggtgcactcatggatgaggttggcctcccgcatccccatggagtttgtgtgcgcatgtcccgagggcttcacccccgacccggccacgacggagctctgtcaggccacgggcgtcagctccatcagcataagccacgagccgtttgaggcggtgaagggcgcagatatcgtgtacaccgatgtctgggcctccatgggtcagaaggaggaggcggaggagaggaagcgtcagttcaagggtttccaggtatga

SEQ ID NO: 1361 - DNA, 999 bp, Chlorella protothecoides
atgtccatgcttgtcacctacaccccggtgggtgcccggtcccagcggctcgggctcgggacccccatccggcccaccgcctccccaagccggcgtacggcccacattcgggctcgtgccgccgcgaagagctggagcagcaaggatgtgtcccctccttcctcgggcacacacttcttgcacctggacgacttctccaaggaggagctagtgcacatgctacagacggccaaggatgccaaggcaatcctaaagtctggggaccagagcttcaagccattcaagggcaagaccatggccatgatcttcaccaagcccagcatgcgcacgcgggtgtcctttgaaacaggcttcaccaagctggggggaaatgctgtgtacctgggaccagacaccatccagctgggcaagcggcgaagagtctacgattatcagttggggcgctgcccgcgagctaacactgcaacaccagcaaagcgagacgccactagtctgccctttcaggaattctctatcgccagcggccggcaggatgccatcctcccggaatgtaccattggaccgttcccaggaaccagaaccgctcatccgctgcacaccctcctcgtttcccatgattgtaggtacaacgagatgatcatggcccgcctgtttgggcaccaggatctcatcgacctggcgcagtactccgactctccaatcatcaatggcctcacagactacaaccacccctgccagcccattatcgagggggtgcagaccccatgggaggtgttgatgacagcgcctccaaaccagctattcctggacacattgcagatcatggcagacatgctgacggcttgggagcatctaggacggctcgagaacctcaaggtgacatgttggaggtttggttacgaagaggtgatgcagatgaacaccatgtgccaacagcctgggcgacccggtgatggcggcaaggggtacgcccaaggctgcggcgataccatgccatga

SEQ ID NO: 1362 - DNA, 2124 bp, Chlorella protothecoides
atgccgagacgtctggcacctcatacggtgccagatgatgcagcgagtgcaggacctccaggcaccgctccggctggctggtgtggaggaagccgactaggcactccagggcagttgccttcctggggggggaggagaggacagaaaccgcatcgacactgtccgggtggatgcgcagtgcgtggcagccaggcacttggggcaagttcgcctgtgggtgcagacgagttcaagcaccttcatgccacaaacccctcagaaccacgcacccgaagcattggagccccaccgcaggacctctctctctctgtctgtgaggagagcccccgccacgagctcgtcatagcagcgcgcctgagcctctgcacagaccctgctcctcaccgcctcgtagtagtcttgcaggtggaggccgggcagcaggaatttctggcgcaagtgcatctgaaattgatggggggacgagtgtggattgcaagctgcatgttgacgaggcgcagggaggagaatgtgcctaatcatctgtgccatgcggacagcagcccaggcggccaacttgatgggtgcaaaccattcttgtctcttcccccagcccacctcccagacggcgtcccccaggaaggcgagagctcctggcccgctcatggaacgcagctgatctggcgacggccgggaggtgggtgctgtggcatgctggtggactggcatggcctgcgacagccacacagccagctagctcgggaaggatggcctaaggacgcccaactaagaaaatccaccaggaccttggaattacccagtaatggtgattacatgaggcattcgagcgctgtgccactgtgtgatgatcctacccttgtttcattcgcgggccatgtttcgatcgttccggcaaggcgcgagactcaaaagggtgctggatcacatgcgccagctcgttgcgtcctccgctcccactcctcctgggggagttttttgcttctacaaggtgttgtagatcccatctgcgccttctgctgcccattctgcccgcgcaaccctggaagaactgcgcgcagggaactcatcgccagacattcgagcttcagatgggtgttggagaccaggcgtcggtggacggatggctcgaggccgagtctctgggcgacgaccgaattctctcacgatcgcccacaatcaggacgaggtgggcagggtagccaggatcttgcttgcactaagcatatgagacggaactgctgggtccaaggctccgaacagtgctctgtcgtgcatgaggtgggtgcactcaatgtagctgcatgccagctcctccacaagttagctcctttccccccccccccccccccccaacacatacacacacaccaggatcgcagctactctgcatcgaatgcgaaaatggagatctggggtcctttgcgttgccctcctcacaggtgtggtcgatcagatggggttctgaggggtcccagtatgtggctgtccaggtgtggagtgggccatactcctgccagctcatccctgcacgctatgctccacgtctcaaccaacggccttgccatgcgactcgcaggcctcatcgccttgacgctggtgactgtatttgtcggcggcaggtacagcatgcgatcggcacgcgaggaggtccccaatgatcgccctgcggtcactccaaagaagtcgtccgccccagaaggtagatttccttttgtttcatggcttgcggactcctcagttgccctgctcgttcccggccactccttgcgctgcagccaggtacccactccacctggtgtgcaatgcgtaatccctcgcctctgtcgaccacccacacacccttccactgcaggctccatcacgggcgacttctccgcgcggcacgactaccggggccacccacgtgccgtgtcagcgcgccggggtgtagtggccgcggaccacgggcgctgctccgacatgggcgtggacaccctgaggaggggtgggaacgctgtggacgctgcggtcaccaccacgctgtgccagggcgtgatgaaccccgctgccagtggcctggggggtggtgccttcatcctcgtcaggcgaggcgagggaggagctgtggatggaggagggggatga

SEQ ID NO: 1363 - DNA, 810 bp, Chlorella protothecoides
atggccgtcagcctgaccaccacaataaacactgggtttggatcaaagatcctgtccccctccacgggtgggtggtgcgaggggatgcctgccgggctaatgtgggttgctggctgccagatcaggcatgtccgtatgcatcctgctgaacaaccagatggccgacttctctacacccgggcagttcaacgtgtttggctaccccccatctccgagcaacttcatcaggtgggacgtggccgtggcaaaggggctgcgccgcctgccttgccaggaccgaggcgcggtgctggacgaatccgtgtctgcgactgcgctgccgtcgccactccgtgcccagcagtgcgaggcgtggcacgcggggccttgctgtcatcacaattcaaacccctgaaccttgtgcatgccccccccacgctgcaggccagggaagaagcccttcagttccatgagccccctcatcgtggagcaggatggcaagctgcgcgtgtgcgtggggggccacgtgaggttctgtgtgcgccctgcgcggctgtgcataacgagggtccgcgcaggggaggggctcgggtgaacacctggcgccacacggcgtcaactcgccacacagaatccatcgagtctcggccaccggtgcgcgctcgcaggctcgtggcctatggcgaacccgcgtttgacgcggtggccaatccgcgtctccaccaccagctggtgccctccattctttacgctgagaattggagtgtgggcggcatcagcttcaattacagcacacccctgctggcggtgaggcgtgcggggtgcatgtga

SEQ ID NO: 1364 - DNA, 720 bp, Chlorella protothecoides
atgtggagcgtaggttctttcttgagcctggcggtccggccacttccgctctggggccgtggtctcatccctacctcctccaaccctgcgcagccgcaacacgggggtgcagctgggcttcctgggacccatgggcaaggtctgggagaacggatctgtgcaagtcgttcagggcgcggactcgctgccctccgagtgccacccgcgcgaccgcctgaagggcgcccaaccatctgtaccgccgctgactggccgcccctccacccttcacccaccccaggcgctctgttggagagcatcgccgagatcatatacatccccatctacgacaccgcggcgacggtgtccggcggcgtgctggcggtgctggagctcatggtctcctcagatgcgcacgacccgcaggtggtggccaacaccatcgcctgcgtggcccgcatcctggactccctggccctgcacctgagctcctccgggtctggcgcgccctgctcccttccggggtcggggccgcccagccccacgcccacagaccgcgtggggtccacccggcgcggcctgccccccgtcatgcgggtgtcggcgcccgccgcgccgcagccagaggtcgccgccgccgccgccgccgccgacggccaggcccggccaccgcgcagctcttcagcggggcgcatgcagcgcacgcgctccctcctggtcatccgccccctgctctgctga

SEQ ID NO: 1365 - DNA, 285 bp, Chlorella protothecoides
atggccctgcccacgcacgtagcccatgcatgcttggcgaccatgaaccggcctgatgcacctactcgctgtcctcgtgccgccttcggcagtctgacagacgacgccgacaccgtcttctgcacaaacgtgtccgcgctccaaggtagctcccccgtgctgctgggcctcctggactactttcagcgccagacgccgcatgttggctttttccagcccatcggggcaaaccccctgaatggagcgtcccggtacaccggcgagcctaagcacgtagcactgtga

SEQ ID NO: 1366 - DNA, 528 bp, Chlorella protothecoides
atggaactgcaggccggtcgcatcgtgcctttcaagaactgcgggggggtattcgccggcacgagtcggccgttgcttcccacaggtgggtggggcagggagggcggtggccaggaggcgaaaggatggctggcgatgccggtgtgctgccatcgatggcgtgcaagcacccctctgaacccgggctctacatctgaagctccgacagtcccaccccttccctcgatatcgacaggccgtctcaccgcggctgccatgtgtgccaccattgctgcactgcagccggagggtgctatcgttgtggatgaggcactcaccagcgggactgcctactgggaggcctcctccggctgcccacagttttcacacctcacgctgacgggcggggccattggggcaggtatcccaatggccgttggggcggccatggcgtgccctgctcgtcgtgtcatcaatattcaggtgggcagcactgctgatgcagggaggagggaggctgctctgggacgcgaaggtttgtgggcctga

SEQ ID NO: 1367 - DNA, 909 bp, Chlorella protothecoides
atgcagcggcatgcccattacctttgtggaactacacccctcttgctcagcctgtggcactctcgacctccacctcgccccacagaccgccccgatgccgccatcaccgggggtctggctgtcgcggtgcccatggagctccagggcctgcacagcgtgcacagtaggcacggggcgctcccctggtcagacgtggtggcccccgtcgtccccgtggccgccaagggcttccccgcccacccctacctggtggcggcgctgggaaacgtgaaccagagcgcggtgctgggcgccttccccgccttccgggacgctttcttcgtgcgcgagggcggcggctggcgggccccgagggtgaacgagacgtgctgcgcgcgtcccgccctggcgcggctgctggaaagggtggcaaaggaggggccgggcgcgatgtatgagggcgagacggcggcgggactggtgctggagatcgcgggggagggcggcgtcgtgagcgaggctgacctggccggcgcgcaggccacgctgtcggtgcccagtcgggagcgggtgctggggctggagttttggaccccggggcccccgacctccgcgctgaccatcaccagcgccctccgcatcctggcaggatcccacgggtgcggcggcgctcgcaccagcccatgtcctgcatgccccacctcgaccgcaccatggcaccgcacccttgcagggtacgacctgcccctggcgggctccggagccctgggcatgcaccgcaccgttgagagcatgaagcatgcctttgcggcgcgcatgagcctcggggaccccggcccagggtcaaagttcctggacgtggatcccgtcctgcaggaccttcgctccccttcatatgcagacgccctcaggcgagtgcctggggcgtga

SEQ ID NO: 1368 - DNA, 324 bp, Chlorella protothecoides
atgcctggcgtgccggggggtgctgccccacaaggggcaagggtcttccagggtgattctattccaccactcgtcatgaggacacatggggtggtccagaagtttcccacccatgcaaagcccactcatccaagaactccgccctcttgccaccaccaccagctggcgctggggaagaaggccagggcagctggcctggtgacatacacagtgcaggacgcagggagaacgcaggtggcgccaggatccaggacggtgctggccatcggcccagcaccccgcaccgcctttgacgccatcacagggcacctcaagctcctctga

SEQ ID NO: 1369 - DNA, 1662 bp, Chlorella protothecoides
atggcctcccctaagcatgcgtgcacgcttggccccgctgccccagtcacaccatcctccgtgccctccaagtggctgtcggcctgcctggcccttgaggcaccccaaccatgcaaggcattccgtcaggccccgggatccctactcttcccaacacacctgcaccacacgccacacctcagcctcctgccctccccgccccgcagcgcctcgggcctgcgcttcaccggcgacctgaaggctcacacgcactccatcacgggcatggtgagcgcggcgcacagccccgcagccctgtacaccgccagcggggacggggtggtgcgggcctgggacctgcgggccggcgccgtggcgcaggagttccgggccggctgccggggggaggcgctgagcgtggccgtggggcccacgctggtggcggccggggtggcggacaacctggccctctgggacgcccggtcggggcgccagatggcgcactggggcgacacacacgcccaggacgtgaccgccgtgcagctgcaccccgacgcgccggcggccctggtctccgggtcggaggacggcctgctggccgtgtttgacctctcggcgggactgggtgaggggcagggtgtgtgggggggggctcgctggttggcgctggtgtatgggatccaccgcctgccctgcctgtggggggcttggcggtgggacgtcccgggccccaggtccacaggcggtcggctccgtggggtgtgtgcagatgacgcgctggccgagctgccctcttctccctgcccggaagcggctggtgcagcaaacgtgcaggcattggcatgcgtgtctctccaagggccagactcctcgactgcatcccaccctccgccccccctccaccacgcagacgaggacgagagcttccaggcggctctcaacatcgacaatgccgtggcggccacggggtggtacggacagggggggaccaagctgtggtgcaccaccgggaccgagaccctgcacctctgggagtggcaggccgcctgcaacgaggagggcggaggtgagaaacctggcgggtgggctcccgacagtgcggttgtgtggtgtctggatggacggtgctctcaacatattcgggcaaaagtctttgtgccgttcctctctgtacctgcaaggcagctcccgccagagacgctgtgtggcaccaagggtatagtgcctccctgccccgcttcaggtggccagggctccctggccgacgtcgcggacgctcgtgcgcagctgtccgcgctgacacccgatttcgagggcggcgtgtcctacctggtgggctgcagctacgacgcagcttccgggacgctgggcctgttggggggcagcctggagggcggcctgggcatctaccccgtcgtagactcggatgccgtggctcccctcagggcgccgctgagcgtgctggccggtgggcacgcagacatcgtgcggtgcgccctgcccctgggcggggggcgcgtggtgacggggggtgaggacgcgcgggtgtgcctgtgggacctgacgcagaacggcgcggattccagccagggtgctggctctgtggggccggccgcgccccccgctccgggacggggctccaagcacgcgccgcagcacacgcggcggaccagcccctactga

SEQ ID NO: 1370 - DNA, 1794 bp, Chlorella protothecoides
atgaccagcaccatcctgttggcggtgcactgtaagaagggggagtctctggacctgagaaaggctgtgaacacgtatgtggccggcacctacggcgtgcaggtgggtgatccgggcgggggtgtggctgcttgcaggagggccctgtctcactcaccagccggccggtgtgttcctgcggcccccggcctactcccattcccggcaccttaccctcctccacaggcggcggaggaggctggggacgacatgcaggagatccagtccctgcgcgacgacatcgtcaacctgtccggctccctgcagcacctgcgccgcacgctgtccaagtactaccgcatgctggccctgatggagtcgcgcttccccctgtccaggtctcgggagggggtcaacctgaccttctcctgggcggacgccttcaagccctccaagcgcgccgagcaggcctcgctcgacttcgagcgcgccgccatcctgttcaacctcggcgccgtggcctcgcagcagggcctggcctgcgagcgccggtccgaggcgggtctgcgcgagtcggcgcgggtgttccaggaggcggcgggctacttcgcggcgctgcgggaggggccgtgcctcaggatcgagcgccccgcgcccatggacctgacgcccgaggcggcggacatgctgtgccacatgatgctggcccaggcgcaggagtgcgtgtttgagaaggccgccgcagacaggaagagcccggcgctgctggccaggccaagcgtgctggcagccacttccgagccaccctcaccgcacggaaacaaccacccccacaggctgtccaagcaggtgtccagctactatgacgactgctcccgcctgctgacgtccgcgcccctcacctcccactttgacaagtcgtgggtggcgcacgccggggtcaagtccatgctgtacgatgtggaggccatcgtgcagagcagcgcggccctggccgctgccgaccctctcgccggggtggcccaggagattgcccgtctcaaggtcttgtgtgagtggaactgcgcacgtcagggtgtcccctgcaccatcgatgggcctcacgacactgttttcccttgcccccgcctgcgccaggcggcccagatcgtgctggcccgggcgcgcaaggacgccaaggccaccagcaaggagctgcaggagaacgtggccgccaaggagagccaggtggcgcagcggctggccaaggccgagcgcgagaacgccaccgtgtacttgcagcgcgtgccagccgaggcggacctgccccccatcgcgccggcctccctggtgaaaccagtggcgcccgcagacctggaggcggtggacgacgaggtgaggaacctcttctcctccgtcatcccagacgccaggtggggctgggttcccggggaggagggagggccaggtgcccgcggaccgcagggtgtggggtacgctctggccagtgaagcgccaggcccttgctccttcaagcagtctcagctgtgtcttctgggtggcactctggtctggcatggaccagatcttgcatgccccatgccagccgggcatcgtctacatagaagtcctggtggcaggacttggtcgctgcgcctgcaccggccgctcaggctccctgtgacactcctctccaccgcgcagcgcaaaggcgctgtctcgctacacagaaatggtggacatcgtgatccggaaagccacggaggccctggatgcagcatccgacgaggcgcggctgcggctgagggagtgggacctccccgaggcgagtggtga

SEQ ID NO: 1371 - DNA, 411 bp, Chlorella protothecoides
atgccaggcgctgtgaccatgcatgcgattctgcccagcgctgccaccaggccggtggcattgacgcgtggtgcgcccttccgggcgcggcccccccatgatgcgagccagaaggccttggcccgacgattgcataccatgaggaacgagagggccggaaaggtggtgtgtgctgccgcggcagacgactcgcccgatggtaaccccgctccgaaagccctggctccctccccaccgaccacgtccctgggagagatggcctcgtactacttgtctgtacagccccacctcttccaagagactgtggaccggcagttcagcctgctccaggaggcaaaggagaaggaccaggccagcgagagtggggagggcacgagcagcacctccacagatctggttctgtccaggtag

SEQ ID NO: 1372 - DNA, 1392 bp, Chlorella protothecoides
atggctggtactgagacaggcgcaacagcggtgatccgaggcgcccgcgatgcgggcatcgaggtctgcttcgccaatccaggtgggtcaggagcgcacatcgggtaccggcggacctccgagatgcacttcgtgtcggccctggaccaggtccccggcatccgcgcggtgctgggcctgcacgagacggtatgcaccggggccgccgatgggtacgggcgcatggcgggcaagccggccatggccctgctgcacctgggccccggcctggccaacggcctggccaacctgcacaatgcccggcgggcccgcacccccaccctggccctggtaggggacatggccacctggcaccagcccgccgacgcggtgctggccatggacatcgactccctggcgcgcacggtcagcgaggaggtgcaccgcgcgggggccgggggcgaggacttccgccacctcgccgagcgggccgcggaggcgcggggggtgaccaccctggtggtcccgcacgacgtctcctggacgagggtgcctgcgcccgaggatggcgtcaagggggggggaagggagggctcggggcccggcgccgcgcccgcaccgccccccgggacggaagagtttgtcagggacctggccgctgcgatgagggcggcgtcccagggacgcctgggcatctactgcggcggcaaggcgctcatcgatgacggtacgtgggtgcggctcgggcgggcagtctgtatggtcatgcattttcgggggagggtgaggcaggtgctgcctgcctctgcatgccagcccggggtggactggctcgaccgtgtgggccgtgatgatcgaccgtcacctcgtgacttgggtgcagcaacgcggtccgtcccactcgcacacccagagggcgcgctgcggctgttgggccagattgcagcggcctcaggggccgacctgctgtgtgagaattcgttcgccagggtcgaccgtggccatggtctcccaaagtttcgacgtgtgccctacttcccccaggtgagggtgggaggctcacggactcggtggtgtggagaggtccgctgcagctggttgctgatgagaaccaaaggaacccttctgtggcgaggtgacagtcaggatggtcacgctcgtagccttctgcatccttcctcccacaatgcactggatcgcataccgctgcaggaagcatcggcggccctgggcaagtatgagaccctggtactcgtggatgctcgacgccctgttgccaactttggatacgagggcggtcccagtcagttggtcacgcagagcgtgagtgggctggggccgcaggagcctggttgtatatgggccggggaaggcgatgaaatcatactggggcccacctcgtgcgcgcagtga

SEQ ID NO: 1373 - DNA, 1164 bp, Chlorella protothecoides
atgtcgccgccaccccctctcaggaaactggtccgacttccatcgccccctcctccccaccgtcaggccctgcaagccctggaggccggctccgtagcggcgctgccggatgctgtccgctccgagcttgaggatgtggagcggagtgggggcctcaagcacctccaggaggtggcccagcaagtgaagggaatgacatgcgtaccatgggaggaggccgaggcgtccctggcaagcacggacggggatggtgattgtgggggaggcatctcaggactggcggtgccatcttccgatgcagctttcaagatttcgccttggatggttgactgcatccggaatccaaacctgctcctcccatctcccaacccttgggcccgtctggtcgtgtgccgatgccacagcccttccctccccgaccgcctccaggaggtgcgccgggtggcggtggaggagctgcaggcggtggcgcgggacctggccaacgaggaggccgacgacgagcagctgaggtgcgcggcgcaggggcgcgtcgagggtggggccaggtgcgggccgcatgcgtccggggcacgccgcgccgcgcactgctcgggcgcaggcactcccgccgaccgcatggctggagccgtggcccaggcccacctcccacacacccccaagcccatcctgctcccagggctcaccacggctcgcgctggaaccgtgcacccagctcccagctcacacggggcctgcgcgacagggtggcggggtaccagtccaacctggcggtggctggggagagcgactccaggtgcgggtggcccccgggacgcggcggcacaaggatcaccccgggttgggagggatgcatgtgtcgccggtccctgcacctggctgcagccaggccgggcgtccccccgctgcctgcaccatcctggtcctcctgctggcgcacacctcgacagctcaccactcgtcgccccggtgaccaggttggagcgccgcctggcgggggagtctgcggcctttgctgcgctgggcatcgaagccgccgctgcggagatgccgcgactccaggtgggacgtgtgcactcggaggggcattctggatggtacggcccccctgctgtcttgaaccacctggcagtggggacctgtgtccatctggtcgctccttga

SEQ ID NO: 1374 - DNA, 456 bp, Chlorella protothecoides
atgttccacctgttcaccgagcgcaggctggtgacgcaggagggcggcgccctggtggagcgccagaccaaggcactgtttggcgaccccaaggcgctgcagcgccagatgcaggaggcggtgggcaaggacatcgcctccctggacgatctcatggagcgcgtgcaaaagggggcattgggatgctgggcgccaccccagtgtgcgaaggagcgagccgcgctcttgcgccgccccgtccattggtctgttcaacccacaccgtgcatcaacccccaggcggtggccgacggcaaggtggagaccctgaccctgacagtggggacacagcgccgcgccgtgctggaggccgtggcatacggcgttttcctgagggatgtggagtcctgggtggacggcgagtatgcgctactgtctccccacaggggtgggggttctgcgggcctgtccctgtga

SEQ ID NO: 1375 - DNA, 264 bp, Chlorella protothecoides
atgtgcagggaggacgatgaatgccttggcgtccatacccctgtctcttggctacaggtcaacgatgaactgaagatgggcaaagggaagataggcgctcagtgtgcacacgcggctgtcggcgcggtggagctggccaccctccgggcgccgcacgtcctggacgcatgggagagcaggggccaggccaaaatctgcctgcgcgccgattcgactgcagccctggtgaggccgcagggcgtgcggggcgtgagtggggcgtga

SEQ ID NO: 1376 - DNA, 672 bp, Chlorella protothecoides
atggccgaggtgcagcgtgcagagcgcggccgcgcggtggaggacctcatgtatgtctgcatcctgggcaagtttcgggacctgggcgtggacatgctgccccggatcgaggaggtgcaggagagctccgacacactgcgcgcgctgaccgagggcgtgcactcgcgcgaggcgctggacatggtgaaggagcacgtgctgggcgtgctggggcccgcctcaatggcctacgctgccaccaagatcaagatgtccgccctgcaggccgcccaggtctacgctgcctcggtgctctttgggtactttttgcggagggtggacacccgcttccagctggccaagtcgctggacatgctgccggagagccaggaggaagctgtggccaggctcgaacgcctcttctctgcggcggacgacgggcttccagaaggtgccacgccccaccctgaggttccagggagcgatgcagcggctgccaagccggcagaggagagtgaggcagccagcagcgacaggccgcccgccgaccagccgccgccgacctcggccctggtgaagaagacaaagggtgcgctgcggcgctacgtcgagtcctttgaccagcagacgatgctggacatggccaagtgggtggggactggggaggcagaaggattgttcgtggcagggtaa

SEQ ID NO: 1377 - DNA, 528 bp, Chlorella protothecoides
atgccaacttgctgctctccactgcttcacccaccatcacatcccctttcaggcgacattgaccctgccattgtgacgtatctgttgggccaaggccactccggggcggaggtggatgcgctgctgaacaagcggagtgggttcctgggcctgaccgggcactccgacctgcgcgctgtcatcgacggcgctgcagccggcagcgcccccgaccggattgcgctggacgtgtggcggcaccgcatccgcaagtacattggcgcctacgcgctccagatgggcggccccctggatgccctgatcttctccgccggcataggggagaacagctccatcctgcgcgccttcctgctggaggggctggagtggtatggcatcgcgctggacgaagaaagtaataaggcggccgtggacggggtggcgggcaacatcacggcgccgggggcaaaggtgcaggtgctggtgattcccacggacgaggagctgtccattgcggagcaggccatagaggtcgtggaccgcacctga

SEQ ID NO: 1378 - DNA, 357 bp, Chlorella protothecoides
atgaagcacgccatgggtttgaaagacccctctgagagcatgtatggcgtgacagaggaggaggcaaagcgcctgttgaccctgggaagattcgatgagctcatggacagggtaggtggtggattgaaggaggcagcactccggggaaagttggcaatgaagaaggccaaggacgtgatcctgctggagggcgccaccgtgcgcgggctgctgggcaaccacaacgagctgaacgccaagattgccgccgagctggacacctccatcctcatggtggggtgggctcggattcctgggcgtgatgctgggaaggagtggagtgcacagtcggtatgcgggcctgattccaggtcttag

SEQ ID NO: 1379 - DNA, 1014 bp, Chlorella protothecoides
ctgattgaaggatttcctggattgccacgtccaatcttcaatctcgatcatttcgcatgggagataatgttgagagtgagcactggccccatcgacaggaatgctgaccctgaatcgaaacaaacagccgacgatgaggattacgccggtcagttagcccggctgatgagctgtcagctggagggcgagcccgtcgtgacggtccggcaactctcgaatgcccgcgtgaatgtcagcgctgtggagtcatcggagccccaaaaggagttcatgccgcacacggcccgcctgcgcagcatggacttctcggctcatgcccaagatggactggactgccagccggtgggacctggacagtgccctcaagtcagagcaggaggcggcgggcaagcgggcggtgtgggagactggcctgctcctggcggaggacacgctgcgggcgcggctgaggaagctcagcctggatctgcacataatggagggggacggcaactgccagtttcgctccgtggctcactcggtctacggtgggtgcaggggagctacgcggaggcacagcagcggggcggcgggggcgtcccttggttctgtgcatggccctgccatgcatcatcgcctgcatgtgagcttgggtactgtaacccagccgccggccacaggcgccctgcagggtgcacacccaacagaacgcctcactgcaggaaggctcgaggtgtgcaggaaggacagcctcaccaggtcccttacttcccatgcctcacattcgccacaggctcccaagagcagcacatgcgggtccgccgggcggcgatcatgcacatgcgacgctgccccgacgagttccgtgctttcctgggctccgattttgacgcctacctggcatcaatgagcgagtctggcgtctggggcgacgaactgaccctggaggaggaagcctgcctcattactccggctaagcacatattctctggtgttccatctcatgagagtgctgccgtgtccaggtgggtgtga

SEQ ID NO: 1380 - DNA, 1653 bp, Chlorella protothecoides
  modified_base (1012)..(1021): a, c, t, g, unknown or other
  modified_base (1211)..(1220): a, c, t, g, unknown or other
  modified_base (1408)..(1417): a, c, t, g, unknown or other
atgacagtgctgccgtgtccaggtgggtgtgaaactctttgtgccaaacattccgaaccgccaccccgcgtcatgcagagggccatcagcgacgccctctgcatcaccatctcggtggtcatcggcgcaactcagatggtacggtacatcccaaccgactacaggcaggggaagacggtgaggcgcatgtgggtgggcaggacagatgcgtggacaggcaatcgtgcaggactggtttgggtaggggtggctgccccgagctcctgcgctgaggccaggatgcagggccatgtactgacagcaacaccattgtttgatagtcgggtccacactccacacagctgggtggaagaaaggacgcctcggtctactcatcaattaagcaatagggtcctttcgcggaatacttcacgccggcaagatgggggacacgaactccgacagtcccactgcctccccggaggctgccttcgaagcacctcccacagcaaccgtgtcgctgagagaagatcagctgcagaatgctgtttccttcctctcccaccccaaggtagggccttcacttgcgtggacttggcccttgcccgacctgggaccgctccttggaggactgtaccttgcacaggtccggacctcactccgtcccatcggcctttccaggtccggtcgtcggctgtggagcagaagcggcagttcctgcagcgcaagggcctgaccgacgcggagattgaggaggcattcaggcgggtcccggaagcccctgctgcggcctatgtacctgccccatctccacactccgtggtggccgtgccagcggggaccgtggcgccggctgggtacgtccccgtgcagcagcagcagcagcagctggtgtctgcacagccccaacctgtgcgatggggacaggggatgcccacctcatacattgtcgttgcccaaaacatccaccacccccaactccgacaggccatgctgggcgcggcctttgtcgccgcgggcgtctacgccctcnnnnnnnnnnctggtaagggacacgggaggaagcatcatgctcaaagatctgctctaggcccctattgtttcattgggccgctgttgtttggagaggatgcccatctcatacattgtcgttgcccaagacatccaccaaccccaactccgacaggccatgctgggcgcagcctttgtcgccgcgggcgtctacgccctcnnnnnnnnnnctttgctgttccaacaatccgtatcccagcctgctcagctcatgggccaccctgccctgcccgctccctgcaggcccagacgtccgagctgcggaatacggtggagctgctgcagaagctgaccgtgagcctggagtcgagcgttgcagagtccaaacgcgccgcccaggattcgctcagcttggccnnnnnnnnnnttttgctgttccaacaatccgcatcccagcctgctcagctcatggggcacccctgccctgccctctccctgcaggcccagacctccgagctgcggaacacggtggagctgctgcagaagttgaccgtgagcctggaggcgagcgttgcagagtccaagcgcgccgcccaggattcgctcagcttggccgacctgagggctgaactgcgcactctggccggcaccatccgagagtga

SEQ ID NO: 1381 - DNA, 381 bp, Chlorella protothecoides
atgcccctcacattttcacttgtggcgagcgggcgcatttgcccgaccagcacatcgtacggacccagcagcacttctcttcaggcacatggtgccttcttcggtccctcgagagtagcccctaagcagaggaaggcccggcgctccatcttggcttcgcgtcaaccccggcgagtgcgattaaatgcggtggcagcagcgtctgaccaggccctggagttgacagaggccaatgtggagaaggtcctggacgagatccggccatacctcatggctgatggcggcaacgtggagttcgtagagatcgatggacccgtggtctacctcaggtcaggaagcacatgtgcctcccactggagggccaggggccctgtgtcatag

SEQ ID NO: 1382 - DNA, 897 bp, Chlorella protothecoides
  modified_base (378)..(387): a, c, t, g, unknown or other
  modified_base (836)..(845): a, c, t, g, unknown or other
atggcggtgaagaccgagggcgtcagcgaggcgcacgccaagctctggctgcggcgcctcagcctgcgcggcgggggcggccccccgccccgccccgtctggcactggcactacgctgcctggcccgaccacggcgtgccggcgtcgccggaggcgctgctgcggctggtgggcgagctggctcctgtgcagacccccatcctcgcccactgctctggtggggggggggttccgaggggggttggttctgtggaggaggggtcgggtgagcgcggcgttgcctgtgcggctggtgacccatgtcggagcgggtggctggccgtggtctcccctccccagggctcctcaccgtcctctccccgccccaccccccaaacnnnnnnnnnnctgtggaggaggggtcgggtgagcgcggcgctgcctatgcggctggttacccatgccggagcgggtggttggccgtggtttcccctccctagggctcctcaccgtcctctccccgcccacccccccaaaatcctcagccggcatcgggcggtctggcgtgtttgcggtgctgctggtggccgtgcgccgggcggaggccgcgctgagcggcgcgcgccccgccagcgcggaggacctggccgacctgcgcggcctggtggccgcgtgtcgtgcccagcgtgcggggtgcgtgcagactctggcccagtacgcctttgtgcacacggccctcaagcgctgggcgggcgagcgcctgggggaggcggaggaccagggcgcgtgagccttgatccgatctcagagccaagtgcccagggcgcgtgcccggccccctggctgttgcaccctgnnnnnnnnnncaagcgctgggcgggcgagcgcctgggggatgcggaggaccagggcgcgtga

SEQ ID NO: 1383 - DNA, 684 bp, Chlorella protothecoides
atgagcagctgcgaagtcgtccagctcccggcccgtggcactctcgacgtgtttgcacatcagattccggaggtcctgcgcgccctgttgcacaccatcatcttccacagggcactcggactcgtgaggccccaggaggtagactcccagctctttgatctcacctgggtaagttgtacaacgggggcccctgctggtcctccgcccattcaagccgtaggcccacccaacaggatcaccccgccatccgcaggtccagtgtggggatccgagcgtcgagcgcaggatcgaggacaagatagcccaattcacggcctgggtcgagaagaaccccagcaagcgcggccaggtgggaatggcatgggcagggtgggtgaccaccccatggccgccttgcgaatcaccatgcagcctgcatcgtcccgcgtcctcaccctttgcacgccatcaccctgcttcagcctcttcgtgcatctttccttcccaggtttgcttgtccttctacgagaagcgtcagaaggcggcttggtttgggtcccaggaacagcgcctgtactgggagcagtggtgagaggcagtggcaggcgccctgtgcgggagacgtgtgatggtggacctcagcatgcgctgccggtggctctcctactcggcctaggggctttgggtccctggcctgctgagtga

SEQ ID NO: 1384 - DNA, 966 bp, Chlorella protothecoides
  modified_base (605)..(614): a, c, t, g, unknown or other
atgcctcatagcattaatctatgtgctgattcttgggctgggatgtcgaccgagcttgtgggccgggttcaacgcgacagatttgacggagtggcccaggcccagggtgattgggagagccggaaggaaagtgggaaaccgactttaggttgtgtgggtgaagactaccaatccagggccttcccccgacatcttcccccaccattgcaactgtcttgttacatcgtttcgtgccccgcggcaccagacccaatctccgtcctcggtcccggacaccaagctctgcagcaacaattgcggctttttcgggtaagattgggagcgcgcggtcggtgcgctcgatgtgcgcgtcagtctcggagcttcctgaagggagggcatgtgcagcaagtgctggcgggacaccgaggtccagcggcagaagctgacccggcctcccgggctggtcaccccgggccccctccccatcgagccagcggcggtgccattgcccacagcgccctcctcccgcgcggaggagcaggctgcagtccaagccccccctcgggccccagtgccagccgcccagccatccgttccagccatcgaggctgcagcagatgccnnnnnnnnnntgagccagcggcggtgccattgcctacagcgccctcctcccgcgcgaaggagcaggctgcagtccaagctccccctcgggccccagtgctagccgcccagccctctgttccagccatcgaggctgcagcagatgcccctgcccgccccgtgcaggcccagcgcaatcgctgcttcggctgcaacaagaaagtgggcctgctggggttcgagtgccggtgcggcttcgtgttctgctcctcgcaccgccatgccgcggaccatgcctgcacctttgactatgtgggcatggacagggcccgcctggcagcccagaaccccctggtcgcagcctccaagcttgacaaactctga

SEQ ID NO: 1385 - DNA, 381 bp, Chlorella protothecoides
atgccacaggcgctggtggcacgccttgccgcaaagctgagccccaagctgctggaagccgagttcctggcgcttgggcaggaggacgcggccgccgtcgcggcggccgctgctgcgggcggcttctcggcggctaccggctgcatggagcgcaatcgctactccgacgtcctgccctttgacgaccaccgcatccgcctgcggcgggagcccagccctggcgacgcggggaccgtctcggacccgctgtacatcaatgcctcgccgctggagggggcgccgggggacgtcccctggcacctcaccctggcccaggtgcggggtttacctgacgaggccgttcagcaccggggcctgattcggggaatgggatctgattga

SEQ ID NO: 1386 - DNA, 507 bp, Chlorella protothecoides
atgctttctgatgacggatgtctgatgcctgcgggccgtctccatgatgtttccgacccgcacgaccgtgcagtttctccagagacagctccagaactgttcgtcagcatggccaaaggcggtgatgtggccagggcagagaaagccctcctggagcatggaagaacgactaccctcctccccctcgctctgaatcaagtcgtgaaatcaaatcctcccacagggacatcgcatccgggcatggactcggtggcggtttctgtgctggtcatcaagtccctggcggcgctgaggaccccgctggtggaccccggttcgtgccagcagctcctcggccttgctttttcccgcgatggacctcaagtgaagctgtcctgcctcacacagatcatgggctcccgctctggggtccaccatggtgagggcgcctgcttgatgacttggaatgggttggctggttgctctgtggctaggtctgaagtggtgatggagacactctgggcatag

SEQ ID NO: 1387 - DNA, 390 bp, Chlorella protothecoides
atgcgcatccaattgaggtgcgcgtgtcaagtgtcgatggtggtgctgccagcgcctgcacaggaccccttcctaacctgcacttctcctcctcctcggcagacatgccctctggctgatgggggcacctggggccaggccacacagagcacggctgcacggcatttgtccagcaaagtgacgaagcaggacctcattgtccgttttaaagcttacaaggttgcgaatgtgcataaagcagccttgtcggaagccctggctggcagtccttacgcttggtcatgggtcagcagggacaaccctgcctctgcctttcccaccgattttggactgctgcgggtgctctccacagagattgcctctgtaacggtgcgtttgagtgctgtatga

SEQ ID NO: 1388 - DNA, 3363 bp, Chlorella protothecoides
  modified_base (778)..(787): a, c, t, g, unknown or other
  modified_base (859)..(868): a, c, t, g, unknown or other
  modified_base (3087)..(3121): a, c, t, g, unknown or other
atggcatccaagcatgtgctcattcttgggggcaccggccgcgtggggtcctcgactgcagcatccttgctgcggacgcaccctgacatccggatctccttggggagtcggggcatggagtcccatggcgccgcagtgctgaggaggccagagctgcgtgactgcccctggatcggctgcgacgctcgggacgcgcacagcctggacaaggctctctccagcagcggcgtggacctggtggtgcatgcggccggccccttccagggcgacgcggcctgctcccccttggaggcggccatccggcatggtgtgccctacatggacgtctgcgacgacgcgatgtatgcgcagcgcgccaagcgcctggagccggccgccagggcggcgggggtgcccgccctctccactgccggcatcttcccaggtctcagcaacgtcatggcagcagacatggtgactcgccacgcgggcgggagggcccctgcccgagtcctgtactcctactacactgccgggacggggggcgcggggcctacgatcctggagaccaccttcctcctggcggggcaggatgtggtggtgtaccggtgcgtactgctgagggttggtagtgtggggatggggacttctgaggcagccactggccgaggtcctgccatcgcggccttgtccagggatggcaagcagctcactgtgccagccatcagcaacaggcgtcctgtggactttgggaccactatcgggaccaaggatggcaagcagctcactgtgccagccnnnnnnnnnngccggctctgcatgcacataacggctcactatccatccaactgcaggtccgtgtacctctacaacctgccgnnnnnnnnnncgcctcgaccagggcggagtcctgacaatggattgcctgcccacgaaaaccgtcgtgctcaaccatatgcaacccggccctgcatgcacataacgactcactatccatccaattgcaggtccgtgtacctctacaacctgccggaaacgcacactggccgggctgtgttccaggcccccagcatcagtgcccgtttcgggattgaccccggcgtcttcaatgtcgccatgatcctggtcgcccgcctcttgccgaaacgtagggaaggaggtggcgtgatgggcagggtggcacagcattggcacctgcttccctacgatgaccaaaggagcaggcaggcgactatggtcctctcagccgtgaccaaattttcctcaattccaggttggctggaagatcgtgccctggtgcagaccctggccaagctgactgcgcccctggtggccctggtggatcgctttgctggcgacagggtgggcatgctgatcgaggtcgagctcgaaggtgtagtcgatgagagtgtggatctgtcctactcctttctggttttatctgatcatgccaacactgaacttctacagttcagcaatttttcagttcttgaatactcgacgatgtgtgacaaggcgcactcaatcccaagcgtgcatcattggttcaagttcgatctagggtttggtttccatgtccaactcccaaaccattcacagatggaaaggtgctggccagcctgtacgtgcacgaccacctggcagagggcatgggcgctgcagtggcagcctttgcagcctcaatgctcaagagtgagtggtttcttccttgccccatttctgttttcaaagccagatagatatgcttggctccgctggactgatacaaagctcgcagtgcatgccagctccgtgggcagcatcctccacggaacgaggcatgctcggtgcctgaccgctccgccttcttctcggccgcgtcggagggggcacgcaccttccagctgggccgggccgcctgggagatcggcagcaccccccgccgctttggcatgggcatctacctctgagcctggtgtgctgctgtgctgccggcgagtgcagagtgtggggcgagtggcctggacccccttttgtgagcacgcgaggccggcccgtcccttacgttctgagtatgtcacacgcgtgcctgcccaggcatcagcaaggctgcagctgagcgcaggggggtcatggtacagggcgatcaggcatgaatcagtgcttggcatgcccgccctcccagccgtagaccaccgccaggagctggcagaaggccaggaaggagcagacgccgaccagccagatgacggtggcctccaggacgccaaagtaggagtcgtgcgcctgctggcgcaggatgtccagcatctccttcatcaccccgaaccggtcgttgagcagggtcacgcgctgcaccacctccatgtagtcaaagatggagcggtagagggtgcagatgtggtcgtccgcctcgtccagcgcggacggcgcgtccaggagctgggtcagcaggttgacggagcgctgctgcaggaagagctggcccatcagctgcatcaccgcgcggccacccacatcgatctcacccttgtctggggatgggcagggggagggaagtggtggaggtcggggatgtggcagtgtgagagggagcttgcacatcaccactcgcccttcatgatcccaacccagacgctcaccggccatcatggcggggaggtaggacaccgacctcccgaggctgcgcaggtcctcctcaaacacgctgagcttggtggactccgccagggcaaagctgatggccagcttcacgtacagctcgtccgcgtggcggtagtgcagggagatggtgtcgtcctcaatcacggccttggtgacggccgagtaggtgaccaaaacacggtcccgctcgatgcggtcgggcggcagggggcggtccacacacggcatcaccagctcgttcaatatgtacctgccagggaaagcaaggaggggcgaggcagggtgttgggtcccaagacgggcttcacagggtactgcaagggggtcccaagacggggcttcagagggtactgcaaggggtactggtgcactccccccacttcgatcctgaatctggggcacagcgtgcgtactgcaccgccctcgacccgaccaaatcgcatccgctgcccgccagccgcccannnnnnnnnnnnnnnnnnnnnnnnnnnnnnnnnnncgaggccccagaacacgacgacacccgagtcgaagaagaaaatgtccgcattccctttgcccttgccaccccggtggtactgtatgcaaagcacctgtgcggcgataggggaagaacatcaggcgttgagtgggaagcgaccgccgtgtctggccagccttaagttgtgccggtgccatgcgcgcgccccctcccaacccccacccaccccacgtcaagcatcgagacctacatcagagtag

SEQ ID NO: 1389 - DNA, 504 bp, Chlorella protothecoides
atgtcagcgccaggggaggaggtgctgttggccgtggagaccgtcgaggaggagaaggttgaagcagagacgagaaccgtcgaccatcagaggagtagatccgtcccgagcgtccgagagctgagggtgggctgggacacgcatcgagtgtggtccacagggctaggtttttcttcgggtgcccccttcaaaggatccgcactgggcgatttgctcctccccttctttcctcccactgcgcagcgtctgccctcctccacctccactgtccgacccctgggccgcatcgtctccttgggtcctggatgggagagtcccctggacgtggagaagccggtggaggctccgcctgaggtgcccgtgcaatatcaagggctgggacaggcggtgcgggtgcgcagctactgcgtcgcaaacgggtttgaccggtacgccctccaagacgccatcctgcgacggaatgccacgttgcgagcctactctgatgtgggtctctatgcttga

SEQ ID NO: 1390 - DNA, 1047 bp, Chlorella protothecoides
  modified_base (142)..(151): a, c, t, g, unknown or other
  modified_base (801)..(810): a, c, t, g, unknown or other
atgatgaagcgcactcgatttgcatgcttgaacataaaatcctccttccctgtccctgcgaacccgaaattgcagaaacctggccccgatcgacgggcgacaaagatctcccggcttggcgccaacgctcatgtggccaagnnnnnnnnnngctgcgaacccggaattgcagaaacctggccccgatcgaggggagacaaagatttctcggcttggcgccaacgctcatgtggccaagtgcaggctcgcctgcggacctgcctgggctacctgccctgcatcaccctgctgccaccatatcgagaagaggataggcggtacaacgcacgattggcagctgtagactggcgttgtgaggagttcaggaagtacacaatggtgaagctcgtcagattcctgatgaagctgtcgaatgagaaggtgcagatcgagctgaagaatggaacggtggttgccggcaccatcaccggtgagttccccgcagtctccggcgggattgattgctgggccaggtacgcaagctgtcgtgggtctacctctcaccctcccatgcctcctcccccgcgcgcacaggcatgtccctgcgtgggaacacaatccgctactacctcctccccgactccctcaatctcgacaccctgctggtggacctggaccaggccaagacacgacccaaacgtgcagaacggccggcaggaggaagagggcgcggcagggggcgcggccgtggccgcggaaggggtcgtgcttgatatttgggataatggcatacagcaagtcgccactgaagcatggcaccannnnnnnnnngcgcgcagaacggccggcaggaggaagggggcgcggcagggggcgcggccgtggccgtggcaggggtcgtgcttgatacccgggataatggcacacagcaagtcgccactgaagcatggcaccagctgcttcagcggatggcctgccctcatggactattgcttgctcagtcccggcaacccctgcgctccgtctcactgtgcatcacggactcttcgcatgcatggcaactgctga

SEQ ID NO: 1391 - DNA, 879 bp, Chlorella protothecoides
  modified_base (139)..(148): a, c, t, g, unknown or other
  modified_base (425)..(434): a, c, t, g, unknown or other
atgggcttgatggcgaggaacattgggttatcgcagagcatgggcatttgtgcaccgaatacaagggggcgcacgatggacagctcattcccaatcacactctacactctgctgatgcagttttatgaggttccctggnnnnnnnnnnaggctctgattggtgcttggggctttggaatatgggctagatggcgagaagcattggctcatcgcagagcatgggcatttgtgcaccgagtgcaaggacagcatcgggcccttggaggagcgatcaggacacatgaacggtggggcttcttggcgattggcgatggtactggtcttgcagctgcacctcctgcgtttcagtcggctgggcgtcacggggagttgccatggctgctgcccctcccaggcctccccttcttcctgaccacccaccgatnnnnnnnnnnatactggtcttgcagccgcacctcctgcgtttctgttggctgggcgtcatggggacttgccatggctgctgcccctcccaagcctccccttcttcctgaccacccaccgatatactcccccatggacgacgcctgttcaggcgtctggggctactggtcgacggatggcctgggcctgttcgagtacatgcagctggcagaggccctggacacagagccggtgtgggtgatcaacaatggcgtggcccacgccgacagtgagcgctcgggggcaggggaggactgcgcagtcgactgcgtggagggcgcctcgtcgaggatcgaccacgcgatatgcagggcgccgcaggctgcaaagcaaactgcacccactggatcagcaacagcgtacttccaaagtctaatgcctgtactcctgtgttctgttcccacagatgatgaatga

SEQ ID NO: 1392 - DNA, 873 bp, Chlorella protothecoides
  modified_base (503)..(512): a, c, t, g, unknown or other
atgagagcgccctcacccaaccccacccacaatcactctcgcttaacaggtgtgccggcatcggacatctggccctacgtccaggacgccctcgactctctggagttcatcctgggctcccctgactcccgctggggctccgtcaggtcgagcatgggacgggagcagccctggaacatcacctatgtggccatcggcaacgaggactgcgggaagtggatgtacctgaacaattaccttgccttcttcggcgccctgcgcggcgcgcatccccacctgcgcctgatcagcaactgcgacatgggccgcgatgcgcccactgacatctgggactggcacatctacaccaacccccgcgacctcttcaacaagcgcaatatcttcgatgggcggaggccggaggtggggtcaattagggggatttgggagggggggggttggaaagggaggcgcccagggctgcacgcgtatgaatgcagaactgaaaggatttgggatgggcnnnnnnnnnncggggttttgaaaggggggcgcccagggctgcacctgtataaatgcagaactgaaaggatttgggatgggtcaaaggaagtgctcgagaatcacgcgccgctcgtcgctgcctgcttccagaccatgcgtctatgcaaacaactctcaatcactttgcggatcatgaccacagcccatccccgcaacctccctcccccccacacacacacacttggtatcaggacggccactttgtgtttgcgtccgagtacgccgtcaccgagggcgggggctggggcaaccttgtcggtgagcgcgggagcgctgcctggaggggagtcggctggggcgacgggatgtgctgatcttcaaacggattga

SEQ ID NO: 1393 - DNA, 1518 bp, Chlorella protothecoides
  modified_base (1472)..(1481): a, c, t, g, unknown or other
atgaccctggtcgactgggctcctattctggccagtgctttggcgcccaaggcgaagaggggcctcaccttgagtaaagccatcaaacgctgcgtgaaggaggccggcaagacgcatgctgtgtcaaagtcagagcttaccgccgagttcaaggcatacattagtagtcggaagaggtacgatgtctgcaatggtgtccttcgcaatgcatgttgcactgtggggaaaatcttccgaaatggagcagcgcatggaggtgctttggaggttaaggatggtcggatcttccctgcaaagccccggctggcctctcctcctatggagaccagttcccaagctggatcccccagcgagccgcccaagaagcgaagaaagggcacgcctgtgcgtgtggtggacaaggaagcggtaccttccccagccagtgttcccatagcggcagggacgcagcctctgcgtgaggaaaccccgagtcaaggtgctacagagttggggtctcactggaattgtttccagcatgagaagtgtccaggcagtagacagattttgaaagaaagaagggtgctcggtcgtcggtgtatcttatgcgcaccccttcctcatcccagatcctccaggtgtcagcgtcatgcccctcgccgaggtgcctggggacgcagcattgaaatggcgcgactctgtccagcggcgcgacgtgaaggcgggccccttcacccaggcagagaaggataccattcgccaagcccttgccaagtgggcagatgccattcaccctcttctactcccacaacatctccaggggagcatggccactcccagacagatttcgactgggttttcaacccccaggcttcccggtcaggcctgtggaaggcggtgggggcctacctcccacatcggactatcaaagcggtgtgggctgcctccactcgaatgcttcactccggaaactatcaggtgaagggagggatggctgtctgtgtgatatctttgggaggacgctggacgaaggaggaggatgccaagctccttgcatttgtggaggagcatggcaaatcctgggtcaaagcagaggctgccctagggcgcatggcggtgtcgtgccgggatagatggcgggaaataaggtgggcctggtgcgttgttggggatggaactgccttcgatgatgtacttgagctttgcgaaatagacttgggaacctgcctttgcctttgtttgccactggacctctggcagggcatgcggcggtggggtgcatgttctccttcacctattcagcatgccccactccccatgtgcgcaggcttgggagcgacaagaagagcggcccatggtcggcagacgagattgctcggctacgaaaggccatcgccgactacgaggaggcgcggcaggtgcgcgtcggcactgaaggaattggcgccctcagatacttgggacgctacacatgggctggagctcgtcacacnnnnnnnnnnactacgaggaggcgcggcaggtgcgcgtcgtcactga

SEQ ID NO: 1394 - DNA, 1110 bp, Chlorella protothecoides
  modified_base (887)..(896): a, c, t, g, unknown or other
atgaaggtgggcgtgctgcccgaccgcgttctgcccacgctgctggaggaccgcctggtgcagaagggcaccatcctgcagttcaccaccgagttctacgtggacttcctgtccagcgacagcgtggagacgctgatggagacgctgcgcaaggcacgactggaggggcgcctgctggagttcttcccgcagcagaagcagtcctgggcggactttgaggaccacttcaacgccgcgggcctgaagacgctggtggagtacagccggcgcaagctgtacgacgcgcactgcgcggagctgcgtgccttcgtccgcgacacggtggcggagggtggcgagggcgccgcgctgggcgcgctggttcccgccatgcaggcgcggcaggaggagtggagcctggccgacggcgacgtcgcgcgcgccgccttcctgggcctggccgacagcgtgctggcctccgccatcgggcgcaatcagcagcaggtgcaattcaacgtgctgcgcacggtgcggcattacgcacccgccctggcgcgctttgcgcgcgcgccacgtctggaggcggccctgctccagaccgtgcaggtgacgtgctacgaggagtcgcgcctgctcaagatcttcaaggacatcgtcaagatcctgtacgactgcgaggtcatcggcgagaccgccatccgccactggtacaccaaggggtccaacgccaaggggcgcaacgtcttcctccaggacatgcagcccttcatgcagtggtgtgcctgctgtgccagggggggcgggggaagtgggaggaggctccaccatgtatgtgggtgtggggcggaaggaaggccaacgaagaacagaaaagttctggctggaagtggagaggagatcgcgagttnnnnnnnnnnccaggacatgcagcccttcatgcagtggtgcgcctgctgtgccagggggggcgggggaggtgggaggaggctccaccatctatgtgggtgtggggcggaaggaaggctgacgaagaacagaaaagttctggccggaagtggagaggagatcgcgagtctgagcgtgcaggactggcagcagaggggctgcgatggtcaggaaagagggctctga

SEQ ID NO: 1395 - DNA, 1539 bp, Chlorella protothecoides
  modified_base (948)..(957): a, c, t, g, unknown or other
atgccaggtgtggacgtggatgccctggaggcagccgccgcagcagcaggaaagcaggataaggggcccgatgtggcccgcagcgatcgagctatcctcatcaagaatttaccctggtcgacgagcgaagatgagctgcagtccctctttgcggagagcgggcttcatctcgatcgagtaacaaaacattggtcacgcagtatgtttgaggctcacttcaacttcgcctgccggcattgccacgctttccttcatgccctcaccccaccctcccctgtccctggtcccctccctgtccttctcttgccaggtgaggttgcccgattcgtgctgccagacaccaaggccctggccgtcatcgagttcgaggacgcctcggacgccaagcgcgccttccggcgcctggcgtacaagccctaccaccacgtgccgctgtacctggagtgggccccgcgctccatattctccggaacccccaagccaaaggctgccaaggtgtgtgatggaggggggcgatgcggcctggggccgggctgcgtcacaatttgtggcgaagcgatggaaagggagggcagaatgacagcaaccggtgtcccaaagcagtcgccagccgcctggtcggtcttcgaggccaaggcggtgccagctgcgacgctcaccaccagccccaccataaagcccgaggctgggctgcaggcgacggcggcggcggcagtgcttccggaagacacggaggccgactcggtcagcatctacgtgaagaatctggcctgggccacgaccgacaagggcttgcatgcccactttgcagctgctgcggaggccaagggcgctgccctgcggagcgctcgtgtggccaggaaggcggggccggacggcaagcccctctccgcgggctatgggtttgtggagtgtgccacggaggcagccgccagggaacttattggnnnnnnnnnngaaggcggggccggacggcaagcccctctctgcgggctacggatagaaaaaacagggatcgtctggatgtgttgtggggaagtgctcaagggctcggttctggatggccacaagctgatgctgcagctttctcagaagcgagacgcccaggagggcaaggggggtgtgcccgccaaccttgggaccaagatcgtcgtccgaaatgtggcatttgaggccacccgcaaggacgtgctcgggctcttctcctccttcggcgacgtgaagagctgcaggctgccacgtaaatttgatggcacccacagaggctttgccttccttgagttttcgagcaagcaggaaacaaggaacgctgtggaggccgtccagggcacgcatctctacgggcgtcggttagtcatagaggtggctgctgaggacggaggactggacgagctgcgcgccaagacagccgcaaagttctcctccatcctcgggccagagacgggagccaccaagcgtgtccctgctcccatggatgccgatgcaggggcacagcttgcccagccacccacaaaacgagcgaagaaggggaaggcttga

SEQ ID NO: 1396 - DNA, 2106 bp, Chlorella protothecoides
  modified_base (193)..(202): a, c, t, g, unknown or other
  modified_base (843)..(852): a, c, t, g, unknown or other
atggagacccaagacgatccacagaaagctgtagagcgccccccctgctccagactctgcattaagaacctgcccaagtatgtcgacgaggctcgactgaaagagcacttttcggccaagggcgaggtgggaggctgggatgagctgggggctgttcgtgcaccctctcacaggtttaaacaaggattccaannnnnnnnnnaacacttgaagctgcccggtccagtctgccgatgctctgtatgggtctgtgctgcgatatataatggcccgctccccactgggaagccgccctccctgacacagcatctagcacattcacagggatggaaagtctcgatgctttgggttcattggctaccgcttgttggacgatgccgtggcagccttcaatatgctcagcagtacggccgggctgcgacggagcaccgcccctggagcaagcacacgcccggctcgagcgcgcatgacaagtctcaggccgcaaagcctgatgtggagcctgcgcctctgaaggcacgggaggccatcaaggcggccaagacgaaggcggctgccgggaagaaagctcccgaagaggccgacccaaagctggctgagttcctggagctgatggcaccccggagcaagaaagccacctggtccaacgacgacgctgtcgcggcagcggctgggtctgccagtgcagctgctgtccaacaggccgtgcaaggatcagacgacgaggagtatgaggacctggaaggtgagacgtgggccggagcgtctgtgcttgacttgctacaccccggatctcgattgcagggccgagcaccagagcaggaagcaggagtgactcatctnnnnnnnnnnctggacaactcgagactgcaggtctgtgctcgacttgctgcaccccggatctcgattgcagggctgggcaccggagcaggaagcaggagtgactcatcagacgaggaaggtgacgagactgcgcctccagcagctgagaaagaccggctggttgtggacgcgaccgtgtcccatctggactacctcaaggcccggcgaaaggctgcgttcagtgatgacgaggacgagggagaggagtccactggcgccgctgacagcgacgaggaggagctggaagccgccaccgggccatcggggggttccgaggcgggtgcagggacgagcggcagcgatgctgcttctgacgaggagggtgacgatgcggcgagcgagggcgcgcctgagcccgaccctggcatgcagcatgcctcccggaccgccgaggtgtcggacacagggcgcctcttcgtgcgcaacctgccctatgccgccacggacgatgagttgagggagctattcactgcctatggcgaggtggaggaggtccacatcgtcaaggacaggagtacatctgtgtccctcctctgtgcctgtccctcctctgtgcctgtcgataacatcctcactgctgacagcctgccaaaacccctctccacccgcccagggctacacggcagagcaagggctttgcgcacgtgctgttcagctcgcccgcagcagcggttgcagcgcaggcgggcgccgatggcgccatcttccagggcaggctcctccacgtcctgcccggcaggccagcccccaagacagaggaggagggtcccagcgatgccaagtccttcaagtccccgggcttggctagccgcagcacagagggacttcagccagtgcagcgcgcgatgtcgccctcccctgcctccccatcccactcacgagcggctcctcccagcatcaccactccccctctcctatacaggaggaacgggcgcgaagcctgaaggccggcgcggggaccaaccgcgccgcctggaactcgctgttcgtcaggcccgacacggtggccgaggcggtggccgcccactttggcatcaccaagtcggccctgctggaccgggagtcctcggatgtggcggtgcgcatggccctgggggaggcccaggtgtttgccgccaccaaggccgcgctgtccgacgcaggtgctgcgggggttgggtgaccatgggaggctggggcgtttgggagtgtttggggactgatgatgtgtttggggtccgatga

SEQ ID NO: 1397 - DNA, 594 bp, Chlorella protothecoides
atgggaaaagcaaagaagacgcggaagtttgcggaggtcaagaggatgatgagcctgaaggacgtgaaaccgcctcctatgaagaagacaaagccagaggatgaggttcgacacatgtacgacgtgcagcttttatctttcaggatcaggagtgggtgttcccgagcgacacagcttgggtctggagaaatctctgtcatccttatcatacaaccctctccccctccaaccaacacccatgcagagataaaacgccatcagctctgttcttcaggtgagatggaatgctttgagatcggtcgttgtctcacatggctgtgttccatcgcagtgatgacaagcagtgtgggactcgctgtgatgacaagcagtgtgagactcgctggtgagcagtccagcggctcattctcggacaccccttcaacctgtcagattgacctggtcaagggcatgatggactgtttgtatgcggagtgcaccccatgcatctgcgactgcgtcatggcggaactggagaaactggggcagaagtaccgagtggcgctcaagattgccaaggtctgttggtggagctggtgtgaaacgcttgcatga

SEQ ID NO: 1398 - DNA, 1623 bp, Chlorella protothecoides
  modified_base (229)..(238): a, c, t, g, unknown or other
  modified_base (524)..(533): a, c, t, g, unknown or other
  modified_base (649)..(658): a, c, t, g, unknown or other
  modified_base (1296)..(1305): a, c, t, g, unknown or other
atgccaaaagccgagagtgccagcccaaagacggagcctgtgcggagtgcagggctgacgaggggggtcgagggatcggcaccaacacacacgcgctccttactgaaagcaagcatcctcaacgtacctattgggccgcacatggtgacggctcgctcctctgtatggggcctgggttccaactattcccctgcggcgccctttgtggatgcgcgcaaggacgacgctnnnnnnnnnngaggggggtggcaaagtgggaatgtaagtatgcaatcatggcatgtagattggcaccctttgtggatgcgcgcaaggacgacgctgacttcacgcatgccctgcagatccagaccgagagcgcgatcattcgccgagcgcgcgctggttctccttggcaaacctataagtgaagcaagcccagggcctgcatacacctctgagagcacgacgtctcagataaagagggctttgtcatttaccgcgcctgctgccattgcattgacgccagagcatggaggctctgnnnnnnnnnnaaggggtgtggcaaagtgggaatgtaaggatgcactcatggcatgtaaaatggagcagccggtcccaagcttttcgtcccttgaggactgcttcagccctgcatttgaaatctggnnnnnnnnnnatgttcagcaaaatccaaagagcagtcggtcgcaaacttttcgtcccttgaagactgcttcagccctgcatttgaaatctggagcttcagcgccctatgcagcgcggcacgtggctatgccgtgcgcgagcgccaagtccgtttccgtccctgcgacgttaatgctgcccatccgcgggcgtactcggcagtgcattccgcattcagccccacgaggccaccgcctctacaccttcacaatcattcaaagactgccaggaccagccgaggctcgacggcccttcctctcaacattatcccccgacgctcccaatcccaatgacgacctgcatgcatgtaccattcagcaccgcgagcagccaccgcggactcagtgcggcggtgcgcggctgctcccacgtcggcgggaaggctgtgcggcaggcagttccagtccgcgcatcggccccggactcgcgcaccacggtgaatttggtgcctggctactgggccagggcggcgtgggagagagcgccgtccctctgaagatgcctccgtcgccagctgcatgtgcctcccccgtgacgctgctggcacatcatccaacaccttccacccctgcaatgcccagggacgtgacgcgtgcctgcggcatcatnnnnnnnnnnagcatggacgtgacgcgtgcctgcggcatcatcggcgtgtcgacgcaagaaagcgacgccaacctggagatctatgagggcttgctcatgctgcagcaccgtggccaggactcagccggcatcgtgaccacggaccgcacccgctttcacgagcacaagggcaacggcctggtcaaggacgtgtttgacagccaggacgtcctggggaagctgacaggtgggtgtgatgggatggggtggagctgggggggatggggtggagctggggggacggggcgttgtccatcgcatacctcatcggcggcaatggatgcttga

SEQ ID NO: 1399 - DNA, 570 bp, Chlorella protothecoides
atgtgcgggacgacaggcgcatgggatgggacaggggctccgcgctcttcctctgacctctcacccccctttggatcccccttcctcccccctctccttcccaccaccatcaacgataccctccacgcaccggatgccgtgcgggtcccggaaggccagcaggccgacgccgttgatgagggcgatgcaggagtaggcgccctggatcagcttcatggtggccgccacggcctcggccaccaggtccagcttcttgcggttggggtcgcaggcgtcctccagcaagcagcgctggtgggcgcggtggatctcgtccgccagcacgttgagcaggacctccgagtcggagctggtgcgcatgcagcggttgaagaaggaggtgctgctgttcagcagcgtgcgcagcgcgtccgtgttggtcaggttgccgttgtggatcaggtagatgcccagcggggagttgacgaagaagggctgcgcctcctgcaccgaggacgagccggccgtggggtaccgcacatgccccagcccggtgctgcctgcacgtgtgtgcatgagtgtttatcttga

SEQ ID NO: 1400 - DNA, 2325 bp, Chlorella protothecoides
atgtgcgtgcctcctcttgcgtcgtgtgcacagcaatgcagcctgccgctccggcttgacagtgtgactagcacgttcatgatgttctccatacgtcaactctgcgacgcagatgctgccctggagtccgggggcgagctcatagatttcggcaacctctcctacctcccgtctgaggtctggatccgagggcgccgcaggggtcgtggcacagctggtcagggcattatctgcttgcgagggagcccaacactgctgcgtatgagatgcccaccccctctcatgcctggcctgatatctccagatgcgtgccttgctgttgctcttgcactgccactcgagttccctgctgaagacctccgcgtccatgtgtttgaccccgtgcgctcgccgcgcccccgcaccctccccgccccgccacccccggtgcccgtcctgagcctgcatctggtgccgccgccgccgcgcctgccccccctgcagcgccccttcccgggcggccgcctggaggacggcgcggcgctgggcagcccaaagcgcgggcggggggacgaatcatcagagtcggagccctcccccaagcgctggcccagcagcgcgtccggctacttcacggacgacagccccagcccgcgcagcacggtgtccagggcgcaggcccagggggaccctgcgccggggaccggcgcgcgctcccgcctggccacgcagccggccgccgcgccaggccaggtggagcaggcgggggcgccgcccggcgggcggacctccgcctaccgcggcgtgagccggcacaggctgacccagcgctgggaggcctccctctggctgaacgggcggcagctgtacctggggggctttaacggccaggaggaggctgccgcggcatacgacctggcggccctggcgtgcaaggggctgggggcaatgactaatcacccgccagaggagtacaccgagcagctggcggagatcgcggggctcaccagggtgagtcacgggcggcgttggatgccagtgtggatgtgtggccctggaccaaggacctccaagttgaaacccaggtggggttccactgacgagctgagcgcaaatgcattgaccacgatttctctcacgctcgcaggacgaggtggtggcctacgtgcggaggcgcagcagcgccttcagccgcggcaagtccaagtacaggggcgtctcggggcacaacgggcgctgggaggctcgcatcggatcctttgggggtcgaaagaacgtgagcatggggttgggggagagccagtgggaagttgcaatcctccaagggttcctggcaggtgccctcggagtcagtgcagcgaaaggagtgcgcacccggcaaggcttggagatgcgtccaggccaagcgatgcagtgttccacgctgcacactcataccatcgtccaggtgggggtgcctggtgtcgctgtggggagcacttctgggttcgcagttgggacaaggatgagaggagcaggccccagcctggagccaggcatactgtgcgtgacaggggaatgttcaggaaggcccatgtttcaggaacattatgttctggcatcagccaggcacagcctgagcagattcttggtctccacctgaaacccaccccgtccacacttgtcagggtcggagtgccaagacaaacttcccgctccaggactatgagcgggaggttgcacagcacgaagcctacctccagagcatgtttcgtggcatctgtagagcgtgttattttctattcgttcatctcaatcacccctttacacaggccaccatccagtgtcccaacatcccagagatcattcaaatcgggcagagacaccagcccagaagacaggcggcgcaatagtgcgacaaactttgtacgaaagtggctcggctgggttcacgaaagcaaaggtgttcgagtgtacctcgctcgggaagaggcatgctgccatgcacctaaatgtgtacgttataggagggcagtcacagcctctggagctacccgaccagctcacggtgggagtatattgtgttggagttgggatgttggtgctaaacactttgagcacaccgtttggggttgctccagggcttctccagatgccatgtgggaagtctacatgcgtgtggtgcattcaatggtcaagccaggcagtggtggtgtgtactgtaatggacatgcgcaagtgggacaccctattcccatcactcctgcttcaacagaaagatgttctgtacgcaactgtgtcgaggcggctggacctgcccctggaccgcctgaagctggtctcaaaggggcaatcgctgcagaatga

SEQ ID NO: 1401 - DNA, 1410 bp, Chlorella protothecoides
  modified_base (326)..(335): a, c, t, g, unknown or other
  modified_base (873)..(882): a, c, t, g, unknown or other
  modified_base (1268)..(1277): a, c, t, g, unknown or other
atggctgtggtacccgacgcgccccgctttccacccattcccgctttccagggcagcttggagcgcctgggctcccagcgtgtcacgttgtacttgcagcactggcccggcttcttcttcaatgcctttgccaacgacgcctacatccagggcctggcagatgtggtggaccaggggctggctcaggcggtgggggtgtccaacttcaacgctgacagggtcaggcgggctgcacagcagttgcaggtcggtgtgtggaatggcgagaaagtggtgcaatggcgcaaggaggcgggtgtccgggagcaacaccattgccaaccaannnnnnnnnncggtgtgtggaatggcgagaaagtggtgcagtggtgcaaggaggcgggtgtccgggagcgacacctttgccaaccatgtccgtgtgctggagttggtgtcctcagatatcgtgctctgggaggcgggagtgctctgtggactgtcgtggccgttccaatgtgccttgcttgcacgagggtcaccagactgactcgcgcgggggacgtccctggcctgcaaccaggtgcagtacagcctgctgtaccgtgcccccgaaacaaatggagtgctggaggcctgccgcgaggcgggaagcaccctggtggcctacagccccctttgccagggcttcttggtaaggccgtgggatcacgaggcctgtatggggggagggccatctttcctagacagggagttgaggtatatggtgcgagcgcagatgagcaaaagccagtgtgcagatttcagggagggcgtgcaccttcgccttgcaattcaccacctcatctcgcctccttctctttcggcctccttgagaagatccccagccccaatctnnnnnnnnnncacctcatctcgcctccttctctttcggccaccttgagaagatgctcagccccaatccacccatccatcccacagaacaaacccagcggggtgcgagggcgcaacttcagcgccgcacagtacgaggagctggtccgcctgctcgacctcatgcgcgccgtgggggcagaggagggcgatcacacccccgcccagattgccatcaactggttactgtgcaagggggtgctgcccattcctggggccaagaacgcagcccaggtgaggcagggctgtgtggttccgtgtgggaggtggtgttgggagtgtgcgagggggagagacgttgcttggaaattacaccgtttccagtgcatcgtggtgccctattgtgcatggttctcagnnnnnnnnnngtgttgggagtgtgcgagggggagagacgtggcttggaaatcacaccgtttccagtgcatcgtggtgccctgtggtgcatggttctcactcatcctgcggtgcctcttgcgatgtagtcctggcctgcgatag

SEQ ID NO: 1402 - DNA, 1656 bp, Chlorella protothecoides
  modified_base (404)..(413): a, c, t, g, unknown or other
  modified_base (1428)..(1437): a, c, t, g, unknown or other
atgccccatcccccccctccagatcaagttcctgacgggcttgggcctgaggaatcgagatgtggagaatatggcttcctcctgcaagcccatcctccgcgtcccagagccccagctgcgagcggtagtggactacctgaccgcccagggcctctcggatgctgcgctgcagaacttcctggtgcggaaccctcagctgctgacctatgtgccagagggcgacgtcctcaccaagggccgcgccaaggccagcgtggaggtggcgccagctggcgatggctcggtgggggcccgcgtgcacgtctggagggacggtgcggcttttgggacggcgccggtcgcgcccctcaccccgaacaagcaatgaagggctggctagcaggagtggggagcttggcagaggnnnnnnnnnnctcaccccgaacaagcaatgaagggctggcaagcaggagtgggagcttggcggagactgcagcgcagccgggcctcctcatcgccttgcgtgcagcgcccagccacttcgatcctacttcttgcacagaacatgtttcaaaacactgtaaacctcacatgcctccacattattctagagggggttgtgatcgtggcgttgttggggcgtcccgggccactgttggcgagagggccactgattccggggcgcgcagatcgcttccccagagctccacctcgaactccatgcaggggatcgcttccccagagctccacctcgcactccatgcagggggccacgctcttacaaaatggcgcactgagcacgaacaagtcctcagcatggactgggttgcctgcccggggacgacagactcgtcgcgggcctccggcccctcgggcctctccagccaagactcagggcatagacaaagtacagctgggacgctcagctgggccgctcaggtatcgtctaggcctgcacatgatagacatgcattccttctggcaacgcacatgcctgggaagcataaactcccggcagaatcccagatcccctatggacaccgaccccagatgccagggtgtcggagattggcattggagcatggtcctggagggacagttccggagggtcatccggccaaccctgcagatctacagaccatgtattccttagcttgtcctcttatggagctgcaacatcactatcccaacgcgcaggctttcaaggccgccatggaggccggagccactttcctggataccgccgaggtgggatgggatgatgcacctcccgggtcgctattctgccaggcatgcatcctgcagtttcttggtgagggtccacattctccacgactgggccctccatccactacagcaacacccatcgttcctggcaggtgtacgggtttggaaactccgagcgcttcatccgtgaattttctgagagcaccgggttcaaacccgatnnnnnnnnnnactgggccctccatccactacagcaacaccaatcattcttggcaggtgtacgggtttgggaactccgagcgcttcatccgtgaattttctgcgagcaccggactcgagcccgacgttgcaactaagtttgggccgctaccttggaggcagagcgccggcagcttggtcaaggcctgcaaggtggggtgggccagggagcccacggtcctcccagcctga

SEQ ID NO: 1403 - DNA, 1104 bp, Chlorella protothecoides
atgccccctctctgggatgctccaccgcgattcaactcatggggagccctgccactctcgccctgtgacccaccatcacccacacagactgtctttggcctggtgtacgtgaaccccgtctgcttgaccgagttccacacggcagttaacagggaccctgcagccatcatcccagcctgggacgggagcactgggaccaggaccctgagtttcatgaagtcagtggatgcacctgccttcatcaagagggtgctgggatcagggacactgagggttgttgagtctcagagcgtggcccttgggccggtgcagggcagcgtctccctcgcgtcggtgccctgccccgagatgaagggcgctgacaagttcaagactgctgttgcggtcgatctcgtgccgacaccctgtggctgccaggtatgggcagttcagtgcatgtggaggttttcccaaagggggttcatgggctcctttcaggtgccctgggtgcgatttctccagtcacatcgcgggctcacccccccgccgccacacgcggtgtccatgcaccagcgtttgccctgcgcaggatcctcctgtcaaccttctcaacctgctctttcattgcaggtgcacgcaagggtgagctgcagcgcggccgggccctacggcctgagcggcgcgatcgagggcttcatggcggagaccgccaaggccagcctggtcgagtttttcgagttctgcgccaggttcctggcagcttccggcgcggagcgcctgctcgccggcgcctcggaggcccgcgcgctactggagggcctggcggccccgtcccccgcccagctgccccgcgcggattcggaggcctgggctgacgcggaggcgctgcccctccccgccgccgacagcgactcggcggaggtgctgtacctgcggtacctgtgcagcaccggcgaccaggccgtggcgctgctgcagcgcatggacggccggctcgcgcggctccagcgcgacccgcgccccgccatcccggcccgtgacctggtgctgggcttcgcggcgggggtggtcacggcgtcggcgctgggcgcgctggccctgtcctggcgccgccagtctcgctga

SEQ ID NO: 1404 - DNA, 324 bp, Chlorella protothecoides
atggagcgcaaggacgccgtcgagctgcgcgaggaaaagccatgtacagtgcccaacggcagtgcgtgggtccctcccgctgaacccagcaacgtggtagaacccagtcccgaactactctgccgaattattccagtgccagactgttggtgtgggtgtctcgccaggcagctcgcctccaagacgcctgagaaccctggacgagccttcttcacatgcgcgaggcgaagaaaggagtgcggtttttactgctgggccgacgaggtgcctctgccacccgtccagaaacccgaagcggcctttagccttgctggtgcggcgtga

SEQ ID NO: 1405 - DNA, 5343 bp, Chlorella protothecoides
  modified_base (2748)..(2757): a, c, t, g, unknown or other
  modified_base (3323)..(3332): a, c, t, g, unknown or other
  modified_base (4364)..(4373): a, c, t, g, unknown or other
atgacgagcatgtccaggttgagcctggcttcgggctctcgagctggcagaaggacatacccggcgtttacgggagatattccacgttcggtctctgcaagtaaacggggcctgcgtgtgttcgcgggcgtcgccatgaatggagctgccccagccatggctcccggtgagagttttcacgtatgtggtcgtgggtgcagcgcttgctcctggcgatctcagcatgtgcgcgtggccactgtgaagcgtgagaccaaggaaacaagggtggaggtgaccatcaacctggatggcacgggccaggctgacaatgactctggcatcccattcctggatcacatgctcgatcagatctcttcgcacggtctgtttgacctcacagtcaaagcaaaggtgcgtctgctcctttgccttgttgcaggtcccagccacaaccacagagcattgggatcccattcgctacaaaggcccaagacgcttttcccaagcgcgaccttcctaatcactgaacaacagggcgacacatggatcgatgaccaccacaccaatgaggacattgctttggcctttggcaccgcgctgtcccaagccctgggagatcgcaagggtatccaccgctttggaaacttctcaggtgagcgttgtttgcatcaggacggacccacacaagcaccactggatgaggctctcgtggatgtggtgctggacctgtctggtaggccctacctgggctacgaccttgccttcaggaccgagaacatcggcaggttcgaggtgcagctggtggagcacttcttccagtccctggcaaacactagtgggatgacactgcacattcgtcagccctggttcctggagaggtgtgggagtgaggagtggtgtgtgagccgggtttcaggggttgttctcgtgttcccagaatatcttgttgtgcatgctcctggagccctggtccctggaggggtgctgctgccatgctgtcatcatttctcctgttgcttccctcctcatcgtctactgcacgctcgcttccatcgccgctcgcagcttgctggacaaaactcgcaccacatagtagaggcggccttcaaggctttcgcgcgagcgctgcggcgagcatgtgagccagatgtatacactgctccaggaagactgctcagcggcaccattttggttttgcagacggtgtatgtgcccataccaagtatcaacactatagggtctctgtactccggctttccagcgccccccttccagaaggtcaagcgggtgaaacctcagagcccttgccaggcttgcgaatggatgtcgtccccaaacaccattaggggtattctagtaagcactcttcagagcgcagcaggggcctttctagcccatttgagaccaggtaaaccgcagtatgggtgcactgatgtctggtgtgccagtactagagtgccctggccgcttgccgcgctctgccttcctgagacatccccctgcatcccccgctgcggggcagcagccccgggtccaacatggccttctcggctcggtcgatcctgtttcctacctgggttccattcttcacgccctgacgcgcctcctcgacctgcagggcgtagccgagctcacttcagcatgtttttcggtggcggtggattcccaggtggcttcccctacggcgagatgcccggcatgggcggcgggcgcggcggtgccggcaagcccccggacaaccagcggtactacgacatcctgggggtggaccgcaacgccagcgagacggaggtgaagaaggcccaccgcaagctggccctgaaggagcaccccgacaagggtggcgaccccgagaagttcaaggagatcaacgaggcgtacgagacgctgcgcgaccccgagaagcgcaagatctacgaccagttcggggaggagggcctgaaggagggcatgggcggcggcggcggcggccccgccgacatcttcgacctcttcggcatgggcggcggcggccggcgcggcggcccgccccgcgagcgccgctccgaggacgtgacccacaagatgaaggtgtccctggacgagatgtacaagggcaacgtgcgcaagctgcagatgtcgcgcagcatcaagtgccccacctgccagggctccgggtccaagtcggggaagaagtacacctgcgaggtgtgccacggctcgggcgtggaggtgaagctgcgcccgctgggccccggcatgatgcagcagatccagcagcgctgctccaagtgctccggcacggggtccttcacacccccctccgaccgctgcggcgcctgctccggcaagggcctggtctccgatcgcaaggtgttcgaggtccacgtcgagcccgggcaccgccacggctccaaggtcctgttccggggggaggcgggggctgatgcccccgacgttcttcccggcgacctcatctttgtgctggagcagaaggaacaccccaccttcaagcgcatcggctctgacctcttctacgagaagaaggtgtcgctggtggaggcgctgacgggggcgctgctgcacatcacccacctcgacaaccgggtgctggaggtgaacagcgccggcagcatcatcaagcccgactcctggatggccatcaaggggcgctggccccccgcaaatgaggcactttgtatcaggcgcgcactcgtgctcccgcggggttgggttcgggatgtatgcaccgccacgtcggcatgcctcggcctcgaggctgtcccnnnnnnnnnntggccgggcgactggatggggttgcaggggtgctggtcccctgcagatgaggcactttgtatcaggggcacactcatgctcccgcggggttggggccgggatttatgcaccgccacgtcggcatgccttggcctcgaggctgtccttttggcggcagccatggtctggccagtgtgcaggctcggaatcccccaactccaaacaccccccttgcagaacgagggcatgcccatccacggccggccgtacgagaagggcaacctctacatccactttgcggtggagttcccggaccagctggcgcccgacgcggcatccgccctgcgctcgctcctgggggagcccgctcacaccaacggtgtggtgcccatggaggagctggaggaggtgcagctgacgcccgtgaaggacatcgaggccgagatcaaggtccggagggagcatgagcgacgcactgccgcgacggaggcggggcatgcgtgcacagaggctggactgagcgcatgcacggtgccggacccggggtgtgcagggcctggctggtgcaaggctgtcgtagccgtggnnnnnnnnnnacgcactggtgagtgccggcgtgggtgggcaaaaatggtttggtggggtgtggcgggggcgaggcagagccgcgacggaggtggggcatgcgtgcacaggggctggactgagcacatgcacggtgccggacccggggtggccagtacgacagtgacagcgatgaggagggcgggcagcggggacagcgcgtggcctgctcccagcagtagtcccaggcgcctgcggcgttcaccctgcccgaagtgggcgggggagtcaaaccctgataattgttccggagataatcaccgaccgagttggtggtgccgtctctgttcccgtgctaagtcttgcgctgccctgcagcctggaatgacaccgagggatgggtttctgggacggacctctttacccctcccactcggggcggcatcaaatcccgaccacatcgaacacccactgtacgaatgccttgtcccgctcgcactgcctctcgccacactgctacctgcattctcgcactcttcggtctctttctccgggctcatcgtgttggtggggcaggagccctctggtccactgggttcgcagcaccccgccagacggcgacagccgacctggctgaccctgcagcgctggcccatcagtactgatgtctcagccctccaggattcgatgtcggtcacgtactgcaccctggcctccctggccgcgggcctgatcctgcacctggttcatcggaagttaaaacatgtccgggctcgggccaagctccttgcggccggccagtccctgacctcggggctcgggcagctctcagtgctctcctacaacatgctcactgatgctcccgggcgtgccaagacgctgagggccgtgtccccggaagcgttagactggagccaccgctggaggctcctgtcaacccagatcagtgggagtgacgccgacatcatctgtctgcaggaggtgtccatgcacaggtgcggttttcttgggggaatctggtgttactgccttgtaggcgcaacccgctgcatcctggctgacannnnnnnnnntgtccatgcacaggtgcggttttcttggggaatctggtgtcactgccttgtaggcgcaccccgctgcatcctggctgccgttcatggtattcttgcaagaatgcctgtcactggctgctggcccttcgggcaacatgttctgccccatcgccaacccgctttcatgcgcttgccctgccctttgcagctggcaagagctggtggacctgctctcgagccgggggtatcatccgtttgccctggagtggacccaggaggcgcagcacgggctgctggtctgcctgcagcacagggacgatgcgccgtgccaggagccctccgcctcgtcgctgaggagcagcgactacctccacgtcgtgaatgttcacctggaggcctcgcccctgctcccaggcagccgcctgcatcagctgaaggccatccttgggctgctctccgagaagctgggaagccgcaaggccgctgccgccgcccagctcgtcctggcgggggacctgggcagcacgcgacaggcttccccctgcgcattcctctcttctggcagggtggacgcgcactggacggaggccggcctgccaaaggtgaggagtggcttggtgaccctggggcctatgggaggtccagagcccagcgccacacgacttgctgtcagagactttcccaaggcgctgccgcccatgccgcttcaccctctgcctgccgtctgaagcaggtgggactcaatcgggagagcctggagcacgccttccctctgcaggaggcctaccaggcggggcagcgcctgccccaggggaaggcgcaggtgccataccgagacactgacttcatctggtacagccgaggggggcgtgtggtggccgtgctggatcccatgccggcaggactgaggcatggggcaccgcatgcgagccttccaaacagcaccgtcccctctgaccacacgcccaggggggccatcctgcaaatgtga

SEQ ID NO: 1406 - DNA, 1812 bp, Chlorella protothecoides
  modified_base (82)..(91): a, c, t, g, unknown or other
  modified_base (360)..(369): a, c, t, g, unknown or other
  modified_base (1227)..(1236): a, c, t, g, unknown or other
atggcgtatggtaatgcttccgcccgtgaacataataggaagccatacgctagagcttcccacacgttcgcgccccgactcnnnnnnnnnnctgatccgaagggtcagtcggactcttgcaaagatgtaaatgctatgccctcaggatggcgtatggtaatgcgtccgcccgtgaacattataggaagccatacgcgagagcttcccacacgttcgcgccccgactccacttggaattccgggggtgacattcgcagcccgctagaagcgctcttagaatacgcggagggcttcctcaacgtcgtatataaacacagccgtgcccgacatttgtgccctgttggccggcgttccgcctgnnnnnnnnnncctaaattgaattcgattcagcttagaatacgcggagagcttcctcaacgtcgtatatatacaccagccgtgcccgacttttgtgccctgttggccggcgttccgcctggacctcactttctcctgacatggaggtcggccccctccaacctccctcagcctgcccaccatcccatccatcccatccattgcctgtacgcagacttcctgggagtcagttccgaagaggaggatgtggaagatcaaggcacttgtagtgatgcatccgaccctgagacagatccagagcccagcgggagtgaggatgccagtgcctctgggggccatgacgatgacgactttggcgacgatgactcacaattggatgaaggtgcgctgaaaccctggaaggccttcccctggccatctctgcgtgccctctggccctgcatgtccctctgcaccacatcgccttgcgcccaccatatactatctcacctggcgccccgcctcgttctcctatcagagagcgcctctgacagcgccgttgaagacgaggaggaggctggcgggggcggattgctggcagggaagcaggcatccatcgccaaggcctttgcaaaaatcttgaacaagcagctgccaaggccggcagtcggcaagggtcaggcgggggaggaggccccggggtcctcggccccggcccccatcctgatctcgagcgtgacggtcgccaagcagaaggcagaggacgaggcagaaggcgctcggacgaaggcggcatggaagatgatgcaagaaatgcgaaaacgtggccacgtgctcctggcactcttgcactgcattccaaaccacggcagcgatgcggtgaataaccgnnnnnnnnnngctgtgatcgatgcggtgaataaccgccagccccccccacagccccggctgtcgactctgtttggcaggcttgcctcacaatcccccacacccaccccggccccatccccacctccaacagatccctggccggcgcggcgaggatcccgaggccgacgcccgggagaaggcgctgcagcggtctgccacacgcggcgtggtgcgcctgttcaacgccatcgcgggcgcgcagcgaaagcgacgcgaggcggaggcctccggcgcgggggcgtcacaggcggcgcgcctggggcgcgcgagtctcctgtccaagctgcgcaacccggggcccgccccagagacgcgcctggtgcccagcgcgcggggcgcgacgggtctcgtccccggagctcccgccgcaggcgctcgggagcctgccagcgacagcgaggaggagggaggcgcgggccagggctgggaggtcctgcagcgctccttcaccgggctgcagggtggacgcaagatgaaggactgggaccgggcccaggcggcaggggaggaggaggcggtggcaggactggactccagcgactctga

SEQ ID NO: 1407 - DNA, 360 bp, Chlorella protothecoides
atgtcggagcgacaggcactgctggctcttgtccccggggtcaaggatgtgcacctggataaagcgatgcggcgggggctggcgctgccctcccctgagcctgtggagcccctggacggcgggctcgtgaggaagcggcctggacgcctgcagacgcgacccaccatcggtctgtgggaggacgactcggccgacatggcatacgggcgtgagctgctggctgctgccgggcccacgctccctgtgcgcctgggcgccgacaagatctgggagcagggccattccggcaagggcatcaagatgggcgtatttgacactgggatccgaggcaaccattcccatctcaggaacatcaagtga

SEQ ID NO: 1408 - DNA, 552 bp, Chlorella protothecoides
atgtgtccgcaggctagcctctcaaagtatgatgaggcactggaggctgctgagaaggtggttgccctgaagccagactggcccaagggctactctcgtttgggcgcggcccattttggtctgcgcgccttccaggcagcatcagacgcgtactccaaggcctggaggatgtttgccacgcaccgccaaatcacagctgttgggctgctcgggtgtgatgtaaatctcatcaccgtgactttccacgctgcattcaagttccctgcgatgaactgccacgcccggctgtgtaattacacaggcttggagctcgacccgaccaatgagcagctgaagcagggcttggaagacagcaaggctgccctggcccgacccgctccctcctctggaatcttcacctccccagaggtgctgggccggctggcgacaaaccccactacccgtgccttcctgggtcagcccgatttcatgcaaatgctgcaggagatcaaccgcaacccccaggccatgtctgtgagtagctgcgagggcagattgggagacggagggtga

SEQ ID NO: 1409 - DNA, 1077 bp, Chlorella protothecoides
atgccctcagctcgctatgtgccggcctcacaactggacgccgtcctggctgggctgaccgaggaggccagcgcagggctgggggccctcctcttctctgacgggatggcacttgacacaaaaggatacctggacgggctctgggccgacacgcagcggcgcgccagggaactcggtgcgacctggcttggactctggcttgttccgggagtgcgagtgtgttgttcctcgccacagtctgccctgtcacgcctgcacccactgcagtacatccatccccataccaaacccctcgtcctcctgtgccaagcaggcacagaggcagtgttgcatgagaacaccactgtgcatgacctggcggagctgaacgctggcaagggcccctatgctggcatcgtcctggccatgggggctggggtggcctatctggccggggtcaaggatcacctgccccccttcatggacatggtggccggcatcagcctgacgctggagctgggggccgagggctcggccggtgcagtgccccccgagcgggtccatggagccgagccccccaccgcgaccacggcggtggaacccgacgcacacagcccagatgcgcgctgtgccggcgatctgcccgcgcacgcctctggctggcccgagggcgcccccagcctggcggccatgccgtacatcgcggcgcaggggtcccggcgctgcgtcattggcgcaacctgggaccgccccgcggcgcccgaccagaaccccggcacggcgcccaggacggcgggggagctgctgtcccaggcccgcgcgctgtggcccggcctggcggcctggcacgtggtgcacagcgcgcacggcacgcgcgtcgtgtcccagcgcaccgaccacggcacgccgccctatggcggccggctggcgctggggcctgcgccggcgctgccccccgtctggctgatgagcgggctgggggcgcggggcctgctgtaccacgcctggctggcgcagctgacggcggagggggtgctgcgaggcggcgaggagcacctgccgcccgagctgctcaggtggaggaggcgcaggggctga

SEQ ID NO: 1410 - DNA, 219 bp, Chlorella protothecoides
atgacgcgtggggaagggacggatgcggagcgcaagcagcagcaggaacgcgcgatggcagatcccgagatccaggccatcctcaccgaccccgtcatgcgtcaggtcctgcgtgacatggaggaaaacccagcggccgcccagaagcacctcgccaacgtccaggtcgccgccaagtttgagaagctggtggaggccggcatcgtccagatccgctga

SEQ ID NO: 1411 - DNA, 282 bp, Chlorella protothecoides
atgaccctctccgccaccgccaacggatcggtcggcatcgttaatcatggctactggggcatgcacgtcgagaaggggcagtcctacacggtctcactctatgcccgggccggcgagacgggccctgtccctctgacggtgtccatactgggtgcatccctgaagcacaccctggcctccgtggatctgaacccaccctcggaggactggggcaggctaacggggacgctggagcccaatgccaccgactccagtgccgtcctggtggtgagatggaggtga

SEQ ID NO: 1412 - DNA, 1035 bp, Chlorella protothecoides
atgctcccagcgcatggcagtggtatattctcgcgccctcctcgctcgcaggcagaggagctggcggctgccaagaacatcaagctgcccgccgactttgcagccgccgcagtggaaggaggcctacgtttgtccaccctgcagcactatatcagcctgctgtccggcggctggctcacacgctggctggccagtactattccagcattccgggaccggctcattgccgaccgcatgttcctcttcaaggtcctggccgaggtcaccatcgacacaggttacggttctggcagaaaggggggcgcagataggttcccccgtgattccccccgcgctgcctcgggccctgagcttggtcgtgagcaatgcgatccccgcagcgcttcgcctgcggcttgcaacacctttgatctcccacgcaccgacatgccctccacagggtgtgcgaccgtggctgaggtcaggaagcgtggcgacgagttctggggcgagttcgaattctacctctcggacctcatggtgggcctggtcctggacgtcgtgctcgtcggccttctggcccctgtggcgctcaagggccgcaagccccgcgcccagaccggatgtgagggcgcgtgtatgatgtccatgcatgctgtggcgtttgggagggtggctgcgtgctctgatgcaggtacatgccggccatggggcagggagggggaggtcggcccgtcagggagggctccatcccttggccgggcagctggcgggagggctcaatcccttggccgcgcagctggcggtgggcctgcactgccccatcgaaacacatcgagccatgcatgccacccaccgcgccgctggacagggatcaagaagcggctggccgcgctgccatcggcggtgtttgaggcctccacccccacgcggccgtacaccgtgctcagtcgtctgggctgcctcggggtcaaggcgctggagtactccctggcaggctttgcatgcgggctggtcggccagggggtcgccaactccctgatgatcgtgaagtga

SEQ ID NO: 1413 - DNA, 408 bp, Chlorella protothecoides
atggcgcagatactttgtggacattggacgcctggcatgactacgatccggggcgggcggcacctcacctcggcccactccccccgctatgccgtgatcgggggtgggctggcaggagtggccgttgcctggcacctcctgcaggcaagcagccccacaaagcccctctccctggacctgatcgtccagggggagggactggcggacggcgccagcggtgccgccgccggcctcctgcaccccaccagcccccgtggcaaactgatgtggcgaggtgatgaggctttcctagcgacccggcgcctggtggatgtggctgaagccgctggccgcaaacagattgcatggcgtcagggcgttctgcgcttggcccagacccagcggcagggcttggattccagcccctga

SEQ ID NO: 1414 - DNA, 1065 bp, Chlorella protothecoides
atgggcagagtgtatgacatcaaatacctgcagggtggtggagcagctcttacgaagtgcaagctcgcaaccacctcccgggctgtcaagaacgtcctgggctgtcaccactacccacctgttacctcgcagaactacttgacggacaataggctgcagcaggcgctccaagtcgggctggggctcaactttggcagcgcagaggaggggtccgccacctccacctcggcccatgccgggttcggccctgagcccatggaggtgaggcttttgggagcagggcctggaagccgcagtcggggatcgcatgcgctccctgtgtccattgagctcgcccgaggagtctgccgacccttcccccctcgataccaaatacaggaggacgccgcccccgcgtcggcttccggggcggcgccgcctcccgaggccagctcccggcccggctccgcccccgccccggcgccgcaacccgaggagccggagggggaggacgaggtggctgcggcgcgccgcgccgcgctggccgagaaggaggccgggaacgcagcgtacaaggcccgcgactttgacaccgccattgcgaaatactctcgcgccattgagctggacgacagcgacgtatccttcctgtccaaccgcgcggcggcctacttcgagcagggcagctacgatgagtgcatcgccgactgcgacacggccattgcgcgggggcgggaggtgcgcgcggactacaagctgatggcgcgggccatggcgcgcaagggcaacgcactggcgaagaagggggagctggaggaggcggtggccgtgtaccagaagagcctgacggagcacaggtttgttgggtacatcgtctgcctggcaagcctaggcgctccacactcacgcatggagacgttaccgcctcccccgccacctccaatccccaggacggccgacacactgaagcggctgaatgagacggagaagctgctgaagcagagggtggagaccgcgtacattgacctggagctgtctgccaaggccaaggacgaggggaacgaggccttcaaggcccagaagtga

SEQ ID NO: 1415 - DNA, 1302 bp, Chlorella protothecoides
atgcacttcttccgcgtcttcaccaacgaccaggtgtcctacacctcctggttcctggacgccttcaactacgccatagcctccagcatggacatcgtcaacctgtccattggaggccccgaccacctggacgccccgtttgtggaaaaggtggcggaggtcacgtctgcaggcatcatcatgatctctgccatcggtaacgacggcccattctacggcacgctgaacaacccggcagaccaggccgacgtgattggcgtgggcggcatcgatttctcagacaggtgtgtgctgggacccctggtgctgggtgatccgcccctcggttcaggacggcgcagggtgaggcccctgggttcactgcctggacgacagggcgcttcagcaggagtctgctccatgcccgcagcgccgcgctgccccgcggcatgcgaggtgctgacgcatggtcagcacggcacacaaatcacatctctccccaccctggacattccacaccccaagtgctcgtccctgtccatcatggggtcacgactccacccgccccctcagcaccctcaccccccctcccctacacctccaaggatcgcgcccttctcctcgcgcggcctgaccagctgggacttcccgcgtggtgtgggccacttcaagcccgacgtggtggcgtacggcaaggatgtgcgcgggtcgcacatgcgcgagggctgccgctcgctgtccggcaccagcgtcgcctcgcctgtggtggcgggcgcggtgggcctgttggccagcaccatgcgcagcaaggccggcggccggctgaaccccgccgccatgaagcaggcgctgctgcgcggcgcggcgcgcctgccgggcgtgcccgccgccgagcagggcgcggggcgcattgacctggccgcggccgccgccgcgctggccgagctggaaagcgcgccgcgcgccagcgtgcaccccgaggcgctggacctcgccgactgtccctacatgtggccctactgcgggcagccgctgtacgcggaggccatgcccaccctggtcaacctcaccatcctcaacggggccgggctggtggggcggctggagggcagcccggtgtatgtccccacggatgagccggggcgggcgctggacgtgcagttcgaggcctcggaggtgctctggccctggtccgggtacctggcgctctacatcaggtgcggagggggggtgcgctggggatgcatgtggggtggcaccctctggtggcgctgtgaaaggcaagggcacgctggcacatgccagaatgggaagttgctatga

SEQ ID NO: 1416 - DNA, 201 bp, Chlorella protothecoides
atggctgcaaaaaccagtcattggatgcaccatccctcccttctcagagtgaggccggacgatgccttgctggaggcgacagcacacggcgaggtgcggctcaccgtggtgtcggcccctgggccgggggagaaggaggacaggcgctcagacatcgtggtgcccctgaccgtccccatcattcccacgccccctcggtga

SEQ ID NO: 1417 - DNA, 708 bp, Chlorella protothecoides
atgccgtgtgtggaccgccccctgccgcccgaccgcatcgagcgggaccgtgttttggtcacctactcggccgtcaccaaggccgtgattgaggacgacaccatctccctgcactaccgccacgcggacgagctgtacgtgaagctggccatcagctttgccctggcggagtccaccaagctcagcgtgtttgaggaggacctgcgcagcctcgggaggtcggtgtcctacctccccgccatgatggccgggagggggctcacgtgcaagctccctctcacactgccacatccccgacctccaccacttccctccccctgcccatccccagacaagggtgagatcgatgtgggtggccgcgcggtgatgcagctgatgggccagctcttcctgcagcagcgctccgtcaacctgctgacccagctcctggacgcgccgtccgcgctggacgaggcggacgaccacatctgcaccctctaccgctccatctttgactacatggaggtggtgcagcgcgtgaccctgctcaacgaccggttcggggtgatgaaggagatgctggacatcctgcgccagcaggcgcacgactcctactttggcgtcctggaggccaccgtcatctggctggtcggcgtctgctccttcctggccttctgccagctcctggcggtggtctacggctgggagggcgggcatgccaagcactga

SEQ ID NO: 1418 - DNA, 549 bp, Chlorella protothecoides
atgcccctcatcatctctccagatctgctgcgtcgcctggtgcggtactgcaagcgcctcgtcagcgtccccggcgcggcctgcacgcgcaaggggctcgccaggactttgggcccccccctgctccaacccgagctcagcatgcaggccaccgatccgcgacagctgacgcaggccgccatctggcattgccgccccagaaaacccctgccgctcacagactctgccctcccacacctcggcgtcaggcatttcgagaccgtgtttggggagtcgctgggtccggcagctggggatgcgggggcggccgccgcccggcgcgagaagctggaggcacgcgtgcgcgagctggtggtggcacgcgcggcggcggcgaccggggccggccagggcgctaagccggccagggccggcgcagccgccccgccggcgccggccgtttcccgcctggtgaaccccatcaccaccatgaggaccaaggccgcctcagattggctgctggccgcccactataccccccagccctccgccagcgccgccagcaggtaa

SEQ ID NO: 1419 - DNA, 672 bp, Chlorella protothecoides
atggtgcacggctcgcgactctttctcttgtgtacggtgggacttgtttccctcgtcaccatcggggcggcctggggagtggagggaaggggcaggaattcgaaccccacctccgggtcctcgtggaacgcatctgtgaccgtgaacctgggggcgacccatcccgtcagcaagaccctgtacggcatcttcttcgaggaggtgtgtcttctgcctgcttggggtcgggatcagtccacatcgagcctgtaccttgcaggtttccagcccatcgggggtttgaccgcttcgtctttcccctccccagatcgggcatgccggcgagggtttccagcccatcggggagttgaccgcttcgtcattcccctcctcagatcggtcatgccggcgagggacaggagcttcgacgccatcgccagggtctctggatttgcctcctccaatgcgcctgccctgccggtggacctcggcaagctggctgcccagcaccgtgacgcctggacacccaccagctgggacctgagcgtggcagaggccactaccaccaaggccgatttcctggacaaattgcgcggcccaggtccacggtgggtgcctggcctggaagagatgccagggctggtgccgcaggagctgggcgggtggcctagtgtgggtttgctgcaggcctga

SEQ ID NO: 1420 - DNA, 396 bp, Chlorella protothecoides
atggcgaaggcagtgtggggccctgccatcaacatgtgcatgccacctgaccactgtgcaggtctgattgtctttgcggactggtacgacctggagactatgaagggggtgcgcttctacgacgacaacacccgcagctggtgggaggccgccacagtacgaaaatgccaactggcaggtggggccaacgtcccggcgctgaacgacctgctgcagccctttggcatcgggctggggggacctgtcctggagggcaccatggagctgcccgggggtgaaagcgtggcgctgcaatccgggacggcggtgatggcagcgccacagggcgcctggctctacaccgccacgaccccaggtgtcttgtggggctgtgtttggggctgttacaccgagtaa

SEQ ID NO: 1421 - DNA, 213 bp, Chlorella protothecoides
atggggggagggcgtgggaaggtggtgctgctggaacaccacgagaataccaatcatgtcgacaggctcccttcaccatcagcgacgcctcacatacccgccctgctggccccgcagattgcgtatggcaccacggtggccatccgttttgctaacaatgtcattgggggcgagcagtttgtggacctggcgcgctgggcgggcgtgcagtga

SEQ ID NO: 1422 - DNA, 450 bp, Chlorella protothecoides
atggcatcgagctctgcacatcacctggagcagcatgcgcggcagccccttcgctcaccccccatccccctcccctcccaacccaggacggagggtggggacggcgtgacggcattcctccccgccggtctttcgctggacgacctcctgcaggcagcagaggacatgcagcgccacctccccagcccgggcggcgagggtccgcccggcggcgggtttgccggggacgatgcgccggacgcttacacccccctggacctggccagtctgctggcggcacatgcccaccggctgaggcaggagagcgagaagaggcaggcgctgcgggccgccgaggaggtgctggcgagccggctgggcctcccgggaccaggtctgcctgtgtgttgtggtttgggaaggggccggggaggaggtggggagattgcaggtgtgtggggtgaccgatga

SEQ ID NO: 1423 - DNA, 708 bp, Chlorella protothecoides
atgaaccgggctcctggcagcgtgccgctaaacttgaacatctgcccttctgcctaccccaccacatcaaacacccgccctgtcattccggcaacatcacccgcccccaccctcggacagttcctggcaactgtcgaggccttctcgggggcctgccccggcacgcgcgtgctgctgctcccctccccacgcgacctccacctcccgcccgtcttccccgcccccgctccgcgtctggccgcccccgccactcctgctctcaccccgctgcccaaccccacgacaatcatgttggaggatgcgggtctcgccctgggctgcacctccgtggactggctgatggcggtggggcgggaggagctggtgcggcttgaccccggtgcccccgcccctgaccgcctggcccagcttgcgacgcacgtcctcgagcagcggagctacttccccctcttccccccgcccccggggctgccgctggacgcgcggcgggcgcgggcggcgctggccctgcctgaccagacccctgcggtcctggtcctgccctctgacctggcccccttcgcgcggctggcgccaggcggggccaccctgtgcatcaaccccggccgcgccgccaagggcgcgggggccggcacctttgcccacctctgcgccgcgcccggcgagcgtgcctgcgacgcgttgcgctgcgacatcctgcgcatctga

SEQ ID NO: 1424 - DNA, 1827 bp, Chlorella protothecoides
  modified_base (194)..(203): a, c, t, g, unknown or other
atgccaacaccagcaccacctcccgaatcgacaggacctccccgtccccgacctgcccgaggaggtgcgcgccgcgttcgacaccgcgcgcgccaacatcgcggccttccacgccgcgcaggccgcccccgacctgaccctggagacgatgccgggggtgtgctgctcccgcgtcacccgccccatcgcggccnnnnnnnnnnccccgacctgaccctggagacgatgccgggagtgcgttgctcccgcgtcacccgccccatctcggcggtgggcctgtacgtccccggcggcaccgccgtgctcccctcctccgccctcatgctggccgtccccgcctcgctggcggggtgccgcaccatcgtgctggccacgccgccgcgccccgacggctccatcgcgcccgaggtcctctactgcgcgcgcgcagcgggggtgacccacgtcctcgccgccggcggcgcgcaggcggtcgcagcgctggcctggggcacggcctccgtgccaaaggtgcacaaggtgtgcggtcccggcaaccagggccgacccgacccacgtcgcgctggacctgctgtcccaggccgagcacgggccggactcgcaggcggtgctggtcgcgctgccgggcgtggacgtgggcgcgctggtggcggaggtcgccgcacagtgcgaccgcctgccgcgggccgcggcgacgcgcgccgcgctgcgccactcgcgcgtggtctgcgtggcggggcgggccgaggcgctggacttcgtggaggcctacgcgccggagcacctgatcataaacaccgccgatgcgggggagtgggtgccccacgtggccagcgccggctccgtattcctggggcgctggacgccggagtcggtgggggactacgcgagcgggaccaaccacacgctgccaacctatggctatgcgcgcatgtactcgggggtcagcctggacaccttcacgcgcaagatgacggtgcaggagctgacgcggcaggggctggacctgctggggcccaccgtggccaccatggcggcggtggaggggctggaggcccacaggcgcgccgtcacctgccggatggatggggagtgaggatggaggcgtggggaaggggggggtggagctgcttggatgtcgggccccagcccaaggggcgcaggtgcagggcgcgccgtcacctgccggatgaatggggagtgaggatggaggcgtggggagaggggggtggagatgcttggatgtcgggcccccgcccaaggggcgcagggtaccaatgcatgctggctcgccgccccatgcaccactccggggtggtacaagtgtgtagcgggagagaaaagaacaggaaggaagcaagggacaaagtctcatccgccggggaccttgggcgcccgctccagcgtgttgtagttcagcagcttctctatgaggtccacatgcgtcatgatcatgcgccggcagcagtagcgggagaggcccagggcgtccatggcatccctggggcgatgggaggagaaaccagtgagcatctggcagcctgcagcaagcatgctcgaactgcagaaaccaccagtcctggtcgctcaacgcctcttgcgctccaccgcgactcacccctcggaatattctgcctggaggaggtcgaggtatgtgtcccacttgttcccaatcactttgccgcatgtgaagcagcgcactgggataatcatggagaccgagtccgcccgctccgatcggacgccgagtctcgggtgctggtggagaatttaggagaaggtctggagcctagtcctagcccgtccttccacgctcttgcaatgtaa

SEQ ID NO: 1425 - DNA, 582 bp, Chlorella protothecoides
atgccagggagtcgttacaggcccgaatctgccggcaggccctccacctcgcccgaatccatccttgtggccccgcactcaagtcacccactcacccctaccaacctgctactggtagaggagggccggctcaacccccagtccctgctgctggaggggtcccaggccctgtccggcggcgcgcgtgtccggctggatgtctcccgcctcgccgccttccgcctcttcccgggtcaggtggtgagcctgcgtggcaccaacccctccgggcactgcatcatagcggcagagctgtgtggcccccgcgagccggacgccaagaccggcccctcccacccagccgcgcccacctctgtcgtcctcgctgcgggcccctactgctgccctgagaatctggagtatgcgcccctgcacgccctgctggagcactgccggcgcctgcgcccagcccacctgctgctggcggggccgtgggtggacgaggcacacccgctgctggcgggcgggctggtagacgagaccttccagtccattttccagaccagggtgcgtggcaattcatgctccatgagcatgggttga

SEQ ID NO: 1426 - DNA, 1392 bp, Chlorella protothecoides
atgcattggtaccctgcacctgcgccccttgggctggggcccgacatccaagcagctccaccccccccttccccacgcctccatcctcactccccatccatccggcaggtgacggcgcgcctgtgggcctccagcccctccaccgccgccatggtggccacggtccagcccctgccgcgtcagctcctgcaccgtcatcttgcgcgtgaaggtgtccaggctgacccccgagtacatgcgcgcatagccataggttggcagcgtgtggttggtcccgctcgcgtagtcccccaccgactccggcgtccagcgccccaggaatacggagccggcgctggccacgtggggcacccactcccccgcatcggcggtgtttatgatcaggtgctccggcgcgtaggcctccacgaagtccagcgcctcggcccgccccgccacgcagaccacgcgcgagtggcgcagcgcggcgcgcgtcgccgcggcccgcggcaggcggtcgcactgtgcggcgacctccgccaccagcgcgcccacgtccacgcccggcagcgcgaccagcaccgcctgcgagtccggcccgtgctcggcctgggacagcaggtccagcgcgacgtgggtcgggtcggcccctgcgtcggccaccaccaggacttcgctgggccccgcgggcatgtcgatggccaccatggcctctcccgcggccagcgccaccttggccgcggtgacgtactggttgccgggaccgcacaccttgtgcacctttggcacggaggccgtgccccaggccagcgctgcgaccgcctgcgcgccgccggcggcgaggacgtgggtcacccccgctgcgcgcgcgcagtagaggacctcgggcgcgatggagccgtcggggcgcggcggcgtggccagcacgatggtgcggcaccccgccagcgaggcggggacggccagcatgagggcggaggaggggagcacggcggtgccgccggggacgtacaggcccaccgccgagatggggcgggtgacgcgggagcaacgcactcccggcatcgtctccagggtcagggtcaggtcgggggcggcctgcgcggcgtggaaggccgcgatgttggcgcgcgcggtgtcgaacgcggcgcgcacctcctcgggcaggtcggggacggggaggtcctgtcgattcgggaggtggtgctggtgttggcatcgcaggaggcgtgcatgagaacactgaaggggtcgttgtgtacttgcttgggatgcaatgagcgagggagaggggagggaaggcaacacagacgtgggcagctgaggaatacggccgaagatgacggcgtcaccggcgcggcggcggccatctgtcgtgagtctccacagcagtcagcaggtcacggactctga

SEQ ID NO: 1427 - DNA, 1725 bp, Chlorella protothecoides
  modified_base (292)..(301): a, c, t, g, unknown or other
atgtctccactgaatcctgcacagagattccaggagcagcagcaaaagctgcaactcaaggagggtgacgaccctgaggagccacaggaagggagtgcaagtgctgcccccgagtctgctccacccccgtcctcgcttgccatggtcgtgccttcctcgggcatggagggcgtggtcccgcagccgcatgcaccctcgcaggggatgcggggcactgctcgcgttcatttcaccctccgctttcgcacagactggggccagcgactccgcatcgtgggcagtcaggagggtnnnnnnnnnntgccttcctcgggcatggagggcgtggtcctgcagccgcgcgcaccctcgcagggtgtggggggcaccgctcgcgttcatttcaccctctgctttcgcacagactggggccagcgcctccgcatcgtgggcagtcaggaggggctggtttgttgggtgctggggcatcatcgtgggtggggaaggcctggttccattgtggcacagcatgactgtataaagcctacggcgcccaccactctcgcaggcaactggcggctggcagatgggcacaacatgaagtggacgacgggtgacaactgggtggctgaggtggatctccccaccggcacagtctacgagtacaagtttgtggtggtggaccacgccagtggccatgccctggcctggcaatccgggaacaactcagtgctggcacttcgccccgaggaccgatctgtagacgtgtttgacaactggacttggagcggcggcctgccctactcctgtgctgctgcctcgcttcatacccagcctcaggccgcaaggctgggtcaaatttgccaccctggaagatggaggcctccatggtggggcagcggcaggagctgcgccgcgcgcgcatggagctcgttgccgcccaggaggtgggagtgcttgttcgggcctgctgggatgatgctgagttatcggctgccaggggggctgcagccccgacgtggcggtcctcagcaggtcctcagtgtcctcttcttgcgtgtgcaggatgcacgcaaggcgcgggaagaaagcaagcgcatgtacgcccgcctggcggagagcgaggcggcgcgcatcgcggcggcgaccgacctgcgggccgccgagaccaccaacaaggtgcgctgggatagggcaaggggagggagtccgttcagcgtatgggctacttctcaatcgtgtgtgctgcagggatgcacagggtgtgtgctcagaggcccactctcgggcagcaccacagtgcctcttctcaaacggtcgcctgtgcattcctggtgccaggtgctgatggcgcagctgaacgaggtcaacacctcgttcaagtctgccctggagaccgcggcggatctgctgcaggccatctccacgcggcccaggccgcggcgagcctctgcaaaggctggcacagccgtggatgctgacaaggcagcagccgcggcagtgggcaggggggcgggcacaccgttggggtcggcggcgggcgtggcaggcgggcaagtgtctgagccgacggccgagccggcagctgagcccgcagcgggtgcagcgtcaggaccggggacgagcaccgcgtcaaagcggaaagccacggtcgtcactaccacgaccccggtacccagcccgacgaatctcagtccggccgtcccggcacccaaaccctggggcaagggctctgccaaggcctga

SEQ ID NO: 1428 - DNA, 2661 bp, Chlorella protothecoides
atggtgggcgcactagggtcgtccctgatgacgatgacacgtcagttccttatgcgcaaaggattcagcgcccttcaccatggccgcaggttctgtctagggcgcgatccggaggtggcagtacttcacaagcctatttgcagctcaaggaccgagcttattattcctggcaacatggtgcaagtcaaagctcactggtcatgcacgagcatgcatggcaagagctcgagcggtgaaggaagcgctcacttcccttcattcttctccttggcagccgcgcgctcgagtctgtccttcaggaagagcgtgaccacggccaggatggacagcaggacggcagctgcaaatgcagcctctgcgaagaacagtcgtggggttggaggcttgtggtatgtgaccaagaggtgtttggcactcaccctgcatacatcctcctactcctggttcacacaagatcttgttggcaatgaaccccctctggacctcgcgatttgcagggccaggaaatgggcgaccctgaaaacctcactttggtgcactcccgccaatcaactcacccgagttgtactccttgtaagaagactccacaaagagggtcagggtctgggtctggccgatgatgttgccagagatgacgctgaccgccccaaactcccccatggcgcgctgaggaaggagagggaggatggatgggtgccttgcagcgttggtcaggatgatgccatacagcagaccccatcgaatattgggcagcgtgaccttccagaatcagtgatatgcatgagcaagcatagtctgccagaccaaacctgcaacccctggcagcattatgactgtgctcatctacacaaaaacagcagtcagctgtacaccttccctccaggcccccacggaacaactcgccaagggaggtggcagcctcctcctcctggatgtccatttcctccagcaccggcatcagctcacggaccacaaacggcatggtcacaaacatcgtggccaaagccattcctgcaaggcaaggggggagagggatggggtaggtcggggtgtttgaccggcatctatgcatgggaggcaggctggtgtgaggagccaagcaaagacgatgttgaacccgaacctagagatgaggggcgcaaagagtccagagcggccgtacagcagcacaaacatcatgcccgtgaccacgggcgagatggcaaagggcaggtccatgaaggagatgaggagctccttgcccctaaaccggttgcgggacaggaagagcgccgccagcacgccaaacacggtgttgatagggaccgcgacggcgctgaggagcagggtcatcttcaccgcctgccggaactctggctccgccaggacggccaggaaggggccgatgcccttgctgaaggcttgcacgaagacgttggcaaagggcaggatgacaatcagggccatgtacccgatcccgacaaaggccaggaggaaggcgccgggggtgtcgatctggagcgagcgaggtggcgtctgagctgggtgcgcttggtacctttgcgccgagccgtggggccggcggagagttctcacagctggcaagacggcagctcgccggggtgcacagggttccagtcagccaccactccaccccaacggcagcccagctcaatgcgcaccttgcgccctgtggacttgtttgcgaggcgaaggggctccgcaggcacctctccccggcagagcagccggtatcagacctggtgggaagaagggccaggcgccgtcctggaggagcctgtgaggccaagagagtcgtctgaagcgccccgctccattcaagattatcgaatctcaaagttgagcagcgtcgtggcgtcaaggcgccgtgcgtcgatccctgacatagtccaggagtacgccccggccgcatccctggaccctcttcggagggatcatcgccaggactcgcgtcgcacccaaccctatgagcaagccatgaaggtctatattcggcgacctgctggcactttttcgatagcgcgccctcagcccgaaggggaggcacttgtctgggatcgactcggtgcagtgcaacactcaacaccgtgcatgagttggcgtgccggagcctgccagattttctggccaggtagaggacgggcaggcagtgcccagcacgaccttcctgacgcctgtgcctgtcccacgaatggcgagacgcgtgatagggcaccaggtgtggggacgttaggcatgcgaggtatatttgtccctgcctgctggctgtgtatgctggcgctggatgccagggcactaccctgcagggcccctcgcctgagcagtgctgctcccctcctggcactcccgcagatcccagatgacatcatgcaagaccctgggctgagggaagccatagcactgctcccggccaactacaatttcgagatccacaagacggtgtggcggctgcgccgcgccggggcccgtaccgtggcactccaattcccggagggcctcctcatgtacgcctgcgtgattgctgacatcctgcaggcccacgccggcgtggccagggcctacgtcatgggtgacgtgacctttggagcctgttgcgtggatgactactcagccgtcgcgctcggtaggcgtggctccatgctccacaccagagggaaatag

SEQ ID NO: 1429 - DNA, 492 bp, Chlorella protothecoides
  modified_base (126)..(135): a, c, t, g, unknown or other
atgggtgtaccctgttgttattcttgctcgaggcccctacccttgccaacccatcgccgcaacccatccctcacccatggatcaattcaggggccgacttcctggtgcactacggtcacagctgtnnnnnnnnnngcaccggagggaaatagagtggcaggcgcagacgcttctagtcctgacaattcagataccaagctcaagcagggcatgcgttgctcctgggatgggtgtaccctgttgttatccttgctcgaggcccctacccttgcccacccatcgccgcaacctatccctcacccatggatcaattcaggggctgacttcctggtgcactacggtcacagctgtctggtgccggtagacatcacctccatcccctgcatgtatgtctttgtggatatccagatggaccttcaacaccttgtggacagcgtcaggtgcggtctggcggtgggaagaagtaaagaggagggagagatgttggggtga

SEQ ID NO: 1430 - DNA, 822 bp, Chlorella protothecoides
  modified_base (494)..(503): a, c, t, g, unknown or other
atgatcgccaacccgggcgtcccggcctaccgctatgacccctatgcccgcagcctcacgcgggagggctacgaccacaagggcatgcaggccgcgcgacgggaagccatccggaagggtgcgcgcggcgaggtctggggcctcgtcctgggcacccttgggcggcagtgtttagaacaacaagaagatgtaccagcgccgcattgggccttgccactgagcgacaggcaggctgctgcgccttgggccgtgcccgggctggcaccagcccgtaaacctcttcccctgccggcggcatgcccgacccctcaaccctcctcctcccccacccacatccacacgtgcacagggcaaccctgccctactggccagcctgcagcgcctggtcagggccgcgggcaagcagtacatcgtggtgctcctgtccgaggtgtcccccgccaagctggcggcgctgtcccccggcgtggacacttgggtccaggtggcctgcnnnnnnnnnntgccaggctggcggctctgtccccaggcgtggacacttgggtccaggtggcctgcccccgcctgagcatcgactggggcgagggctttgcccagcccacgctcaacccctacgaggcctttgtggcgctgggcgaggtgcccggctggtgggagggcgacggcgatggggagggaggcgccgcgccctaccccatggactactacagcagcacgggcggggcgtgggcggggacctaccatcgccccaagcccaaggggagcggggcagcggccctggcgaggctgagggcatcccgggccggcaaggccagcgaatga

SEQ ID NO: 1431 - DNA, 1293 bp, Chlorella protothecoides
atggcggaggacatgtctacgtggaggcccgaaggtcgcctggcggggcatgaggtggcaacctttgctggagggtgcttctggagtgtgcagcttgccttcgaccggctccacggcgtgctctccagctccgtgggctacgcgcagggccaaaaacagcatccgacttacaaagagattggagcgctgcatgcacggggaagacggtggccagggaatgttttgcggccagctccctccaggcttagatcggtctgtgccggtcccgacaccgtaggtgtgcacgggaacgaccgggcattccgaggcagttcagctcgtattacaagcagtccctcggtacatgaagcccagcaatctcacctatgcattgtctcgccactgcctgcagagatagaccctctccagcgcgaaggtcagggcgcggatgtcggatcgcagtaccgtaccggcatctacacccacagccaggccgccaagcagaaggtggcttccgtcgagggctgtgcggtcgaggtggagccattcaccgtcttctggcccgcagaagagtaccaccagagcacctggagggtggtccaaacgtaccatgccgttcttgtggcagctgcatgcagctcgtcagccagacccaccctcttccacggcaggggagagagtgccttggctgtaacccgccggacttgggcagacgaacggatcgtcgaaatgagtaggaaatcttcgaactgccgctgccgccaatccttgctcctttgctggtcggactgcgcgtatgtgcaaggtgcagggccacacccttcacctcaacttggccaagcagctgaacctcgccttcaagaagaaatttgtgcacagtaccgacaccgagctcaaggttcaaggtcgtctgaataccaccaatgcagcggccaccgtcaacaccagcctcaacaaggtgggctggttatgtgcggcacgggggtgggggcagtatacacagcacatcttcgatcgcccacgtctcggcccattggtttggggtgccgtaacccttgctttctggagtttaaccagctggccatcctctccccgcagtacttttacctgggctcttccgtcgtgaagccgaatgaggcctaccagccggacacgaggctgagggtaggactgggggccaaggcatcgacatcctcagacgacgtcaccattaggtgcggggccccggagactggacctccgactccgtaccatgtgtgggaaggatgctgcactgctgttgaggggccaggacacagcacctgccccgcctga

SEQ ID NO: 1432 - DNA, 213 bp, Chlorella protothecoides
atgggggagtttggggcggtcagcgtcatctctggcaacatcatcggccagacccagaccctgaccctctttgtggagtcttcttacaaggagtacaactcggaggctgcatttgcagctgccgtcctgctgtccatcctggccgtggtcacgctcttcctgaaggacagactcgagcgcgcggctgccaaggagaagaatgaagggaagtga

SEQ ID NO: 1433 - DNA, 342 bp, Chlorella protothecoides
atgccgccacgcatgctgcacgtggatgctcagcgacgtgcccgccctcacaccccagactctgctgccacgcagagcccatgcacccacgcattccctcctttccaccctccaggcaacgagaaggtgctggccacggtgacggccatcatcgacggcatggggtcggtgggcgcggccatcgggcccatggtcacgggctacatctcggagctcccgggcggcttcgacaacgtcttcctcatgctctacggggcagccgcctgcgcgggtgggtgtgcaaaggggagggtggagggccccccccagtggtgggccctgtgcgtgcgactgcacccttga

SEQ ID NO: 1434 - DNA, 204 bp, Chlorella protothecoides
atgccgtttgtggtccgtgagctgatgccggtgctggaggaaatggacatccaggaggaggaggctgccacctcccttggcgagttgttccgtgggggcctggagggaaggcgcatctgggtggcagacattctggaaggtcacgctgcccaatattcgatggggtctgctgtatggcatcatcctgaccaacgctgtgagtga

SEQ ID NO: 1435 - DNA, 468 bp, Chlorella protothecoides
atggccctgattgtcatcctgccctttgccaacgtcttcgtgcaagccttcagcaagggcatcggccccttcctggccgtcctggcggagccagagttccggcaggcggtgaagatgaccctgctcctcagcgccgtcgcggtccctatcaacaccgtgtttggcgtgctggcggcgctcttcctgtcccgcaaccggtttaggggcaaggagctcctcatctccttcatggacctgccctttgccatctcgcccgtggtcacgggcatgatgtttgtgctgctgtacggccgctctggactctttgcgcccctcatctctaggttcgggttcaacatcgtctttgccttcccaggtatggagggacccgggagtgagggtggcatggagaccagagttgatgagatggcggtgcgggagtgttcaatggtcattctctatgaccaaggcatgtggcagtgcaagtag

SEQ ID NO: 1436 - DNA, 2343 bp, Chlorella protothecoides
  modified_base (848)..(857): a, c, t, g, unknown or other
  modified_base (1250)..(1259): a, c, t, g, unknown or other
  modified_base (1823)..(1832): a, c, t, g, unknown or other
atgagccctaccaccgcaacccaatccagaatttcccttgcaggaggaaggatgggagaccaagacccccagcgtcaccgagaagacggtgcccgaggtcggtcccacgcccactgggcttggcctgtcctccctcccccctgtgacccctggggtgcctcaggcccccacagagcaccagggacgtaccccgcagcccacccctgcccatggtctgctcccgagtggcaccctcccaggggtagaatcggccctgaaggcagctgcaaagctgtggtcatgggggaggtgtattcccaagatgtggttccacatgagcctgctcttcaatctctcccacatcagcgtgcctctctccctgcacgacacgctcctcaggtcctaggtggcagtgatgatgccctggtagaggcaacaccagtcgtgtctgcccccaccctcgcccccgcccccttcacctcggcctacttctccccagtggggacactgtctccctgcgatttctccacaccccccgagtctccctgcgcgtcaatctcggtcggcgacgccatcgctgctgccgtggcgtgcagcccgggggtggactcggccagccccggagtggactcagccagccccgcgccggcgtctgccccacccatgggaccccgacctgtgaccgtgcttgggcccagctccgccatcgccttttccgccagccccgggcaggaggaggccgcccctgccctcgccagctcactggggagcgggacaaaggcgagcgccgacacgcccaatggtaacgccggcacgcctgccaccgccggcacggctgccgccggtatgcctggcctcagccccgcatnnnnnnnnnncgcccaatgccccgcaatcctcttcatcgccgctggtgcggctgctggcgcggcagagcgcgagcccccgaccgctgcctcaccggaggcagccactgcggtcaacagcgccctggccagggaggtggaggagctgggggatcaaaccatcgaggaggaaggcgctgaggacaccccgccgctcctggctgcgaccgtggcaggcaccgatgccgtgctgccgcaggggcgcccacgtgtagcctccaaggtgtctgtccccagctccggcttcgattccaggtttgaaatcctgggcaggacatgggagtggccggtggtagttgtggggccggcaggaccatgttccccgcagcatgcgtcttccttcagagctgagccggatttttcaannnnnnnnnncctgggcaggacatgggagtggccggtggtggttgtgggggcggcaggaccatgtttcccgcagcatgcgccttccttcagagctgagccggagctttcagccaccgagaacactcgggcatgccccttggctcaccccaaatcccacaatgcattcccccgcaaggcgaaggaggacgctcccaaagactgtgaggacgaagttgagaaagaggaggaggaggaggaggaggagtacgatgcctacggggaggaggaggcctgggtaagtgtggagtttgcaggctgccctcatacaatgctgcggtgtccctcccttgcctggcgagcattgcgcgaggaggaggagcaggctggtgcagaggacctcacctccgctctcgccgggcttgagctggggcccgaggcgaagctgcggggcgtccccacccctgtgggaacacacatcagggccgccacatcaggtttgatgattgatggcgtcatggcctgccacgcaggagagcctctgcaggactggcggccaggtggggtcaagttcaagttccagggtggtggtgttcnnnnnnnnnngcaggagagcctctgcaggactggcgggtatgcaccccctaaggtggtgatgtctaataacaccaggtttgttttggtgacgaggttcttaggcgccgaagccgtacagggtgcggccctggcgcttgagggcgtagaccacgtcgaaggcggtcacggtcttgcggcgggcgtgctcggtgtaggtcacggcatcgcgcacgacgttctccaggaacaccttgagcacgccgcgggtctcctcgtagatcaggccgctgatgcgcttgacaccgccacggcgggccaggcgacggatggcgggcttggtgatgccctggatgttatcgcgcaacaccttcctgtggcgcttggcaccgccctttcccaggccctttccgcccttgccgcgcccagacatggttgcaggaggccgggagctcaccaatccaagaggggttttagaaagcgtgggaaagaacgacgatccactgcgggaggcacaaacacgttcaggcatggacatggggct

SEQ ID NO: 1437 - DNA, 312 bp, Chlorella protothecoides
atgtctgggcgcggcaagggcggaaagggcctgggaaagggcggtgccaagcgccacaggaaggtgttgcgcgataacatccagggcatcaccaagcccgccatccgtcgcctggcccgccgtggcggtgtcaagcgcatcagcggcctgatctacgaggagacccgcggcgtgctcaaggtgttcctggagaacgtcgtgcgcgatgccgtgacctacaccgagcacgcccgccgcaagaccgtgaccgccttcgacgtggtctacgccctcaagcgccagggccgcaccctgtacggcttcggcgcctaa

SEQ ID NO: 1438 - DNA, 816 bp, Chlorella protothecoides
atggcagggttcagcaccggagcaggggctcccgtgcacgtctccgccggacgcctggaggccgcgaggcggctgctggacgagactgtaggtgcggcgcccgccgccgccgaccggcagggagggcccatcggcgagggcctggctgaacatagccccacgcccggcttcacgacggggctaggggcgccggtggccgtctcgtcgtcccgcctcgaagccgccaggaagctgctggccgaggagccacccgccgccgaggacccgcgccccgcccccgccaccgtggcggcgtgcttcagcacggggctaggcagacctgtgagcgtgtcgccgtcgcagctggcagctgcgcggaagctgttgaccgaggacccaccccaggccggcaagaccgcagacccagcgccgccggccgccggcccctcctcgcccatggtggggttcagcacggggctgggcacgccggtcgcggtgtccaggaagcgtttggaagccgccaggaagcttctcactgacgaagacggcgcaaacgagggccacccggcctcggccttcccgggatccagcggagcaaacgagggccacccggcctccgccttcccgggatccagtccggccggacagccagatacgcccagcctcagggtcaggccgcctgcaccgggcgagggccccggccccggcgagacgaccccctgcgccaacacgagccaccagctgctgagtccagggtccaccggtctccgctgcgggcccgggcccgggcgggcccgctctggtggggtgcagccctcaaggtttgtcttggcatga

SEQ ID NO: 1439 - DNA, 237 bp, Chlorella protothecoides
atgcagtccccaccccttcatgtacctgctccgcaggtggagctcacagacgggtggtaccggatctggggccggctggacgccccgctcgccgcgctgtgctcgtctggcaggatcgcgccggggtcaaaactccgcatttgcggcaccaccctgcagggcgcagggccaggggacccgctcacggcggccgccacctcgagtctgcagctctgcatcaacgggacgcacaggtga

SEQ ID NO: 1440 - DNA, 357 bp, Chlorella protothecoides
gggcgcccgagcggcggcggcgccgcggccgcgcgtgccgaggcgttcggccgcgtcgcgctgggcaatctgaacctctacaccgcgccgcgcgagcgcaagacgccacgcgacgtcgagcgcgcggaggtgcacttttcgtatgccgcccgcgagtatgcgcgcgctctcgagcgcgaccctgccaacctctgggccgcccaggggctgggctgcgtgctggccgaggcggggcacctgcgcgaggcgcgcgtggccttcaccgcggtcaacgaggcggcggcggcctcgggcggcttcgtggccgcgcccgacgccggggtcaatctcgcgcatgtcgctctggcagaggaggcg

SEQ ID NO: 1441 - DNA, 3324 bp, Chlorella protothecoides
gtgtcagccgcacgctgcgccaccacaaaagcccttcgagggttccggcgtgcgagcagcgcgggggcggcctcccgggtctggcaccccaacatccccccctcagaaggaggtgtccagggcgttggcaatgagctccgcctgctcctgggcgtgcaccgagccgaagccggtggccgtggaggccatggtcttgcgtcccgagtacttgatgcgcatggggggcgtgccgcccacgccctggatgcaggtctgcaggcggggctggacgtggaggtaggcgcccatgttctttggttcctcctgggcccacagcacctccgcgttggggtagcgccgcagctcccgctccaccaggtcgaaggggaagggcgcgagctgttcgatgcgcacgatggccacctcgtcggccttgccctcctgccgcgcccgctccgtggccagctcgtagtagagcttgccggagcagaagacgacacgcttgacccccggcactggctccggattgggggagcggtcggtggcgttctcgtccatgatgacgcgcttgaagcgcacgccctcgatgtacttatcgtcgggcttgtcgtcgaactcggtgagcggggagcgcgccagcgggtggcgcagcaggttcttgggcgagaagacgaccagaggcttgcggaactggcggtggatctggcggcgcaggacgtggaagtagttggcgggggtggtgcagttgaccacctgccagttgatgcgctgggtctgggagcccaggtgcccacccgtgaaccactccttctcgtcgatgacggggggctggtacgggtcctcgtccaccatctgcaggaagcgctccatgcgcgcggaggagtgctccggcccctgcccatcgtagccgtggggcaggagcacggtgagccccgactggcgcagccacttggcctcgccggaggacatgaactggtcgaaaataatctgggcgccgttggcaaagtcgccgaactgggcctcccacaggaccagcgcattgggcgactccaggctgtaccccagctcgaagcccaggatgccgaactcggagagggaggagttggacaccgtgaactgccctgcgcgctggtcctcgtacacatgggccagcggtgtgtacttgtccccggtggcctggtcgtgcaccaccgcgtgccggtggctgaaagtcccgcgctccacgtcctgcccgctcaggcgcacgtggttgccctccgccagcagcgtgccaaaggccagcgcctccgcgaacccccagtccacgccctgctcccccgccaccatggcgcgccggttctcgtacaccttggcgatctggcggtggggcttgaagctggccggcagcgcggtgatcacgtcgcccacggactggccaccgcagagatacatgcagtcgacgctcaggaatcaagggtccctccccctcgctctaaaaaaccaaccccccctcaccttgaggaggtcaatggggacgccggtgttgcggatgcgcgaatactggatgggggagttgaagcccttccagtggctggacagccagtcggagagcttgggctggtgctccttggccccctcaaacgcggcggccagcttggcctgcaccgtgctttgaatgtcgtccaccgtctccttgctcaccgacccctcggccagcaggcgctggacgtagagctgctgcgggttggcgtggcgcttgatggcggagtacatgaggggctgggtgaacatgggctcgtcgatctcgttgtgtccgtagcgcctgtagccgatgaggtcgatgacgacgtcggagccccaggtctggcgccactccgcggccagctcgcagacgcggaccaccgcctccgcgtcgtccgcattcacgtggaagacgggggcggagagggccttggccacgtcggtgcagtagggcgaggagcgcgacttgcgcgggtcggtggtgaaggccacctggttgttgaccaccacgtggatggtgccgcccacggtgtagtcgggcagggccgacatgtccagggtctcatacacgatgccctgccccgcaaacgcgccgtcgccgtgcatgaggatgggcaggttggcgcggcgcgagtcgtcggccgagtagtactgcttggcgcgcaccttgcccaggcacaccgtattcaccgcctccaggtgggaggggttggccagcaggctcaggtgcacgcgcttgccgtggatggtggggcggtcataggaggtgcccaggtggtacttgacgtcgcccgacccggtgtaggcgccgccgccctcgccggggcgccgccctgcgaactcgctgaacacctgctccatgggcttgcgcatgacgttggccaggatgttcaggcgcccgcggtgtggcatgccgatgaccacgctgcgcgcctccagctcggccgcggagtcgatgatggccttgagccccgggatcagcgcctcgcacccctccagcccgaagcgcttggccgcggtgtatttgttggccaggaaggactcgaagagctcgctccaagacaggcggtccaggatgagcatcttcttctcgcgcgagtacgactcgcgctccgcggtctcgatgcgcgcgcggatccagttgcaccgctcgcgatcgttgatgtgcatgtactcgtagccgatggggccgcagtacgtctcacgcaggcgccccaggatctcgcgcagcgtgcggatgggccggtcctccgccatgaacccctccatgttccaggcccagcgggtccagctgcgccgacaggtggcccatcacctggtaggcacgcaccagcagcagcaggcgcattgactcctggatggactgggccgacaccgccgccgcggccaggggggatgcgttctccccgcgctcaaaggcgtcgtacgcctcggccaccgcctcggcggacacacccatgtctgtcgttgttgtgtgggggaggaagctggggttggggataccggagtgttgaagtttgccagggggtcgttgttagaagcatggtgttggggccaagcagggaaaggggatctcctcaccccgcgccccaggcagagcacagcaccacaggaggcccaggtgcggtccacgctcgcggggtcctcccggtagcgctgctccagctcctccaggtaggtggaggaggtgccatccaggaaactgtccttcagcttagagagaggcaccggtttggggtgggcctgtcccgcctcggcgctggacttgaagtcacgttggacggcagcgagcgtgcgggcgacgcggcccgccacccgacgggacgagtgcgccaacatggctga

SEQ ID NO: 1442 - DNA, 657 bp, Chlorella protothecoides
atgactgcgagcccacccccggcagcggcagccccggccaaggctgatggcgccggcccccccgccgtcaccgccgccgccccgcccggcaccgcccccgccgacaccgcgcccgaccccgaggccgcggcccggatcgcgcgcgaggacgccgtgctggcgtccggcgccgacccggctcgccccttctcccactgggatgcggtgctggccgaggcgcactggctggccgtcgacttcgcgcaggagcggctgtggaaggccagcacggcgctggccgtggccgccgaggttgccggaaagcgcggcgagtttgggctgcgcccgccgccgcccgagcaccgggccttccacgacgagatcgtcgcggcgcgcgcggcggcggtcgccgctgcggccgccgtggcgggtaagcgcctgacggccgccgcgcgtgccgaggccggcgccggcctggccctggaccccacagccgaccccatctgggcggacctggccctggaggccatcccccccacgcccccgggcttcgactacgcgctggtgtactctgtggagccggagctggcgcccgcgctggaggcgaccctggagagccgggagctggagcgcgccatcgaggcggacatggcctgggcagggcctggcggcggctga

SEQ ID NO: 1443 - DNA, 315 bp, Chlorella protothecoides
atgttggcgcactcgtcccgtcgggtggcgggccgcgtcgcccgcacgctcgctgccgtccaacgtgacttcaagtccagcgccgaggcgggacaggcccaccccaaaccggtgcctctctctaagctgaaggacagtttcctggatggcacctcctccacctacctggaggagctggagcagcgctaccgggaggaccccgcgagcgtggaccgcacctgggcctccttcttcaagtccatgggtgggctactgggggcctgtatggcgttcccgcggggggtttcgaatcaacatgcccaccgggctgcgtga

SEQ ID NO: 1444 - DNA, 552 bp, Chlorella protothecoides
atgccaccccgcaacgatggcaccctgcgaccttccctgctgccgcgcctggcgcctagtgtgtcatccctcgtccagccacagtcccggtctcatgcacggtcatggagtcaacccccctccccctccacaatctctcaccaggtgtgccgcggctaccgctacgagctggacgcggcgctgaggagccactttgcggcggtggcggaggccagcaagcgcgccatgcgcctggacgccgacctggccgatgggtgcctgctgggcgacgccggcgacggcgccgatctggccgacgacggcgacccctacgcccagaaaggaaagcgcggcaagggcggccgccgcgccggctacctcctggacgactttgcggagctgggcgacgcggagttcgcggagcgcgcgccgcccaagcgcgccgcctcgcggcagtacatcgaggacacgtacctgcgcaaacggcggcgcgagcgctaccgcgacgtggacgccgactacgacgtgggcgccgagccggcgacggggcggtacggcacgcgccgcgcgacg

SEQ ID NO: 1445 - DNA, 1599 bp, Chlorella protothecoides
atgggtgtgtccgccgaggcggtggccgaggcgtacgacgcctttgagcgcggggagaacgcatcccccctggccgcggcggcggtgtcggcccagtccatccaggagtcaatgcgcctgctgctgctggtgcgtgcctaccaggtgatgggccacctgtcggcgcagctggacccgctgggcctggaccagcgcgccgcccccgcggagctggaccacactttctacggcttctcggacgcggatctggaccgcgagttcttcctgggcacctggaacatggaggggttcatggcggaggaccggcccatccgcacgctgcgcgagatcctggggcgcctgcgtgagacgtactgcggccccatcggctacgagtacatgcacatcaacgatcgcgagcggtgcaactggatccgcgcgcgcatcgagaccgcggagcgcgagtcgtactcgcgcgagaagaagatgctcatcctggaccgcctgtcttggagcgagctcttcgagtccttcctggccaacaaatacaccgcggccaagcgcttcgggctggaggggtgcgaggcgctgatcccggggctcaaggccatcatcgactccgcggccgagctggaggcgcgcagcgtggtcatcggcatgccacaccgcgggcgcctgaacatcctggccaacgtcatgcgcaagcccatggagcaggtgttcagcgagttcgcagggcggcgccccggcgagggcggcggcgcctacaccgggtcgggcgacgtcaagtaccacctgggcacctcctatgaccgccccaccatccacggcaagcgcgtgcacctgagcctgctggccaacccctcccacctggaggcggtgaatacggtgtgcctgggcaaggtgcgcgccaagcagtactactcggccgacgactcgcgccgcgccaacctgcccatcctcatgcacggcgacggcgcgtttgcggggcagggcatcgtgtatgagaccctggacatgtcggccctgcccgactacaccgtgggcggcaccatccacgtggtggtcaacaaccaggtggccttcaccaccgacccgcgcaagtcgcgctcctcgccctactgcaccgacgtggccaaggccctctccgcccccgtcttccacgtgaatgcggacgacgcggaggcggtggtccgcgtctgcgagctggccgcggagtggcgccagacctggggctccgacgtcgtcatcgacctcatcggctacaggcgctacggacacaacgagatcgacgagcccatgttcacccagcccctcatgtactccgccatcaagcgccacgccaacccgcagcagctctacgtccagcgcctgctggccgaggggtcggtgagcaaggagacggtggacgacattcaaagcacggtgcaggccaagctggccgccgcgtttgagggggccaaggagcaccagcccaagctctccgactggctgtccagccactggaagggcttcaactcccccatccagtattcgcgcatccgcaacaccggcgtccccattgacctcctcaaggtgagggggggttggttttttagagcgagggggagggacccttga

SEQ ID NO: 1446 - DNA, 1716 bp, Chlorella protothecoides
  modified_base (127)..(136): a, c, t, g, unknown or other
atgcctgaggaggagcaggtggccgccatgacccccatcggcgaagagggtgtcacagccacggacgggggtggaccagggacccccactgccaggccccaggccgggagccctgcccaggaggctnnnnnnnnnngtcacagccacggacgggggtggaccaggggaccccactgccgggcctcaggccgggagccctgcccaggagggctctgtggacgccgtggaggcggaggcgactggtgctgggtcccaggaggcaggggcggggaccgcggagtccgcctccctgcccaacgccaagaagaagaggaaggtggcgctgctcatggcatacgtgggccacggctatgcgggcatgcagcgcaaccccggggtccgaaccatcgaggaggacctcttccgcgccatccacaaggcgggcggcatctcccacgccaactccgacgaggcggggttctccaagatccactggatgcgggcggcgaggaccgacaagggcgtgagcgcggtgggccaggtggtcagcctgcgcatggtgctggaggaccccgatatcctcgccaagatcaacgtcgagctgcccgcccaggtgggtcgtgtgagtttcggagtggggaatggggggaggaagttggagagagtgggatggaaacaggttggccgccgagggctgaaccccacccaggatccaggcagctggactctcatttgcggcgtgctcagacggccgccctgagtgtaccttccccttggacacgcttggtccgcgtgtttggtttcgggcgggcgacgcatggcttcgatgccaggaagcactgtgacaagcggcggtacgagtacatcctgccggcttgggcctttgaccccgccctagtccctccctccagcctgcttggggaggaggacggcgaggccgtgccgctcctggagacggaggaggacggcgaggctgccacggccctgggtgatgacgaggacgcgccggccgcaggtggcgacgccgctggggatccgggtgacgcgccgccggggacaggggaaggagtgaccccctctgtggaggcagacggcgcgctggcggcttcgacaggagtgccacagccagaggacaccggattcattttcgatgcggcctgtgcggcccgaatgacctccatcctctccgcctttgaggggacccacaacttccacaacttcacggtgcgggtcgccgcctccgcgccaaatgcgagacggtatatcctgtcgttcaggtgggccgggctgtggcggtttggggctcgtcctggggggctggctgatggggcaggccgaatggtgagcaggatcgattggagactgaatggggtggatgccttgggcggtctcaagagggtggcaagtatgcaaagggtgtgggtgggccgggctgtggcggttgagggcttgtcctggggggctgacagatggggcaggccaacttgtgagcaggagcgattggagactggatggggtggatgccttgggcggtcacaagagggtggcgagtatgcaatgggtgtgggtaccacccccagctgcaagtggtggtacgagttctgcctgaacatcgatcggagcacttccccagcacccccatccacatgtccaatcaccgaccctgtcgacgaccccgcctccctgattccaccaggtgcctgggggcctttgacatcggcgggaagccgtgggtga

SEQ ID NO: 1447 - DNA, 1323 bp, Chlorella protothecoides
  modified_base (1184)..(1193): a, c, t, g, unknown or other
atgacaaccccgatgtcctggccacggccgctgaggtgggtgtacggaggggtgctggtcgctgagcccgtgtggggatgcgcccgtcacacatgcatcgcaaagccccgctccgccctgagcaccccctcccggcactcgcaggagaacctgttcgagtggcacttcgccatccgaggcgcttgggacagcgatttcgccggaggcatctaccatggccgcatcctgctgcccgcggactaccccttcaagccaccctccttcgtgatggccaccccctctggccgctgggaggtgggcaccaagatctgcctgtccatctcctcccaccaccccgagtcctggcagccgtcctggagcgtgcgggccgcgctggtggccctgcgcgcgttcatgcagacccccgccggcggcgcggtgggcgcggtggacgcctcgcccgaggcgcggcgcgctctggcgcaggattcccgggcctgggtgcccaggtcctcctctgccaccacacaggagcagctgaacggcctgcacgcctccatgctggctgcagaggcgggctccagggccctgcacctcgcgcaggtggggtcggagcagcgggccggtccggcggcgccatcgcaggatggggcggggcctgctgccgcaggggacgtggcggcgacggccagtgcccaggctgatgctgcagcggcgcaagctgcagcgtcagagagcaccagaccgggtgttgtgagccctgccgccgctgctcccgaagcatccgagcctgaggatgatgcgcgaggggtcggtgcggacagagcagagccggaggtgcgtgccacagtggaccacgaggccctcccaccaagcggcgctgcggcggcggccgcccggtccccctccccggaccccaggcccgaggtcgtcgctcccccaccgttccccgctttcctgcgcatggccgacgcgccctcgctgcaccaccgcacgccgcctctgggggaggaccggggcctgacctacctggcgctcctcctggtgctctgcatcctggccatcatggtccgaaaggtgtgcgcttggggcgggggtcggggagagaaggtgtctgaggaagttcccagagccctgatggtacacaagaggcaggaacagcctcttgtttacattgtgtaccagactcacgactccgctccatnnnnnnnnnnagttcccagagccctgatggtacacaagagtcagcaacagcctcttgtttacattgtataccagactcacgactccgctccacctgcccctgccccaggtcttcctggtgatgcatgtggacacggatga

SEQ ID NO: 1448 - DNA, 333 bp, Chlorella protothecoides
atgtgccctggcaaccgctgcactaccctcggccctctggtcccacgctgcggcgaccgacagctgtctccacctgccccacaccactctggccccgggaccctgagctgctcccaccaaagtcctcgcaacaccacactctccctccatcaaccacgagtgcagctgctggaagagtttgacgaggagctggagggcacctccacgcggctggccgccgcgcagaagaagatccaggcggtcctggaccgcaccgggtccaagggccagctggccatcatcggcttcctcctcgtcgtgctcgtgctcctggtggtgctcgccatcgcatga

SEQ ID NO: 1449 - DNA, 651 bp, Chlorella protothecoides
atgcgtttcctggactgggtaggccccctccgcgcccagggattctccttctacctggaccgcctggccacccaggtgcatgctatgcatgctgtgcatggcagagttgccttggtgggccactccgcgggcggctggatcgcgcggattgccctgggcagtgtgccctaccagaaacatgagtatgggctgtcgcccaaagttcacactctgctcaccctcggcacgccgcatgccagcattgagcagtacccattctacaaacctgtggagaccctggaccctggccccaccgcccccctggatcctagggacctcacgagcagcctgaggtggaccaactactactaccccaccggcgactgctttgggggcacgcggatcgtctgcgtaggaggacgtgtctcgctcggcccaggggacggcaggctgcggcggtacctcgtcttcgagagctacatggcagggtgtggggatggggcggtggaaggggacggcgtcacgcccctctgcatcgccatgctgcccgggtccgagcatgtggtgctggagggggtgtggcacatgccgcagagaaagggcggggggcgctggtacggggacccagaggtgctgcgccagctggaggtgtggctgcagcccccggaatga

SEQ ID NO: 1450 - DNA, 1683 bp, Chlorella protothecoides
atggggcagctcctctgcgcagggatgggcgggccggggtgcatggtcaagatgcatggacagaacatgtgcgacgcatgtagaccaacatgtgcatggctggagcgaagattgtccatgcgaaatccggtgacatgggaagaggcaagcaatggtagaatactggtgaaacaacattgccctggagcatttttaccactgccagaggtccctcaccatagacaaccgcctcgtagcgcgtgtgggagtcgccatcggacgccttcaggcgaacctgccaattgcgcggttccttgcgagaacaattatccttcctcatcatacctgagtctcgacagactccacagagatcgaggtggaggaggagtgcttgcctttgatctgtgcgtgggtgcggtcagcatgggtctggcacccccgccccatgccgcccatctccatcatcctacctccttggttgctacatcgactgcctggttcacgcgcgcgtcgttctctccggcaggtttggagctgaatccgcctatcggtgtggagggcaaacgcgtcgagcttgagagaagagaccgagggaacggcacggcagctagccccagtgtgccaagggcggcaacacctcggcagatcccagggatccgcagcgaaggtccctggggtaacaaaggtcatcctgagctggttaatattttgaactggctgcccgccgtgcagccacgcctggactggccgctgcagccacgagcctcccgtcatgacatctgccaaggtaggagggcatggggatgcgcgatctccacgactggccccgaatcaggctccttggtgggcccatctcgtctccgtggcgcgactggcgcccgtcccgctcacccaccgccacccgtctgtcgccgggacacaggggctgtggacggaagaggaagatttcctcctggcgaaatggcaggtgggactggtcctggagtcactccggtctgcatgcgggtcctgtcgaggcgctgcgcgcgtccgggagcgcttgcaccttcctccctcgtcgctaacactctgcgtgggctccgcgatgtgcaggaggtccacggaaaccgctggagcgaggtggctcgccacatcggcaccaagaccgggcagcaatgcgcgcagcgctggcgccatcgcgtgaaccccaatatcagcaagtgcctcccctcatcctcgtcctccccagggagaagtggacagaagcggaagacaaccagctcaccagccttgtgcggcagtatgggagctgctgggccgagatctcgcgcaagtgcgtcgctgaggctgcctggttgggagcccgggctcgggaagggtggcggcacggctcgtgctgcacccctatcagctagcctggatgagagccacccgacccctgacatgcaccctgccggtgtgaagccagcatgcatgagcccacataccccaccacccccccggcccctcagctgcgccacattcccctacacctcactcttccccctcttccgtgcacagtttaccgggcagaacggatcagcagtgcatggggaggtggcggcgccatctggacccctcggtccgccgtgtcagctggcaccccaccgaggacgagaagctgagggagctcgtggccgagcatggtgggtggcgcagggagcagggccggctgatcgctgcgcg

SEQ ID NO: 1451 - DNA, 363 bp, Chlorella protothecoides
atgggtagcatcccgaccatgccccccaaacttctaattcacacccctatgtgccttgctctttccaggtatgcgagcatccggtcgctgctcctgggttttgctgccaccttcttcgcagcgtttgacatccccgtcttctggccgatcctggtgctctactggtttgtgctcttcttcgtcaccatgaagaagcagatcctgcacatggtcaagtaccggtatctgcctttctcatggggcaagaaggtgaggttcgctcttgcctcttgggcatcgggggtgttgggtggggatactgtcctgtacagcacttgtaccactcccttccctgcactgatttgtctgagagctgacaactga

SEQ ID NO: 1452 - DNA, 1461 bp, Chlorella protothecoides
atgggctggatgattccaccacatccgggcattgcttcaagcaaaccctgtgtaccctgtcgccgacccatctccacacagagggaggaccccgtgcatgccctcaggctcaggggccatgcctgcgccgtgccgggcgacagcaggacgtgctgcgcagctgacctggcgcagggcttggtccagctcccaggcggcgcacccggggaagatgtggaccgctttgacgcccgcatgctgctggacccggcggagctggcggcggcgggccccgcgccgggaggcgcggggcggggcccggccgacaccgagctggaggagcagctggcgttcgagtcttaccgcgacgtcatccggtgggcctgccagggcctggcgccccacgagggcctggcccgcgcggcgcaggaggacgttgccatccgcacggcgcagcgacgcaccgcgttgggcctggcggcggggatgcgggggggcgggggacctgcgggccgtgaccctggatatgcggcgggggggcttggccacgacgcccccaccgacggggacagggttagcgcgtcagaggggagcggggacgaggggggaggcgaggaccccggcgccgacgtgcgaatggacgcgctggcgcgcgcctacggcgtcgcggacttctcggccatgctgcgctgggccgtgcggcgtgaggcggcggccgcggcggccggcctgtcggcgcgcctggccccgcgtgggccggtcggcggctgggccgcgcgcaagcgggcgctgaggctgagcgtccctgcggggcaggacaggtgctctgaggggcccggcacccatgcgggcagcctggactggatcccggtgcagcaggcggtggaggtggggttgcgcccgtgcctcagtggggtgggggcacgccccgggccctcgctgcggggccaggcacgggaccgtgacctcggcgcacgggcgggggcgcaggggccgacagccctgccggggtcccgaactgcgccccaggcgcaccagcagtctcctggccctgccccgccgcccgccagggagacacccaaggagcgcctgcagcgtctcatggcggcgcagctggggaagaagatccaccaggatgcggcggcccaggccctgcgccggagcctgggacttccagggggcccctcccccataagctctcacactccacctgcccgcctccctccgactcctgtgcaggaggtccgcgaggcagctgctctttcagcggcccatgcttcccaggccccccgccgggctggggcaggcgggaatgcagatccaagcggccacaggtactgttttgggaatgtgttgggctcgccaggatggagctgcgaggctgagtgttacagcatgctgcaacagcgtggagttcaaggcactgcgcatgggaaggaacgaggaaatcttgctatgcatgagtgtactccacacagttga

SEQ ID NO: 1453 - DNA, 870 bp, Chlorella protothecoides
atgcacaatgggagcgatgccatccgatcatgcggagcatgcggtgctgtgccaggctacgctcagcttgtaaacagtcaatcacagcaagatgctaggataattataagaccgcgacatatgcagcatgcaatgtcggtgactccgacgaccttggcacgcgccacgagcagcagcaagtcctgcctggcaggtcgcgctccgaccacctcttccggacctgtgcgcgtcctgtcgacctgcggtgtacacagtccgacacaccgtctaaaacatgcaaccaatgctgctcgcaaagctcgtatgggcccgggtcctccaaaggcgcggcagaccgtggtttgcggggcaggcggactaacgcccaccagacatgctgtcttgcacgacttctgcatggtcctgcccgccggcggtctcctcctcgccgccggcgtcgccggcctcctggctggctccggcaggggcgccgcggtcgtggcatggggaggggtagcggagctgctcctcgccgccatgagcttgaaagcctggaagaagggacgccgctcagttggggccgccatcacctccctgcaaacaggtgcgctgcggaaatcgaacagaagagttgttaacatggcctgtgccatgctgcatgccctgcatcagcgagtcactctgtcgccccgccactccattgtcgcaggcatcgctgcattcctctcgctgcggctctatcgtgtcttcctggcctccgccaagcccgccgcccgcattgtgcatggcgtgctcctggcaatcgcaggctcgctcctcgttttcctggtgtacaacctgcttgcagggggaaacccaccgaagcgtgctcagcctggcgaggagccctga

SEQ ID NO: 1454 - DNA, 1260 bp, Chlorella protothecoides
atgctgtcaacacaccagcaccatttccctgcaacacatcttgacaccgccaggaaggccaaggcaatcgaactcatggtcgtggatgcgctgctggagagcgacgccgccctgaagctctccgaccggatctgggaccccgcagagttcagcctcatggacgactccatcctggattgggtggagaactaccggctcttcggaaacctgttcaccgtggaggacgagaacatttgtgccatcgagagggcgcaggtgctatgcgagggggttgtgatgggcgttgcgcacacacatcccgctgggactttgctcggaaatccagccgcaccaccccctcacaacatgtggacgcaggtcctgatcgaccgcctgcgtcgacgagacctctacaaattctgcgacgaggctctcatcccagctgtgagtcctggctgtctgttctcctcacactctcgcaacatgccccagagcatgggtctgcatggtccagcctggacggcgatgctgtcttctcactgtggcagatgggtcccccccaccgcggcagacgtggtgaactcgtatcgtggctcgggtgtgcgcatgcggccggaggacatagtcgtccaggcccccagagtctgcacgatccagatttgtggccggcccaccgctggctcctgcggggcatcgagcaccgatccccgtaccagagacaccctgtccatcccacgtcccccgcaggagaaccgaatcaacttctccatgcgcaatctgaatccgttggacagcgtccacttcttcgactccctggagtccacgcagaaacgggtgctgcggaccaaccagatcagctccatggtcgcccctgtcttccaggtgcgccgccaggcctggggtcacacgatccgggatgggatcgagggagaggcttctggacgacaaaaccgacatgcggggggccgtcctccgatcggccgcacagatttcgtcgagcaatggctgggcatccagagggaagatgctcagccagcactcagcgcccctgagtgcccaggcacaccccctgagtacacacccgcgccggtcgcaggaaaacacactccgtgtctactccaagaacagtgcgccggaggtggtgcaggcggtgcgggaggcttatggcgcctggctggtgaagcgatttgggggcaaggtgcagacactcacgccctccaaggcaccccgacccgcccgatgcgacacggcaccctccgaggacctgcacccagccgttaa

SEQ ID NO: 1455 - DNA, 540 bp, Chlorella protothecoides
atgaatcaccctctcgcgggattgccgtgtcccgtgatcacggcatctcacgacatggtccccctccccacaccgcaggctgccctgtcagcctacctccggaagacattgggaagcaaagcgccggcaggtcccctggagatatcacagttctcccacggtcagagcaacccaacatacttcctcaaggtaaagccctgtttgggtttcgcattgttggaacacttcctgagaaggcagatggctggtgaaggtcctctcgcctggcagggtaggctgctgtctttcacatcattcgagacacccacccttgccatccgttggctacccgcactccaatcctgcatccctcgaaatgctcaggccggcggacagcgctttgtcctgcgcaagcagcctcccggcaaagtgctgcagtctgcgcatgccgtggatcgtgagcacctcatcatgtccaggctggcaaacaccccagtgcccgtgccgcgcatggtgaggaggggatcgagaggtcagaggagtatgtcactgatgaattga

SEQ ID NO: 1456 - DNA, 384 bp, Chlorella protothecoides
atgacatctgacccacccccaccagcccgacgacagcctggcgagtcggcgctgcccgagatggtggccctgagcgagtggctcagcgagaacatccccgctgcagacgcagacccctcccgcacccgcatcacgcacggcgacttcaggcgagtggatgagtggaccgggagtgatgaggctggcaagcgcggcgatgacatcctctcacccctcattgccctgccctgcccaggctggacaatctggtgctggacccgtcgggtgctggcagtcctggactgggagctgtccacgctcggcgaccccttctccgacctggcatacaactgcctggcctaccacctgccccaggtaggcggctgtgtggagagggaactgtga

SEQ ID NO: 1457 - DNA, 264 bp, Chlorella protothecoides
atgcccccaaaaccctcgacgcagggtacccccggcctggccccgctgcccaagcccctccccctgggcatcccctccgaggcgcagtacctggagacgtactgcgcggcgcggcgcatccccgtcccacccaaggccgagtggcacttctacctggcgctgtccacgttccgcgcggccgccatcctggcgggcgtgggcgcgcgcgcggcggccggcaacgcctcctccctccgcgccgccgctgtgggcgactcggcggtg

SEQ ID NO: 1458 - DNA, 2958 bp, Chlorella protothecoides
  modified_base (2626)..(2635): a, c, t, g, unknown or other
  modified_base (2816)..(2825): a, c, t, g, unknown or other
agcagcaacaggcccctctctcacccagcacatgcatcgccggctgcagaagtggcctgtaaagccagaaagcatgccgctcaggctgccttgccgcctctcacccatggccctcccgtctccttccaaacagctgctgtccagcccaaagagcagcttgaatgcctgcaacgagagccactggtaccgcgcggccgaccagcggtgggtgcccgagttcgagagcgcctcgctcaagctgcatcactggcgcaagtcctggcagtggtttgccctgagccgcgtccacgcgaggttggtggtcgcagatgtggaggtggaggcccagttccagcagcactgccgccccagctgggtgccggagtggaggacgttccgcgtctgctactctggtgggtggagcagcggcggctgaggaagcacatgcacggtttcctgcggggccggtggccaggagcatggttggcgacgcctgggacttactgtgggctgggtcagaggggaactaacccttgtggcctccacacaccgagccctgccccagcaaacctgatgctgccctgcaccagcaaacctgacgctggtgctcggccaaggctcatctttcacggcctcctttcccattccccctttctagacgagcactacatacccaccctcctggctgtccatggactggacaatgagacggactgttcggggagtaccactggtgagaagctgttgggtagccattccccatggagcctggccctgttccatggacttctgtgcggggtgatacacatgccaggtgcccttcaggccccgcaacgactcatacatacctcctctcccttctgcctgcgcctgcaccagacgccaactgggaccggagggcggacaagtactccccccacccatacgagtacactcgatgtgagcatgactggagcgaatgtgtcattctgtgctgtgccgccggatcgaggctgggatatctgcctggtcatcatcaccggatcttgcaattcttcccagtactcggcacctgttgctcttcccggtgcgggatcgaagaaccctcactgccctaccctggctgcccacattccgccaggggacatacggttgggcctgctggccgccgtgcggcgctcttccctagcccagtgcgcgcacggcgagcgggagaaccggtctgtgcgcggcggcttcctgcagctgggccaggacccggcgccatccccagaggacatcgccgcggccgcgcgccgcgccgcgggttacgccccgctgggcagggactgcccgctcctggcccgcaagttcggggagggggtggtggcccaggcgctggcgctctttctgcgctgtcaccccagcatcggcgtgctgaacggcggcgactgccgtgacggaagggggctgtcccaccgcctcgcgagcgctgccctgccgtgggcggcggccgccgcggtctgctccgctgcagcgctgctgtcaggggcgatggccctcctgctgcaggcgctgttcctccagcacctggcggagcacgcgccgcacgatgcgccgcagaacttatcatcggaggctcagcttgtcacgtgcagtgttggcggtccttcactccgcgaagaggtgctaagagatgagactttgcttttcgaccgcgagtcagctcacgtagccatgtgtgaagggtatcgattcgtgcagtgccgatccgaaactgatgcggtgtacaaacaggttctagccctcgagaagaaatgcttctccaaggcagactcctggagagcgttcacgcgacccaccacgcgtaggggacatggcgctggagctacgacggaggaacaccttcatcatatgcatgacaatgcacgcggatcagcatgtgagtgtggttgctgttgcaggtccagctttgctggccaggcggccgctgtgagatgcatgcatcgcacaacacggcaacgagtgcctcatcagccctgcacagccgcttcactgacgcgcaacaggcgggctgggcatgccaagaggctcattcaacatgtgacccgtgagctacagcgcgcccgccgtatcagcaccttctccttgcatgtcgccgccgtgaatgagccggcactcgcactgtacaaggcgtctggattcaaggaggatgctttcctgcaggcaaggccttccctgtgtggcgtgagtgtcgtgatcccggaactcaggactactatgcacccggtcggcatgcacacaggcttccgagtcgatcaactcgccaatgagcttgtggcagcagaagtaaacagattggagactctcttcgcatcgtggcaaaacctggcggatatggcagcgcctgccgaggagccttcgccggctcgactattacaacctccgcaatacattcaagccttccgagtcgatcaactcgccgatgagcttctgacagcagaagtaaacagattggagcctctcttcgcatcctggcaaaacttggcggatatggaagcgcctgccgaggagccttcgccggtaaatggcacgaggaagcctcagccacaccggtgcaatgctcgcttggaggatctcatacagaccggtgcttattccacaacctgcgcagtccctggtcaccttnnnnnnnnnnataatgcagtacacctaaatgttcagaccggtccattatttgcagtcaatgcctccatgagtgagatggccaaggttgtgccaagatatggtgcccccaaactagcctccttacctcattccgtggcacacaagactcccagcattgccctttgtgcaggagagagccaaccggtccttannnnnnnnnncccgtggcactcagactcccagcactgccatttgtgcaggagagagccaaccggtccttaccttgtggtagaggatccatctgcctacctcgatccagacagggtctttaacaagagaagaggccctcagtga

SEQ ID NO: 1459 - DNA, 867 bp, Chlorella protothecoides
  modified_base (809)..(818): a, c, t, g, unknown or other
atgctgagatgcatgccgagcctttcattggcactcctgcgcccagcatctggcatagctgggaggtgggctgttcgtggggtctggacggagacacccgggcccaaggagtcggaggtccgggactccttttacgacagcacaattgagaacgtgcgctgggaggaggcttccagggaccatggatgttgcgcatcatggcctcgaagttcgctagcaggcgacctgggctcgagcatggcgtgcatgcatgcagcatgggcctctgcggagggcggtgtcctgctggctggatcacaggccagccctaccagactggcgccgccaagccaccttcccctacactctgccccctctccatgcacgcagtatgcccgtcagccgatcgtgcagctgacccttcgggggatgctggacatggggcgcgacaccctgaagggccctgcctgcaggatcgccagcgcccgcttcgtgcaggaggagctgcccaagcgcctggcgcgccgcctgctggacctccagctcctccctcacctggtggtgaccaacccccacatccaccgcgtgtacaccgcctactttcacaccctgcagaccttgctggccgtcccccccgtcaccagcctcgcgcagaacgaggagttcaccgccctgctcaagcgcctggaggtgaccaatatagggattgacggagcagcctctccgtcgcctgcacctgcctgtcatccaggtcctggctgtgccactcctcatcaatcagagccgctcgccccaccccgtgcagcgcccatgctggattacctggccannnnnnnnnnggaggaaggggttggggttgggggaggagatgaccaatgtagggattaa

SEQ ID NO: 1460 - DNA, 1110 bp, Chlorella protothecoides
atgagcgtggccgagggtgtggactttgcagggcagcgctgccggcaggtgggtgctgtcttcgtatgcctgaggaggcacaacaggacatcgggcatccctcattggcagggagatgaacgcattggatccatggcacacacagtttgcttctgcgcggctacaggcccccttatcctcccctcacaggtctgcaatgagacatacggcctggcgcccgacgtcgtcatcaccggggacaaacggctgaccatcccctacgtcccctcccactttgactacatggtgtacgaggtgctgaagaactccagccgtgcggtggtggagcggcacctgcagcaaagcgcgcacagcgccctggagcgccggctccctgccatccacgcccgcatctgcagcggcgaggggcaggtcacgctgaggtgtgtgtgcctggcggtgaacttgtgctccgctcctgctctcatgcttgcctccatgcgcatgcgggccgctggtggacaggatttgggagtttggatttaccaccatggggtgagagggagggtcggatgtctcgaatgctgttggaggtttattaggcttgctgctcggatgagggcctgtatcccaagctcttctctgaccatacacaggaaggagctgattgatggggtggagaggaccgaggggctcggctttgaccccagctttggtgcgggctggtcggttgcccagataccggtgaccagcggcaaccgcttcaggatggggggcttggggttcggactccccctttcacgtctctatgcgcgatactttggtacgtcagccgaggatggggcaggaggtggggttggctgggtggtctatagcatgacaccatggcaccccgtttggggaccccacgcgttggagagaagccctgcaatcccctctttgccagctcttcttcaagacttcctggccatcacgcgcaggtggcgacctagaagtccgctccattcaagggtatggaacagacacgtttctgaccttgaagaagctggaagacgaggactggcaggaggagtatgcagaggattatacgtcgcccatgccaaatctataccattgaacatgaggggatga

SEQ ID NO: 1461 - DNA, 657 bp, Chlorella protothecoides
atgcagggcgtctcggatctgagtgtgcgtcagaccgaggcgcaacgggaccttcgcgctttcttaaagctcctggcggccatggcgcgcagtgggtcggcagaagccgggcctgcagcagagacggagcttgtccagccgaggggctggggaccatcatgccgctccttcccccggacctgccggcgcaccccaagctgtgccactccttcttcgacaccgttgcattcatgctcgaggtcagtgaagtgtggtgagaacccttgtgcaggcagtgctgcactgggggccgctctctgctgcactacattgtccccaccccttgagcggaccctaacctttgatagagcacacccaccaaccagtcccatatcccacccaccacagacctttcccggcgctatggcgagcctgccgccgcacgtgtggggcgccctgatgggcaccctattccagggcctgggcatggcggggggcggcctagctctgacccaggtggtcctggacggtctggccgcgctggccaccttccacgtcaaggatgcgcttgcgggaggaaagggcgtcagggacagcaatgtacccggcccaggtggcggggggtccgagggctgggctggactctgtgagcaggccaacgctgctgtttctccatga

SEQ ID NO: 1462 - DNA, 2496 bp, Chlorella protothecoides
atgcccggccctcaccgcaatcacgcacgcaccttcgtcctgggtggcctcggctgcagcaagggccaggcccctgcgcaggccggcctcgaagaccgcagccgcggcctcagcgccgccctggacgccctccagtcccgttgcgagcgcggcccaggcgtccaccagcgtccgcccagcctcggtcagccaatcgtcgcgatgagggtccgaggccagcgtggacaacacggcacgcgtcagctccgccgcggcggcgatgcgggtctgggtcccctcgccgggctcgacccagtcccacagcctgggggccgagaccggggcggcggcggccgcagccgctacgaccctgcacccgtccaggaactcctcctccgtgccttgctcggcgcggtccagcgccgcgccgggcggccacagccacgcctggaatgcgaggcgcagggaccaggcggtgtaggtgggcgcggggcggtggggccccaggggctcgctcgtctgtgccaggtgcaccgccagctgccgcagggcgcgcgcagcttcccggtcgcatgctggcgggccgctgcgcaggatgttgtggagtgcatggtcgcgtcatctcccggcggggtagccatggagcattgtcctacccttgacaatgacaaggtacaggcgacatgtgatggggccactcagtggtacctgagcagctgctatgccctgccaccccccctcatgagatgcatcctgtctgagcatgccaagctaccagaacctacgaggatcttccccccccacacacaacagaaaagcatcctacctgagcgcggccgagaggtgcagacaccagtccagggcgcccgggctggaaagcacggcatgcacctcctgcgacagccggttggggcccctccggctcccatccccgccaggtcggtccccaagctgggtgctcacgtgcatcatcagggcctcccgcccagaggcaaagccccagctcagcacggcgcacagtgtggtgagcgcggcggccgcgacgccctggtcctcgtaggcagcggcggcgggcgcggccgcggcaccgacgcgcagcgcgcacagcgcgacctcggcgagggcgccgcgctcaaagtcctggcgagccttgtcgtgccagctcctgtttgcgatggtaagagggagggatggggcctcgagcggagtggcacaggctcatcattaggatgcgcagggctgggacaaagcgaccacaggggtgcccaatctcccaacgctgcatccacaaggcaggcaggccacctcaaagttccacggttcagcaggtgcagggctcaccagggcttctccatggggctggccgactgcgggttgcactccgcggtgagtgcggtcagcagctccaggcacgtgcgctgctcatgcaggtcccgggtggagagggctcggtgcacgatgccccgtaccaggccctccagccccagatccgattggctggcatcaccgtgcccgcgcttgaccagctgcgcggcggtgaggacgcactgggaccgcaccagggacagggactctcgagacctgtgcagggcctgttccagcacgaatctggtgacgccctggcgctctggggcccccagctcgggccagagtcggaggctggcgtctcgcagggtcaggaccgcctggaactgggccgccggcacgctggagtggctgaggatgtgctggcaggctgcgaggggggaggggctgcagcggaagtccaggagcgtgcgctctgcctccagacgcgtgaggggattctcgagggcattggaggccgcttcgatcaccgtctggatggaggccaaatccatggcaccggcgtgtgcgcctccctcgccccgccctgggggtcctaggcacgcccaccacgagctgtgcctgcaagcgcagaggagaatagactgtttacatattcaatgcgacggagtattacagcacacctatggattgcaaatccctgcatgtggctcgcaacatgctcacatatacaaccttcatggtcgtggtttgcgtgctgtcggaccgaaaatcaccgagcagttgacctccggtccctcgggagagcacctctgcggagtgatcgcaccgggatggcggacggacgcttcttctccaccaccaagaagggtgcgagatgaggagatgacgcggcacatccctgatcacgccccagaatcgctttgcaggggcgggacggggcatgaatgttggggtgggatcgctggcgctgagcagcggttccgccgtgtgcagtggggccctccacccagcccgagcggccctctcattgcctcaggggaggtggcggagtacaagaatgatctccacagcctggatcgcaagtcccagaagaacgcggtcaagcgcgtcattgccgcgatgaccgtgggcaaggacgtcagctccttgttcccaggcacgcatagtaggggggaatcctgtctctcaggcctgcctgtctcgtcatga

SEQ ID NO: 1463 - DNA, 714 bp, Chlorella protothecoides
atgttcgtgttcgacccccaatctcgccgagttactgcattgcttggttccctggcgcttgtcactgatctctgcctgtccactgccagcctttctcagccctgcgcggaatccttctgtgcgatcttcatcctacccttccgccccttgcactgcacagatgtggtgaactgcatgcagaccgaagacatggagctgaaaaaactggtctacctgtacctgataaactacgccaagacccagcccgatctggcaatcatggctgtcaacacctttgtcaaggtgggcgtgccgtgtgacatgtgtaggtggtgcgttgattcgtcactgtgcgagacagcaggcgcgcacccgtctttgatcctgatccccaccctcaaccagccccctccatccccgcctctccttctctctccaggacacgcaagaccccaacccgctgatccgcgcactggcggtgcgcaccatgggctgcatccgggtggacaagatcaccgagtacctgtgcgacccgctgcagcgctgcctgaaggacgaggacccctacgtgcgcaagaccgccgcggtctgcgtggccaagctgtacgacatctccgccgagatggtggaggaccgcggcttcctggacgtgctcagggtgtgcctggttgcttgtgggggggtgggaggctgggcaccgagtgcagactaccagcagggtgccaaggtggctag

SEQ ID NO: 1464 - DNA, 1575 bp, Chlorella protothecoides
atgggcctggcaggcaccatgccatgcccacttctcctgtcggccgctctcaaaccccacccaccctctccttccatcccgaccgctccatggcaggacatggtgggggacgccaacccgatggtggtggccaatgcggtggcggcgctggccgagatacaggcctcctcctccggcccggtctttgtcatcgacggcgcggtgctgaccaagctcctccgcgccctcaacgagtgcagcgagtggggccaggtcttcatcctggatgcgctggcggcctacacccctgccgactcgcgcgatgccgagggcatcgtggagcgcgtggctgcacgcctgcagcatgccaacggcgccgtcgtgctgtcggccatcaagctcatcctgcacgcagccaaggtgagctggctggctggtgggtggcaccttgaatcttgcccacaactccctccccatccctcctccctccatgcacaccacggccatgcgcagtacatcgacgacgccggcgcgcgcgcggccatccacaagaagctggccccgcccctggtcacgctgctgggcgccgagcccgagatccagtatgtggcattgcgcaacatcgacctcatcgtgcagagcgtgccgggcattctgtcccacgaggtgaaggtcttcttctgcaagtacaatgaccccatctacgtcaagaccgagaagctggagatcatgatcaagctggcggacgagaagaacatcgaccagggaggcttcaacctgctggttcaaccctctccctgggatccctctgggctcgtccaaccccatgacatgctgccaccccctgctcttcatcatccccagccccacccatctgacaaacctctgaaatcccaaacctgtaaagatgctgctggagctgcgcgagtatgccagcgaggtggacgtggactttgtgcgcaaggcggtgcgcgcggtggggcgctgcgccatctcgctggagcccgccgcggagcgctgcgtgaacgtgctgctggacctgatccagggccgcgtgtcctacgtggtccaggaggcggtggtggtcctgcgcgacgtcttccggcgctacccggggcgctacgagcgcgtgatcgcgccgctgtgcgagtgcctggaggcactggacgagcccgaggccaaggctgccatggtgtggatcatcggggagtacgcggaccgcatcgacaacgccgacgagctgctggagcagttcctggaggggttcccggaggagtcgcccggggtgcagctggcgctggtcaccgccacggtgaagctgttcctgaggaagcccagcgagaagccgcaggccctgatccagctggtgctgtcctacgcgacgcaggagacggacagccccgacctgcgcgaccgcgcctacatctactggcgcctgctgtcggccgaccccgacgccgcgcgcgacgtggtgctggcgccgcgccccgtgatcgaggccgccgccgacggcgtggacccggccctgcgcgccgagctgctgggcgagctgggctcgctggccagcgtcctgcaccgccccgccgcggccttcac

SEQ ID NO: 1465 - DNA, 2016 bp, Chlorella protothecoides
atgcacgtgagcacccagcttggggaccgacctggcggggatgggagccggaggggccccaaccggctgtcgcaggaggtgcatgccgtgctttccagcccgggcgccctggactggtgtctgcacctctcggccgcgctcagcgggccgcctcagcacgggaaccaaagagggcagacctgcatcagtttcatcttcccccaccgatcactccacaacatcctgcgcagcggcccgccagcatgcgaccgggaagctgcgcgcgccctgcggcagctggcggtgcacctggcacagacgagcgagcccctggggccccaccgccccgcgcccacctacaccgcctggtccctgcgcctcgcattccaggcgtggctgtggccgcccggcgcggcgctggaccgcgccgagcaaggcacggaggaggagttcctggacgggtgcagggtcgtagcggctgcggccgccgccgccccggtctcggcccccaggctgtgggactgggtcgagcccggcgaggggacccagacccgcatcgccgccgcggcggagctgacgcgtgccgtgttgtccacgctggcctcggaccctcatcgcgacgattggctgaccgaggctgggcggacgctggtggacgcctgggccgcgctcgcaacgggactggagggcgtccagggcggcgctgaggccgcggctgcggtcttcgaggccggcctgcgcaggggcctggcccttgctgcagccgaggccacccaggacgaaggtgcgtgcgtgattgcgttctcaccaccgttccctcctgtcttccatactcccgtccgcccagacgatgccggcgagcacgccgaggccgccacgctggagcacgacctggcgtgcctggccgcgatcggccggggcgccggcgcccccgtgctcgccgccgtctcgagcgccctggtggacgcccggtcccggctggaggcggcggtggcggccgcgagcgacccgtcggttcccctggagcagctgtgctggctgctccaggtggccgccgcgctgctggccgacgcgccgggggccgacgccggggacagccccgccttgcccctggcctgggatgcgatgagggacgcggcggcggcggcttccatgcagctcctggctgtcgcccagctctgcgtcacgcacggcgggcacgacgccctgagcccccggctggggagtgcagtgccggatgggccgaggcagtctgatgccttcccacctctgccagcctggggagtggacagaacagctcattttcatcagggcctgacctcccgcccgcaccccacacaccacaggctgctggaggtcacatgcgtgagcctgggaaggtgggcagccacctggttccccaccgaggccagcctgccgcccgccagcggggcgcaggacgctgacgtggcgcagctgctcgtccagctcgcgaggacggccttccttgcgtacccaggggagaccgccctgcacaaggcttgccccccgtgtttctcccgctcccgcactctctttgccattcttttccgccctcgtgctctcttctcccatccgcgcccttctcatcaagctcaaaccctcccccctgcacccgccttgtcgcagaaggccagccgccgcctgctgcgcgcgctgccgaccagcgcccctgccgccgccactctcctgcgctgcgattcctggctggacctgtgccgggcagtagcttcccaggagctgctggtcagtgccgacgtcgcgcgcccgctgctgtgcgcgctgtgcctggccgccaagggggacgacgccgagggggccgcggcctacgtccgccacctggtccagcccagcgtcgatcgcctgcaggtggtttggggttgggcagggggtccttctgggggtgggtcggtcggggtggagcacccgctggcgcccggccgacgagatgttgaaggggccgggagacgcgccattcacaagcgccaacttcccgccacgagcatgccattcccgtga

SEQ ID NO: 1466 - DNA, 453 bp, Chlorella protothecoides
cgcggctacgccaaggcgcactcgcgcctggccaccgcgctgggcgaggtcgggcgccatgccgacgcggctgaggccctgcgtcgtgcgctggcctgccgcggtgcgacccccgcggagaagaagggctaccaaacgcgcctggcggcggcgcagcgcgccgccgcgccgcgctcaaacggcatgatgcgccgcggtggcgagggcgaggcgccgccgccgccggaccactaccgcctgctgggcctggcggcgaactgcagcggtgaggaggtacgccgcgccttcaagcgcctggccttgcagctgcacccggacaagacggcgggggcggtgcggtgccgcgccagcctgggctcctgcggggtggtgatagaggaggaccaggagaccgagctgcgccagagcctgcaggaagcagccacctggctcttcaagtgcttgagtgcgtga

SEQ ID NO: 1467 - DNA, 1311 bp, Chlorella protothecoides
atgggcgacttcgtcaagcttagtcccgacaagaaacacctggagctaaatggacaacctttcaggatcgtgggggccaacagctatcatgtacagacccacggggcagacaacgatggaggcagcggccgacagaacatcgcaaagctcctcaaagtggccaaacaggaaggcgtcaatgtgcttcgcatctgggcgcacagtgagcattgcgaggaattcaaatggtgggatcatcagaagaatgattggataccattttctaacacttggaaaatcatccagaagcagcccacgccggatggtacctggtacaagcctaacattgatcctgatggaatcgatggattggactgggtggtggctgaggctggcaagcttggtattaagctgatcatgagcctgaccaactactggaatgactacggagggatgcctcagtatgctaggtgggcaaccggcaagaaagatggcctcgagcgcgacatgcaagaggagttcctcagaaatggcaatgctcagtccatgctgaaagcttacatccagtttctgctgaacagggagaacccctacaccaataagttgtacaaagatgaccccaccatcctagcctggtctctagcaaatgagcccagaggagggggcgacacctctggaaacaggctggatgattggatcaaggataccacagactacattcggtcggtggacaagaatcatctcattactgtggataccgaaggcttcttcattcgagatgacaaagtggagataggcccggatgagaaaattgacatcaaggtggattacatgaatcctggcgagcgctctgagggatgcgatttccttcgaaatgcgagtcatcccaacgttgactttgcatgcatccacatgtatcaggaaaagtgggccccagattatgcaaagagcttccattgtcaatcccattcattcccaatacagggagatggaaatgatgctcagcagtggaagtggatctacaagtggctggacgtacacctggctatctgcaagaaaaagctgcagaagcctctggtactctcggagttcagtgagattgcctacaatgatgacttcgccaaacgacgcgaattcctgaagaaggtgtacagatggctggagaagggcatgtactcaaatgattttgtggctggatcctgctattggatgatctgcgaagacaactacaagaacagcgatggtgacagtgagtcggagctaatcgaccatgctaagaagtttccagtggtcaaagcggcggctcctacacctaatgtggctgcgcagtga

SEQ ID NO: 1468 - DNA, 1860 bp, Chlorella protothecoides
  modified_base (274)..(283): a, c, t, g, unknown or other
atgcagcgccaacatgctcatccagccccctgtggtgctgggggctgtcacctgagggcagtccgacgttggtggccaggccatagagggccccggcacccgcccctgcccatgccgtctgtcgggggcgcctctcgccgtcgtacactcgcagcaggagctcggtggagaagaaagcagcgctcagagcccccacccgcaaacccacgctgcgcattggacatggggcgatgtgaatcatggtgcaggtgggcggcagacaagagcccgggcnnnnnnnnnncacccgcaaacccacgctgcgcattggacaggggacgatgtgaatcatggtacaggtggacggcagacaagagcccgggtcagcaggagggcgatgctggactgccggagggggggcagttccctggatggagggcgcctcttgcgctcgcatgtcctactggctcagcaatgtacgatggcgactgcaacaggccccacaagtcactacgactgatactgatcacaagcaagcaggttccaggaatgtcggctgcgctacctggtggcgcggttggccaaacggatgaggcgctgggtcttggcttcggccaggtaccgcgcagcgtgggcgggagagggggcatcggtgggggccaccagggcacctgtcagagggttggagtaggcacggcaataggcacaccgtacacgtacatgagcgattgctggaacgtacacgtcgttgatgcacggccgtggcgatgcaccctcttcctgaggaacagaccatcccacctcacctgccgccctctcctgcttccattgcatatatgtacccagcgagatgcccaccaacgccatctgcgaggtcgatctcgcccattctcggagctcctcggggaccggggcgagctgggaacagcggggaaaggtgggaacttatacatactagagtaccaaatagattgcgcagacgctcctcccccgagccctggccaccctcctccttccgctcggtcatcgaatgtacagggtgcggccagatggaagttaagatctcggttcgcctttaaatggggagaattatccttctattgcatacccagtgaaggatccatgccatgctgtgccatgcatgagtcccgcaagaggcgctgccgtgctcgaggtgcaccgggctctgcaacccggggccaaggacgcgaaacggctcaggcagtccgaagccgccctcctgaaacaactcaaggcaggtgcctggcgtctcctgttgtgtcgccttccctgcgagtgacccgccacgtaccttccgagggtggtttaggcctggcacgggcccctccatgccctccatgccccgcaccctgccctctgcaggatgcacagtcggagctgtctgccattcggcagcagaaacaagcagtggatgccgagctgagcggactggaggccagggccacccagctgcaggccagctgcgagacgctgctgcacgacaagtccggactgcaagaagagaaccgggagctcctggagcgggccgaccgcctgctggagcgtcagagcctgctggaggcggccgctgagtccctgaagctggagaacggcacgctgctccagcaatttgacaggctgaagctcacctatgaggaggagaccgccggcttccaggcggagctggcggcgctgaagacccgcgtggtctccatgtttgcccagttcacggcgggggacatcagcgccgagcagctgatcgagtacctgtcggccagcggggtggggctgagggtgcacggggacgacaccgcggcatccgacagcagcctcacagcccgcctcgactctgcacgcagccgggaggagcgcgtggagtga

SEQ ID NO: 1469 - DNA, 594 bp, Chlorella protothecoides
atgaccaaggccaacgtgggaagcctgctggtctttgacccctccaagatcgaggagcccaaggggacggacaagatcctgcacgcgtcaagggaggccgtcgtgggcatcttcaccgagcgtggtgaggcgcgccagaggggtggtgggccagcctgccggggagtggctgctgtttgcactcggggtggtagcctgttggtacaagttcccggagatcaggaggcttccatgtgcacaccggcaaccggaccgatctggggtcgggtggcagcatcagactctgtgcttggtgccacctggcgtgcatttcgtgcctctgtcaccctgcgcggggcatcagccgcgactatcacgagggttgccctttgccaccgcgtcacgccgtcctcacccacttccccgccgctcgccagattacatgaccaagattgcagtccagggacgaagctcccgcgacaccaagatctcggaggtgatgacgcccaaccccatcaccgtcacgcccaagcacaggtgtgggcgggaagtggggaacagcggctgtgcgtcgggcaagggaggcttcatggcgcctggggcctggccgtctga

SEQ ID NO: 1470 - DNA, 1185 bp, Chlorella protothecoides
atgcccctctcacctcaacgatccccaggctcggcggaggatggagccgatccgagcgccctggaccaggtcctcggtgacggtgttaccacagcagcggcagggttcgaccatgtcctggtggccaccggcgaggagacccacgtgtttgggccctcctacaccccgcagggtgtccggggtctgcacctggcctccatccacacaccgcacccggtggctgccctggccgcaggggagcaccacagcttgatcctgacccgggccggctccctgtacacctttggcctcaaccgggagggccagctgggcacgggccgcacagatgcccgcggcccggaggcccccgccctggtgctgggcccggggtccagccggcccgagcccatcacggcggtggccgccggggcacgacacagcctggccgtgacccgccagggtcaggtcctgggctggggctggtcgctgcatggccaggcgggcacgggggaggcgaccccggcggtgaacagtccccaccttgtggtcgcgctggggccgctggtggtcgactccgtggcggggggccaggcccactccctggccctcacccaggacggggacgtgtatgcctggggcctgaacggcgacggccagctgggcgacggcaccacccagacctcgctccaggcaagtcgacaggggtctttggggggggcagatgcagcggacttgccaatggtgacgcctagcgcacgccatgccgcaagaccagagcgatgtttttcagtactgcctgtgcaccgcatacccgtccctcgccgccccagccaccgcactcccgtcgccgaccctccactggcctggcaatcccctgcagcccaaactgctggaggcggtgacggtgcccgtggccagcatcagcgccggcgcacggcactccctcctgctgacccggacgggctgcgcccttgccgccggacacggcgcgtttggggccacggggacggggcgctacgaggacagcctggcgcccactgccgtcgccagcccggccggcaggcgggtgacggccctggcggcgggctggtggcacagcctcttcgtgctggcgtgagtgggatgcgcggcggcggcgtgctgggcaaggtgcctccctggaaatctgcactcacagcgcaccccggcctgcatgactttcgctga

SEQ ID NO: 1471 - DNA, 804 bp, Chlorella protothecoides
atgctccccaccactcaccccatcactcaccctctccccatcaatcctccccccacccccgcccctccttgggaaccgccttccgccaccaccaacacaggctgcacggtgagctggccggcgctgtggtgcgcgattcagcggcggcggtgcagcaggagctgctggcgtgctacgcgctcatcgagcgcctcgggcgaggcgtggtgtactacggctcggcgcgcctgcgccgcgagtcgccgcactggcggaccgccgtgcagctgggggagcaggtggcccggctactggggtccaccacctggagcggaggtgggtcagaggaatgggaggggaggggggtggggcattgagggggatgcaggcgcaaacatggatcgagtgcacagtgtgttagagtcagctggcgagatgcaccacatgtgtgcacccaccaccaccacccccgacgcagggggcccgggcatgatggaggcggccactgagggcgcgctggctgcagggggcaccgtgggcggtatcaagatcagccgggaggcaggcacctccgtccgcaccgccgcctcctacctgcccgccgacgcccaggtctactgccgcttcttggccccgcgcaaggtcgcgctggtggactgcgcggtgcgccccggcgaggcggaccgcaccgcctacgtcttcctgccgggcggcctgggcaccatggacgagctgttcgagctgctcacgctcgcgcagctgggcaagctggggtccaagcaccctgtgcccatcattctgtgcaagtgggtttgggatgtatga

SEQ ID NO: 1472 - DNA, 2451 bp, Chlorella protothecoides
  modified_base (180)..(189): a, c, t, g, unknown or other
  modified_base (998)..(1007): a, c, t, g, unknown or other
atggagggcgcaaggaggttctgtttggtgggaggacgagcagaggaaggcctggctaggagagacgttcaaagagacattactgtgtgcccctctgagcctgctcgcccggcaagcacagctccgcatcgaagaaagacaaaagcttcatccttgagaacgatatatatgcacgaggtnnnnnnnnnncctgctcgcccggcaagcacagctccgcatggaagaaaggcaaaaactttatccttgagaacgatatatatgcacgagggaacgcagataacctcctacattttgatcctggttgtcgccatcccagctggagcgttggggagacgctggcctgaggatgttgagttggagcctgggcggcatgctgaaactgatggcgcgtgcgtatcggtgtgcggcggatggccccgtgttggatctccgtctcggatggtggtaccctcgtccgaccacgaccgccctcgtccctgcgtgataggcttcctcgctgatgctggcgatatgggcttgcacctcacttttaaagtcacgagtaacatcctgtatcgctcacgatctgctccccgctgtccccgtgctcttcaaaagcatctcatgcagagcacgacgaggtgtctcgggagacctcgcacgacctacacagcctacgccaccgctttgtggtgggatgtcgcggcagaattaccggggcagcagcaaccagtattctatgagcctatcccatctcccattcaccaggccagcacggagatcagaggtctcggaatcagggcaataatgcgtgaggcaccgtcgctctggcgtgatgtcgtgagggacgacctcatccaccaacggcccttctgggtgctgtcgtgctacggacacgcacgagagggtgccaacgatctgaccggcgatgtcagccctgaagaggtcggcagcgcagtagcgggctggggggagggcagtgcaggtctacacggggttgtggatgctgccatgggcannnnnnnnnnattgattcccgttatgactaggatccactgcaccccaccacaggtgcgctggatggacatgcggcgtggggcaccgcagcgccagctggcctcggatttccagagcgctcgacgcgcgcgcatcaactgcatggacaggctaatgaaggcaccccaagcccccagcaggggtggaggcgcagtggctgccccgccctaccctgcagcacaggccggcatcagcgagcagccccgaccccagcagccggccgtggcccaacagatgggtggcggggggggcttcggggctgccttccggaacgtgcaggctggcgcgacggcagcgcccgctccgcccagtcagacaggttttggagcggctgcagggctggggccgttacccctggctgccgcacccttcggcccacgccctgtatcgggatttgggagtggagtgccctcggcagcccagccgggctttgaggcagcagccgcgcagcagggcttcggaacagcagtcgcgcagccaggcttcggggcagcagccgctcagccgggcttccgaacagcagccgcgcagccgggcttcggggcagcagccgtgcagccgggcttcggggcagcagccgtgcagccgggcttcggggcagcagccgcgcagccgggcttcggggcagcagccgcgcagcagggcttcggaacagcagccgcgcagccgggcttcggggcagcagccgtgcagccgggcttcggggcagcagccgtgcagccgggcttcggggcagcagccgcgcagccgggcttcggggcagcagccgctcagccgggcttcggggcagcagccgctcagccgggcttccgaacagcagccgcgcagccgggcttcggggcagcagccgtgcagccgggcttcggggcagcagccgtgcagccgggcttcggggcagcagccgcgcagcagggcttcggaacagcagtcgcgcagccaggcttcggggcagcagccgctcagccgggcttcggggcagcagcccctcagcagggctttgcaagcatccccatcatccagccgggctttggggcagctgccgcgcgtcctggctttgggaatgcgcccaccccatcaggcacatttggtggtgcgcctcctgctccagcaggattcggggcctcgcctggcgccggcccctttggagcttctggggtgcccacaccagccgctgcacccccgagctttgggggctttggggccactccaagccctcctgcatacgaaggacagagcatggcagccctgggcctcaatgccacaccgcagggagcaggtctgggtcaggctcagcagccacccttgaaccaggccagcctggacgggacggacgcagatgtcgctgcatggcgtgcgccggcctttgagccggggaagattcccgagacctcccccccacaggaattctgcacatga

SEQ ID NO: 1473 - DNA, 2817 bp, Chlorella protothecoides
  modified_base (154)..(163): a, c, t, g, unknown or other
  modified_base (1296)..(1305): a, c, t, g, unknown or other
  modified_base (1777)..(1786): a, c, t, g, unknown or other
  modified_base (2153)..(2162): a, c, t, g, unknown or other
  modified_base (2497)..(2506): a, c, t, g, unknown or other
  modified_base (2587)..(2596): a, c, t, g, unknown or other
atgggttgtgtgcagacgggaagatgcctcccagccatgtttatcttgatctggtacgaaccacaatcatcgccctccttcacgtctagctctcagccaatccccccctcatcaccctcccccgcccacccctccgtctgccagatcagcgagnnnnnnnnnncggtgtggggggcgctaggggcttgtgtaagggacagggccatgtgccccttgtggaaatttaaagcaactgggttgagtgcagacgtgaagatacctcccagccttgtttatcttgaactggtacgaaccacaatcatcgccccttcatcaccctcccctgcccacccctccgtctgccagatcagcgagtgcgacgtgcgcatgctgcgccagctgggcgccggcgcctgcggcgtggtgcacaaggcctggctgccgcgcgaggcgcggttcgtggcagtgaagaagatcagcgtgctggaccgtggcagccgccaccagctgatgaacgacatcaaggccttgtgcaacgcgcccccctgcgacggcctggtccagttccacggcgcctaccacgcggccgaccggggtcaaatcgctgtcgtgctggagtacgtagacggaggctccctggctgacgtcattgccaaggtggattattgttgggatggcatggacgaggtctggtgccagagtctccgcccggacccctcccttgtgatgccttctggtgatgaaagaatcattagaatgatatgctcgcccctcagctcttccattcaccgcaaggcctcccggacccccttcccccaaacgaataaggtgggcgccgtgcccgagcgcatcctggcccccatcacggcgcgcgtgctgcgtgcgctgggcgcgctgcacggccgccgcctgctgcaccgtgacatcaagcccgcaaacgtgctgctgacgcgggcgggcgacccgcgcgtcgccgactttggcatctccgccaccatccccgatgcgacgctggccgcctgccacaccttcaccggcacggtgacctacatgtcgccggagagggtagacggcttgccctatggcctgccctccgacgtctgggccctcggcctgacgttgctggaggcggtgacgggcaagtacccctacgacgccagcgccggggtggggaatggccctccagggggtgccaggcacacgcgtgggtggcctaccacctcagacccgaaacccacagtggtcgtcggccagtccatggccttgcgcacaggtgcagggacgcccttgcaccattcgatgacccccaggccagannnnnnnnnngacccacagtggtcgtcggccagtccaggggcttgcgcacaggtgatggaggaggagtgccccctgcccgcgcccggcgccgtctcgcccgcctgccgctccttcctagcggcctgcctggctcgcgatccgacaaaacgcgccagcattgaggagctgctgcgccacccctgggtcgcggggtcgggcgcgcagggtggcgtgctgcagcgcacggcgatggcggccacgctccgccagttcatgcgctgcacgcacgacgtggaggaggcgcggggcgacgccgtgctcgccgcctgcgcccgcttcttccgggccctggccaccagcgggcgggcgggcgaggcggggctggcgccgctgctggggccgacctgcgtgagtggcggggatggaggaggtgggaagagggccaggggcctctacgaacatgacccacagacacctccctccacatgcacaggcggtgagnnnnnnnnnncgccgcccagcaaacaatcatttatcagggcctctacaatgacgaccaacaaacacctccctccacatgcacaggcggtgagggtgggtgccacagagcactcggggcggtacaccgccgccaagaccgtggagcaggcgatgcggcgtggggccccggcagatgtggagctctgggtggaacgcgtggactggaagagcatcacggcgaccgtgaatggtgggttccgcctgctgcacactcctgggagcgaaatgccccgagtcatgtggcgcaccttcccttctcaagcccaaaatgggaaggtatcttcattcgatcaaatcaaggtccaggacaccatcctcatcctcgctctcctcttccnnnnnnnnnnagaagtgccccgagtcgtgtggcgcaccttcccttctcgaaaccatagtgggaaggtgtcttcattcgatcaaatcaaggtccagaacaccatcctcatcctcgctctcctcttcccatcccccaacgctggtttgtgctccgtaggaagatgttgtggcggtgactgcccacctcagcattcaccggcagggagagaaccaagggccaccactggcggccagggccaagctgcacatgcagttggcaggggcggaggaacctgggccaggcagcgccacggtcttattgctggacctaggaggactgctgggtgtgtggagctgattcagtcannnnnnnnnnctggcaggggcggaggaacctgggccagtagagcagcccagaagccccatcctttgtgcgccctaccgagggagggtgacnnnnnnnnnnccagtggagcagcccagaggcccctccctttgtgcgccctaccgagggagggtgaccatgtcccagcaaattccagcaagttccagtggcgcgcgcgccggaggccaaccctaccgcattgggccgaccggcccccggcagtcaatagcgacgtgccatgcctgttttatattgagcgcggagtccttgtgatctggaacaggttcgtattgtggcgatag

SEQ ID NO: 1474 - DNA, 1512 bp, Chlorella protothecoides
  modified_base (484)..(577): a, c, t, g, unknown or other
  modified_base (914)..(923): a, c, t, g, unknown or other
  modified_base (1419)..(1428): a, c, t, g, unknown or other
atgcagacgcgggtggatgcacaggagctgcccatggtcgagatcaacttcctgtgtgtgcacaagaagctgcgacacaagcgcctcgcccccgtcctgatcaaggttggtcgctcgagggtgccaatgggatgtcaactttgggaggagtatgatgaagggcaggcaatgggaatgggcccccaggcttcatcagatgggacagcgctgcagctgtccgctcgcggacgacggccagcggcctccctgcagccaatgcgcacataccagtgcagacgccctcccacaccacctcctctccctcgcccctccgcaggagatcacgcggcgtgtgaacctggcgggcatctggcaggcggtgtatacggccggcgtgctgctgccgcgccccgcggccgaggcgcagtactggcaccgcacgctgaacccgcgcaagctggtggcggtgggcttctcgcgcctcgccccgcgcatgacagtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtgcggcccatggcccgcgccgacgtgccggccgtggcggcgctgctggcgcgccacctggcgcgctaccgcctcgcccccgtgctcagcgaggccgaggtcgcgcactggctcctccccctgccggacgtggtgcacagctacgtggtggaggacgagggcggcgccatcaccgacatgctctccttctacaccctgccctccagcgtcatcaacaacaccgagtacaacacgctcaaggtagaaagggggaaggggaggctcaggagtggggaggtgggagcgtttggaaggcgctgtatcagtctgtgtgcgcatggctcctcaccaggcannnnnnnnnngacacgctcaaggcatgccccccctctgcggttggcttgtggacagaacagggaatccacacgcatacaccgacacaaccagccgcaatcgcgtggacctcgtcgctccacggcagcaccgctcaatttccctccccctccctcccaacgccaggcggcgtacatgttctacaccgtggcggccaccatcccgctgtccaagctgctcaacgacgccctcatcctggcgcatactacggggcatgacgtttttaatgcactggacatctttgagaatggggaggtcctcagaggtgggtggaggtctttctggggcatggcggcgactggtcctgtcagggactcatgctgccagaacatgggggtgggagtcggggagggcagccgggtgcttctggtgggctcgagaaccggtccgcaccctggatccagcctgcatatgccgaaagacccacacttccacatatggaaccacttcccaatcacagacctcaannnnnnnnnnagggggtgggaggaagggagggcggccgggtgcttctggtgggctcgagatccggtacgcaccctggatccagcctgcacatga

SEQ ID NO: 1475 - DNA, 840 bp, Chlorella protothecoides
atggaaccacttcccaatcacagacctcaagtttgggatcggggatggcaagctgcggtactacctctacaactggagggtgggcaagacgctggcacccagcgaagtgggcctcgtgatgctgtgaacaggcacggtaccaacccctccaatccggggggtgtacaagagatcccatggcagattcatttccgggtggtcttccgggatagctcaaggcgtgccgtgcctctccatccttccagcactgcttttcgaaatcccaaacctgctgagtgtagaagccttcgccgggagagcgaggtgatgagtggggcagaggccaccccgggacccccagttctagggcggccgctcggggggccattcgcgcgtcccgtcactctgttggccggcgcggggccgaggcctcggaggtgcctggcgatggccgcccaggcattcaggcctgcaacgcagggccagctgcgtgattggctggagggtcatggggtcccgaccgctccttatggccagggccccaccaagagcctggaacatctgctgaccgaggtcctggatggggagtccacactggggctggatgcgggggggcagccgcagcgccgtgtctcggtggtgtcggtggagatccgggacgcgcggggacggacgctcatcgaggcccgacaggtgctccccagcggtgctcagcgggcccgggccctgcccctgtccgagaagctgcttccgggcgaggcgtgggaggcggcagctgtgcgtggcgtgcacgaggagctggccagcgtgctgcccccctcccctcaggtatctctgaacacctgtgcatgcacctgctga

SEQ ID NO: 1476 - DNA, 1728 bp, Chlorella protothecoides
  modified_base (971)..(980): a, c, t, g, unknown or other
  modified_base (1224)..(1233): a, c, t, g, unknown or other
atgatccactggatcgataatggtgcagagtctgcacctgctttgtcacctgttgccgacgatccgaggggcgatcaggttggaaccggaagatcacgaaagaacaggcctcagtgcacgatttttaacaaattggacacccatagcgatgctttggaaggaattacgaaatattttattgatcaaaggaatagaaaatgggtggcatgggagaaattcgaggttggcgcggcctctggcatgaggggtagtcgggcaaagggccgcgggcatctgcagatgcaactctcatccggagctgggcgcgatgaaggatcacatctgatgttccataagcgtaatgcttgccaagcgcataattatcgaggcatgcggaagcatcgagtacactttgcccatttgctgactgacttcacattaagatggggaccacctgctgggccggagtggaaagagggtggtcctccggtcagtgcaccttccccccgtggagttagggcggaaacagatcgagatctctcgactccatataaaagagacctcgggatgcccatatccaaacaatcgccaaccgcccacatttcaagcaaggaacctcaacttctccatactggcacgttcccgcacaccacccgcttgatacattatcgtgagactttaacctcgcaatgcgcacttacgcgcgggccgcctcgctggtccttgcccttgccgtggctgcctgcttgctgcagcgtgtggaggcccatggctaccttgctgtgcctctctcgaggaatgccctgcacaacaccgactactgcaagcagtgcctcaacgccggaggtgagggtgcgcgaacctagaataaatggcgacgtttacacatcgggttcccaccctgtcaaacccttaacaccttggacaggaccaagcgcttgcagcgccggtgggtccttgcagtggccggctggtcgccatggaatgtgcgnnnnnnnnnncttacacatcgggttcccaccctttcaaacccttaacaccttggacaggaccgagcgcttgcagcgccggtgggtccttggagtggccggctggtcgccatggaatgtgcggggacccttacaccggggagcggaagcacgagtacggcggcgtctccgccaccggcaccatcaccgggacctacacggaggggcaggtcgtcaacatgacgatcgtgatcactgcagctcacaaggggcgttnnnnnnnnnnagcgccatcaccgggacctacacggaggggcagatcgtcgtcctgacggtcgtgatcactgcagctcacaaggggcgtttcatgttcagggtgtgcgtcattcaggacccaacctcggagcgcgcggagctcaccgatgagtgcctcaaccagcacatcctgatgcaagctgatgtggctggagcccagaacgccggcagcccctactggtacgatcgtggagtcggatcctgggacatggcctaccagctgccccagggtctcacttgcgatggcgtcaacacgcgctgcgtgatgcagtggtggtacctcacaggtgagggcagcactgggcggtggaaggtgatggaactcttgattgccctgggttctggggagatgcagggcgttgcggtgtgcccatcagtggcaaaagtcttgccgtgcaccggggacagcattcccattaccctccccaccctcgccacgcctctgcgccgcaggcaactcctgtga

SEQ ID NO: 1477 - DNA, 534 bp, Chlorella protothecoides
atgacggcgatctcgctcaaaacggcagctgtcacggcaatgctggtgctcacgcaagtcgatgcgcacggctacattgccgtccctgcctcgagaaacttcttgcataacaccgactactgccctcactgcctgaatgccggagggacccgagccaccagcgagggtggtgcactgaggtggccactttcccgtcacggcatctgcggggacccttttgccggggagcgaaagcatgagtacggtggcgtctctgccaccggcaccatcaccgggaattatactgagggcgacaacatcaacattaccatcgtgatcaatacgagccataagggacggttctccttcagaatctgtgtcatctggaacccttccctggagctcaccgagctgactgaggattgtctgaacgagcacatcctggtgagagctgaatttggggggggtgagtgggaggggtggactggaatcaccgccgtccgtgcagagcctgggtgcaaaaagcgaccggttttctttcactcctccagttga

SEQ ID NO: 1478 - DNA, 1350 bp, Chlorella protothecoides
atgaccacccccatcccctccttcggcgacggcgccatgttcctgcagcagcaaatgctgcagcagcagctccccccccgcacccccacgggctccgcccccctgttccccgacccccccctggccgcccctgcggccaacctcttctcctccatccccatgcccgacttcggcaagccggccacctcctcccgcccccctgccgactccgaccactccagcgacgacgctgaggggcggtcgcgcgggcccgacgcgcacaagaccacggccatccaggagaagaacaggcgcgcacagaagcgcttccgcgagcgccagaaggccaagatgaaggacatgacggaggagctggacgacatgacctccgagctggggcgccttcgcgtggagaacggcgcgctgaagaaccggaattccatcctggagaaggtgctggccctgcgcgacgagcacatccgggtcctgcaggacgagcagcatgtgtttgacctgggcaaccaccatctgcagaccagcaaccccaagctgcttgggccgggacctgccgcccctgccatgctggggtatggggccggcgggggcgggagtggtctgcagggcggcggcctgcccgggtctggccagggcgcggggtcgcagctgccggcgcgggggtcgggcccgctggcgctgtccgccgcgctggcctcggaggtggcatcggtgaagaccatgcccgctgacgccgtcatctcgcgctggaaggagacggtgcgcgagctgggcaacatcctggtgaccctggagggctgccccgacccgtcggcgccggcgcacgcggaggccagcgccacgctgacccgcgtgctggacgcggcgggcgcgctgtgcatgcacaccgcggtgctgcaccccaccaacatgcagcgcctgatcgccaccgcgctggacgacgggcggtcggggatcagctcggaggaccgcgcgcgctgggcaggagtcaccgcctcgctggccctcgcccccgatcagcgcgcgcaggtggtcagcctgcgcgccatcttcctgcgccgcatgcggcgcgtggtggaggagcgccgcgccatcctggaccggctgcagagcgtgagcgtgccggaccgcatgctggccctgcagtcggtcatcgccgagacgttgaaggtcaacgagtgcaccgtggagctgaaagccaacctgcaggaggagcacctggcgggcatggagttcatcggcaccgtgttcaaaaccatcttcacccccctgcaaaaggcgcgcgccatcgtgcagagctaccccttctacccggacgtctaccaggtgtgctggaggggtgtgtgtgtgtgttaa

SEQ ID NO: 1479 - DNA, 336 bp, Chlorella protothecoides
cgcgacctggacctgaaggagctgatgctgtcggcgtacgagacggggcgcctgcaccccatcctctgctttgtgcgctcgctgctggaggtggggctggtgtcccgcgtcttccgcccccccaacccatggttcatgggcctgctggcgctgatggccgaggtgtacaagctgccgggcctgcgcaactccatcgtgttcgaggtggagctcctgttcaaggccgcgggcctggtggtggccgacgtggcgcccagcgcgctgctgggcgcgcgccgcgccccgcccccggactcggccgactttggcggcggcgcgcaggggcccggcgtggcc

SEQ ID NO: 1480 - DNA, 1752 bp, Chlorella protothecoides
  modified_base (279)..(288): a, c, t, g, unknown or other
  modified_base (1422)..(1431): a, c, t, g, unknown or other
atgcgggccgggagcggtggcgccacccagcaccacttgcttcgacactctttgcccaccgacagcaagggtgcaacggctctatctcactttggggcggccactgtggcggaagcaggcaagaccatcaagcgcatgagtcagcgtgaccttcagaacacctttcgtgcggtgtacgggacaagaacattcagcaataacaacaactggctccgccgcaagctgtgcgagggtaaggagtggtacaaagctcgatccttggctgctttgatagagctnnnnnnnnnncggctgctttggtgggggctgagcctcatgcttcatgcccctgcaatgagacctgagccatcgggatcgatcctggcaagggtccctccgccaagcggtcgtccaatgcagcaaccacacactccaaggcgaagcgccgcaagtctgtggctccgaaggcgcacgccatgtcccctgaggacgcagcacaggccctgctcaccctgggagagagttccagctgggacggcgacaggcctgcgtgtccaatgccccgctccccccgcctccacacgcagctattacgatcgtggcagcagccgaagtgccgccaccgggccacctgcggtggggctggaggagctgcagctgagcatgagcagccaggccgatcagacgagtggcgccggcgaggaggcctccgtccatcgtacccaggcggccgaggtctacgtgctgcccgccccagaagcgcacattctggcgctgcagcacgccgtcccacggaccgtgcacagctcgacgacggcgcagccaacgcatgccggcgctgacagccggccggcagcggaggctgcgccgcaggccaggcaggcttccccgccccgtcccacccagggcatgcccgcctgggtgtcgcccgagcttctcatgcagctgcgcatgctgctggactctggcggctacctggccagcggccaacctcccgccaccagccgccccgcctcacgccaccagccgtcgctgcggggccccgagcagcgcaacgactgggaggcggtggcgcgggcgggcatccccctgcgcgccatcccgctgcccctctccggcgtctccacctgggacacgcagggcaagcccatggtggggccggggaacggggccggggccgacgccgcgccggtcgtggtgctgggcggcaggtcgggcgccgtgtcgcccggagtgggtcggcggcctgccggcaaggcggccgcaatccctcttgtgtcccatacagcctgggcgcccccctgccgatacgccagatcgtttcggggtggggcagtcggccggcgccgcttcaaagatgcccatcgtctcaagcccccaccagagtgccccgacggccccccccagcccgcccctccctgtactccgtcctctcgcctgccnnnnnnnnnnttcggggcgggccgttcggccggcgccgcttcagagatacccatcgtctcaagcccccaccggagtgccccgacgccccccccccgccccgccctccctgtactccgtcctctcgcctgccccctcccttgtgacaaaacccgtatgtttcttcctagcttactacccagcgatgctctcaccctacgtgcctgcctccaggctgccatgcctgaccctcatgcccttatgtttgaaatatcttctgccccgcggcccctccgggggtccaccgaggaatcccctgctctgcccagacggtctgtaccatatgtgccctga

SEQ ID NO: 1481 - DNA, 909 bp, Chlorella protothecoides
  modified_base (847)..(856): a, c, t, g, unknown or other
atggttctcggaggagggccccgcccaggcccccatgtccatgagatttggccacctggcctagtatggtggtcgacgcggtggactggacatgaactttggggagccatgatggaccctcactccccaccctactactccacatctggtggtgaacatactcttcatcttgttgtggaagccgggggcttcagcttccctcagggctccccagggaccccgtgcaagttcgggacgccctcatactccctgccctcaggcggggcgtcatcaccttcccgaaactcttctgcgcccaattttggcgtgttcatagggggacctcgccagttgccgcacatgtcggggccggcacagcccctgccggtggacgatgccggcctgcccgaggaagtgcgggagatcgtggccaaggcccggagttcctggctgaagaacagcgaggtctttcaaatcttgcaacatgccaccagcggcctcctgccgctctccacctcgccgccggagctgccaccgggtgggactctgttcctcatcgaccgtagcagctgccgcaccttccgcaaggaccagcaccagtggcgcaagaaaccaggtgcggcgaggggatgtggggcgcggtgcacacgcaagccacaggctggccgagctgtgtttacaccacgcaggaacatatggggttgttcagttgcgtgcaggtcaggggcacgtctcatcggatctgggattggcgcggggtcccacaccagcttgcttgtcaggggctggcttccttcggcccaggagctgcacggggcccccgccccccctcctcatctcccccctcaccagcgtttgccccccaccnnnnnnnnnngattggcgcggggtcccacaccagcttgctcgtcaggggctggcttcctttag

SEQ ID NO: 1482 - DNA, 2880 bp, Chlorella protothecoides
  modified_base (1802)..(1811): a, c, t, g, unknown or other
  modified_base (2389)..(2398): a, c, t, g, unknown or other
atgccgggcagcggacgtccttggtgcgcggcagggtcggatcggagcgcacgtcctgcagacggtggcggaagggagggtgtgacaggattgactgcaggatccaccatggggaagcctccagaactggcgcaggggggccacactcatcctgccacgggcactcccgggaccaagacccccaacacggaagacactgacctggagcaccaccagcttctccttggaggtgtgctgcacctcattgcggaagacacaccactcgctggggtctgcagcctcgacatatggacaactccgacagtgatatacgagtcgtttgttggctctatcctccttgggtgcgagggtgtggtgatggacgtgaccaggagcgtgcacgggggaagtgttggcaagggaacgacggtgcaccttcttgataccactaagttcgtgatagaattaacttccggctcgcaaatgccagtgcgatttttggatttgtggaacgtgttggagatcgatgcgaaagcctcccgaggggcccgtcgcttgctgcgcgtgcggggcaggaggatgtccttggaagcttggggtgccgtgcccacagaaagacacagctcccgataccccgtttgtgattcctggtgtattcatttgccaagagcacctcaaaattgccccacagatcgcgcgagcccgcccgccggggctttgccaagtctggaaggggcggctttcgtaggctgccgctcgcctctcgctgcttcccttcacccgctgctaccaccagcttactgcgcacagaagagtgggagccgagggtgttctgtgccatcgaccccgcgccacatcgacatggcagccactggtgtgatatcgctgtgctcatactcatgtacagccaactcacaagctgtggtgctggggtctgatggagttatccaggatggcccaaagaagctgagcctggtcgtggcggatgctctcaagcggtggtatgcggagactgagaaggaggctcttcgcggagacctgtgtctccataccctcgatttgacggcccctgtacttccccatgcattccagaaatcggcagccctgctgggacagatgctgaacgaggggtacggctgcaaggcgaacccagagcgcgggcgggagtggattgagaaggcacggcggagggggcacggcgagggtttgcagaggtgggcctcgtcctggtgtgataaagaggcaatttgtcgtgggattacggtgcaaacaagctttactcgtaatgaatgcgctggcgctagtacaggcgtggcctaaatccccttgaacccgctgcccccttcgtgccgaagccagcatcgcctcgcttcttctgagtatcctcgtgcatgtccttgtgacctgaaggctagccgccgggatgtgcgttcgcggcctcgaggacgcccaggaggcttgccttgcgacgcagacaccagacgtgattgtgcaatttcaatcccagacgcacgcctacagatgcgtgctgctgcaccagagtggagccttcttccccgagggctgtggagtggaggtgcgcactgctgctctatgtgcacctcggctgaggaagttgggccccgaacagaccatgccggcccctgcctggtcctgctcaagggtgtgaccctccccagggccgactttgaggcctggctccgagactcagtgatggagtgggccgtcatgcgcgtctactggattaagcagcggtgtgctgaccgacagggttcctgcttatcttgtctagcatacaagcaacactgggcagacaaccatcnnnnnnnnnnaagtgtcttcattgtgacagggagttggtccgtcagctcttggctaaaggcccccctgatggagccctccgcctccactgctttccccataagcttgagccgtggctgggagggggctcaagggacagagtttgacacagccagtgcgccttgctctgtctcatgccacgcccagagcattgggcaacaggctgcggccatccttacacccagtgaactaggccaccttgtagctccactcctctcaacacatcacgatcccacttcctacaccgtcccgcaggacgccttgcccctggactgggtgctgcagcctgctgccttcacccacgtgctggacgtggtggagacagccgcaggcgtcgcgtactccatgagcccctgcccccgcctcttccgcaccactgcctggacccggccgcgactggagggctcgctgtgcaaggccacgtccaagctggcggaggccctcgcctgggtcaagcacgcacctcgcgggggggtcgccatagacctcggtgtatctggagaataccgtctgatacgaggtccaccttccctcctatgccgtgcaggcnnnnnnnnnncctgcagacactgcctgcacccaacactgttatgcgaccgttctaccccaggggcgtccccgggcggctggtccaccctgctcgcctcctccatgcaccgcgtgatctccatcgaccccgccgacatggccccggaggccctggccctgcccaacctgacgcacattaagagcagggtggagacggccctgccccagatagaggccgccctggccgcggcgggggcgggcgggggcgcagacctcctggtctcagacatgaacaagcaccccagcgccatgatcggaatggtggagcccctgctggcgtacctcaagccgggggggcacctcctgctgaccctcaaattcttctcccggtcgagggacaaggcctgggaccccaccaactgcccccagctggctggcttcagaggggtgcaggtggtctggctgctggcaaacaccgcgcatgaacgcacctgcgtggctatcaagtgctga

SEQ ID NO: 1483 - DNA, 1728 bp, Chlorella protothecoides
  modified_base (866)..(875): a, c, t, g, unknown or other
  modified_base (1519)..(1528): a, c, t, g, unknown or other
atggcagccctggcgggacacgtccacgcccgcaacctgagcttcggcatgtacgccgactccggcacctccacctgcggcggctaccccggctcccgcggcttcgaggcccgggacgccgccgcgtttgcggggtggggcgcggactacctcaagtacgacaactgctaccccaaggagggggactcggtgcgcgcgaggtacggcgccatgcgcgacgcgctcaacgccacgggtcgccccatactcttcagcctgtgcgagtggggggtggaggagccctggctctggggccgcgccgttggcaactcctggcgcaccaccggcgactcctccgcctcctggctcagcctggtcaacaacctggacaacagcgtgggcctggcgcggtatgctgggccgggggcatggaacgacccagacatgctccaggtctcagagaacggggagggggaatgggggggattgccaagggtaatactattacttgcttgcggtccaaaaggtgtcaaagtggtgattgtgggggggcccagagtggacgtgcctctgagaggctctgaggtgcagcttcaagtggtggaccacagcaaaacacagcctccagttgggcacaagatgaggaggcccttccccctctccaaacttgggagtcgggctgcactcaaggctctgacgctgcttgcccgccagctatatgcagctgctgcagggcggaattcgccttgcataaacaagcgatgcagggcacctggcaagcaatgccaacccatgctcctgactcaccctctcaacaggggacctcatctggaagcaggcaaggggggaggacctggcagggcagccaggaactggaggggaatgannnnnnnnnngaagcaggcaaggggggaggacctggcaggcagccaggaactggagaggaaagggggggatggaagcctgcccatccagtccttggatttggacctgagtgatgctggggatgcctgtacagaccgtggtggtgagcccatctaccctccaacccccccccttcaggggtccaaggagatctacgccgggccgctcgcgggcggggatcgggccgtggtgttcttcaaccgtgccgaacatgacgagggggcggcaggggcccgtttcacacgtaagccgccctgcatgctgtgggcaggagtcttgattgttttaccatgctacccagctgctgcctctgcccgttcccttctgaatcgctgtgccagagggcagctcacaggggcgcagttgttcacctgccgctgtacagcccggctcagatgccgccctctcttccctccaaattcttgcagtgcgcacagagcaggtcgggtaccaggaagacaccgcggtgcgcgtgcgcgacctttatgcacggcacgacatcggcaccttccgcggcaggttttccgcgcgggtgccgccgcacgacgtgcttgtgctgaggctgacaccggaggcggcgccgtttttgaagtgggagggcggccggcggccccannnnnnnnnncccagacagcagaattgctgacgccggaggcggcgccgtttttggagtgggagggcggccggtggccccgagatgatgggtggaggccgtggaccgggcaagccatctacgctgagcacgaggaggacctggagaacatcccctggcgcaagacggaaggggatgatgatgcgctggaagaccccgcagttgcgatttga

SEQ ID NO: 1484 - DNA, 1128 bp, Chlorella protothecoides
  modified_base (394)..(403): a, c, t, g, unknown or other
  modified_base (551)..(560): a, c, t, g, unknown or other
atggtctcccactcactccccagccgccacgactcagagactgcccatgggcgatcagcggtacctccgcagagacacacggttgttctttttccagacggcgcgccgactgggcctgttcttggtgtgcaggtgccccttgccggtcaggccgcggtacttcttgccggcgctggtcaggccgcgcagctcgcggtgcttgtggacggggttggcgatccagttgatgcgggcatcctgcagcatggtggtgcagtgttcagggtgacatggggcgcatgtggaggtgatgagaatggaaaattggattgtgggagcatgagaagtgtactgcgcactgaacatgagccggccacttgcataggtctgggaagggctaccaggacctcctccnnnnnnnnnntattggattgtgggagcatgggaagtgtactgcgcactgaacatgagccggtcacttgcatgggtctgggaagggctaccaggacctcctcccattcgaattcgatccatgtgcaatggaagccagatggctcttgtccagcggctgnnnnnnnnnncagtgcctcccttcccggccttcttgacaaagcctcagctcacgttgcggatggccttgtggaaggggtccaccaggatgacctcaaagtacttgtagactgcgtcctggttcacccagtaggagttcagcacgcgcagtccaccgcacttgcggccgacacgctcctcggccaggttggccaggttgcgggtgggcttcagctgggtgataccctggttcacgggcttgccgtacacgattccctgcagcggaggcatgggggaggggaggtgcatttcacgagggtgcactcatcaatcgccattcatcccaaacatgctcaagatgactatacgatccccacgcacatggctccgagcatgtgctcagggccccatccccaggtcgggttcgagacccagccaaccctccggaccccagaaggagggcaccagggccgagcatgttccagacgcgcaccttggggacgggcttcttgcggccaccacggcgcacgcgcacgcggtagacgacgtatccctgcttggccttgtagcccatgcggcgtgccttgtcgggccgggtag

SEQ ID NO: 1485 - DNA, 495 bp, Chlorella protothecoides
  modified_base (448)..(457): a, c, t, g, unknown or other
atgcgagtattcaatctcagtcgtatctcaggctgcatcaaagccactaccaccccattctttgtctccatgcgacgcacacgggccgctgctgtcgctcttctctcagccgaccctattgccaatcagaccaagcctgcccctcctctgcaagggaggcaatcaggaaggggtccgcaggggatcgaggccagatccctgaaaagcacggcacatgtggtagttgcccaggtcgagccgccccagcagaaaactggtagccctgcctcaaagaagaagcggagcaaggcggcgcttgacccatccggttttgtccagaaggacattttgtccatacgcaacaaggcttcacgcattgcatcgcagctcgacggcctgtacccgaatcccaaggtgcccctggacagtgcatcgccgttccagctactcgttgccgtcatcctttccnnnnnnnnnnaacggcctgtacctgaatcccaaggtgcccctggatag

SEQ ID NO: 1486 - DNA, 603 bp, Chlorella protothecoides
  modified_base (52)..(61): a, c, t, g, unknown or other
atgtacagaattcacccaccctgcacccatcagacgacggatgtcaaggtcnnnnnnnnnntttacagccacccgcaagcagatggctgctgggtaaaaagtccaaacgcattacaaatgcacatttacagaattcacccaccgtgcacccatcagacgacggatgtcaaggtcaacacggtcacacctgccctcttcaagctcgccgccacctcctcggccatggcagatgctgacctggcagaggtcaccgccatcatccagcctctcggcctctccgccaccaaggccaagcacctcaagggcatgagcaaagtgggtggttgtttggatggggtgattggcgagggtgaggctattccctacgaaagcaacatgccaagcgagggtgaggctattcactacgaaagcaataagccaaggtgtacacttatagggatattggtttcccaacatcctctggtgcatccttgcagaagcagacccgttcattggactcggctgagctgtgaatccgccctgaactctaccttccttttctttcttcctcccacagatgctggtcgcgctgcatggcggccaggtcccatccagctacgctga

SEQ ID NO: 1487 - DNA, 666 bp, Chlorella protothecoides
atgtggctttgggtggataggaggtccgccggcgcggggagccatcccgggcggaggtctgaggggccctctcctcctccccattttccctcgcagtacattgaggagctttggaagaagaagcagtccgatgtgctgcgcttcttgctgcgcgtccgctgctgggagtaccgccagctcccgagcatcgtgcgcctgacgggacctacccggcccgacaaggcacgccgcatgggctacaaggccaagcagggatacgtcgtctaccgcgtgcgcgtgcgccgtggtggccgcaagaagcccgtccccaaggtgcgcgtctggaacatgctcggccctggtgccctccttctggggtccggagggttggctgggtctcgaacccgacctggggatggggccctgagcacatgctcggagccatgtgcgtggggatcgtatagtcatcttgagcatggaatcgtgtacggcaagcccgtgaaccagggtatcacccagctgaagcccacccgcaacctggccaacctggccgaggagcgtgtcggccgcaagtgcggtggactgcgcgtgctgaactcctactgggtgaaccaggacgcagtctacaagtactttgaggtcatcctggtggaccccttccacaaggccatccgcaacgtgagctga

SEQ ID NO: 1488 - DNA, 603 bp, Chlorella protothecoides
atggcctggctctacgccctctactcattcgactacaagtgggcggctcatggcgtcccgctcatcacccgcgtgtctttcttcgagacgcactgggcctactttgcaggtgcccaggtgtcagggtggcatgtgtccttgacctctgatgcactgcattccaatcaggtaggcccatggcagtcttgcacccccctccctcctcccctgggcgcagggtttggcctgctccccatcctgccggtcctgctgaccagcttcttcataggttccgccgtcgtgggagtggccttccccctcttcatcatcttggctgcggatgccaaccccaaagcgcggcaagcggagggtatgccacctgagaacaccattcccttgcccgctcccttcgatcatgccgcagtccagcaagcacatggcccggcgcagctcagcccactacgtgtgtttgcccccgccagctggatgacaaatgcagcgctgcggtcggtcggaggcggcatgcgcgccgcgacacggatgctgaggcggcgatggacgccgcggcgggcagagcatggcgaaagtcggcgtccggcgccgaccagggaacctgcaggctga

SEQ ID NO: 1489 - DNA, 480 bp, Chlorella protothecoides
atggggaagggggccaaaaactccctggcgctcgctgaggcggggtccgtgctggacgaccccgtcttcacccccttcttggccgatgacttcgatgctgccaccttcgcgagccaagccatcgtgtctggcggtggatccgccccggctcacatgcgggagctgcgggagggcatagacaggctggaggcaggcatccgagagcacctgaacacccaccaggactccctcctggcctctgcggggtccctgggcagcgtggaggcagatctggaccgcacatccctgtccattgcagccctgcgcagcctcgcctctcgcgtgcgagccgatgtcgccggccccgccgcgagggtccgggcactcactcaccaggcgcggggcctgcagtccaccatcgacctgctgcagcacgtgacctacaggctcaagctcgtgtcccagctccgagccagtgtctccaacgggcaaggtgcttga

SEQ ID NO: 1490 - DNA, 906 bp, Chlorella protothecoides
atgttcggcacggttgaagaacaccacggcccgatccccgcccgcgagcggcccggcgtagatctccttggacccctgaagggggggggttggagggtagatgggctcaccaccacggtcctccccccttgcctgcttccagatgaggtcccctgccacgccaaggtcatcctgattgatggccaccacctcagcggccaagaggatggcggcagacgcgttgctcagctcctgcagcctggtgctgatcatcaggggcgacttgagcagggaccagagcgccaagttggcgcgctgctccccaagggtcagccctgggttgcccacctgttgagaggcataccgcgccaggcccacgctgttgtccaggttgttgaccaggctgagccaggaggcggaggagtcgccggtggtgcgccaggagttgccaacggcgcggccccagagccagggctcctccaccccccactcgcacaggctgaagagtatggggcgacccgtggcgttgagcgcgtcgcgcatggcgccgtacctcgcgcgcaccgagtccccctccttggggtagcagttgtcgtacttgaggtagtccgcgccccaccccgcaaacgcggcggcgtcccgggcctcgaagccgcgggagccggggtagccgccgcaggtggaggtgccggagtcggcgtacatgccgaagctcaggttgcgggcgtggacgtgtcccgccagggctgccatgccccccggaaagcgcgaatagtcggccaccaggtccccatcgggggtgcgctcatgctccgaccagccatctggatggggtgggtgaggggaggaagggagggatggcaagcattttgtgtgagtttgggaggtttgccgaggcatggcagtagagcatcgagcatttgctag

SEQ ID NO: 1491 - DNA, 240 bp, Chlorella protothecoides
atgccggccttcccagtggatacgcacatccatcgcctggcggagcgctggggtctgtcctcggggaagagtgtggagcaaacggaggccgatctgaaggccgtgttccgggaggagttgtggaacaagctgcacctccagctcatctggtttggccggcagcactgctcggctcgggcccacaacccccaggcctgcccagtgtgcgtctgggcggcgcctaaccgggccaaggaatga

SEQ ID NO: 1492 - DNA, 624 bp, Chlorella protothecoides
atgacggtgcctgagcctcgccagggcagtccccgagctggatctcctggcccgggctacgacaggagagatggcccaggctcgcacagtcaccatggaggcgactttggaggtcgctacgggggtggtggattcggcggcggcggccacacccacacctggaagcctggcgactggacgtgcatggcttgccactcccactgctttgcctcccgcgacacctgctttcgctgcggcgccgaccgcctgggccagcgcgggccgccgccaggccccaggttcgacccacgctacccgcaggacccgggcatgtacccgccctttgaccccggcatggcgggcatgcccggggccgcgtttcctccccccggcgcggaatctgtgtacgtccacgtcccgcccccctcgatccccggcggctacggcgatgcggcggcctggggccggggccccgtcaaggacggcggctaccccatgcgctacgaggcctttgagtaccagccgcacgacacctgctaccgcgtgcctggggctccggaggccgcccccgccgccggcgggatgtcgggcggcgctcctgggtttggcggcggtgctcctggggcctccgggtgggtggggtga

SEQ ID NO: 1493 - DNA, 192 bp, Chlorella protothecoides
atgctgcaggatgcccgcatcaactggatcgccaaccccgtccacaagcaccgcgagctgcgcggcctgaccagcgccggcaagaagtaccgcggcctgaccggcaaggggcacctgcacaccaagaacaggcccagtcggcgcgccgtctggaaaaagaacaaccgtgtgtctctgcggaggtaccgctga

SEQ ID NO: 1494 - DNA, 801 bp, Chlorella protothecoides
atgactctgcacccctggatcacagcaggttgggattgcgatatgcaccagcgctgtcctcacttccttgcgtttctggacgccacgaccccgtcgacccactttgcggcgttcgccgcgcgccaagccgcagagcgcgcacgccgcgaggctgcctgggcctcagagtgtgaggccgttgagaaagcgcggcaacatgcccggcacgagttgcagcttgcagagcaagccgtcgccggcgccttcacccaccaggagtacacagcggggctggcggcgctgcgcgccgcgcgggcggccacggaggcggcgggggcagcgcggccgccgccagctcccgatcacgctgacctggacggggagcaggcgccgatggttcacacggcgcccgagcagcttctggccctgctgcgcgatggccagcggcgcggcctccaggcggcggcgggggccgccgcggccgcgacggccctgcacgccgcccgacgggacgcggaggaggaagggcgcgcggacctgcgcacgatcgccgcgctggccgagcgtctggcctgggcggaacgctgcctggcggaggcggaactgagggaggcagagctcacgcgggcggcggagctgagggaggcagagctcgcgcgggcggtgctggcgctggatgcgccgagggcaggggccgagggaacggaggctgctgccgtgccctgggccctgcaggatgccctgcgtctgtgcgggttgggcgaggctcccggcggcgcctgcgcgctggacctcctccagcagatcgaggtgcttggctga

SEQ ID NO: 1495 - DNA, 1842 bp, Chlorella protothecoides
  modified_base (1391)..(1400): a, c, t, g, unknown or other
  modified_base (1811)..(1820): a, c, t, g, unknown or other
atgcgccgtctgagcgcccatgggcgagatgctggcctgcgagcctccctcctgatcgatacttgctcgaacactgcggcaggggatcgatgcacgggacccactgggcacacgctgccgcttcctggagcagcacctgaagaagaatgcgcggcacaagcacatgatcctgctgctcaacaaggtgtggcagggggggaatttgagcagtgcaccgcttccaccgcatcgcccccctcggctgcattgcgggtgacgttctgctctcataccatgaccttagtctggtgtatgcagtctgccacccacctaatcctcgcgtctcagtggcaacccccattccatggacccactgacatcccctccccccctctcctccccacaggtccccgcctgggtcaccaagcgctggctgcacacgctgtccaaggagttccccacgctggccttccacgcctcggtgaccaatccctttggcaagggcagcctgctgggcctgctgcgccagctgtcccgcctgcgcagcgacaagcagtgtgcaaggtggcccccgtccccggcgagaccaaggtctggcagtacatcacgctgaccaagaagatcttcctcatcgactgccccggcgtcgtgtacaacggcaccacggacaccgagtcggatgccatcctcaagggcgtggtgcgcgtggagagcctggaggaggccgccgaccacgtgggcgaggtgctggcgcgggtgaagccgcagtatctgcgccgtgcctacaagctggaggcctgggaggacgcggaggacttcctgtcacagctggcgcgcgccgcggggaagctgaacaagggtggcgagcccgacctgaacactgtggccaagatggtgctcctggactggcagcgcgggcggatccccttcttctccctgcccccagaccacgtggacgagcgggacggggtggagggcgacgccgccgcggcgctggcggcggcggaggaggaggaggaggaggaggacgcgctagtcgtgggcggtgtgacggaggaggacgccgccgccgtccccgacggggacccaatcaaggcagcggctgcggcgcgcgcgctgacggcggccgcggccgaggagatccaggcgcaacgggcgggggccatccccgtgcgccatgccttcttctcccccgaggacgcgggggagggcggccaggacctgagcggcgatgactcggagggcgacgcctctgacggcagcgaggaggaagaggaggacaatggggaggaggcggccgcgggggccgaaggcgaggcccccgcggcgtctgacgacgacgcggaggcagggtatggcgagggcgggctgagctgggaggccgtcctccagagcatacagagggctgctannnnnnnnnnctgggaggccgtcctccagagcatacaggtatgttggtttgcgtcacagtgttgggtggtgcggaatgcatgcagtactcgagacatgcttagacatgctgttggcttcagagagggctgcttgtgcctgcgccgtccagccatggaatccgccctgcgaggtttcggagtgcctgtgcagtgcatgactcgtactctgccatgctgcgccatctactctgcaacaaaatactccaacctggtcaccgcacaggagcctggggcagccgaggatgaggacgagcaggaggaggagccgacgatcaccgtccctgccccccaaaagcggagggctggagccgctgggccggcgaagcggaggggtggagctgatgcggggggccggaagaggaaggcagcgataggcacgcnnnnnnnnnnagcctggggcagccgaggatga

SEQ ID NO: 1496 - DNA, 963 bp, Chlorella protothecoides
  modified_base (437)..(446): a, c, t, g, unknown or other
  modified_base (529)..(538): a, c, t, g, unknown or other
  modified_base (801)..(810): a, c, t, g, unknown or other
atgcaggagctgcaaagcaaggagctgcccagcacccgcatccagccagaccgccgctggtttggcaatacgcgtgtcattggccagaagcagctcgaggtgttccgtgaggaaatggcggccaaggtggccgaccccttcaccgtcctcgtcaaggagaagaagctcccactttcgctcctcagcgacccttccacaaattttgccgcatccaacagatctgggtactcacctgagaatccactccgctgctcaacaaccagcacacactgcaaggatgacacctctgtacgcaccgcaggcagggctgcccgtaatgggctggtggcgactcagccctttgccgacacctttgggaagaagcagcggcggaagaagccaaagctctcggcagagagctaccagggtctgttggaccgcgccgagactgtggaggnnnnnnnnnncgatacccaaccttctccgcccagtttcacaagcaaggccgacgctgtgggtccctccgacccctttgccgacatccggccannnnnnnnnngtgagtgtacacttgtggctgggcggttggcctctgtttcctgggaacgggctggacaggccaagcaccgatacgccaccaagcccccttgcgctgactgcccaggagtccgtcttcttcaagggccagtccaagcgcatctggggcgagctgtacaaggtcctcgactcctcagacgtcgtcatccaggtctgggacgtgctgtggggctgtgccagggtttcccctggcttcgagctgcatccctcccccctcccttctgnnnnnnnnnnactcctcagacgtcgtcatccaggtctgggctgtgctgtggggctgtgctggggtttcccctggcgtcgagctgcatcccacccccctcccttctcagtgctgtggccggcgatgatcacccttgcttgtccgtaccatctgattttcagtga

SEQ ID NO: 1497 - DNA, 1872 bp, Chlorella protothecoides
  modified_base (1336)..(1345): a, c, t, g, unknown or other
  modified_base (1597)..(1644): a, c, t, g, unknown or other
atgaccagccacggtccgggcacgctgccggagattcccagcaacagcgccgccctgggggaggaggacgagccccccactttctcccctcgctccctggcggtgcagcggggcatcctggccgaggccgtgggtgctctgggtagtcaagactttgcggcggcgctgagcgcccagggggacagcgtcagtgacgacagtgactgggaatatgagctggagaatttcgaccaggttcgtggtcctgggctcctcgcactaaacatagcgcatgcaggtgggagggtcgcacccagtgcatgcgcaccgcccccctgctgcctgcatgtggctcgccaccggactgcatgcccctggctgggggttgcacccagtgcctgcgcaccgcccccctgctggctgtatgagactcgccatggggctgcatgcccagggctggggtctggcaaggccagcctcagggcctcaccctgcgctcctttcacctccgcagatcaacatcaagcacctgatcagggcggagctgaaggacacggtgcgcaagatgatcgcaaagcagaagagccccgcccggacgctgatgcgcgacaagctcatcttcgtggggtgttggacggtctcatgccctgtccatgccagtcgactgcattggggcaaggggttgatattgagattggctggggcacctggagcgggatttgttaccctaacccgatgcccaacccacctccacatcatgcagtccccagtccttctaccagctgtacactcccaggtggtcctcctcatacagctctggctcttccccaccagcatcgcatggatcaaggtgagagcatggatggcagccagggccatgatggattggggatggagtgcggcttgtgggtcacgtttgcactaaatctggggcccctcgtgtggagcatcgtggccttccgcaacagtctggtgccacactccctcgacaagatgacgtcgcacttcctgagttggcgcttcagcagccccgttgattccttgcccacaccaccaagcgcaggcactggttcccggcctgcgtcagctatgcggcacgctggcaccccccctcccaggtggtggattacctggcctcttccgcggaggcccgcagggcctgggagtccaccagcctgcgtgagctattcttcctccccctggtcccctacctcatctgggcggtcctctactacctcaaggtgccttggagggtggcaggaagcaggttttcaacctctcggtgggcaagtggcctcactgattcccatcccagcaccagcaaatgagtacgtccttccaccccgtcctcgcatcnnnnnnnnnntccatcccagcgtcagcaaacgagtacgtccttccaccccgtcctcgcatctccttggtgcaggtgtttgtcatcagctccagcaggatagagcagcggggctacgaaaccctgttcaagtgagggccgggatgttttgcacccgctgggatctcatggccgtcggtgcttgcagcggagcgggccggggcttcctccccacgatgcaggccaggctcctgggtcaaggggggagtcaccccgccatgcaannnnnnnnnnnnnnnnnnnnnnnnnnnnnnnnnnnnnnnnnnnnnnnngaatcccgcaatgcctcgcgcccgcaggtttgcgacctccaaccgccgcagcctttttggcgcggtggtgctgcgctttcctcacgcgctgcagcccgccgtgtacatggctatgcacgtgggcctctgcgccgcgaccctggtgctgacctccgtctggtggcggtaccagctggcctgcgaggccttcctggtgatccagttcaccgcctcggcctggagcggtga

SEQ ID NO: 1498 - DNA, 3099 bp, Chlorella protothecoides
  modified_base (1123)..(1132): a, c, t, g, unknown or other
  modified_base (2487)..(2496): a, c, t, g, unknown or other
  modified_base (2581)..(2590): a, c, t, g, unknown or other
  modified_base (2806)..(2815): a, c, t, g, unknown or other
atgcccaaggacgcaaaggccgatatcctcacgaagggcaccaagatcaagcccaagaaggatcctcgcaccccgaagaagccgtctggcgcatgtgagcatggtattcaagactgtgtagctggcctcacagatccaggcctctcttccccatcgcgtacgagaagcaccgcaaatcccggcaacgcagacatacactactgcaaggacaagcgtgagctcctcaaacaggagcaccccagcctcagcctgggagatatgggaagggagatggggaagcggtggcaagaggagaccatggaggtcaagaaggtcggtgtgcgtcgtgctttccgccatgggtgggggattgagtttgcttctcagggacgattgtcagtgttgggctggagaggaaagctcccgattaaggtaacgcacgctgcatgcaccaaaagtgattgtgggctgtacaatgacgcccatggcttgcacatgacgcaattccttggagccatgtctgaacaaatcacagcctctctaagcacatgcactccttggctgcagccctactttgacatggcggcgcgagacaaggcgagaaaacactcgctccacggtccttcagctgaacttgtattccagatccacgtgtttgcactcaaagcacaggtattgatgctctggcctggtataatggactcacccagcagccgctcccctcccatgatcctccttcccaacgtgagcccaggttgttgcaccagaaatgtacaagctgagatgacaagcaggcaggcctctttggggagggcaaggatccttggctcatcgcagctctactttcagctggcgttcagcaccacgatcttcaacagccctcgaccgactcccaaacactcatcctcctcaccggcggacggtccactggagctcattgatctcctcatccgtgaggctgcgctgcatggagcggtatgcaatgcggtagcagtggctcgtcttgccctggggtgtcaggaggtcgagggaatggggtttgtggatgtccatgctcaaggcgtcactgcagcccagtcgcgtctcgcagcgcccgcccaggagtggattgatacctcaagcgaccacgcgtggctggcatgcnnnnnnnnnngtgtcaggaggtcgagggaatggggtgtgtggatgtccatgctcaaatcgccaccgcagcccagtcgggtctcgcagtacccatccacgagtggattgacacctcaagcgaccacgcgtggctggcatgctcccagggacagctgtgctcctgaaacgcagcccccagcgaactcaaccacccaccgtctttgggtgtgtgaagctgtcgatgagcttcacctcctccacgaggtcccccgccacggcacgcaccacctcgcacaggttgttctcggtgaagctgtcgctcagccagaatgccacgtccttgaagcagggcgggtacttgctgtagggcttgaacctgggcgaagcgcgagtcctccgtccagaacagccggatgtctgggatgtcaaacaggaccatggccagacgctccagaccaaggctgcaaaggaaagcaggaagagctggctcggtactgtgggtggagcaggggtcccagcatgcctcgctgcttgggatgccgagcgtacccacaacagccgatgggggggccttctttgccaggccaagcagatgatgccctgtgggtcctgacactgcaaccccatgcaacaagttgccaccgcttcagcacagatgccgtcctgttcctcctgcactcccggaatgaccaaggcgctcacccgaatgcccaggccttgcggcctgcaaaacctccgtcatccacgatggactgctgggtgacgccgcaccccagcacctccagccactcccccttgaacagaatctccagctcgaaagagggctcggtgaaggggaaccaccggtgggcatgggggaatgtctcagagagcaggagccgtgactggcgtgcaggccttccagagttcaggactggtcaggcatgcctatcaggagggcctattgccctctgctctcaaccctcctccatgacaaacaatctgtcccacccttgctctcaccaaagagcactcgcagcccctccatctggtggaacaccgggtagtgcgtcgagtcgatgctgtctcgcctgcagcagtgcacgtgtgggggtgagtggcacggctgccacggaacgggacggggtgggagctccacctggtgtgagccctagatggccgaggattgacaagaccacgcttcacagcctacttgatcacgccaaatttgaatgccaggctgaggttttgcacccaggagccttcagttctccagcgggagaggcactgtcccggattccggcccctctcccactgtcccgccttcctacatcatcaaagttctggcgattggaagggggggggggacgggggcgattggtatgcatgatcggagagcgtgtgccnnnnnnnnnngggcaccaagacatcatcaaagttctggccgatggaagggggggagcgggggcaattggtatgcatgatcggagagcgtgtgccnnnnnnnnnncgtcccggattccggccccttcccccccccgtcccgccttcctgtgcacccactcccaagccctttgccacccaccggtacacatcgccggtgatgaggaaggcgggctccccgcgcttcagcagctccagctggtgtgcagaggtgtggcagcgcagcacggtggcatcactcacgtagtaggtgtcgttggggttgcgggagacgtggtcggcnnnnnnnnnnaggagcctggccctgtcgcaaggtgggaggaggagccagccagcagccacggcctggtacaggagggtgcccccccatgtccagcccgtgaggcaggagccacgcaccgccttgaccgtgaccacggggtacaggtcatcaaaggtcttcagggcggggtccgccttctggaggtactcgtagatggaagtcttgatgatgccgagcgggtgggatggccgtctggggaaaaacagagtgagggtgtggggaggggtgagggtgagcagaacagatcggcatga

SEQ ID NO: 1499 - DNA, 540 bp, Chlorella protothecoides
atgagcgcctccgtgctcgtcccccatggtcaggcccgggtgcctgtgggtgtcgggcactcccccgcccctcgatcccccttgctcctccagcgcgccagggccatgggcccatgcttcgtgccaaacgtcacccataaatccagctgctctcctcgcatgtcgagctgcatcatcacccgagctgtggctgaggagcaggaggtcgcctcggctgcccccaccccccccgcaccccagcagaaaatccggattaagctgaagtcatactgggtggacctgctgcaggtggccgtggatgccatcctggatgtcgccaagaccaccggcgccacggtgtctggtcctgtccccctgcccacaaggatacggaagtggaccgtgctcagctccccgcacgtgaacaaggatgcacgggagcagttcgagcagcgcacccactcccgcctcctcgacgtcaagaacctgtctgccgagactgtggacaagctcatgcagctggagatccccgcgggcgtgaacatcgacgtcaagctctga

SEQ ID NO: 1500 - DNA, 297 bp, Chlorella protothecoides
atggaggggctgcgagtgctgggtccagaggactggggctccatggaccctacccagtatgcagagacgcagctcaagcagaccctggagggccttgcccagcacctctttggtgagagcaagggttctgtggagatgcggtgggtggatgcctacttccccttcaccgagccctctttcgagctggagattctgttcaagggggagtggctggaggtgctggggtgcggcgtcacccagcagtccatcgtggatgacggaggttttgcaggccgcaaggcctgggcattcgggtga

SEQ ID NO: 1501 - DNA, 297 bp, Chlorella protothecoides
atggctgcacgggaggccgcccacgagcgggtgtccaccttcctggtgtcctccgacagggcccaggccagcggcaacgagatacgagaggccctggagtccagcaacgatgaggccaaggtggaggccatggagaaggccatcgccgccctgctggcgggggagcagctgccagccctgttcatcaccatcgtgcgctatgtgctgccatccgagaaccaccaagtccagaagctcctcctcctctaccttgtgagtggggccattggtttggaggctgtgctcgtgctgtcgtga

SEQ ID NO: 1502 - DNA, 993 bp, Chlorella protothecoides
atgatcctgatctgccagaacctgaggaacagcctgcagcaccccaacgagttcatacggggggtgacgctgcgctttctcacccgcatccgcgaggaggagctgctggagcccctggtgcactcaggtgatctccgggacaggatggggtgtattgttgttgtgatccaacaggcatgctgcatgtcttccatgagacgggtgcaatcctcccctattccgcccctccagtgccgccctccctcatcagcacccccccccttcctttccaagcgcctccctaatgtcaaaaccaaaatcgcagtgctggccaacctggagcaccggcactcgtatgtgcgcaagaacgcggtgctggccctggatgccatctggaagctgccgcgcggcgagctgctggcccccgacgcgcccgaggtggtggagcgcctgctggcgggcgaggcggacctgtccacgcggcgcaacgccttccacctgttggtcaaccacgcgcgcgaccgggccgtggcgtacctgctgagcaacgcggaccgcgtggcggagtggggcgacgtgctccagatcgcggcgctggacctgacgcgccgcgtctgcggcgacgaccccgcccagcgcccccgcttcctcaaggtggtcctggccctgctccaggcgcgcagcacggcggttgtgtacgaggcggcggtgaccctggtgggcctgagctccgcgccggccgcggtgcgcggcgctgcggccaccttcacctcgctgctggccagccagtcggacaacaacgtgcgcctgatcgtgctggaccggctggaggagctggcggcgcggcacccggaggtgatgcgcgaggcgctgatgggcgtgctgcgcgcgctggcggcgcccgacctggacgtgcggcgcaaggccctggacctggcactggacctggtcacgccgcgcagcgtggaggaggtggtcggcgtgctgcgcaaggaggtggtccgcgccgcggcg

SEQ ID NO: 1503 - DNA, 447 bp, Chlorella protothecoides
atggtcctgtttgacatcccagacatccggctgttctggacggaggactcgcgcttcctgtcccagttcaaggccggcagcatgaagacaaagtgggtggtgcagcgaggcaagcgcacgaatcgcctggacagcctctctccctcaccccccccctccctcgcgccccgcacgcccaggttcaagccctacagcaagtacccgccctgcttcaaggacgtggcattctggctgagcgacagcttcaccgagaacaacctgtgcgaggtggtgcgtgccgtggcgggggacctcgtggaggaggtgaagctcatcgacagcttcacacacccaaagacggagcacagctgtccctgggagcatgccagccacgcgtggtcgcttgaggtgtcaatccactcgtggatgggtactgcgagacccgactgggctgcggtggcgatttga

SEQ ID NO: 1504 - DNA, 3636 bp, Chlorella protothecoides
  modified_base (169)..(212): a, c, t, g, unknown or other
  modified_base (380)..(389): a, c, t, g, unknown or other
  modified_base (1422)..(1457): a, c, t, g, unknown or other
  modified_base (2056)..(2065): a, c, t, g, unknown or other
  modified_base (2615)..(2624): a, c, t, g, unknown or other
  modified_base (2696)..(2705): a, c, t, g, unknown or other
  modified_base (2788)..(2797): a, c, t, g, unknown or other
cctccacccccacccccaccgcccccatcaagctcgccggccccatctcccgggatctctccttccccaggtaccaagtctcctccacctccatcctacgtagcctcaccgccgccaccatcaaaggcctccccaccgccgccaacgtcttctccctcgccccgcaagnnnnnnnnnnnnnnnnnnnnnnnnnnnnnnnnnnnnnnnnnnnncgcaacctttcccccgccaccccccatcagcaaagacctctacaagtcggtaagttggtttggcatgagggaagtgcacacgtcaacaggaacctgttctagggcagtatccgttcacattctgaacaagttccactgcaccccctgctgcaggcactgtatggatcnnnnnnnnnncacacaatctgaacaagttccaccgcaccccctgctgcaggcactgtatggatcgtacctattctacgaggctcaagtcagcggtgagaagcccagctggaaccgcatcacataccgcggcgactcccacaccgacgatgtcgtcccgggtggatgccttttacacatacgagtgattggcggggctgcagtctccttttatatagacctaaccggctgttctcttgatggaactgccctgccttcaaaatcagaacccctgccttcaaccaagtcaacccccccccctcctccccctgccaggtacgatgccggcgactttctgaagctgaacttccctatgggccagaccgtgtccttcctggcctggagtctgttggatttcccgaccgcctatgctgacgctgggacggccacccccgccctgaacaacatcaagctggcagccacctacctgatgaagtgccacatcggggagtaccagtacgtgggccagatcggcaatcccggaaccgaccactcctactggggccgtccggagcagcagaccggcacccgccccgcctacacctacaccaaagaaaccacggccagcgacctgctgggctcggtctccgcggccctcacttcctctagcctggtcctggccggcagcgacgccgcgctttccaaggagatgctgatgcacgccaaggccctgtatgcatggggcaaggcctacccaggtggatgggaaggcgtggatgtccttgggggaaaggaggatgagcgggggcactgcacccagagcaggctcccctccccaagaccgaggatcaccccgccccggccccttgccgtgcaggcctgtacaacgcggcatactcctccgccacctatgtgtactggtcctcgcggtacgtggacaagctcatgtacgccgccgcctggctgttcagggccaccggggacgccgcgtacgctgccgacgcctacaccttctggcagtctgccggaacgggcgacatctacaccggctgggactccacctttnnnnnnnnnnnnnnnnnnnnnnnnnnnnnnnnnnnntaacctgctgctcaagctggccagcgaaggcaagaccgtgcccggcaaagcggcgtacgagaagtggatcgtctccagcttcctctccgcctggcagacggccgacggtgagcctgggggttggctttcctcctggtgcgggatgcaccgttttcttgtccagggcagcggcaggctgcagagtcagccagtttcagcactcttcccaacagacggggccaatggtgcgggccaggagccaccaatgcaactggagcatcatcaagacgcccaagggcctgacctacccatcctggagcaagtgggggaacctgcgctactccaacaacgcggccttcatgaccatcatgcgcgcctcctactcctccgtgaacaaggcgaccaacatcgcgtgggccaagagccagctggactacgcgctgagcaccaccggccgcagcttcgtgtgtggcgtgggcaccggcttcccgctgcagccccaccaccgctccgcgtcctgccccaacatgcccgcggcctgcggctgggaccagttctactctgcggcctccagtccccagacgctgacgggggccctggtgggtgggccccccaacggnnnnnnnnnnagcaaggcggcaagcccacagacgctgacgggggccctggtgggtggaccccccaacggggatggcacctacgtggacctgcgcagcgactatgtctccaacgaggtggcggtcgactacaacgcgggcttcaccggcgcgctggccggctacatcgccctggcctgaggcggctgctccgtctcaaaaagccacgcagagtgcccgacgaccgcgttgccctgatcagggccgcagccgaccccccctggaaaccctggccagacacctgcacccttgtatactgcatactgccactgacacactcccctcatcattgtctcctgagacatccaggcatcacccccccccgccccgattgcgcagcgcagccaggtccccctcccggtcgcccattggtgcagggagggggaggcggctcgcgcctgcgcctcagaagattcgatgcggttggaggcacaccaggtatccagagcgtgcagcgtgcatgctgcgcacaagggagcgatcgcactttcctcagggatgcattcgtacatgggacgggcgnnnnnnnnnngcactcggcccagggctcaggctcctcgcaacaggccttttccccgcctcctgggtgtcggctgccgggtcnnnnnnnnnnggcacgttctcactgcctgctgggtgagggcctgctcctctgccggccatgcctcggttcggccagcccttgcgccggccatnnnnnnnnnnagcatgttctcactgcctgctgggtgagggcctggtcctctgccggccatgtctcggttcggccagcccttgcgccggccatgggcggctgggtgaggcctccactcggccctggattcaggctcctcgcaacaggcctttcccccgcctcctgggtgtcggctgccgggtcgcaggttgccaaggagcagcgcccgctccagcaccctgccccgcagctgcaggtcgtggtagggcgtgaccttgtgccggtgctggcgcccgcccgcgcccgtgtcggcgagtgcgctgggatcaaagaccacgaggtcggcgtcgaagcccggcctgagcgcgcccttgcgcgcgctcaggcctgcaaggcgcgccggcgcggcggcccaggcgcggaagaaggcggggagccccacgccgtgctgcgccgcgccgtgccagctggcgggcaggccgtactgcagaccggcgatgccgccccaggcgccgcggaagttaccgctgtccaggtgcttgagcgctgggggcgctggggagtggtcgctggccagcaggtcgatggtgccgtcggccaggccgcgccacagcgcctctcggttggccgcgctcctgatgggcggcatgcaggagaagcgcgtgtcgccgtcggccacgtcgtcggcggaaaagaggaggtagtgggggcaggtctccacgctgaccggaaggccctcggccttggccgccgccagcgcggggagcaggctggaggagaccaggagggggggatcagggagtgggctgggaggcggccccttgtgtggaggtcgcgggtgctgggccgggggcagcaggcatgcacgtag

SEQ ID NO: 1505 - DNA, 996 bp, Chlorella protothecoides
  modified_base (277)..(286): a, c, t, g, unknown or other
  modified_base (407)..(416): a, c, t, g, unknown or other
atgggggagacttccatacccatccctgctcccgcccatccctcgcatggctgtgtcacaccgggcgcctccctgccatggacacaacccacagtgcacgtgcgcgggagcaggattgtgacggtggccaccgccggccccgacgtggaccgggtggccttcgcgcggcactacgcagccgccaacccgcgcgccgcgctgctggactacggcggcgcggtcatcggacccggcctcatcgatgtgcacgtgcacctgaacgagccggggcgggagnnnnnnnnnnggtatggtgagttatttgggttccctatgacgattggggtccgttcccggacgagtgtgaggggggcccattccggtggttctgccgctcactgcccaggagtctctgcatcatggggggnnnnnnnnnncggcgcggtcatcggacccggcctcatcgacgtgcacgtgcacttgaacgagccaggacgggaagagtgggagggcatccccactggcaccgccgccgccgcggcagggggcctgaccacgctgctggacatgccgctaaacagcgagccgtgcacaaacaccgtggccgacctgcgtgccaagcgtgccgcgatccgcgccggcgcgcgcgtcgacgtcggtgcctggggcggcgtcgtgcccggcaacgcgcgcgacgcgcgcgcgctgcgcgccctcgcccgcgcgggcgcccggggcttcaagtccttcctctccccctcgggcatggccgccttccccaacgtgtccctggccgacgtggccgccgccatccccgtgctcaagcgcctgggcgcgccctacctcctccacgccgagctggtggacggcgacgtcccgcccggcgccgaaccccgctcctacgcggagttcctggccaggcgcccggcgcgctacgagcgcgccgcagtgcacgccgtcctcgacatcctgcgcaagggtgggcgtggttgggcgtgtgggtgggcctgggggtga

SEQ ID NO: 1506 - DNA, 276 bp, Chlorella protothecoides
  modified_base (177)..(186): a, c, t, g, unknown or other
atggtgctgacggtggacgcgctggtcatctacctgggctgcgtgctggcggggtgcgtggtggtgtccatcgccgactccttctccgcggaggagatcgcgagccggctacgcatcagcgccgcgcgcgcagtgttcacgcaggacgcggtgctgcgcgcagggcggcgcctgccnnnnnnnnnngcgcatcagcgccgcgcgcgcggtgttcacgcaggacgcggtgctgcgcgcggggcggcgcctgccgctgtacgagcgcgtggcggcggc

SEQ ID NO: 1507 - DNA, 291 bp, Chlorella protothecoides
atgaaccaaatccggatacggagcaaggccaagcagctgctggatgctggttgccagattcacgagtttggaggacagacgctggaggagggtggctttggcgacgacgtggcggcgctgcaggcattcctgagcgaacgggaaggcttcagcggttactttgggagcgtgacgaaggaggctctgtgcgactggcaacgcgacagcggattggaagtcacaggttccttcaacacggcgagccacctggaatacctgcgccagaaggtgagtcgtggggaaagatggtga

SEQ ID NO: 1508 - DNA, 681 bp, Chlorella protothecoides
atgccagacaccacgcccgcccgccctggattcgtggtgcactttgtgcacctggtctcctccagcctgctccccgcgctggcggcggccaaggccgagggccttccggtcagcgtggagacctgcccccactacctcctcttttccgccgacgacgtggccgacggcgacacgcgcttctcctgcatgccgcccatcaggagcgcggccaaccgagaggcgctgtggcgcggcctggccgacggcaccatcgacctgctggccagcgaccactccccagcgcccccagcgctcaagcacctggacagcggtaacttccgcggcgcctggggcggcatcgccggtctgcagtacggcctgcccgccagctggcacggcgcggcgcagcacggcgtggggctccccgccttcttccgcgcctgggccgccgcgccggcgcgccttgcaggcctgagcgcgcgcaagggcgcgctcaggccgggcttcgacgccgacctcgtggtctttgatcccagcgcactcgccgacacgggcgcgggcgggcgccagcaccggcacaaggtcacgccctaccacgacctgcagctgcggggcagggtgctggccacgtttgtcagggggcagcaggtgtttgactccgaaaagggggtcgcacagcaggcctgtgggcgatacgtgtag

SEQ ID NO: 1509 - DNA, 855 bp, Chlorella protothecoides
atgacggcccaggaggcaggacccactgccatgagactgaaggaggtgctggaaggtgccgatgccctccctctgccccaggtcaggaagcaccatctggggctggactccctgggcacacctggtccaggtggcaggtggggcccacctggtgggacgcacatccgtgcacctgagcgatgccctcatcccccactcttcccacagctctggagactggtcagcaagcacgtcctccacccggacctccccttccccctgcacgtcaagctctacaaggccgcctatgctggctgggacggggaggcgcagggccccccaccgtcctgggtccctgacccggacgccatgcgtgacaccaacatagctcgcttcatgcaggagtggaagggctctgagctgtggcgccggctgcggaccggcgaccccacccaggactggcccctgctgcagcagatctccttcgaggaccccgagtccttctggcccgctgtgctgcagcgcctgcgcatccgcttccacagcgtgcccagcagggtgctggcccgccacgccgacccggaccaggtctcctggttcccgggggccaggctgaacgtcgcggagtgcgcgctggcagggcgcgacccggaccgccccgcggtggtgtgggccgaggagggcacgcccacggagctgcacacgctgagcctgggggcgctggcgcagcgtgcgcagcacgtcgcggacgcgctgcgggcggccggcttccagccgggtgcggcggaattgggtgtcgggacggccagtgcccctggacgcctcccctctcccaggcgtgcgcctcctcggcttcacaccccctgtgcagcgtga

SEQ ID NO: 1510 - DNA, 465 bp, Chlorella protothecoides
  modified_base (97)..(110): a, c, t, g, unknown or other
ctcggcgctgccgccgtccatggtgcccacggggtgggaggtgcccttcggcgcggcgcagccgcccgacgacgccgccgccgcggggcggttgggnnnnnnnnnnnnnnagggtgggaggtgcccttcggcgcggcgcacccgccggacgacgccgccgccgcggggcgcgtgggcgtggacgagtcgctggccccgctgccccagatcatggccgtcttctccgcggtggcctggaacatcgtgggcgaggagcagccggcgcgcgtgacgctgcgcctctggtccttcgaccccgctcgccccacggcctcgctggaggacctgcgcctgcaggtccccgacgccgtgctgtgctcggagatgggcgtctccttctcgccctgcggccggtacctggccgccgcggtggcctgccgcgcggggacgcggcgcggggcccccgcgccgttgggcacgcccggc

SEQ ID NO: 1511 - DNA, 699 bp, Chlorella protothecoides
atggcccgcaccacctccagcctgctcctgaagctgctgggcaatgtgctgtcccagcctggggaggccaggttccggcgcctgcgcctgaacaaccccgtcctgcgcggatccatcctggagaccgaaggcgggctggatgtgctgctggccgcagggttccagctgcagcccggcgacgaggctgatggagggtgcggcgtgggggtcggagaggcagaatgggcaatggagccgcgtggcgctgcacagtttggttcccgcccgggcgcagtgtcccagtttgcggtgctggagccaggggccgacctggcgccgctgcgggccgcctgccagatgctgcggcacctcaacgccacagagcagcccgcaggagactcccgcgcagagcctggggtggggcgtgcgcccgcagccagtgcgggtccggcaccaaagcccgctcctgcgggcggcgcgggtccagcagcggggtcaccttccgcaagctgcacggtcccggcagcagccccaccgttcgctggggtccagccggcccctgcccggcggcgcgcaacgagggtcgtcctgccctcctcggtcgagcgtgaggtgcccccgtggttctttgagcgcaccggtgcagagctgaaggccgcgttcctgggcgccgccaggcggcgacaggaggagcaggcaagtcggggccggggggaatga

SEQ ID NO: 1512 - DNA, 318 bp, Chlorella protothecoides
atgcggtttccagatgttcaccccggcccattccaaccacaggacgtttccatcagggtcagccagaagccgggctacctgtgccgcatcgaggcggagtgcagcctgcccctgccccccgacaccctgttccaccagatcgtgacgcacccagacaacgcgaccatcttcaggaacatggacagctgcacattccgcaagatcctgcagcgatcagacgcggtacgcgtgctggaggtggagcacgccgccaactggcgcatcctgctcttccgcggcaccttcaagaccaggtgggtgggtgggttcgaggtgtaa

SEQ ID NO: 1513 - DNA, 417 bp, Chlorella protothecoides
ggcgcgccgcccgagccggggcccttccccggcgcacccgacctgggcgcggcggccgcctccggcgagcggccgcacctgcaggcgtgcacgctgcgcgtgctgcgatcggccgccatcgagcgcctggcagagccaggccggcgcagcctgctgcgccgcctgacggcgctgctgacggaggcccccgcaccgccggcgccgtccggcctgcacctcgtccccgtcgccgtggtgctgctggaaagcgtggcgctggtcatcgagctcctgggcgaggcgggggcggagacgctggccgcactgagcccggccctgctcgcatgcctgggctggccggcacagggtgcgcgcgtgcaggccgcgcgcgcgctggccgcgctggccgtcgcggagcccggggcggccgcggggctg

SEQ ID NO: 1514 - DNA, 921 bp, Chlorella protothecoides
  modified_base (173)..(217): a, c, t, g, unknown or other
ggcgccgccgccgctcgccgcgctggcgctggacaggcgcgccgccaggctggcgcggggggaggagtgggcggagccctcgcccgacccggacccggcctccgtgccgcccgaggcgtctcgatccatgtcggggacacgggggtgggggtcggtgcggtcgatcacgccgnnnnnnnnnnnnnnnnnnnnnnnnnnnnnnnnnnnnnnnnnnnnngcctgggtgggtggggggagaaaggggggagaaagggggaggctggcttggaggcggaacggaaggagtggacagggggcaagataaggagtcaagggctctgtcggcccacagggggcacgggggtgttccatgaatttgtcgaagcaccgcgtgccacaacaaatccccctcgccaactacaacccgaacaccacaatcacaccacagcatgcatcccgcctcccccaccctgtcccaccaaagtcggcgagcttgatgtggccgtccgcggcgatgagcaggttgtcgggcttgaggtcgcggtgaatgatgccctgcgcgtggcagtactccagcgccagcaccgtctccgcggcgtactgccgcgccacaccctcgctcaacccgccgagcgcgcggaggagggagaagaggtcgccccccgccgcgtactccatgaccaggtagagattggcgtgggaggtgaaggaggtgtggaagcggatgacaaaggggttgcgcgccgccgccaggatgttgcgctcgttgcgcacgctctgcaccatgttcttccggatcaggtccgccttgcgcatgacctggattgggttgttgttttggaagggggtgggaggggcttggtgagacagccgcgcagggcagcagcggttgatggtgaggtgagtgggagggcagccctgctcttgctcatgaacatgtga

SEQ ID NO: 1515 - DNA, 399 bp, Chlorella protothecoides
atgcgcaaggcggacctgatccggaagaacatggtgcagagcgtgcgcaacgagcgcaacatcctggcggcggcgcgcaacccctttgtcatccgcttccacacctccttcacctcccacgccaatctctacctggtcatggagtacgcggcggggggcgacctcttctccctcctccgcgcgctcggcgggttgagcgagggtgtggcgcggcagtacgccgcggagacggtgctggcgctggagtactgccacgcgcagggcatcattcaccgcgacctcaagcccgacaacctgctcatcgccgcggacggccacatcaagctcgccgactttggtgggacagggtgggggaggcgggatgcatgctgtggtgtgattgtggtgttcgggttgtag

SEQ ID NO: 1516 - DNA, 603 bp, Chlorella protothecoides
  modified_base (150)..(159): a, c, t, g, unknown or other
gccgagccgcacggcctggcgcgcgtggacccgcgcggcgccgacctgccgccacccacctgcaccaacggcggcggcgccggcaccaacggcagcggcgtggggtacctgcaggccaacgcgctgcaggcctacgacgagctgctgcgnnnnnnnnnnacgcgcggcgccgacctgccgccacccaactgcaacaacggtggcggcgccggcaccaacggcggcggcgtggggtacctgcaggccaccgcgctgcaggcctacgacgagctgctgcgcgcggcgctgggcgcgcaggggtgcgggcggcggaatctgaccccggagggcccatggcgctggctgctggccgagtttgcgtcggcctacggcgtgcgcccccagtacgccgcgctgtcctacctgaagtgggtggtgggcgaggaggtggccagcctcacctccgactgcttcggcgtgctggcgcgggagctggcgccgctgcacgccgcgcgcgccgccgccgcactttcctcgggcgagctgggcgtgctggcccaggtctgcaaccgcgtggacggcctgctgtcccagtgcttcgagaactacttcatgctcaggtga

SEQ ID NO: 1517 - DNA, 2955 bp, Chlorella protothecoides
  modified_base (147)..(156): a, c, t, g, unknown or other
  modified_base (1813)..(1822): a, c, t, g, unknown or other
  modified_base (2659)..(2775): a, c, t, g, unknown or other
atgggttgtacaaagcaggttgctcctggcagatactgtgttgaggggaggcgacgggaagggagtgcgaaggtgtcgcttgatggagaccccgagggccgcatgcccgcaatctccccctggtacctcgttatttgtgtaggtgtnnnnnnnnnncaggggaggcgaggggaagggagtgcgaaggtgtcgcttgatagagaccccgaaggccgcatgcccgcaatctccttcccctggtacctcgttatttgtgtaggtgtatgtgcgcgtacgggccagggtggggcttgcaaggctcagcagggcaagcgcggtccccagcagtgcggagcgcgagacaccgcgttggtccattcgtatgctgctagccatgcaggagggtccaagcgtgcggcaaaccgtgctctggcgcccaggaacgcaccactcgcgctaagagggtctgatgtactctctgtggctccaccaatagggtgtctttcctgctccagggcaagatttaagattgcggttgtaaactgcattccaggcatccagggagaaatttgcagctgcctgccgattgttcagcttctaacatggaaatatgggcacctgatcacaaggcagcgatgcacacctgaaaggagtggagatatgtgggcggagagcaaagcagtgcgcagggctccaggttttcacttcaagtgtgcatcaatccatgaagcttcttcagaaaccggtccaataaaggatggaattattcattgttcaatttgtcaccactatgtacggtttaatcatgctcgtcccttgtttcttcgtcaattcaagtgtcttggcctgggttcctgtgagggggggcaccccttgttgactccggtcgttggccctccagcgcggagcggagctctgacagtcaaagcaatcgcgggtccattgcaggagcacaggacatcctcgctgcaccactactgtagtcaacatctggctgggctcctgattcctcagtatgggactgaccttcacgaagctgttcagccgggtgagccgaagagtagcaaggggaagcaaggtgcctcccggggcaaggcgcggcactctgtgatcgccgacctccaacaacattctgacagttgcaccgcacttccctcgcagctgttctcccggaaggagatgcggatcttgatggtgggactcgacgctgcgggtaagaccaccatcctgtacaagctgaagctgggcgagattgtcaccaccatccccaccatcggcttcaacgttgagactgtggagtacaagaacatcagcttcactgtgtgggatgtgggcggtcaggacaaggtgggttcctctttattattcgcccgcaaacctcgcccgcatccctcctccccagatccgtcccctctggaggcactacttccagaacactcagggcctgatcttcgtggtcgattccaacgatcgcgaccgcatcggcgaggcccgcgacgagctgcaccgcatgctaaacgaggacgagctgcgcgatgccgtgctgctggtgtttgccaacaagcaggatctgcccaacgccatgaatgccgccgagatcaccgacaagttggggctgcactccctgcgccagcgccactggtgagccagggtgattgccatggagtgttgctggtgcttgtgagaagggtgtgcgtgcaagggtttgcaaatcggtggcgtgagtactacttccccgatgtgttctgccccacatcccccctgcatccctgcaaacccccctttagcccccccccctcaccatctgcatccattccttctttgtggtacaggnnnnnnnnnnatgctaggatttgcaaacaggtacatccagtcttgctgcgccaccagcggcgagggtttgtacgagggcctggactggctctcccagaacattgccaaccgaacgtgagcggtcgcagatggctggaaaggatgcgcagaagatgggtggcgtggggctctgctctgcctggagcgccagtgggggccactgtttggcacggcgagagccgcggagcgacgcacgtcgcatgtcaccctcctcccgatgccctcccctgcaccgcgtcccccgatatacacttgcttggctgtaatcctggaacgtgcagggcaggaagggtagagaggggatggggaaggtgcaagctggaaaagttcattggctgcgacagcagcctgtggcaccgccggtgtacggtgtcctgcacctcccgcccagcccatgagccatcactccgcgccgccgggcttggccagcttggccagcagctccgccccctgctgcccgaccagggccagcttgtaggtgaagaagccgcccaccagcgccagcagggacaggtgctggcccgtcgccggcgcggccagcgtctcgtatcgattgaaccccaggataaggatggcagggatgaggaggcgctgctggctcaacatgctgcctgccatgccggagccgctgggcgacatgccgtccaccgtgcgatacagggcccgcaggtagagcagccccgccaccgcacccacggcgtagctcgcggcgctcgagctgcaaagggcgggaagagggaaagggtggcggggactgtcgtgcgaggcgctcgtgctcggcagggagggaggctgacatgcaaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgccatgcacaaaggctgtgcctgccagacagatgcctgacagccccagcgtccacaccaggcctgcagctttcatggtgtcgtacgcctcctgctccagccgcgccgcctccgccgcagcctccccattgcggacgcgggaggcgtccgccgccagcgaggcctggcagggggggtaa

SEQ ID NO: 1518 - DNA, 873 bp, Chlorella protothecoides
  modified_base (344)..(353): a, c, t, g, unknown or other
  modified_base (636)..(645): a, c, t, g, unknown or other
atgatgatgtttgctagtgcgccgtcgctaaaaccatgtcgccctcgcgctctgttcgcgacggcctcccatgcagagggaggggcccgggaccgcccaaaacgaggtttgaaggcattgcaacgccccaagaccggctattttgctgacgtagaccccaaggcggaggtatatcctgttaagaagacaaataatgcaagtctgactgataagaaggaccgatggactccagaattcatctggaacatcgactggatgggtcaggtggggagggcgtccaagggcattaaagatgaggccaggtggtcattcctatgcggtctgatattagttttcgaggattnnnnnnnnnnggaacatcgactggatgggtcaggatcctggacaccgcctcccccttatggacactgtaagcaggcagacagcaatggagagccaccccagcagggaagctcccccgaagccgtcgcggagccagcacgacccgcagcgcgagggtacctctccattgccggccgccagagccttgacagcctggaccgggacctttcccaggaactgatcatccagaagaagcagcggttggatggtgcagcagaggccgggctggcagcgcagatgcggccagctgcaaannnnnnnnnnggaccgggacctttcccaggaactgatcattcagaagaagcagcggttggacggtgcagcagaagccgggctggcagcgcagatgcagccagctgcaaggtcccaacccgttcccgctttcaggaacgaaactcgtgcttggcagagaacctcccggtttgccgagcgggtgagtgtgttggtcattttcctgcgctccccgcagctctagtccgcggggcgcggtag

SEQ ID NO: 1519 - DNA, 687 bp, Chlorella protothecoides
atggcgcctcaggcccgaactcctcttgcatgcagtcccgcgaatggcttggcggggaagcaatacaattggtataccctgaaccaaagagtcttccgcagcctgggtctctccttcaccaagcagcagctctcggatgctgcctctgccattcccgggtccgcagagtccatcttgaaggtgctgagagccaggcttcaggatgaagtcggcccacaagccgagagaacagaaggcaagggtgtagaggaggagccatgtgtggacgtcatccctgccgtgcgcaggggtgaagcttctcctccccctgcaattgtggaaggcgacctggtggctcatctgcagcagaccattgaggtgaggggaatgggattgttgttgataacccggtctccccttgctcgagttacagaattgaaatggtcttcgatgacagcggcaactcacgatcttttgtatggcttgcagtccacaaccgatctccacgccatatgtagatcacccacgctcaagccagactgcgtgacgtcccaacctcttcctcccacagctacttggcgtcaagatatccaagatggagcagctactgcaactgaaagatgcaaagatccaggcactgatggagaagctgcagacgcagcaggccatgcactcttattaaaagccagacctattttgacgacttga

SEQ ID NO: 1520 - DNA, 924 bp, Chlorella protothecoides
atggtcggatgggtgctggccaactcggtgggggccccggccctcaccccttcgaaagagggtctgagcagcgaacccggctccaagcacgccctcccctccctgagcatgtactccgagctacccggctctgaaatatccatcgaggagtttgagcaggccgccttggacaggctgcgggtcctgaagggcctggacgacctgaaggccaagggcttccgccccgatcaggtgcaggacaaggtcctttccctggtggaccagtacctcaaagtgagtgcaaagaagggggaaagggatagtccaccttgcacggcccctcgtctgtgctggggcaaagaccccgaccaatccactgagctggctcccaaacttcacaaccaagttcacctaaattacgtatctcccccccctccctcctcaaactggtcaggccgctacacgagaaagtaccatccggaaggacaccgtgtcccactacgtgctgcgcctggcgtattgccggaccgaggagctgcgtcgctggttcctggcccaggagtgcgatctcttccgtgcacgctttcgggccctgctccccggcgagcaacgcgccttcatcgagggcaaccgcctgcccttccgccccctcacccccgccgagttcagggaggtggaggacgacctgcgggccaccatgctggcggtgaccggcagcctgcagcaaaccaatgcgctgttccagggcgccgccgcgccacacgaggccttctaccgtgcgcccttcgaggccgtgccggacctggtggggggcaggagggtgtacctgcgcggcggccacgcctacgtcagccgcgaccaggcggtcagcctggcagtgcagcccttcaggtggagatttcagggagttcgatgtggaagagggagtgggggggggaaggctga

SEQ ID NO: 1521 - DNA, 846 bp, Chlorella protothecoides
  modified_base (34)..(43): a, c, t, g, unknown or other
  modified_base (440)..(449): a, c, t, g, unknown or other
atgtcgggtgtctgtcacactgtcctgcacccannnnnnnnnnggcccactgacgccgaggggggcataattgctgcatgcatttcgggtgtctgtcacactgtcctgcacccaattcacccccctccccccctccttgccatgcagcttggggcacatcacatgctagaagattatgcgaggaggggtgatgagcccaaggacgagattcagttgtacacatggacagacgccaccctgaggtgtgtgtgcggtgggatgcagcttcatgtggcaagtggggtgaacagtgacagatctgtactgcacaagactcaacctctggcctgcccatcccccgtccccacttaccctttcccattccacatttccaacccttccctctgcccaggtgggggtggtgcactcgagcagactcggggaggacgatgtgaaaacgnnnnnnnnnnatacggtgggatgcagcttcatgtggcaggtggggtgaacagtgacaggtgtttccaccccaccctactcacctgccttcttcattccaccaaaacatcaatcagggagctttgtgacctggtgaaggaggtccaccaaacggcgcgaagacctagcgtgcgactttctttctcgcttgtctatccagaccgacggggccggaatgtgctcagacatagtcaacctatggcctgcccgtcccccgtccccacttaccctaccccattccacatttccaaccctccctctgcccaggtgggggtggtgcactccagcagactcggggaggacgatgtgaaaacgctgcgctccataaacttccagatcggggacttcctggatgttgccatctactga

SEQ ID NO: 1522 - DNA, 264 bp, Chlorella protothecoides
atggaggctgtcaaggtctccacatcggtgatggacattggtgggggcatcgcggcacctggagcgccgggcatcggggccgcccaggtttgcacgctctgtgtcaagcacggcatggcggcggcggggggctttggcggcgagctcgtcgtcaaaaggctggaatccctggagaccttcacctacaggtgcggctcctggggtcgagggggagtcctcatgtatgtgagcagtcgagtggctggcagtggcctgtccacttga

SEQ ID NO: 1523 - DNA, 804 bp, Chlorella protothecoides
atgaccccgccaataccttcctttgaatcaatacagggcggcgctgagcaaggcgctggtgaccacggcgcggcgctggagccaggtggtgggccccagcgaggcgcaccgccttgcgcccatcgtggagtcgctgagtcagcgctacctggggcccgactactcggaccccgagaagcgaggggtgacgggccaggtggcggcctcggacatcccgcgcctcgcccaggaatcgccctgcacgagtcgcaccacctcaagcacgacgggcgcatgcagctgggcctcttcctcaagggtatcgggctgcccctggaggaggccgtccgcttctggcgcgccgagatggccgccaccgcgccgggcgagaagttcgacaaggagtttctgtacaacgtgcggcacaactacgggaaggaaggaaaccggcgcgactacacgccctacacctgctccaagataatcgcctccgtgccgggagtggtgcgtgtggtggcgtgccgggggaatgggttcccctcgttccagcgtcatggtggggaaaagcctgggggcaggcactggggaaggcagggagcggaagggcttggagctgagagcctctcgaaggatttgtgcagggggcactggcctggcgtccctgcactgccttgccactggcaggctgctgttggctggtgccacgcctcatgctccgctggtgtcccaccccacatgataccttccagggtcaagtgcacgggtgccccttcagaacgtttgggcccgacgccctgcgatcggccatcagccgactccaggtga

SEQ ID NO: 1524 - DNA, 342 bp, Chlorella protothecoides
atgtatttcagccccggccatatccattttccgaccccctccatcccccaggtgaccccggcaaaggtcgacgaggcctgcgcaaaggccaaggctggccactttcagctggcatgcgctgcggtctgggaagggaagcatggctgcagctgcgagacggggatcaaccaccccaaccagtactttgaggagagccaaaaggtgctgcatggcgagcagcagccgggcgggccgggtctgagccagagccagggtgtctccacggcaaatcctgcgccggctggagcgtcgccactccctgcatctgtccagccccataccaagcatgcgagagtggcttga

SEQ ID NO: 1525 - DNA, 516 bp, Chlorella protothecoides
atgtcttaccccccctgccaggcctcgctggcggcggacgcctcccgcgtccgcaatggggaggctgcggcggaggcggcgcggctggagcaggaggcgtacgacaccatgaaagctgcaggcctgcctccctccctgccgagcacgagcgcctcgcacgacagtccccgccaccctttccctcttcccgccctttgcagctcgagcgccgcgagctacgccgtgggtgcggtggcggggctgctctacctgcgggccctgtatcgcacggtggacggcatgtcgcccagcggctccggcatggcaggcagcatgttgagccagcagcgcctcctcatccctgccatccttatcctggggttcaatcgatacgagacgctggccgcgccggcgacgggccagcacctgtccctgctggcgctggtgggcggcttcttcacctacaagctggccctggtcgggcagcagggggcggagctgctggccaagctggccaagcccggcggcgcggagtga

SEQ ID NO: 1526 - DNA, 288 bp, Chlorella protothecoides
atgccttgggcggtgaacaccactgtggcgcagcccggcggccgcctgttgtgctcggtgggcgacgacccaggggcgctcatatttgatccaggagtgggcccctctcggccggccgtgaagctggcagatgggcacgtggacttttcctttgcggctgcctggcatcctggcggcaactgtgtggccacagggaaccaggtgtggaggggtgatggacatcccacggacagggcgacaaggggagagggcaaggggacctcacagcacctgcccaaatggcaatga

SEQ ID NO: 1527 - DNA, 381 bp, Chlorella protothecoides
atgcttggtcccgcctggtcgccgacgtcaggccctggcaccccgtgcaggctcgtgggctttggaccatcctccctgggcatggagagggtcatgaatgccacgtaccccttcccagacttctccattggcaccatgaaccccagaacctacgaggtctgcgaccccctggatggggtcgactgcccttttgtcgctgtcgcccaatgcgtgccaaagggcatgatgccatgtttccaggattcggcaggcaacatcggaagttacaacctgggccacggcaacaagggcaaccacaacaggggcgacaacaacatgggtaggtgccagtcgtgtgggcggggtccagtgctctgtgcgctgaggggcctcatagattaa

SEQ ID NO: 1528 - DNA, 429 bp, Chlorella protothecoides
atggctgctcgcaaagcctccaggactcctgcgaggcaaggctcagcatgcgtgcacggctggcactgcacacatgacactggctggggtgcaaggggagcctgctgtgtgtgtcgtgcccgaggtgctgccgcaggtcgtgcgccctccctctgcatcccatgcacgccacccagcacccacccttccaggggtctggcgctggaccccgtggcagcgttccacctgaagaatggcgcgacgtgctggcgcctgaactggcgcgccgacgtcagcgggcccggcctggagcgcagccacggcatcatggtcaactacatgtacgatctgggctcgctggaggccaacaaccgggtatacgtggtgcagggcaaggtagccgcctcggaggaggtcctgcggctgctggacaaggatgaggcatcatag

SEQ ID NO: 1529 - DNA, 831 bp, Chlorella protothecoides
atgcaagtgatgaggcgctcagcctcctctccccctgtgtccccttaccaacaggctgtcggatctgacattcaagttgcccctgcatcgtccagacgtctgctccgagattcttccttctctcgtgcgcggaagttcccggtctccaacctcaccacgctcatcctggtggccggccactctgtgtacacgggtctggactaccatgacgcccagggctccagcagctggtacctcctcgactaccagaaggaggaggaccggccgagctcgagctccccgccacctgcacaggtcaagggccagacggagagtttcatggcacatatcaggctgggagtggagcaggctgcagcagaccccaagtcggtgctcctcttcagtggagggaaagcacgggccagcgccggcccccgggccgaggccgagggttactggcttgtcgccgaggccaacgactggtttgggttccctgaggtacgccgcagggcgttcacagaggtgagcggaatgggctgggaggtgcgaagtgtttgctccttccatggggggagttcttggagattgctgtgccactgtcactggagggactactacaaaggtactcccgtgtcctccacaccctcccttcatgctgctgggccccaacaggagaaggctagggacagttttgaaaacttgctgtttggtttgtgccgatactacgagctgacaggtgggatttgtatgcggcaagaatgcgtgctgcagcactcaatgacatttgcgcacatcactgctctggtggcgctgcaagcacgggcacatgcttccgttctgtccagtctctaa

SEQ ID NO: 1530 - DNA, 1959 bp, Chlorella protothecoides
atggcgactggtcgcacatatgatgtggttgtcctcggcgccacgggattcacaggccagaagatcgccgaggaaatgatcgagagcaagttcctagggtgggttgctagtaatgggtttggtcaagggaccaggcctgggccaggcctgtacgttatggggcatcatgagggtgctggtctaggtaccagcaattacaggcggcatgccagcctgatccccccacctacccccggcaggtcatgggcggtggctggccggtcccgcagcaagctggagagcgtcgtggagaggctggacctcacgtcggccagcgtcaggcccgacatcgtgctggcagacgtcggggacgccccctcgctcctcgccctcgcatgctccacgcgggtgctgatcagtgcggtgggccccttccgcaggtacggcacccccgtggtgaaggcatgcatcgaggggaagtgcgactatctggatgtctgtggcgagccaggtgatgatgatggaggcgtgcttattttgtggaggtggggggttggggtggaggcatctggtttgtgcatgacaccacgacactggagtgatgcaagacatgagcaatcgaaacatcaaccgagtgaccacctccacccacctccccgtcgcaccacatccgccattgcagagttcatggagaggattgagctggagtatggagaggctgctgaaactgccggcgtgctcatcacctccgccctcgggttcgactgcgtgcccgccgacgtcggcacgcagctggctgcttccctgttcaagccccctgcgagatgcacctgggtcgagtcctttgtctccatccacgccggcgaggcggggctggggggcaactttgccacctacgagtcggcggtgttcggctacgcccacgcccagtccctcagcaggctgcgcaagcagggcattccccctgcccatcacaccctcatgctgaggaccacccccaaacgtgacactcatccatcaccggcacaggctgtggctgccaagggcaaggtcgacctgaaaatcccggggccgagaccccgccagagcgccaagccggtgtgggacgcccgcctgcggcgctggaccctcccctttcccggtgcgttgtgggggaacgctgatgtggcgtgcatgagacagtgcatccctgccctccagtttccaaatgctgacccaggctcatttacctcctggacccccagctgccgatgcgtccgtcgtcaagaggacctgggccgggctggccaagcagggcgaggctgcagcccacacctctgtctctttcaccctcgccgaccgctggactgtggccctgtgagctgggcaaggggtcgtggcatgccactaccctgcaacctgggaagtgcttcggcacgctgtcattctaaagaaaggcctctgctgctggattgtcgtccatggctccccacccgctccccacctgacgcacgcccacgcatactggcaggtacgtcttcttcggcacgatcttctccttcctggccaaccgggcctggggccggaccctgctcctccgtttccccagcctcttctcctacggcgtgttctcgcgggaaggccccaccgaccgccagatccacgacacccgcttcgagtacctacacatcgcgcatgggcacgccgaccccgcggccgccgccgcgggcgcgccgccggacgagcaccgcagcgtgcgtatcgtggggccagagccggggtacattgcctgctccatctttgtcacccaggccgccaacgtgctgctggaggagcgggacgccatcggggcgaggggcggcgtgctcacgccggggctgctcctgcgcggcacgagttacctcgaccgcatccgggcgcgcggcatccgggtggaggaggtacccaccccctctgcgtaggggggttgtgccgccgactgtggcggctcacgatcgctga

SEQ ID NO: 1531 - DNA, 402 bp, Chlorella protothecoides
atgcttccgttctgtccagtctctaagcaccttcctcctgcctgccacccggcgtgcatagggcaccaccccacccatgtgacggtggtgggctatgagtttaagaaagcgcgcttccaggacatgcaccgggcggccgtgcggtaccccgccacctccttctcctacgtgggcacccccgccctgacgccctcggccgtggacggcgaggctgccgccgcggccgccttccggaccgacccctacggctgctccggcgccctggcggcaaagcgtgccgagcgcgacccctttgccgagggcgggtacggtccagacaggtgcccagccatggccggcctcctgaattggtgcggaccagaccccttcccgggccgcctaccatgggctccgcgacgttga

SEQ ID NO: 1532 - DNA, 876 bp, Chlorella protothecoides
atgtatggctgggaattgtgcatccagactgggggcgacaatgccgagcaggaggagtgccagcttcttcaaggcctgagtgcgcctgctggcgtcctgccagccgggctgaggctgccatgcccagcccatgccggggctggtgtcaggtgcctccgcatccacgcagcctccattcctcgctccccaccccaccccatccccaccccatccctgtgcacaggcatcggcggcgccctccccccgaagcgcgacctgcaccgctttgtgaagtggcccaagtatgtgcgcatccagcgccagcgccgcgtgctgacccagcggctgaaggtcccccccaccctcaaccgcttcaccaagaccctggacaagtccactgcctcctctctcttcaagctgctgctcaagtaccggcccgaggaccgcgcggccaagcgcgagcgcctgctgaaggaggccgaggcacgcaccggcggcgtggaggtggagaagaagcgccctgtggtggtcaagttcggcatcaaccacgtgacgcagctggtggaggcggggaaggccagcctggtggtcatcgcgcacgacgtggaccccatcgagatcgtggtctggctgcccgcgctgtgcaagaagatgggcatcccatacgtcatcgtgaagggcaaggcgcgcctgggcacggtggtgcacaagaagaacgccaccgcgctgtgcctgaccagcgtgaagaacgaggaccagcgcgagctggccaagatcgcggagagcgccgcatcgctgtacgagggccgcatctcctggggcggcggcatcctgggcaccaagagccaggcccgcctgcgcaagcgcgagaaggtgctggccaaggaggctcgctga

SEQ ID NO: 1533 - DNA, 1182 bp, Chlorella protothecoides
  modified_base (751)..(760): a, c, t, g, unknown or other
atgaatcggtgtctcggagtctacatcgttgtgcctgaatctggccgtcgtcagatttggccggaaatcgcgggcacttctcatgcaggggcccctcggttccatgtgggtaacccagggtcgagcgtcatggtttgtccaaccccgaccctcccatgcccggtgaaaccgtggttccccgcacgcccctccaccactcgacacccttcccgacctgctgccatggccacgcgatgcatggtccccgctgcccccagcggcatgctgcgatcgggcaggcaacctggcatgcaccggctcgccctcacccctaggcaccgacccgtgacatgccgccccatgctcgtcatccgggccgctggtcccgggcagacggtggtcatcggcctggcggcggattctggctgtggcaagtccaccttcatgcgccgggtgacaggcgtgtttggcggagtgcccaagcccccatcaggtggcaatcccgactccaacaccctcatctccgacatgaccaccgtcatctgcctggacgactaccactccctggacaggactgggaggaaggtggagaaggtcaccgcccttcacccccgcgcccagaactttgacctgatgtatgagcagaccctgccaatgcgccgcgcgcccgaggtcgtcgagaagcatctggcgtggctcgactgcaggtcatgcctggtgagcggactgacccaggtcatgccgcgcttcaccaactgctgtggcacacctnnnnnnnnnncggtgcgcggattgacccaggtcataccgcgcttcaccaactgctgtggcacaccttcttggcccccacgtttgccactgcaggtcaaggccctgaagaacggccagtctgtgcagaagcccatctacaaccacgtgacgggggcgctggatccgccggaggagatcactccccccaagatcctgatcgtggaggggctgcaccccttcttcgacgatcgcgtgaacgacctcatcgacttccgcatctacctggacatctccgacgccaccaagtttgcctggaagatccagagggacatggaggagagggggcactccctggagagcatcaaggccagcatcgagtctcggaaacccgacttcgacgcttacatcgacccccagaaggccaaggccgatgtcatcatccaggtgggctga

SEQ ID NO: 1534 - DNA, 1485 bp, Chlorella protothecoides
  modified_base (309)..(318): a, c, t, g, unknown or other
  modified_base (1152)..(1161): a, c, t, g, unknown or other
  modified_base (1412)..(1421): a, c, t, g, unknown or other
atggacgggcagtttgagaagctggaggagctgatctatgtcgagtcgcacctctccaacacctccaccaagttctatggcgagatcacgcagcaggtgggggtctttgtgctcggaaagagggggggggccctatgttgggctcctattgtggactgggaaattttgcaggcaggggaggagatgatacattgccaaggagatgcgggcatggggaatgggggtgaagagcatcataggatttttggcatatggcatgaggtgcggcccccagcttgcccgggacgcacatcgtgctgccaggagtgnnnnnnnnnngtgtgctcggaaagaggggggggacttatgctgggcttccatcgtggactgggaaatttgcaggcaggggaggacatgatacattgccaaggagaggcgggcatggggaatgggggtgaagattgttataggatttttggcatatggcatgacgtgcggcctccggctttcccgggacgcacatcgtgctgccaggagtgtcacagcatggccttcttctcctttggagcctcatgcactgcatcacccctccggcacccaacagatgctgaagaacagcaacttcccggggtccaagaacggcacggggctcttccaggtcatcaccgggctgaaggtcagggaagtgtacgagcagctcacgcagcgcgaggtggccagggtctaagagccgccgcctcctgcccctgcatggaatgagccctgatcctcgggttggggtctgaccagtcgagggaactgagtgcatgcccgaaagggaaacctacagagagcaggggctcaagggatgtaggaagcggggtgcagggttgtgggttcaagaaccacggcacattgaggggttgcgcaggctctacaaggaccaagggagaggttgttgcaggcgctgcacgaggcaagctgcttccccgagcacatccatcctgtattccttacgcctctggattgggcgggaatagtactgcggtgggtgaccacgtgggaagtccccgtgacgaagtgtactttttgctggtttggggttggctcgggaagccaaagggggaaggcaaccacccaccgagatacttgcagctgatgcaacaggcaagctctcaccgcaagcatctacannnnnnnnnncaagggggaaggcaaccacccaccgagatatttgcagataggggtcgaacctacgaccttccgctccgtaggcggatgctctatccattgagctacagtgccgatgaagacatcgcgtgtcctgtgatgtcagggcgggatatccagccgcatactgtttgctgtctacgagccaggaagttggaatgttgtctcacatcaaattcccgcaacaacgtagctcctactgccatcggttgttcgaccactgnnnnnnnnnnctttgctgtctacgagacaggaagatggaatgcttcctcacatctaaattctccaacaacgtaa

SEQ ID NO: 1535 - DNA, 873 bp, Chlorella protothecoides
  modified_base (339)..(348): a, c, t, g, unknown or other
atgagacatcctgagaccatcctcccccttcctctgacatcctgtaggtacgatggccaccgtgatgccatcctccgatctggggaccgacaccaagcgggcgccagcagcatgggcggccccgagcaggcaccggatgacataaacctgtatgcctacttctcgtccactgcctactctggatttggggacggcctgcgggtgagtacgcgtggagacagggagggagtgtgcagctgtggttggagactgtcggggatgtgcacggcacgaggatgtctatggtcggccggcacctggctgatcaagggaggccacaacaggaatggggcttctacnnnnnnnnnncagggagggagtgtgcagctgtggttggaggctgtcggtgatgtgcccggcacgaggatgtccatggtcggccggcaccgggctgatctagggaggccacaacaggaatggagcttctatggcgtatattccgggctttttgagcggctggccaagcaggaggccgagagtcggggtgggaagagcaggacgagcttcgtgtacccctcctttgctgcaccgcttcagcacccgctcctcgctccacactgcaggcacctccgcctctgcatggccggaggtggcgaccttctatgccgagtggtccagcttctcgtctgcacgcagcttttcctgggccgaccagtacaacccggccacggccccaaaccgccaggtgagcgaggagtgggatgcatggcggggcgagcactcacatcgatgcgctgcagcagcgcatgccacatcggagcacatttgtgggagtggcgctcagcaaacccgccagcatgcagctcgtgcacccctgctcaggaagcagattga

SEQ ID NO: 1536 - DNA, 315 bp, Chlorella protothecoides
atgtcctgcatgctgagcttggagacctcgcgcttcctcaccaagcgcgactgctgctacaggttgggccggtgggctgttggcgctgccatggtgcgctgcctctacgaggtgctggaggtggagagggacgccgacgattctgccatccgcctggcctacagaaaagctgctttgaaatggcatccagagtcgctcataccggctgcaccgatgacctccaccatgccctccacccacattgaccccagacaagaaccagcaccaggccgagctcgcaggggacagattcaaagagattcagaacgcatatga

SEQ ID NO: 1537 - DNA, 1455 bp, Chlorella protothecoides
  modified_base (282)..(291): a, c, t, g, unknown or other
atgtacccctcctcgtacccctctgttcagttgcctggctggacggggctggccaacgcccgagtgaccatcttcggggacgtctaccctctgcccagcgacatgcaagaggccgcgcgcgaggcaaatcgttctgccgccggcgtggtcgaatctggctcccctcccgcgtttccaaccagtgacatgcagtgtgccgtgtggagtgtggctcattcctcccacccacccgagcaggttctcacaccatcacactctgccccttcccccaaactcctcttnnnnnnnnnnatgcagtgtgccgtgtggagtgtggctcatccctcccacccatccgaccaggttctcacaccatcgcactctgcccctccccccaaactcctctgctttccccctcccctatcccagatcttccaccagaagcacgcctcgcacgcgggggaccctgccaagaagtcctcgcgctggctctccggcaacgcccagtacttccgcatgcaccacctgcgcgacatctactttgtgggcggcttcggcacggtgcagtgggtggacgcgggggagtacgccgccgcgaccccagacgccatcgtcctgcacggccccaccgccgtcctgcgtgtgctcaacgagcgctttgccggcgcgctgcgcggcctcttcggcgcgcgcggcggcggcgtggacgacgccgtggtcatctccatcgacaagctgggggcggacgtgcgggtggtcacacggggggcagtggagatggtagcatggggggaacgtgcagatgataatgtggatgggaggcccggggcaggggaagtcggctgtagagtctcgtgggcatgctgcacatacccctgcatgcatcctctcgcgccatggaccgacctccgacgcccttgggaaccccttccacccactgcgcccccaggaggtggtgacgctggaggatgccatcgacatcatgcagcggctgaccgcgcatgtggaggcgtagggggccgggatggcgggtggtggcaccggcgagcagaacccagactcttgctggctcactttgacccacctttgcatcacattcgcttgctcaccccacacggattattcccatacctcctgagcatgtattttctggcagagactcggcaggcaggccacacgagggaacccagagcccgcaccgggacgggcacaggcatgcagacaggaacggcagagcatccagctcctgccaggaagatggttcaaaggttcagagcggtgccaatgaggcagaggcggcgggctgcaagcacagatggctgcacagaggcagctccggcgccgatgcaatggagcagtacaggccgccagggttgccagagcactgtctggccatacacaggggagcaagccgaagatcatgaatccggaaccggcaaaataggaggcacctccatcgcgcgaggggtgtgctga

SEQ ID NO: 1538 - DNA, 1632 bp, Chlorella protothecoides
  modified_base (22)..(31): a, c, t, g, unknown or other
  modified_base (51)..(60): a, c, t, g, unknown or other
  modified_base (465)..(474): a, c, t, g, unknown or other
atgggcatgaatcgcaaccctnnnnnnnnnngtgagcctggatcagggctnnnnnnnnnngaccccaacaccatcatcgaaggcgtggacgaggccgggaggggaccactggcaggccccgtggttgcggcagcgtgcatcatccccccagacgtgaccatccctgggttggatgacagcaaagtgatgagcgaggaggggcgggagacggcttacgacctcctcacgcaacacccagccgtcgaatgggccgtgcctggaccagggcgttggctgcctcaaagacccagactcatcccccgacgcagggctgtggtgccagtggaggtgattgacggcatcaacatcctgcaggccgctctgaaggccatggtggaggctgtagacgccctgccagcggggtacccggattacgtcctggtggatggcaaccgattgcccaaggtggctggggagcaggaggtnnnnnnnnnnggccgctctgaaggccatggtggaggctgtggacgccctaccaacggggtacccagattacgtcctggtcgatggcaaccgattgcccaaggtggcaggggagcaggagggtgggtggatggatggtgctgggtcctcagcatgtataggacccccctccacagccaggggggcaatccaccacatgtccagggcctgcagcagacctgtggtcagccccctaccctgtgcaggacatggacagggaaaggagcgccgccatcatcaagggtgacagcaagagcattcccatcgccgcagcctccatcctcgccaaggttttctgctggctgtgacgcgcgacaggctgatggtgagcttgcaccagcagcaccccgagtacggtttcgaccagcacaaagggtatggcgtgccggcccacatcgcagccattcggcagcatgggccatgccccgcgcacaggcgcacctttgcccccgtgaagacctggtggccggtggccaagggtgcagaggcgtcgaaagcgtgaattctgatgggccgctatggaaggaccctggcagcacggtgtttagccctagactgcttccaatcccaaagcgtccccccaattcctcccgcgcgcgcgcgtggtttccgatgccccctcaagccaggctagatttagtcttgcttcccaaccatcgcggaccctggcagcacggtgttaggccctggactgcttccaatcccaaagcgtacccccccccaattcctcccgcgcgcgcgcgtggtttccgatgcccctcaagccaggctagatttcgtcttgcttcccaaccgtcgcggtcagccgtcattacagactactcgacgattcttacattgcattccattcaggcgccgcagtactacccctcctggttcttcccggagtggccatctgaaggggagtgtgctctccgacctcgtccactccctcccagcacccaccaagccacccatcataaagtgctcgctcggcctgtaatccatcgcgcgagtctcagcagggatgtcgggaggagcccactgcttggcctcggcgcagtgccagcttgccacgccatgtcaccagttccgcaacaggggtcgggcctttcctcggccaatgccccgcctccaggtgacccggtgtag

SEQ ID NO: 1539 - DNA, 591 bp, Chlorella protothecoides
atggaggctgggagtggactgcggcgtctcttcctcgaccaaaccagcagcagaccgtccgggggcctattgccaacctcaggcccgaagcgatgcgggaacccagaaacgcagactttggcgactgagaacatagaccttactgcagaagagctttcggatgccgaaaacgatcggtctggcctgcgcgtcgaggcaggggcaggcccccacatagatctcccagaagcccatggtgaggagtggtcccacgacatcgatgacaggctccaggaatggctctcctccatcggactggcgcactaccacccaatcttcagcaatgcaggactgtcgctcgacgctgtgcggcatctcacggaggaagacttccgagtcctaggcattccgacgctgggggctcgcaggcggctcgctcttgccgtgcacgacctcaagcgccctggagctgtggggaagggtgagcagaagtgggaaccccaccaacctgaccaagcccagagcaggacacccctggcccccctcaacagacgacccatctccggcatcacccacttcttccgaccagcccaaaggtgggagacagggtag

SEQ ID NO: 1540 - DNA, 420 bp, Chlorella protothecoides
atgatcgaggctgacaacgagaaggcgcgccgtgcggcacgccgcgagttcaacgagaatgtgcgggagatggtggcgttcgtgaagaagcgggacaagcgcgtcctggcgcatgccgtggaggaggcggcgcggaaggccgaggctgcggcgctggaggccgagaggaaggagcgtgagaagcaggagcgtctcctcaaggcacggcagtacaaggaggctgcatggctggcagcagaggaggcaggctcctcaggctccgaggctgacctgcaggaagaggagctccacaccttttactgcatggcatgcgacaaacactttaagagcgagcgtgcgctccagaaccactcgaggtgggcagaggggggtgggtacgcggggcgccgaggtgtgcacgccacctgcatcactgcgtga

SEQ ID NO: 1541 - DNA, 255 bp, Chlorella protothecoides
atggtgtccgcgcatgccctcctgctgcagattgcgacagacagtcctgaggctccggacgaggcgctgaggagggcaggagtgctcgcttcagactctgcagtcgtgtacttgacccctgcccaggtgcaggcgcttgaggaggagatggcggcatccggggaccttttcgaccctgccagtctggagtcgaccttttactatgtgactgattgtctggcgcgggcacagtggtcgaacaaccgatggcagtag

SEQ ID NO: 1542 - DNA, 219 bp, Chlorella protothecoides
atgatccctcccctgcgccgtgcctcactccttcacccgcctggacccgctgtcttcagaaagggtggcgtggtcccgctccgcccctggcagctggtgcccggcacccagtttgtggtggacaggtttgacagcctaccgccctccctgccccagcaccgccactggttcctgacccacttccacgccgatcactacaagggcctgaccgggaagtga

SEQ ID NO: 1543 - DNA, 252 bp, Chlorella protothecoides
atggtgcaccagggcagacccctggcctcactcctgccagacagcgtcatgccatccttggtgacccccacctgccctcctctccctgttccgcaggccgcgtaccccgctccctgggtgcgccagtccaagttctggcccaccacctgcagggtggacaacgtgtatggcgaccgcaacctggtggtgcgcatgcccgacgtgccagagaccccggcggggacgcgcggcgctgaggtggtggccccctga

SEQ ID NO: 1544 - DNA, 771 bp, Chlorella protothecoides
  modified_base (147)..(156): a, c, t, g, unknown or other
  modified_base (233)..(242): a, c, t, g, unknown or other
  modified_base (312)..(321): a, c, t, g, unknown or other
atgagttcatcctggacatcaggtgggggggggtgggggggtcctggcctgcagtcatgcagctcgcagagctctgtgcaagcctggtctgatacaaggggagaacactcgcaatgtctggtctcgggaagtcaaccaaccctcccnnnnnnnnnngctctgtgcaagcctggtctgatacaagggaagaacactcgcaatgtctggtctcaggaagtcaaccaaccctcctnnnnnnnnnntggccagtgtcagtgcgcggaggcagcatgtgtaggttgtccccagcctgtcccgagtccagccggaagnnnnnnnnnnatcgaggcagaggacattgccaagcgtctgatcgactacggcttccatggaccgactatgtcctggccagtgtcaggtgcagcctgggtgtcttggcagggtggtgcatggaggctgatttctggatgtataagagcagggaccctgcaggatgtttttccagtgcgcggatgcagcatgtgtagtttgtccccagcctgtcctgagtcaagccggaactccagcacacctggccccaacatgctcacccaccccttttcaactactgcaaccaggcacgctgatgatcgagcccaccgagtccgagagcaaggccgagctggatcgtttcgtggaggccatgatcggcatccgggaggagatcgcggagatcgagtccgggaaggccgaccgggcgaacaacgtgctgaagcacgccccgcaccccgcccacgtcgtcatggccgatga

SEQ ID NO: 1545 - DNA, 1956 bp, Chlorella protothecoides
atggcacacatcggcgccgatgagccccggcgcggtcagtcccacctgcgcgttcatgttggcgccgtccatgtacacctgcccgcccgcggcgtggatgatgtcgcacacctcgtcgatgccgttctcgtagatgccgtgggtggaggggtaggtgatcatcagcgcggccagctccttctcgtgctccttggccttggcgcgcagctcctcgatgtccacgttcccctgcttgtccacgcccaccggcacgatgcgcaggccgcacatggcggccgaggcggggttggtcccgtgcgccgacacagggatcaggcagacgcggcggtgcgcgtcgccgcgcgccgcgtggtaggcgcagatggtggccagccccgcgtactcgccgctggccccggagttgggctgcagcgacaccgcgtcgaacccggtgatctccgccagctgctgggccagcgcctcgaacatggcggcgtagcccgcggtctgggaggcgggggcgaaggggtgcagcgccgccagctcgtcccaggtgatgggcagcatctcgctggtggcattcagcttcatggtgcaggagcccaggggtatcatggagtgggccagggacaggtctcggttctccagccgcttcaggtagcgcagcatctcgtgctccgtatggtagctgttgaagatggggtgctgcatgtaggggctggaccgcgccgcgccgccgatgccggtggaggcgtcggcggccagcgaggccgcgtcgaagtcgggcgcggagccgccgttgagcagcgccagcagcgcgtccacctgcgccaggccgcaggtctcgtccagcgcgacggtcaccgtcgcgccgtccagcttccgcaggttgatgcacgcctcatgccccgccctcaccagcgcgtcggcgtcggggacggcgatgcgcacggtgtcgaagaaggggtcggcgcccacctccaggcccaggcggcgcgcgcccgccgccagcacgccggccagcccggccacgcgctgcgcgatcctggcgatgccctcgggaccgtggtacacgccgtacatggcggagatgttggccagcagggcctgcgcggtgcagatgttgctggtggccttgtcgcggcggatgtgctgctcccgcgtctgcatggccatgcgcagggccggggtgccggtggagtcgcggctgacgccgatgatgcggccggggagcacgcgcttgtactcctcgcggcaggccaggaaggcggcgtgcggaccgccaaagcccatgggcacgccgaagcgctgggcgctgcccagcgccacgtcggcgccccactccccgggcggggccagcgccgccagggccagcaggtcggtggcgaccaccaccttggtccccgcagccttggccgcggcggccagctcggcgtagtcgcgcaccgagccgtcggtggcggggtactgcagcagcacgccgcaggtggtgtcgtcaaaggcaaaccctgtctcgtcgcccacctccacctccaggcccaggcccttggcgcgggtctgcaccaccgcaatggtctgcgggtggcagcgctcggagacgaggaagcgcggcttcttgccgcgcgccagcgcgctgcacattgccatggcctcggccgcggcagtgccctcgtcgagcaggctggcgttggccagggggagggcggtgaggtcggagaccatggtctggaagaccagcagcgcctccagccgcccctgcgcgatctctgcctggtagggcgtgtactgggtgtaccacccggggttctccaggatgttgcgcaggatgacggggggggtgatggtgccgtagtaccccatgccgatgtgggaggaggccaccttgttctgctccgccagagccctgggcgattgggaaaggggggctgtgttgaatcgggggagcttggaggagagagggtgggggccacgtattaa

SEQ ID NO: 1546 - DNA, 1677 bp, Chlorella protothecoides
  modified_base (1083)..(1092): a, c, t, g, unknown or other
atgccgattaacatccaacgtcaaggcctccccgcaccccacactcccgcagtccactatgtgggtcgattagtggagggcgatgccgtgttcatggacacgcggtcggaggggcagggcgaaccggtcaagctcgtcgctggcaggggtgagcatggggcagaggaagtgggcattggtagccatgaaatacaccgcgcaggcgtcaccatggttgccttgctcaccacatggcacccatcccttagcccagtcaacactgcaagggagacgggcctgaacctggcggttgcgaccatggtgccgggcgagctggcaaggatagaggtggcgccacggtatggatttggcgtcgccggatccttcagcttcccgaccgtgccgccccatgccggtctagtgtacgagctggagcttctggactatgaggaggtggatgaggtacgaggcggattctgcttggtccctcatggcatgcggctgcaaaggcccatgcccattccggcagtttccccttcccttgttcaggatgccagggtggggtccatgctgtttgaggaccggctggaggcggcggagcggcgccgagccgagggcaacgctctcttcaaagccggcgacggcgagatggcgctgcgcaggtaccacctggcgttgtcctacctagatgccgacctactcatgcagctggagggccggcacctcgacgccgcccaggccatccgcgcgcccaccctgtccaatgtggccgccgtgctgctgagtcagcgcgactgggcggcggcggcggccgccgccggcgaggcgctggcgctgggggtggaggccgcccggccgaagctgctgtaccgccgaggcctggcgcgtagggcactgggtcaaaccgacgcggcggtggaggacctgcacgaagcggcgaggctggcgccgggcgacggcctggtgcggcgggagctggcagaggcgaaacgggagcagcgtgagggcatgaagcttcgtgtggtgccagcaaagtacatgggtatctctgttgaagaatcttcatccatgacaaagtacatgtacccctcggcacgccttacnnnnnnnnnnccagcaaagtacatgggaacgagcgtctggagcccggctgtttggtggggtgctggggaggccccaggcgcctgtcggactggccccacccagccaatgcagacccgcacatcctgcggcggcccccacacctcacctgctgcaagctgcatgggcctgggtgctggcatgctggttggggctctgggcactgtgtgtgcgctgggcagcccggtatacccggaaaaggcacgccgtgtaacgccagccagtggagccggatcccggaggatcaggccctggattgcgtggccagggcggatttcgcctcggcgcgccctgagtcagcccggcaggggtcgtcacgcgcgggtctgccctccggataagttccatgcgcggcgctggcctcctcaaatcagtcggaataaatctactaggtcatcagccatggggcgcagccgatccctctcccgcctggtggccctgctgaggggccctgccctggcagggagtgccacggggggtgccctacccctgcaaggcgtgcagcgatgcgccggatctacctccatgttcacaggtgggatgcatccatgcttgtag

SEQ ID NO: 1547 - DNA, 1545 bp, Chlorella protothecoides
  modified_base (1154)..(1163): a, c, t, g, unknown or other
  modified_base (1243)..(1252): a, c, t, g, unknown or other
  modified_base (1389)..(1398): a, c, t, g, unknown or other
atgaacttcacaacgccaccatcatcggtgatgacgtgcttctctaagggaccggagggtgggtccgtgttcatcgtggcagtggaggggtgtcctgcgaaaggagtccgctccacgtggttgtgcatgtcccagcggcgagatcgatcaggcgaagcacattggccgtggctggtccaagaagaagctggaaactgctgcgtcttgggcccgaggacacggacccctcatgaagatcttgatcttggttgcggtcatgaccgcactcctagcccaggcgtttgccgattcccggcgcctgctggccaaggaacctgcagcggaggacaaaagcaattcatgttgccaggatctggccgccattgggttttcgagcaacctgccggtggtggtgctggacacgggcggcaagaacatcacgaacaagggtggggacgtgaaggtgcgggcctgcacgtgcagcgatggcgccggcttcaaggaatacaatggcaccggcgtggcgtccgtgcatggatccagcagtgcactcttcgacaaaaagtgagtacggatccggattggcacatgaaagccggaatgtgccgaaaccgtgtggtgggtgtcggcagcaccgattacgcttggtccttcacgctgcgactgacacacaagaatggcaccaagaacagtgcttccttcctcggcatgcccaagggcaacgagtgggtgttgtacggcggggacgaggtggacctgaccgacggcatgagggactacgtggcctacaacctggctcgtgcatcgggcgagtacgccacccgcaccgtctggatcgaggtgtttctggtggttgagggtagacccatcgccccttccgactaccatggcatctacatcggcgaggagcacataggacgggtacactttaatattgtcgtccatacctttcatgccgctcctcccccaccatgccatcgccagggaaaagatcgtgtcaatgtgaccaagtggaccaccgccgacccgtctggcggctacatcttcgccttcgacaacaacaactacggcccgacagacctcctgacagagaccctgcccggctacgacttcccatttgtcatcaagtgcgtgctgacaaggggtacatggggtggcagcctgactgcgcaaannnnnnnnnntatcttcgccttcgacaacaacaactatgggccgacggacctcctgacggagaccctgcccggctacgacttcccatttnnnnnnnnnncgctgccgcctgctttggctctatctgctgggtttccagggcttgggggaggtgacccccagcttgacagcgctgtacacatatcaaagcgaaagcgtggagcaagccttctctattcccctccacacactcacacnnnnnnnnnnggctgccgcttgatttggctctatccgctgggttttcagggcttttgggaggtgacccccagcttgacagcgctgtacacgtatcaaagcgaaagcatggagcaaccccttctctattcccctccacacactcacacgcacctctag

SEQ ID NO: 1548 - DNA, 480 bp, Chlorella protothecoides
  modified_base (245)..(293): a, c, t, g, unknown or other
  modified_base (444)..(453): a, c, t, g, unknown or other
atgaagatctccctccccaaaacatcacagtctcctgcaccgccatgcactgccactcgcccaaccaagtctcctcaccccttgccaccgagcagaggctccacctacatgcacaaggacgtcgaccagcccctcgccatgggtcctgcctgggactacaacgaggcctttggcgaatgctgcggcttcccctttgagggctacgaggagaatgggaagagcgagcctggtgcgatggggtggtnnnnnnnnnnnnnnnnnnnnnnnnnnnnnnnnnnnnnnnnnnnnnnnnngtgtgcaaaccagtcgacagccagccccatccttgctgggcctgccggtgtgttttccagacccgagagttccgcattctctcagagttgctggcaccaacaatggaaggcaccttcagcaagcatgtccctcctctacttgcaggtgtgnnnnnnnnnnagggggggttgcgggcctgggggctga

SEQ ID NO: 1549 - DNA, 360 bp, Chlorella protothecoides
atgcctaaggagaatgactgggtgctgtatggtggggacgaggtggatctgaccctgggaatgagaaactacctggcctacaacatggcaagggccactggagagtacgcttccaggactgtctggttcgagctcttcctggtggaggatggtgcccccctgaccctggagaactacaacggcatctacattggagaggagaagatcaagcgggacaatgaccgtgtggacatcggcaagtggacggcagagaaccccacgggcggctacctttttgcctttgagaacgacaacatcaagcccgacgacacccctgtgggacctattcccggcatggaggacccctttgtgctcaggtag

SEQ ID NO: 1550 - DNA, 504 bp, Chlorella protothecoides
atggctgaaggcgagaagctgagcaagaagcagctggcccaggagaccacgctgcgtaagctgcgccagcagaaccgcgagctgagcggccaggtggaggacctgggcgccaggctgggcgccgcgcagcaggccgcctccgaggccggggccagggtggaaagcgcgctcgccgagctggcggcgcagcgggagcagcacgccgcccagctggcggcggaccgcgccacgcacgcccaggcgctgcaggaggcccacgcagcccaggacccggcgatcgcggaggcccgaggggcggcagcggagcaaagggcggccgacgccgcgaggaccggggcggtgcagcagctgcggggcagcgagacccgtgcggccgccctggagaagagcctggcggagcttagggccgaggccgaggcccaggtgtgcgcgtgtgtggtctggctgtgcgttgcgtcgagtgggaagcgaggcgacgtgtggacggagggtggagaagtgtga

SEQ ID NO: 1551 - DNA, 240 bp, Chlorella protothecoides
atgatcccttcccccccggaaatccccaggatcgtgcacaacgatctgaagacctccaacatcctcctggacgactacggcagcgccaagatcaccgacgtcggcctcgcccgcatgctgcctgccaccttcacagacccactgtacaatcggcagcgcgaaggtctcgccctttgggcgttggtgggctgcccgctactctgtttacttcatggatttgcgtcgaggttgggcatctga

SEQ ID NO: 1552 - DNA, 1911 bp, Chlorella protothecoides
atggggtactacggcaccatcaccccccccgtcatcctgcgcaacatcctggagaaccccgggtggtacacccagtacacgccctaccaggcagagatcgcgcaggggcggctggaggcgctgctggtcttccagaccatggtctccgacctcaccgccctccccctggccaacgccagcctgctcgacgagggcactgccgcggccgaggccatggcaatgtgcagcgcgctggcgcgcggcaagaagccgcgcttcctcgtctccgagcgctgccacccgcagaccattgcggtggtgcagacccgcgccaagggcctgggcctggaggtggaggtgggcgacgagacagggtttgcctttgacgacaccacctgcggcgtgctgctgcagtaccccgccaccgacggctcggtgcgcgactacgccgagctggccgccgcggccaaggctgcggggaccaaggtggtggtcgccaccgacctgctggccctggcggcgctggccccgcccggggagtggggcgccgacgtggcgctgggcagcgcccagcgcttcggcgtgcccatgggctttggcggtccgcacgccgccttcctggcctgccgcgaggagtacaagcgcgtgctccccggccgcatcatcggcgtcagccgcgactccaccggcaccccggccctgcgcatggccatgcagacgcgggagcagcacatccgccgcgacaaggccaccagcaacatctgcaccgcgcaggccctgctggccaacatctccgccatgtacggcgtgtaccacggtcccgagggcatcgccaggatcgcgcagcgcgtggccgggctggccggcgtgctggcggcgggcgcgcgccgcctgggcctggaggtgggcgccgaccccttcttcgacaccgtgcgcatcgccgtccccgacgccgacgcgctggtgagggcggggcatgaggcgtgcatcaacctgcggaagctggacggcgcgacggtgaccgtcgcgctggacgagacctgcggcctggcgcaggtggacgcgctgctggcgctgctcaacggcggctccgcgcccgacttcgacgcggcctcgctggccgccgacgcctccaccggcatcggcggcgcggcgcggtccagcccctacatgcagcaccccatcttcaacagctaccatacggagcacgagatgctgcgctacctgaagcggctggagaaccgagacctgtccctggcccactccatgatacccctgggctcctgcaccatgaagctgaatgccaccagcgagatgctgcccatcacctgggacgagctggcggcgctgcaccccttcgcccccgcctcccagaccgcgggctacgccgccatgttcgaggcgctggcccagcagctggcggagatcaccgggttcgacgcggtgtcgctgcagcccaactccggggccagcggcgagtacgcggggctggccaccatctgcgcctaccacgcggcgcgcggcgacgcgcaccgccgcgtctgcctgatccctgtgtcggcgcacgggaccaaccccgcctcggccgccatgtgcggcctgcgcatcgtgccggtgggcgtggacaagcaggggaacgtggacatcgaggagctgcgcgccaaggccaaggagcacgagaaggagctggccgcgctgatgatcacctacccctccacccacggcatctacgagaacggcatcgacgaggtgtgcgacatcatccacgccgcgggcgggcaggtgtacatggacggcgccaacatgaacgcgcaggtgggactgaccgcgccggggctcatcggcgccgatgtgtgccatctgaacctgcacaagaccttctgcatcccgcacgggggcggcgggcctggtgggtcggggtcggttgtttga

SEQ ID NO: 1553 - DNA, 303 bp, Chlorella protothecoides
atgctggtggagcgcatcaacacgagacgaaagcccagagggatcgataccaatgatccttgcactactttccgtcatccgcccacaggggtcgttctctgggagctggtgacgtccgagatccccaagcgggggaagatgcgacccatcagggtaccggaggagtgcccggaagcggtggtgaacctcatggaggcctgctggtcggccgagcccaaaagccggcccagggcggaggaggcggttcgcatcctgagctccctgtatgagacgccggagggcgctggcgcacgctcatcttga

SEQ ID NO: 1554 - DNA, 318 bp, Chlorella protothecoides
atggcgcacatggccagcgtgattgagcggctgactcagcggaatgaggagctggcgctcaaggccgcggcagtctcgcagcaggacgtggaagagctggagagggatttctcggcgcgcctggccgcggcagagaggaaggcctacgccctcaccaaggagcgggacatgctgcgccgcagctgtgagcagaccaccgccctgcaggacaagctcaaggagaaggacgagatgatccaggaggttagctgctgctggcgagctgtccagcaacctgtattcttctgggcggcgaaggaaccctgcgcaagtgcctga

SEQ ID NO: 1555 - DNA, 324 bp, Chlorella protothecoides
atggccgcagagctgggcgaattcgtgagcctggttgggggcccggagcacgcccaggtgctgctgctgccgctggagacactggccaccgtggacgagacggtggtgcgcgacagggcggccgagtcgctcatcgctgtggcctcagccatgcccgtccccgcactcgtggagtttttcgtgccagctctgcaggtgaggcatgtttgggctgggcaggaatggggcttccccaggggtggcctgctccctgcagggagtcccaccttgctgaggagacatgtggggtgcactctcaccgcttacagatggggtgcaaattga

SEQ ID NO: 1556 - DNA, 441 bp, Chlorella protothecoides
  modified_base (269)..(278): a, c, t, g, unknown or other
atgctgccgacagtggtggagagggccaaggggcactgcttgccctggccaacccaccaaggatgtatgggtgccgatcaacccccaccccccattcacccatttccccgctttcccccctttgggccaatccgcacaggatcgggtgcccaacgtgcgattcaacgccgcgcagctgctcgagcggctggcggggctggtggatccccccgttgtcgaccaggtgatcaagcccgtcctggcggagctggcggcagacagggacgcgnnnnnnnnnntgcgcagctgctcgagcggctggcggggctcgtggatccccccgtcgtcgaccaggtgatcaagcccgttctggcggagctggcggcagacagggacgcggacgtgcggttcttcgcaacgcacgcgctggcagcctgcgacgacctggcggccatggcctga

SEQ ID NO: 1557 - DNA, 2043 bp, Chlorella protothecoides
  modified_base (191)..(293): a, c, t, g, unknown or other
  modified_base (372)..(381): a, c, t, g, unknown or other
  modified_base (1055)..(1064): a, c, t, g, unknown or other
  modified_base (1118)..(1152): a, c, t, g, unknown or other
atgatgctgagccacaatgtgcagtcctggcactgtcgcgatggggatattgctgaggatgtgcaacttgggattgagtgtgacaaagaggctcatccaactccggaggaggcaggatctcgtcgagacgctggccccgctacacaatccaacgggccaggggggaagtggcgatcgacctgtggatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactctatgacatcctcttccagaatgagcgatgcaggagcccaaggacctgacaccgcatcgccgtgcgaagaaccnnnnnnnnnngcacggtacacaatccaatgggttagggggaagtggcgatcgacctgtggatctccgatgggacggaccagaagatcctggatcggcacggcttgcaggcatacccttgaagatttaaactctatggcatcctcttccagaatgagcgatgcaggtgcccaagaacctgacaccgcatcgccgtgcgaagaaccgggcagtgccggctcggttgcagatcacatccagttccgcattgtgtacggcaggaatagcaagtcggtctccaggtccccgcagcacacagtcagagagctaaaacgggagatagaagagcacacaggtgtcgtcgttccaaatcagaagcttctatgcaagacccaactccgtgatcaccagactctctccgaggctggcgtaaaacaaggctccaagatcatggtgctggccatccggcctcagagcagcccagcgacgccccagactgccgaggggagcacagaacacgcgtgggatccgacccctgccgctgaggttctggagtcgggtcgaccggagggtggctgggtcggcatcgcagaccggcaggtccctctggatgacaatcaggcattcatcccggccctcctcacacaggccagggtcaaggtgcgtgggcatggggtcctgcgaggagggcctgcttcaagggctcnnnnnnnnnncttcgccgcaggtcctggagtccggtcgaccggagggtggctgggtcggcatcnnnnnnnnnnnnnnnnnnnnnnnnnnnnnnnnnnntgcataagattttgccgagggcgccctccctccccacctgtcagaagcacccctctaatgctcatggcccaagacattccaccccggttgccaggtgcggctgacgttcaagcccgagctgcagcaggtgtggctcgggtcggaccacagcacccaaaaggtcccctacagcagtgtgcgtggcatcatttcccagcccatccctgcctcgcctggctactccatcctgtgcctctctttgggctccgggagcagccagctgtggctctattgggtaccctcgcaggctgtgtcaggcatcaagctgagggtgctgggggtgcaatccctattatgacaggacgagttcttgtggcaaatatgcagcgttccaagaacagcgcattgttggcaaaggtctcaaaagagggtggatctgcaagcacatctccagccactccagcttgggtctgcgctagttcagccaagcagacggcacggatgcctggcgccttcgtggtctccatgcagctccgacatcacttctgcgccgcagccgacgccgtgagctccgcatcgcgcttccccaggccccccatgcccgtgacgaggaccaggataatccccaggggcagcatgccctcagcccatggcgccagcatcgggcagttgcccgaagggtgttcccacgggtccgctcgtcgacaggtttgtcttgccaggcaagcacccaaggagttggagcgcccggttggaccagatgatgagctcgataatcctctccagagcctcctgcggctcgtatcgggggggctgtgggagagacgggtttgggcatgggtgatgctcacagtggtagtaccctctgcaaggcgatggtaccgcgaaggtcccttcctcaccaaagaatga

SEQ ID NO: 1558 - DNA, 702 bp, Chlorella protothecoides
atgccaggatgcgacgaagtcacactcacaccatgtgaaggccgagcggggtgctttgtctcgagagaaaatggtatggcatggtcctggatgtggacctctgcagcggggcactcaggcagccactcccaccttgctgtacttttccaccaggctcttcagcttgtccttggacgcgccgatcaactcgtccaccttctccccggactggaagacctggaaggtcggcatggcggtgatgcccagggcttgggcaacctcttccacctggtccacgtccagcttcacgaacacgacgtcgtcatagttggaggacagctcctggaagtagggggagatgaggcggcagggcccgcaccatgtggcgaagaagtcgacgatgacctggaggagggaggtcaggggggatgtgtggggaggcagaggggaaacctgagacgcgcaggtagctcacgggcccagacgaggcctccacctccccttgatgagggcctgaacgacagccaagacccagccacatcacccaaagagtattaccgccgattcagtccctttcgaatgctcaccgccttgccggagttcttggcctcgttgagcacctggtcgcccgaggtatacgaaaacatagcaggcgatccagaagactccaagcacccacctgccatgttgcgatttgatgagaagattccagtgattgcgtga

SEQ ID NO: 1559 - DNA, 777 bp, Chlorella protothecoides
atgcctggcgacagcagcgtgaaactgaggcatgttttggcgccttcgatgtccggagggaggctatccgatggatcactgctcgccagctggtcggcggtccggatcgaccggagcagaattctcgcggcaggacagagtaggggggttcggcctcagtcatacattttggctcgtacgcactcgccagcgagggaactcgcccatactgaccctccaattctcttcgtagagtacgtatcagcgatggcacctcagggacatgtcgcttcgccggccctgccacagggctccaatagtgcccgccagtgtatttccggggtgtgcatgctcgcagttgtcctcctgttggcggtcgccccagttcaggcattcagaaccctgaacacagtcgtccccgtcaacaacaaggcccagtgggacttcgtgctggctgactccatggccaaaaaccagacggtgcgtgcggggctggagcctgctgttgagacaccactcgcgcacgctccccaccgccaggtcatcgcggagtttggggccgtgtggtgcggcccctgcacagccctccgctcctgggtccaacagatgtccgacaagtacaacgacctgaacttcgtggcagtggacgtggacaacgctaaggaggtggccaagcagtacgacatcatcgcgatgcccacattcatcgtcctgcaggacaccagcgagaaggaacgtgctctcggggccatcaagtcgaggctcgaggccatgtttcacaagtacagcaagtactga

SEQ ID NO: 1560 - DNA, 192 bp, Chlorella protothecoides
atgtccgacaagtacaacgacctgcacttcgtggcagtggacgtggacgacgtcaaggaggtggccaagcagtacaacatcatcacgatgcccacattcatcgtcctgcaggacacccgcgagaaggaacgtgcttccggggctatcaagtcgaggctcgaggccttgtttcacaagtacagcaaatattga

SEQ ID NO: 1561 - DNA, 354 bp, Chlorella protothecoides
atggcaggcggaaaggtcgtggtcgtaaacagcaaagctgagtgggaccaggtgctcaacgaggccaagaactccggcaaggcggtcatcgtcgacttcttcgccacatggtgcgggccctgccgcctcatctccccctacttccaggagctgtcctccaactatgacgacgtcgtgttcgtgaagctggacgtggaccaggtggaagaggttgcccaagccctgggcatcaccgccatgccgaccttccaggtcttccagtccggggagaaggtggacgagttgatcggcgcgtccaaggacaagctgaagagcctggtggaaaagtacagcaaggtgggagtggctgcctga

SEQ ID NO: 1562 - DNA, 540 bp, Chlorella protothecoides
atgtccaatcccccagccccccaacccatccccccactgccccaggcggccaccatcgagcacctgctccccgtcttcctcagcttgctcaaggacgagtgggccgaggcgcggctgaacatcatcggcaagctggaccaggtcaaccaggtcatcggcgtggacctgctggcacagagtttgctgcccgccatcaaggagctggcagaggtacgagggtgtgttgctgcgagtggtggggggactgcagggggtgcatgggcgtgccctcgcgtgaggaggaggagtgatcagcatggggaaggtagtgaggcgccgcgtggcaacatggcgcactcatcgatgcggcgaggcagagcccgcccacggcaaggtccctgcctgctcaggcgcctgcatgggatgtccacgcttgggctgcaaatgctcagaggccagcgctgcatcagccacggagcacagcgatgcctgtgcctccgcggggccgccaccggccagccagcctgggcacgctgccaccatgcccacccagctccctga

SEQ ID NO: 1563 - DNA, 474 bp, Chlorella protothecoides
atggcagctcaggcccagggcctgactgcctgccgaggctgtatggccaccctgcaccgcccagcccgctcaagtatccagaacccctctcgacgacctccgccaccctttctgcagcgcctggccggcaaggagtggacagcccgcgtctcggccacgcgcctcttcacccccacctatgcgcggtgcccgccggagcaccgccccgacctgcttcgcgcattcctcgccctgaccaaggacgagacgccgatggtgcgtcgcgcggcggcccaggccctgggagactttgcgcaggtggtggaaccggagcccctcagcgccgagctgctccccgccttcctccaactcacccgcgacggtgagagctctgggatgctggcaggggagaagtcatgccttgggggtcggccatacgcgccagggagcggtaggggtacgagggagtgcgcggctgcgtgccaggctgggtga

SEQ ID NO: 1564 - DNA, 495 bp, Chlorella protothecoides
atgcggcgtggcggtgttcctgggctgtcctgccagagtccagggtcacctccaccgccggcaagtacccctgcctgtccctgcatcgtctccatcgccgcgccccatgctctctccctccccacctcgcaggacaagtcgtggcgcgtgcggtacaacgtggcgcagcagctccctgccctggccgaggtgctggggggcgaggcgacgcgcgccgagctgctccccgcctttgtccgcctgctccgcgatggcgaggcggaggcgcgcgccgcggcggccgcccgcgtcgcgaccgtggcgcgcctgctccccgcgcaagaagtgctggaccagctgctgccgccggtgaaggagctggcgggggacggcaaccagtacgtccgcgctgccctggcctccgtggtcctggagctcgcgcccgtcgtcggcaaggcgagtggagacatacccctgggaggcggggagtgcagcgacgtgtcggtgcccatgtag

SEQ ID NO: 1565 - DNA, 1206 bp, Chlorella protothecoides
atgccacgcgcctgccctcgtcaggactccctgccgtcgtccagatatcacgcagtcaccgaatcagcgccgacgcacctccatcccagcaacctttgtccaccccccccgcccccacatccacacccgccaggctcggtggccctggccgagaactacccgcgcacagatgcctgggtggtgcgccggctcaaagccgcgggcgccatcgtcttcggcaaggccaacatgggcgagttcgcgctgttcccctccttcaccctgggctccctggcggggttcacgcgcaacccttaccacctgcaccacagccctgcggggtcgagcggcggcagcgcggccgccgtctccgccaacctcgcgctggcggcgctgggcaccgacacggggaacagtgtgcgcgggcccgccagccatgccggggtcgtgggtctgcgccccagcatcggcctggtggggcgcagcggcgtggtgcccctgcgcctggatcgcgacgcggtgggccccctcacccgcaccgtggccgacgccgcggctctgctgggggccatggccgggctcgaccctggcgacgaggccagcgtgcacgagctgggggggccggcgccggcgcacgccccgccggcagactacacccgcttcctgcggggcgccagcctggcggggtcgcgtatcggcgtgctgcgctccatcctcgacctccccggcaccgacgtccagatccgggccatgttcaacggcgcgctctacaccatgcaggcggcgggtgagacgattgttgtgctggttgggagagggggagcggggggaacgcggctctccagcgtgccgcgccgcgtgccctggcgttcctcgttcctgtcatggtcctccctggcaccaaaaacactcccaggatctcacctcctccccgccccctgcgacaggcgccatgctggtcgacaacttcaccatcgcgaacaacagcctgggggagccctggagcgcaaaccgggatggccagggtcccgctctggggcactggaacgtggacggagagtggtcggacctgtgggcctgcaactcccccttcaggtgagggctggccatgggtgtgagggaagggaggtacggctgactggcgaggggtcgctgccgcgcagctgtcctcgcagcagcctgcctggcgtggctcagcactcgccgtcagatgtccgtcagccgtag

SEQ ID NO: 1566 - DNA, 486 bp, Chlorella protothecoides
atgccgggcgtacactgcagcctggccctggccctcctgctccatgctgccgccgcccagactcagatgccgccctctggcatcctgtacccgcccgattccacaggcccagccgtggtcaccgtgtcgcagctggaacgagggatgtgcccgcccgctctgggttcgacggcccacccccctgtcctggagctcagcatcgcgggggcccggaccgccatgctggccggcaggttcacctgcacgcagctggtgcagacctacctggaccgcatccgggtgtacgacgctcccctgggcctgaactcggtcagggcggtggatgtggagcaggccctggcagctgccgcgactgccgatgcccagctggctgccgcgatcgcccagggcaatgacagcagcctggcaccgctcttctgcacccccatgctgctcaaggacaatttcgacgtggtgggcctggccaccaccgcaggtggggggtga

SEQ ID NO: 1567 - DNA, 471 bp, Chlorella protothecoides
atggactacggcagcacctgccacatctcgggccggccatacaccgtgttccggtggcgccccgggaacgacgcccggtacaagaagaccatcatctgccaggaggtggccaaggccaagaatgtgtgccagtgctgcctgctggacctggactacaacctccccgtgcaagtccgggacgaggccctgggcatgcaggccgaccagctccccgccagcgacgcgggcaaggagtatgccctgcagcgcatgtcggacgcgggagagctggaccactccaagtttgacacccccactgcaccggagctcctggtcaagctgcagcgcaccaccccctactacaaggaccccgactgcaggcattgcaaaggggcgggcaagggggctgagaagtgctgtgcaccttgcgtgcttggaccggtgcaggcatcagctgggctcgcagaccaagcagcccggggctctttttga

SEQ ID NO: 1568 - DNA, 651 bp, Chlorella protothecoides
atgtgcaagcgtggcgcggagtgcccctaccgccacgagatgcccattgagggcccgctgtccaagcagaacattaaggaccggtactacggcgtaaacgaccccgtggcggagaagatgctgggccgtgccgcggagatgcagaagctgaccccgcccgaggacacgagcatcgccacgctcttcgtcggcggcctgggacccgagcattccgaggccgacctgcgcgacattttctacacccacggcgagcttaagtcggtgaagaagctggagagcaagggcgtggccttcgtgaccttcaccacgcggcagggggccgaggcggcggccgaggcgctgagcaaccggctgatcatcaagggccagaggtgcaagctgctgtgggggcgcccacagccgggcagggcggcgggcgggccgccgcctgccccgggtggaggcggtggcgcgggagccggcttcccgacggggacggggcccgcggccgcctacccctccatggaccccacccaggcgggcacgaggggggagggcgggcccgccggcaagcggccggcccagggggcccaaggcggcgacgacgcccagaagcggccgagagtccctgtgccgccgccgggggccccccctcccatcgtgaccgcatga

SEQ ID NO: 1569 - DNA, 207 bp, Chlorella protothecoides
atggagaaatcctctcacccaccccgtctcgccccggctgcagccctgggactgccggcgggcatcaccttcctggcccgcccctttgacgagggcacgctgctcgcaatggcgcacgcctacgagcaggccagccagctgcgagccccgcccatgctcttccccgactgcactggagggagcgtgctcagccagacagctgggtag

SEQ ID NO: 1570 - DNA, 570 bp, Chlorella protothecoides
  modified_base (224)..(297): a, c, t, g, unknown or other
cctgtccccgatgcagccccgaaacccgcggtgacgccggtccgggccgccctggcgagcctgaaggagaatgtgccaagaaaaagccccgtgccgcgcgttccggccgccgcctggggcccggatgccgccggctcgcaccagagattccgggaggcgctgcgcaccctgaagactgcggcggagggcgctgcttctcaggcatgcgaggctggccagtctcnnnnnnnnnnnnnnnnnnnnnnnnnnnnnnnnnnnnnnnnnnnnnnnnnnnnnnnnnnnnnnnnnnnnnnnnnnaggcagcctgccgtgcacgtcttctgcgtggagcgcagcggcagggggggcgcgttctaccgctccttcgcggcggcttcctaccccgccgtgtggcagcagtatcaccagacgcccgcgctccagcggcactggtatgaggtgcgcgcacccaggactggggagggagggttgctgcacaggatctgggcgagcagcgtgaggatggtgggggagaggacatatcactgctggtgcctggcctcaatcaatcagcccctcccagctgcgtga

SEQ ID NO: 1571 - DNA, 663 bp, Chlorella protothecoides
atgggcctctatgactcgcggctgaacgcgcgctttgctctgagcagcatccagatgcagacgctgcgactcgtaggggcggcggggacccagggtgcgctccagagcgagctggcggcgacggtgggctcagagaaccgcaacttcttctatgtcatacggaatctggagcagcgagggctcgtcacaaagcgaccggcggtggtggcgacgccccgcaccaacaattacttcagcaaccacatccagaccaatgtggtccatctccagcgctttgcacccgacctgggaagagacactcgcttgttgtctcaccatggcaggcctcctgaccctctacacccccaggatgcacagtatcagcaaagccaggtggagccgccagctggccaagcaggtgctggcagggaggccaaccctaccactccggcctccacccttggggcagtcgacgacggggcctacttctctgccatttccaccaagcttgcagagctgcctgacagcactgctgtcgagagcgaactcaaggtggcgcttggatttgtgggaacgagaggccacaggctgtggcgccgcctcaagggtgcgctcgtcaaaaaggggtgcctggaggagtttatcggccagtccggctctaaacctgtcaagtgcatcaggtaa

SEQ ID NO: 1572 - DNA, 414 bp, Chlorella protothecoides
atgaccgccgccccctggctgacgcacgacgggcgcctgaacgcgaccctctggagggccctggcagccagagcagtcgaggctgtggccgccagacctggtgaggcatgggggagacgcaacctgccaccctcctccccaggcattccgtaccgagaactggtgagcaagttcctcatcgttggcgagccctctgcggaggcgctgatagacgccctctgcttccatggcgtcctggcactcgagggggcaaaaggtgtgacgtcgcccacctctgtcctggggtcgtgtttttctgcacacgtcaaggagcacggtgccgacgtcccgggagaggcagagagatatgtcgtgctgcccgaggggtggttggggagactgaatgccgcgaggccatcgctaatgactgcttag

SEQ ID NO: 1573 - DNA, 918 bp, Chlorella protothecoides
atgaccagcagctcggcctgcgccagcttggcggcgtgctgcggctggatgtactgcaccgtctggcggtcgtcaaggcccttgaagatgaactcgaacagggtgcgcaggttctcggggctgggggcggtgacgaagatgttgctgtaccccagcgccagcgcgccggcgatggccaggcccagggacgcggactgggagcggtggatgggtgggcaggtgggtgtggggtggactgagggtatgctgagggcgctacagggaccatgtcatgctgttcgtctctccctcattgggacactagtatccagcaacaatgcaaggccatgctgcaggttcagccgcaggccggccaaggcaacgcagctccacaccggctggaattccctgcccccaacaagacccatagcagggacccacgcagagtccagaccctccgcggcgcgcctcggcaacacaccttcccgcgccctcgggcggccgtcagcgccaccgtggaacgcagcgtcttctcgctggcggcgtccaggaaggtcgcgacggcccgcgcctggtccagcgtgcggcaccggcccaccagcgccccggccggctgggtgtcggccaggctctccaccagatcccggagctccgaggttcccgccgcctcggcgcccaccgacgcggacaaggggtggatgttttgcacctgagggggcgatgtgtgaggggaccagggtgtccggaggcatgatcttgccagcaggcagctctgctgtcgaggatgatcaagcacggctgcacctgccacgcaacgcggtgcctggtccaggcccccacttggatgttgagctcatcgtccatgaggatgcaattggggcaggatgccaggctcagcaccaggcgctcattaaagcggcctgcagaagggagggatag

SEQ ID NO: 1574 - DNA, 537 bp, Chlorella protothecoides
atgcgcagcgttaccagccaggcttcgggtcccactgggggcattgggttcagatgccaagactccacccctttcagaccatgcctccccattaccaccccccacacgccccctcacccacccacccttcacttcctggtggctctcggtcctcagccgggagtggacgtccatggtcagggagtacagctggctcagcgactccagcgtggacagcaggagcacgatgcagcccccgccctccaccgtctccaccgtccgcgcgagcaggttggggatcagggcctcaaagtcctgaaggaccagcatgccgtatgtgtttcccagcaccttgtgcgtctcagagtagtagcaataccggatgttggtggaggcctgagtggggagggggggtcagtggggagcggccatgagggggggaagcgggggtttactgttccaggcaggcctgggaggagccttgggggcagtggctgcatgggtcacctccagccatccctagcgcatctcacatcccactacaagccttcttactga

SEQ ID NO: 1575 - DNA, 534 bp, Chlorella protothecoides
atggaggtgctcatggcccgcatcgacacggaccgcgacggcgggctgcagctctcggagttcgtggccagcctggtggactggggcgtcgtccagcgccaccacgcctggcaggactgggtgcgtgccgtgttcgaccgcctcgataaggacggcaacggcttcatcaccctggatgagatcgcggaggagctcggtgactacaagggcaaggaaggtgggtgggtgatagtgtgggttgaatttgggcatcgtctgttctttgtacctgggaagggtggcctgaagggggattgctgtggtggggtcaacacaatgctggagcctctcgtttgtggagaggaaatgcagtgtcagggctggctgtgtgtcattgccaatcaggagcaagcatcagtctcaacgcccgtccatggacctccatcaggagcatcacactccaccacgttgcctgactcccacccaatccccgttttgtatcgtccgctttgcagacagcctgattgccgccaggcgcatgctccgggaagctga

SEQ ID NO: 1576 - DNA, 2004 bp, Chlorella protothecoides
atgctgggacaatgtggctcatatcgcacctccacatcgccaggaaagcatgggcagcagctgcatgaggacagtcgactcccgatgacgtgcatgggagttgcggggcccattcaggcaggcccatgcagcccggcctgccggtctagtgtgcaaccgagaagctgtcgacatggtggtcgaccagcctccgggccccaatataacacggctttcgtgacccagcgggtccctcgaaagtgcatggcggtccatgcgaagccaagcgccgcgacgccctctgtcgatagccctcttgtaaagacccagcttcgcactgggcccaaccaccctccgagtgaatacaaggacacctggatggacagggtaatcctagggatcataaatcatcggatggacgaggaattgggagccctcaatcctccaggcgatagagagagaaacaacacattccagggattcctagaccgagccgaaagcatcactcgtgggaggtctgtggaggagcagcgcaggtttgtggccaaggtccttggaggtctggtccagcctgggatgggagtactcctccgtcggcatcttcccctgaacaaggtgctgcaatggtgggggacagcttgcatgccggggtgctgcggtgctgagcaaaaccgtatgtttgggtcagcttgcgccaaccaggtttctgtttgcatgtcatcgctacaacagatccctgatgctcctcctcctcctcgcgcacagttggtggctgaatccatggctctcgttgcgtccacctgctttggcggccttgttggccacacacagcggcaacaggtacgctgtctgcttgggtgtggctttgttggcagagcttgcatggccgtcgccaaaatcaacatgcgctgcctcaaagctgtggtgggcacctggcggcaatatcatgccattatttgtttctcccaggtgaaagtctcaagcaaagggaagacccacgagtggaagagtgccgttcagattgaaaagtgtcgcttccttgaaggcagtggctgtgttggaatgtgtgtctctctgtgcaaggtgagcagcttggggactcggtgtttgcggggggaaagaaggcagctcttgcaaggttgttcccagaaaactgacgcaggatgtccactccagacgatacttgggtcaattgcacctggccatctacttcagctcattggaatgctgctgctcgtccctctcacatcgcagatgcctacacagacatttttcctagaaactgtgggcttacccctgacactggaacccaactttgaaggcaagcgcaacctatcatgcaccatgacttttggtaaggttccccttccagagcatctggaccctgtgcaccaacagccatgtcttcacatgaataagctcagcccaagtggagtgagtcgggtggtggcatactgtcaattgcgttgtgactgttgtctggaagctgttgaactaccttcaatgggttacctattgaaggcggaacatccatgccgattgctggagtgtctatgcgacagttttccaactcatgtgactgcttctgcagagtgttcagacatacccttgattctgcttaaagatttcatgaacaagagccctgctgcaggcttgtgggccatggccacatgccactgtttccctaccagacctgggcgtctaattatacatagtcatcgctgctgccgctaccatggagcgagtccagggtcgacaggtcttcgtccacgacgtcatgggcatatcgcttcagcctcgagtcgtactgcagggatgtgtgtaggagcacaccttcttgatcatccagtcacggacgcagagcaagggagaacagagaagcggtgcagcaccaccctctctcatgccttccgcccacctgattcaagtcgtcgtctgtcgcctccaggagctccacaaactcagaccaagagacctgaagaggcaggggtgggatttgcaaagtattatcgtgccaggtcttga

SEQ ID NO: 1577 - DNA, 414 bp, Chlorella protothecoides
atgcagtcgaccataccccttcagagtggcactctgcacccgcgacaccccctgccctacccccgggcctgccaggtgacgttcatgcatggagatgccatgcagccaggatcatgcatgaattgggccgaggccagtggccctgccctgcttgagtcgctgcgatctctgaggcttacgtcgcccttaaacccgcagggatgtgctgctcagctgccccctctagactggtcccggctccaaaggcggaggatcccgggagttgcctccaggctggtggtccgctgtgctcgcaccgactacaccgccaaggccggggatgtggaggtgctgaaaaagcccctgaagtctgagctcaagccctccgaactcgtcacggtcttcggcttcccccgggactttgacacgcagtga

SEQ ID NO: 1578 - DNA, 654 bp, Chlorella protothecoides
atgggggacatgctgggggcggggtcctttggcgtggtgcggcaggcgacggaaaaccagactggcaaccagtacgcggtgaagagcatcatgaagatccccaagaatggccgcccgacgccaaggtacctgatcaagctgcagacggaggtggatgccatgcgtcagctgggtgccagcctggacgctgtgcacctcaaggggctgcctgcctgcctgcgccccaccagaggtttgcaagataagatatgcactgcggcgccccgtctccgttcctctcacaagccgcaccgcacaaatgacaccttctccaaacaggatgtatttgaggatgagctcagcatccacctggtgatggagctgtgtgagggagggtccgtgcttgatgggctgcagcagggggactacagcgagcgccaggtgagggttgggcagggcttagagtgcgtgtgggagcattcctgcatgatgcctttgctccccaggtgcacagggaaggctccatgtcttgttttgctgtctggcaagacgccatatctccaaaatcctcaggtccagcacatcatgaggagcgtgatgagattcctggcccagagccactccaagggcatcatctaccgtgacgtcaagccagacaatgtgggtgctttttag

SEQ ID NO: 1579 - DNA, 621 bp, Chlorella protothecoides
atgcgtctggccaggcggcatctgctgccgtctgccgcccgtcgttttgcctggtcggctgggtgccttgcgcagagcggccccccttcctcaccatgcagccaccgcaagaagcgcatgcgccagatccagaagatgtcccagcgtggtctgcttgaccccgagaaggaagaccctttctccctctttgtggcctccaccaacatccggtattgctactactctgagacgcacaaggtgctgggaaacacatacggcatgctggtccttcaggactttgaggccctgatccccaacctgctcgcgcggacggtggagacggtggagggcgggggctgcatcgtgctcctgctgtccacgctggagtcgctgagccagctgtactccctgaccatggacgtccactcccggctgaggaccgagagccaccaggaagtgaagggtgggtgggtgagggggcgtgtggggggtggtaatggggaggcatggtctgaaaggggtggagtcttggcatctgaacccaatgcccccagtgggacccgaagcctggctggtaacgctgcgcatggccgctgccacatgggcatcaccctacgacccctgctatacaacatagtttga

SEQ ID NO: 1580 - DNA, 879 bp, Chlorella protothecoides
cgccgccgcctcggcgccgcgccgcgcggcgtccctctccgagcggcgaggcaggttggggtcgggggcgtggcgcgggcaggacgcgccgcacgtggtggccgacgccgaggagggcggccgcgcggtgggcacgccagactacctggccccggagctgctgctgggcacggggcacggcgcggaggtggactggtggagcttgggcgtcatcctgtacgagatggtggtggggcggccgccctttgccgccaacacgcccgaggccatcttccagaacgtgctggacggtgccgtggcctggccggagcgcgggcctggggagggggaggaggaggacgacggggaggaggaggaggaggaggagggtgaggaggaggaggaggctgacgacgacgaagaggctgacgacgacgaagaggctggcgacgacgaagaggctgacgagtacgaagaggctggcgacgaagaagaggctgaccgcgatggccctacagcacaggggcctgcaggcaccccccacacacacgcatcccgaaagccccgcaaggagcgtccgcaccccagccaggcgtgccgcgacctcatcctgggcctgctgacgctggacccgcggcggcggctgggccggcgcggcgcgggcgaggtcaagctgcacccctggttcgcaggcgtggactggccctcgctggcacggcgcaaggcggccttcgtccccgccaccgactgcgacaccgacacctcctacttctcctcgcgccccgtgtcccagctgtcgctgtccctggacgtgccgccctcggaggccggcgacgcgccgggtagcccgggctggggccctgcgcgctcgcgcccggggtcacgcgccgcctcgacgcg

SEQ ID NO: 1581 - DNA, 1125 bp, Chlorella protothecoides
  modified_base (524)..(533): a, c, t, g, unknown or other
atggccgcagaaaatcacagtctgtcacgcgatacatgcggccaggcacacagtgatgcgctgaacattcagtttccatgttgtctcgcgtgcattacccttgctcatgcaaacatgctggtcgcggccagcgctcatgagggccacggaggtcgtagcaccacctcacaaccaggagttcgaggtgcgtcatgccgccgccacagcgtcgcctccacgacgtcactgcgctggattccccgagagactgtccgtatcggcgcaccacgacgtaggggcttcccccggcgctgcgctgtgctgggatcaggggatgcgcagcccagcaggggggtgattatcctgcctggcctgggcaacaattcgacggactacggggccctcgtgcacctcctgcggcaaaggaacttgcatgtggaagtggcacccatgtcccgcctggactgccaatggagctttcaacggccattatttgcctgggtcttcctcattccaggtcctccccctggggcctgtgcactccnnnnnnnnnncgtgcatggagccaatggagctttcaacggtcattacttgcctgggtcttcctcgttccaggtccttcccctggggcctgtgcactcggccaagaccaagccatccccctgcttgtcacgcaaccccacccaccaccccacccacccccaccacggacaccccagggcccgtaacgcggcggggctgcgccaggccgcttactggaagggcacgctcaacccccgccccacggtggactggtacctggaccgcgtgagccatgcggcggaggcggcgctgcgcgcgctgggcggcgaggcgccgctcaccctgctggcgcactccgccggcggctggctggggcgcgtgtatctgggtgcgcgcccgcccgcagcgcgtcgcgtggacgcgtacgtgagcctgggctcgccccaggccccgcccccggacggcacctttgaccagacccggggtatcctgcgcgccgtggaggaggcctaccctggcgcccacgagcctggcgtcgcctacaccacggtggccggacgctacgcgtgcggcgcgccgctcgctggcccgggcggcgcgcgcgcgcgcctgctgggcctggcc

SEQ ID NO: 1582 - DNA, 909 bp, Chlorella protothecoides
  modified_base (538)..(547): a, c, t, g, unknown or other
atgtgggagggcgggcccacgctggcccccgacgcggtcagcttcaacaccgcgctcaaggcctgcaccaacgcgggcgagctggaccgcgcgctggaggtgttcaaggagatggggtcgcgcggggtgcggcccaacatcaccaccttcaactgcctcatcgccgccgcggccgaggcgggggcggcggggacgctgcaggaggtggggcgctggctggaggtcgccgaccgcgacgtgaagggtgcctgcatgaacacctttgtcgccgcgctcgtcaaggtggaaaggaggggtgtggggttggagggggaaggaagggggcgatggaggggaggggaagtggatggcagagggcagtggaagcttgcgccctctgctccccctctgactccctcgcccctcaccctcaatgcaccccccctggcagctgggccactgcgaggagccgcagtcgccgctgggcacaccctggctgggcagcgtggggactcccaagcacggcacccaccctggccctaccacggccctgcacgtnnnnnnnnnntgacatggcccacaacagcagtggaagcttttaccctctgctccccctctgactcccttgcccctcatcctcaatgcacccccccttgcagctgggccactgtgaggagccgcagtcgccgctgggcacaccctggctgggcagcgtggggactcccaagcacggcacccaccccggccctaccacggcccgtgcccggttgccctgtaatgcgtgaggggtcccacctgggaagagcgcgctgtcgaaccacatgccctcgccccaatggtccccaccctaccagacctcttccatctccccccaccaccccacccaccaccccgcgggctccccccggctcccatcactcctcgcagtga

SEQ ID NO: 1583 - DNA, 765 bp, Chlorella protothecoides
cggagtataaagccgaaggacattgaccaaccatcacaaaatcctcccgatcccgaagtcttcaatctccccacacaccaaaaactctgcaatcatgtctggacgcggaaagggaaagacctccggcagcaaggccgtgagcaagtcctccaaggcgggcctgcagttccccgtcgggcgtatcgcccgctacctgaagaacggccgctacgctgagcgcatcggtgccggtgcccccgtgtacctggcagctgtcctggagtacctggcggccgaggtgctcgagctggccggcaacgccgctcgcgacaacaagaagacccgcatcgtgccccgccacatccagctggcggtccgcaacgacgaggagctgtccaagctgctcgccggcgtgaccatcgccgagggcggggtgctccccaacatccagtcggtgctcctgcccaagaagaccggcaagaaggacgagtaaatcgtctcctccaccacacaatccacctggtgttattcaacaccacctctcttggaaagaaggcaaaccttgtgctgtgctctacaaggaagaattcttgggtctgggaatctagatgcaaagaatgttcaatggtatgcctgcacatcaggaaggctgcaaggcctggtccggaactgtgtcattcgacttttcagaatagccatgcaaagtggctcctgtgctctcggccgggactgggattccccctaagtccaaggtgtggaaggaagccaccaccagttgctgcctga

SEQ ID NO: 1584 - DNA, 729 bp, Chlorella protothecoides
atgacctcaaggtggtggccctgccgccccatcggccacggcagagggaggatcacccccccgaggtctacatgggcacggaggtgtgacggggtcggtgcggaggcaggagctggtactcctgggtctctgtcgtgccctgcgctgcgttctcctcccttccgatgctccagtgcagatggtcaggccggcccccaaccgttcacctctgcccccgcaccccagggctacctggctcgcctggagcagctgctggtggaggccctggatgccgggcggcccgtgctggtgggcacggccaccgtggagcagtcggaggcgctgtacggccgcctctcccgcctgctggagtcggagtttggcgggctggggtccaagggtcccaccctgaacctcttgaacgcccgccctgagagcgtccgaagggaggcccagatcatcgcccaggccggactgcccggcacggtgagctggcggggggagggtcggcgggtgggagatttttggtggaaagggaggcggcggcgcgagctgccggcgtgtgtgtctctgccctgtgccccgatgaaccccagcgtctcactccacgccgccccccctcaaaacgcagatcaccatcgccaccaacatggcggggaggggaaccgacatcctgctggggggcaacgccaaggggctgacgcagcagacgctggagcgctacttcctcccgcacctcgcccgaggtga

SEQ ID NO: 1585 - DNA, 912 bp, Chlorella protothecoides
  modified_base (210)..(219): a, c, t, g, unknown or other
atgcgcgccatctcccagaccctctgtcgcctacaacggggttcgagaggtgctccggcccaaggctgcatacaccgtgcgagagctggcactgccagccttagcatgacccaggaccccatcaagctcgtcttggtgggtgatgttcatggtgactgggacgaggacaggtgcgcacaaggagctcatgcatggcgggaccgattgtcnnnnnnnnnncccagccttagcatgacccagaaccccatcaagcttgtcttggtgggtgatgttcatggcgactgggacgaggacagtgcgacggccgcgcgccacctggaaccggatgccgtcctcttcctcggcgactttgggaacgaggatgtggcgctggtgaggtccctggcggcgctggaccttccaaaggccttcatcctcggcaatcacgatgccatgtgcgggggaggaggggaaaggaggggagaaggggagctgagttttggagtgatgtgtcagctggcttcgcggggaggatccccgcgtgatacagccaacgctgcctggtatgagttgcaacgctatgagcttgctgcagcatgcaggtcagcgcgccccaaagcaagtccccaagccctcgagcgcaggttctcgctcagcgggaggggcaaagagtactacgtcaagaggattttgcagaagagcacgctggggccgttctgcagtgaccccgggtccggcgcctcgcctaacgtggccctccagctggaggctctggggtccatgcacttggggtacgcatccgccaccatggccgatggcaggttgagcgtcgtgggtgagtgcagcggcaggggagggtctgtctggggtcaacacctcagcagagctttgggtggcattcgaatctggctgtggcgcaggtgctcatgctga

SEQ ID NO: 1586 - DNA, 1566 bp, Chlorella protothecoides
  modified_base (600)..(609): a, c, t, g, unknown or other
  modified_base (726)..(735): a, c, t, g, unknown or other
atgacgagctcccaccaccccccaaccgacctgccctcggttctcgtgactgacttgacttacaaagccggcttcggtccagtactattagagaatataaatctcgacctgccgcccggcagccgctgcctcctgtgcggcgccaatggggccggtgagtgcgccaagggcctcaaatctctcagggaatgcgccttcatggctcggacgcgagggactggtggcgacctgggattgctttggacaagtgctggcgggcaagcacatggtcccgccatctgcggtccagattctgggccgccccgccttccacgacctctctctggtgaccacgggggacctcggctacctgggcacccagtggcgcagcggggcggggacgcccggcggcggccagcccctgaagggaaacttaagcgcccgcacactgatctacgggcgccgccgggtgcagatcgccatgggcctgctgctgccctacaaggtgctgagctgggtgtaaatgaggggtgggtgggttggcgtgcatctatgctgggagacacatggtggagtgtgccatctgtacgtttccaaactgaccagcattactccttactnnnnnnnnnncttcaagcaggtcggtgggcagcggggctgaggtcactgccatgctccttgggatggggtctgtgtggaacgggaaggctggcagactgtggatgcgagctgcggcaggtccgactnnnnnnnnnnggagacacatggtggagtgtgccatctgtatttttccaagctgaccagcgtcactccttttccccagctgtgccctgcctcatctctttgttgtttcttagtcctcctcacaccccaacatgccaaccatcaaaggtgctgctgctggatgagatcaccgtggacatggacgtcctcggtcggctggacctcctgcacttcttcaagcaggtcggtgggcagcggggctggggtcactgccatgttccttgtgatggggtctgtgtagactgggaaggctcgcagactgtggatgggagctgcggcaggtccaacctattcaagctgaggcccacagctatcgatgggttgttcgcacctgtcaaggaccccagatcccatcctcagcctcgagcgtcaccaaaagggcgaggactcccccggtcaagaaccctcacaccggtgcccagtttgcaagttctccaacccttttgcaagttctcagaccctgtcagccataaggcaggcccccgtccccccccgcaggagtgcgaggagaggggtgccagcatcgtgtatgccacccacatttttgatgggctggagggttggcccacccacctggcctacatggagggcggcaaggtggtcaaggggggcctctgggccggcatccacgagctggagggcgggcagaggctgctcgccacggtcgagcagtggctgctgaaggagaagaaagagcggagggcggccatggcggcaggcggctgcaagcaggacgcactgaccacggccgccaagcagccggcacccatgatgcccagccggcacatggcctacttccgctag

SEQ ID NO: 1587 - DNA, 1077 bp, Chlorella protothecoides
  modified_base (490)..(499): a, c, t, g, unknown or other
atgcggcttaagcgcctacatgcagtgcttggaggctcagaagggcatgcacacctcagcgtacaccgggctgttcgcgtcgttgcgcacatccacggcagccacacaagcgcgagccactggccgagacatgacaagtacgtttgtttacggctttggaaaagttgcagcattgtgccggtccgaggtgcctctccctcccattctcctgagagggttcgtcctgctgagattcagctcttggctcccctcctttcccataggttcgagacggtcgcttttcatccaggtagagaagacgcccaaccccaccagcatgatgttcttgcctggcaagcccgtgttggaggtgaggtcctgggaagagtcatagtgctcgctggcagggaacatctggcagggcatcgctcatgcccttggttacgcacaggtactggcgattccgtgatatcatctattaccgtgccccgtctgactccttcacagagtnnnnnnnnnnctgctcgctggcagggagcatctggctgggcatcgctcatgcccttggtgacgcacaggtactggcgattccgtgataccatcgggcaccgtgccccgtctgactccttcacagagtggcacgcaaggcttcctgacggcgcgcgagagcatggcctccccgctcgcaaaagccctcttccagatcgatggggtgcagcagcaggtgtgggggttgctccactggctgcatgtgacagggcccagacatggaggatctggtggtcgacgtacccgtcgccaggcttgcataccaaagttgggcgctgtcaggacctgcctgctgccgacaccccaccctccccaccacccctccaggttttcttcggcaccaactttgtcacggtgaccaagaccgacacctacccctgggcggtgctgaagcccgacatctttgctgccatcaccgacttctactcctctggcaagccagtgctgctcgagggcggcgctgtggagaacctggacaacgtcatcaacgacgacgatgacgaggtgctggtcgggatgcatgcacagagggtgggaggagacccctga

SEQ ID NO: 1588 - DNA, 285 bp, Chlorella protothecoides
atgatcaaggagctcttggagacccgcatccgcccggcggtgcaggaggatgggggggatgtctcctacaagggtttcgaccccgactctggcatcgtgaccctgaagatgctgggcgcgtgcagcggctgcccctcctccgccatcacgctgaagaacgggattgagaacatgatgtcgcactacgtcccggaggtgaagggggtggtggaggcgccggcagacgagtcggagcaagctgggcttgccgcattcaacgagctggagaagcacttgtccaattga

SEQ ID NO: 1589 - DNA, 414 bp, Chlorella protothecoides
atggaggaggggctggacccaggtgggcctccctgccagtgttcatgtccatgccgagctcatgactacccatcgcgagccgtcgcctcccctcacgcagtcggcgccagagagccccagggtgagcctccagggcctgtcccgcggggagcgccgcgtcccctcgagccggcgctgcgtgagctcacggacgaggagctggcggggacaacgtccaggctgcgcgtccgccttgccggcggggagaccttgaaggcgctcctgcccgaagcctacgctgccgtgagggaggcggcgcgccgtgtcctgggcatgaggcactatgatgtgcagatggttttcatggccaatatggcagggcacctgttggctgcagggcctctgcagctcgggcttgacagcctggccacttga

SEQ ID NO: 1590 - DNA, 759 bp, Chlorella protothecoides
atggccgactttgagctggcagactacgagccacacaagaagatcgccatggacatggcgtgcgcctgcctgccgcccacccaaggccccaagccgcacgccgtgcagacatgggtgcctgcgcaaggggctctcgcgcactgctgccttggagtggtcatgctgaggccagtctctgcgtcctcgagccctgggctgcgcttggctcaaagcatctcctgcccggtcctgtccggcgacgtgacctctcagatgcctctcaccgagaccggcacccctgcccctggccctgcatcttgtcctgccctacatctcaccacactctgtgatcacgcacgccaacttgggcttgttgttctgccccgcggtctgcaccgcctccagcttgcgcacagtcagcatgctctccgccagcacccgcccaaatacgacgtgcttgtcgtccagccactctgcaaggagtcggcttggtttgagagagcggggtgccggacaccgagcctcccctgccctgccaggccccccacctgtcttggcgacggtgatgaagaactggctgccattggtccctggcccagagttggccatggagagcaggccaggacccatgtgtcgccccgtgaagttctcgtcctcgaagcggctgccgtagatgctgagggaaccggtgccgtcgcccttgaggaagtcgccgccctggagcatgaagcccttgatgatctgggtgcatgccgaaggggttggaggggtttggcgtag

SEQ ID NO: 1591 - DNA, 696 bp, Chlorella protothecoides
atggggtggggcccccgaagtgcatggcggccctcacgggtgccatgcgctccccacctcgcatgccgtgccgccggtggcgtgaggggaccatttcaggggcgattcggtgtctaccagcttgatgaccgggacattcaagaggtgatgggctaccggacggggttgagcctcctcgcggcagcagatgccccatgggctggagtcctgcaggcaggcagcgatgtcgctgcagtgagcgccattgggggacttgccatgtccctctccctgatccacatctatgtggcgcccatcaagcgagccctgcaggccttggccgcagtgggggcagtgggggcagcctgggtgggtttgacccagggcggacccctgctacagaccctggagttgcacccgatctacctgctggcggtgggtccggccgcggccgcgctcactggcgtctgcttcaaggaggcgctctgctatggcaaggccgaggcagcggtgctgatgctgggcatccccgtcctctgcctcggacacctgaccggcttgctggcaggggggcttgagctggcggccgccgacatcgtggcaatcttcctggtgctctttgcggcgaggaagtggacccagcccgtgtctgatgacgtcggggacaagagcgttttcgagtacctggccaagcaggggaatggtgccgagttgtga

SEQ ID NO: 1592 - DNA, 192 bp, Chlorella protothecoides
atgactctcaccccacccttggtgcagctgggaggcatcgtcctgttcgagggctgtgtggctgagatgggcacgggcgagggcaagaccctcgtggcgaccctgccagcgtacctcgcctccctggaaggcctgggcgcgcacatcgtgacggtgaacgactacctggccaagcgcgatgcggagtggtga

SEQ ID NO: 1593 - DNA, 975 bp, Chlorella protothecoides
  modified_base (173)..(182): a, c, t, g, unknown or other
atgcagtatctcagcatgaatcctgtcacaccattgtctatcagtcagggatgtcagaactcctgcacatgtttgggagtggagcgcacactttgttcttcggtgtatcgtcaccaaactggtcagagtggaagtgccatggaacctccaaactcacaagctttgatcattcnnnnnnnnnntttgggagtggagcgcacactttgttcttcagtgtatcgtcaccaaactggtcaaagtggaagtgccatggaacctccaaacccacaagctttgatccagcaccgactggatgttggggagcacgccaccctcggcgatggtcacgccggcgagcagcttggacagctcctcgtcattgcggaccgccagctggatgtggcggggcacgatgcgggtcttcttgttgtcgcgagcggcgttgccggccagctcgagcacctcggccgccaggtactccaggacagctgccaggtacacgggggcaccggcaccgatgcgctctgcgtgcgtgtggtcaggcggatcggtgagaaagccgttgttaagggcgacagaccgatctcaggtcgcgctgaaaatgcggacatccggccatatcgggagccctccagaatcacagctacctgcataacgaccgttcttcaggtagcgagcaatgcgcccgacggggaactgcagaccagccttggaggacttgctcacggccttgctgccggaggtctttcccttgccgcgtccagacatgatgcagaatgtgttattctcgagagcgcgtctcctttcaaacaggtgcgatcacggtctggtgtagcgattcctaggcagttgatagaaacatatgtttcacagattgaggtcattctctccagacctgcaacccgcattcaagggaaggaggactcttacgatacgggcctggtttgcttccattttgggcagttatcggctgccaagcgccgtcctgtttactga

SEQ ID NO: 1594 - DNA, 798 bp, Chlorella protothecoides
  modified_base (667)..(676): a, c, t, g, unknown or other
atgtcgctgtcagcgttgcagatccgctatgcacccagggtgtcggggcttggggcatgtgagaagccatcaggccccagtgcacgcatgttgcagcacttctgggagctgcatgcaagacggccgatgcaccgggatgtgagatcgtatgcctccaacacagtgcagcttcgtctgccggatgacagcacggtgatgttggacgttccggagggctcctcgattctggaggtggccctggatgagggactggacatccctcacgactgtaaaatgggcgtctgcatgaattgcgccgcaaagctggtgcgtgaatgtctgatgtgggttcaagaagatctgactatggaagcaagacgattgtggaccattcacaggtgtgctccaggcaggatggtatctagacagtgttcgccccacatcctatcccaggaggagggagacgtcgatcaagaggcaggaatgctcagtgaagacgtccgttccaagggatatgcccttctatgtgtctcacaaccgcatggcaatgtcaaagttcgcatcatccccgaggtgcagtggctggcgagtctttggggcttgtttataggacacgtgttgaccttggcctttcagcgcaagccacccatctgtctcaaatgctttcatccacaggaagagctcctgnnnnnnnnnnttggcgagtctttgggcttgtttataggacacatgttgaccttggcctttgagcgcaagccacccatctgtcttaaatgctttcatccacaggaagagctcctggatgaagtcatgaactga

SEQ ID NO: 1595 - DNA, 768 bp, Chlorella protothecoides
atggggccccgtcgcaccacccttacctatagctcagaggatgcggcacccctgggcgacgcccaggtgttcgtttattactgcaagtacagcggcaagcacgtgctgacgacagactgcgacctgtccaaggcgccccgtcgccagacagaccatgccctggtgatcgacaccacacggcacacagtccgcctgtacaatacaacagacgccggggagaagctcctacgacggaggagtggtgccgtggagcgtcagctccgcatgcgcgtgggcaagctgccctttgcgtactggacggagccggagggcaagctcctgtacatcatggactcggcggtcacgacctacagcacggcggacgacccctccgggtccggggtcatcgtgccggtgcccccctgcatccgcgcgctggacgcggcggggggcgccacggccgtgaccctggaggttgacgaccgcgccagggccacgggcatcctgaaggtgtcggcggatgcggtgcggctgcagctgaagacctctatcatcgcggagggggcggcggaggagctcctggagtacctcaggagcatcctcggtgggtgcatggtggggagggtggaggggggtgatacgtcgcagccccaccggggccgggcccacggagggcctggcgctcggcgcccggcgcccgcccgctgcctgagcacaggtgcctgggtgcgcaggccccgccctgcgcacccccctcgccggcagcctgcttgtgagcgcgccgtgtga

SEQ ID NO: 1596 - DNA, 3861 bp, Chlorella protothecoides
  modified_base (154)..(163): a, c, t, g, unknown or other
  modified_base (2570)..(2579): a, c, t, g, unknown or other
atgccttcctgcacctcctgcccgggttcaggtgggtggtgcgtgggagaagacctgcgtgggggtgagatgaggagcaaaggtggctggccccagctggtgtgcccccctgacgtgccggcaggccttgcattgcctcctgccagccccgagnnnnnnnnnntgcacctcctgcccgggttcaggtgggtgggtgtgtgggagaagacctgcgtgggggtggaggtgaggagcaagggtgcctggccccagctggtgtgcccccccccgacgcgccggcaggccttgcattgcctcccgccagccccgaacccatgcattgcccgcactcgcaggcaagaggacatgtcccaggtcctgggctggcacttcgagcgtgtgggggcccgggaggaggtgactcccgctggtctcttcaccgtggccgcccgcttgattcaggtacgaggcggtgccatgtcatcctgggcaggagtgggtgctgcgccggccatcccgcactgtggtgaatgggtcccgcagcgctgggccgaagttggtcctcaggccggccccaagcacccccttccccagcaatttcatgagcgtacccctgccctccccggtgctgtaggaggggcatgtgcctctggctgcaatcatgagtcacctcaaccctgccgacgaggacctcacggacgcgcacgcggccgccgaggccgcgctgcggggccttcctgctgggcagtggggtgccatgtgctcaggccaggtgtcgttaaacgtgtggatcacatggccctgggccatgtgatccctcgcgggacggtcctcaccccctccatcggacttcctgggcaggcagggaaggcgcccgtcgggcagtttggcctgggcacgctccggctgagcgcctccggcttcgcggatgagtacggtgaggcgctgggcgccaacaaccagaagctccacttgctggcggggctgatcgcggcgggcgccgaggcccccgcccgcgagctgctcagctggctgcgctgcctgggcgtcgcccagcccgccgcctttcccgcggtgggcagagccctgtctgcgcgggctggatcgctgatcacccgggccctgggcgggttgagcgaggagggcggcgctgcgccggacgccctccccatgcagctccttgatacgctgcgcacgctgggcgtctacctgtaccgcgacgtcctggtgctgacccggctcatccgtctgctgggccggtgcctggccagcgggggcgagctcggcgcagagctgcagcagcaggcagggcggcgggtcgggattgggaggcacccaggcgcggggcacctgccccttgacgtggcggggcacgcgcctcggcctcccccctcgccatgcaagacgtggcattctccccctttcccatgtacacacaagcaagcgctcgcacaatttctgcaccctgcaggtcaacgacatcctgtcgggcgtggtgatgccggcctgcagcctggtgcccaccaacgtggccctggtggccgagctctgggctgtgctccagcgcttctcctacccgcagcgcttcaccctctacgcctcgctccagggagtgcagggtccacggcggcttctctccgccaaggcggtagtgtggaaacgaagcatccatggctcccacgtgcccgacccgcggcccacccctctcgattcccgcaggagctgatggcggggacccccctgctgatggccgccgcgaagctggcggagactgaggcgcgtcgcgtactgcgccgcgtcacggctcccagcagccacaaggaggccaaggcggccatgaagcccctgggccggcgcctggccaagctgacccacgccgtgccgctgcccatcgcggagcagctcatccgccagcaccccagccccccacccctttgtccaggtgatgggcatgccgggcatggtgctgaccgtggcagagagcctgaggctgtccacgcccatgaccttcgacgcgctgacctttgtcatcctgcgcaagctgtctgcggccaagcgcaagctcaagagcatggtggtggagtggtgatattggccatgccaacaccctgcctccctctccacaagcctgccttcccgccccgcacccgccaggaggacggcgtgaacatggaggaatggttccagtggctggcagcgttcacgggcatcatctgccgcaggtacccgagcatggagctgtctgcgctgctgcagtacctgaccaaccagctcaagtccactgagtcgctggacctcctggtgctcaaggagatcctcactgccatgacgggtgaccgtgtggcagggatatggaccccttcctcctgccctctgagcctctgcactccttgcattatgggaatcgaactcgtgaatgacgtctccgagcatcagctggacgcgctggcggggtccaaggcgctgcatgttgaggtcttcttccagggccagttcaggccatctcccaaggccctggccggtggtacccggcgcctgctggccgccctcaaggactctgaggtggggcaatactggctgagcgtggggcnnnnnnnnnnggcaatactggctgaggtctgggtctggattggggggttggcgggcaaacacttcccctttcgtcaggtggcaagggcgtcaaaactcgcccctcctgatggtcaagggatgactgcagcgtggggtgcggatggcagtgctggcctgcctccagtcacattgtggacgccaagcaatggccgcaacctcttgttctggcacaaggacacgacagacggagcgcaggaaaactctctgctgcgcccctcgcccgcctgcaagatcctcggtcaacccccctcactctctcccactggatcgctgcgcaggctactcgcacctcaagctggtggcggagctgtacgacagctgccaggagacgctgctgcagtacatcgacttcctgcagacggcccagaccccgacccagtacgccgccttgctgccatccatccaggtgggccagaaaatcggccccggtggagggcccggagggtgccgtgtccacctttcctcctggcgtcagagggactttcaccagggcgcggccccgcctctgaggaagtgcatcccggggccctgtccaaggggcggatccaatgtagcctggcccctcacctgtcccagcctcatcccctccaagtccctcctcatttccatctgcttggcccgcagagcatggtagatgactacctgatcgagccggaagtggtgttccagctggtgcgcccaatggtgaaggcagctgctgtccctccccgcgcggcattggcgccgtctgccgctgcgagcactgcggccggggaggagggggagctggaggaaggggaggccggcccgacggaggctggcccgatggaggcggacagcgccgcggaggagggcgcgctgccagtcgcaaacggcgcgctgccagtcgcaaacggcgcgctgccagtcgcaaacggcgcggccgccggcgtcggtggcaccctggccggcatcctgccggaggtggagcggctgatggcgagccaggccacgttcagggccctctctccgctcctgtatgccgtcttctggacccgcaccctggacgagctggagctgccacgcgacagggggcccggaagcggctcataccgttcgggagggtcggcgcgggtgtcggtgcgaccgactttctgcctcgcaatgcttgcaagggtgcagcgacctgtgcttgggtcgcgtgggtcaggctgcacaggggagtgtccgtcggggcaatggtacttcttcgatgctggctccagctcctgcatctgcgagcggggtgacggg

SEQ ID NO: 1597 - DNA, 819 bp, Chlorella protothecoides
  modified_base (281)..(290): a, c, t, g, unknown or other
atgacgggtgagggcgagttcctggaggaggtggggctggtcgtctcacgagatgcttggcgccgaaaggagattcggaccaacaccaagcacgtctaccaacagcgcaagtgggtgtcgcggggctgctgccaggggatgacgtcttgggattggtggggtcagggcggagcgtccaaccctggttggggtgtccctcttgatttcacaggcctgcgagcacggcctgggacccatatggcatgcatgcgtggcaccccgcttttcccctctgtctactnnnnnnnnnntcagggcggagcgtccaaccctggttggggcgtccctctcaacttcacaggcctacgagcacgggcctggacccatgcgccattcatgcatggcaccccgctttccccctctctctacatcatttcattgccgcagccctcccctgtgatgaccggtatgcccctacccattcctgtccgccgtcatcaaagcaaagtctgcccgctgcccaggtacaacctgctgcgggaggagagcgagggctgggcgaagctcgtgacgctgctgaaccagtccggggcggggaaggtcaccgaggcaaatgcgggcgccgtggtgagtgttagggtcaggggtcgcatgctgcctgcattgccagcaccccatgccagggtgtgctccacaacaggccccacaccaggccagacccatgggctccggatccagtcacagctgctgcgatcctcagccacccaaaaaggtatccccaggcctcagctccccctgccttaccagcatgccatccccctttgcagcttgaggagctga

SEQ ID NO: 1598 - DNA, 1278 bp, Chlorella protothecoides
atggtctcagccacatcgctggccaccacctgcatcgaagcggacatcttaaagactcacacggttccaaagtggatgatggagcctcacgggcgtgcatctatggcaccgcaggcagctcaccgagccatcgttgaggcccttcaccaaagcagccgtgacgagcgactcccccatcctgggtctttgcacacaggccggcgtgctgttagtaagtcctttgcagaagcgatcggcgttacaagagcaggaggctcctgtttaaaaattgatgaattcccaaacgatctgaagatcacagcccattctcagagaagtgccattgatcggatgttgcagccccgagaggaggatggtctggcgccacgccgtcctctccccgagaggaggatggtctggcgccacgccgtcccctgtacttggcaggatgaaccgacggcagctcgttgtacctcggagctaggcaaacaaggtcgtgccaccacatgcgatgctggagcatcttcctgccctgaactcccagcgcatcattctggcatctgcatctcccagaaggcgggagttgctgcagcagataggcctcaaattccaggtactgaggcacatctggtcaatgctgggtggcattgtcccccagcctctcatgttccatcccctccctcaaagcaggtggtggagagtggcttcgaggaaaatctgccaaagacatcggctggagagtatgcacagcgcacagctttgcacaaggctctggacgtcgcccgcagcatgcatggcaagtttgacctcatcatcgcggcagacacagttgtgcaggttggcgatcgcattctcgagaagccaaatgatgacgagcatgccgctgagatgcttgagtccctgtcaggaaggcggcaccaggtgtgcaccggtgtcgtcctcctgacccaacacggtgagcccaccagctttgtggagatgacggacgtgttcttcgcgagtctgacgaccgcaggcatcgaggcatacatcgcgacaggtgaggcacacaggtgcatgtacggagatgtcgatgcgatcacacagccatgcatccaacgtgcccgaacatccggcgcgcaggggagagtcgtggaaaagccggggcttacgggatccagggagcagccgcatgtttcgtggaacggatcgagggatgctacaataacgttgtcggatttcctatctttgcgttttccaaggctgtcgcccgtcttgtgggtaagaagaagctgggataaccaacgaatcgaccgttag

SEQ ID NO: 1599 - DNA, 252 bp, Chlorella protothecoides
atgggggagtcgctcgtcacggctgctttggtgaagggcctcaacgatggctcggtggtggccagcgatgtggctgagaccattccaggagtgacgcaggagctcgcctgtggcttcctgatggatttgctagagcaggtggtcttgggtcagctggagcctggaaagctggacactgcactggctgcagcaggcctaacaaagcacaaggctgccagtctaccactcatgatcgccgatgctgtctggtga

SEQ ID NO: 1600 - DNA, 684 bp, Chlorella protothecoides
gggtgccgccgccgacgccacgcgcgcggtgctctccggcgcggccgatgcggggctggccatcgtgcgcccccccgggcaccacgcggagagtggcaccgcccagggcttctgcttcctgaacagcgcggcagtggccgcggcggcggcgcgcgccgccggcgccgcacgggttctcatcctcgactgggacgtgcaccatggcaacgggacgcaggagatcttcacggccgaccccagcgtgctgtacgcctccctgcaccgccacgagggcggccggttctaccccggcaccggcgcggcgacagacgtgggggtgggcccgggcgcgggtgccagcctcaacgtggcctggccgcgcggcggcctgactgacgccgactacgccatggcctttgccacggtgatcttacccgtcgcccgcgagttcgacccggacctcgtgatcatctcggccgggttcgacgccgcacagggcgaccccatcggcggctgccacctgaccccggggctgtttgcctccctcaccgcggccctgcaggccaccgtcgcgccctgcgtggcggtgctggagggcgggtacaacctgcgcgccaccgcggcatgcaccgaggcctgcgcgcgcgttctgctgggcgagcgggcgccgcggccgcgccgcggcgccggcgccagccccgcggc

SEQ ID NO: 1601 - DNA, 414 bp, Chlorella protothecoides
  modified_base (237)..(246): a, c, t, g, unknown or other
atgagttcctcggagcccaacaactcgggggcgctggacccctccagcctagctccacgcatcctccaggtggtgcagggggatggcacctttgacgagcctgctgtccaggcctacatgcactcctcgggagtagagtctaccggcatagactacaccgtcgtggccattatgggaccccagagctctggcaagagcacactgctgaatgcactggtgcgctgcagggtggggtgnnnnnnnnnnaccccagagctctggcaagagcacactgctcaatgcactggtgcgctgcagggtggtggtggtggggggggggttgacctggttgccgtacaggaggccctgcaaccttaccgctcccattgcatgcaatggggatgccatggcacccacgaaaggggtttgccatga

SEQ ID NO: 1602 - DNA, 981 bp, Chlorella protothecoides
atgccactgcacgctgcgcgccaggccctggtgactgccaagctcatgaccacgcgcgcacgcttcgatgaacaggatgtgtggagcagctttgagaccctggatgccgcaaagaaggtgggctggggtcttgcagtgcgcacgatgtatcccctgatgctggttgtgcagactggtgggtggttatggggcccagaccgacagccgcgtgcctccccagccagcctgcctctgatcaccgctggcggtgcactccctccaacgtcgagatcctcgccatcaaacacctggtgctgccatgcacccctgcaggttgtgaagctgaaggccttcagcaagtttgagaacacagcggatgccctccaggctgccgcgtccctggtggactctaaagcctgggccattgctaggggcccctcgcttccgaggcacacagaaactcaggcccacccctctccccacccacccctcccatcatcgccaggcctgaagaagttcctgaagaagcatgccggctccgacacgctggcggtgctggatgccaagctgggcaacgtgatcaaggagaagctggagatcccctgcgtgtactccacgggcgtgtcggagctgacgcgcggcgtgcgcaaccagctgggcggcctgctggcggggctgggccacgaggcggacctgcgccccatgtccctgggactgtcccactccctgtcccgctacaagctcaagttctcccccgacaaggtggacaccatgatcatccaggccatcggcctgctggacgacctggacaaggagctgaacacctacgccatgcgcgtgcgcgagtggtacggctggcacttcccggagatgaccaagatcgtgggcgacaacatcgcctacgccaagaccgtgaagctgatgggcacgcgcgagaaggccgccgacctcgacttctccgacttcctggaggaggaggtggagtccgccctcaaggaagca

SEQ ID NO: 1603 - DNA, 624 bp, Chlorella protothecoides
ctccaccgaccccccccttcctccccaccgccccagtccctgctggcagagatccggcagcgcgaccccaattacaatgccaataaggcacagtacctggactttatactggcctccggagtcacgcccctgatcgcggccacgcaacgtggaaatctgcagtgcgcggaagtggtgcgttcttgggggcgggctagtgtggcgatagttcttatgtgccttgacataaagagcctgtgttcaccgataatatatgagcgggggtcgtgtgttgcgatcaaaggacaagcccccccccccctgacctccttcatcacgcagttgatcgccgcaggcgccgatgtgcacatcgtgtgccccagcctggatgggaacagcgcactgcacgaggccgtgtcccgcaagcaagacagcttggtggaggtgctgctgcaggcaggggccaacccctgcgtcgagaatgccaagggtgggtgtcatggttttgggtggtggtcccgaggtattgggaagggtggcagaggagcaggtggcgtcatggtcgtggccaatcgttcacgcaggccgcacgctgtcgccccattcgttcaattgccagcacaacgaacctgtgctgggacctga

SEQ ID NO: 1604 - DNA, 474 bp, Chlorella protothecoides
atgctccaggtggtgcccgcgctgtccgggggcaagcagctgaagatgcggtacaagccggcgggcgagacgccgggggagcgcgagggcttggccgcgccgggcgattctgcgcgcgggccgctgtccgcgtcgcgccacctctggctgggcaacatcaaccagcgcccctccgaccaggccctggtggacctcttctcgccctatggccgcgtggactcggtgcgcgtcttccccctcaaggcctacgcctttgtcaactttggcgacatggccggcgcggccagcgccatggcggccctggacggcgtggtggtgcccgcgctgacaggcctcaaacccctggtcatgcgctaccagcaggagccgctggtgggcgccggggcgcgtgcgtcccccctccccggccccgccatctccgcgcccggcgctgacgccgggctgaagggcctgctggccgccggcgccgccgcc

SEQ ID NO: 1605 - DNA, 642 bp, Chlorella protothecoides
  modified_base (627)..(636): a, c, t, g, unknown or other
atgaattgttgcgctcaaggccgaggcagcattgtctgctgtgcacactctgtctcggtagagctgaattggctttgcggggagtggacgaggcagggtgatcccttcaccagcaacgatcctccacaccaccccatcgtccaggcatgcaaggttggcaagctctttgccaagcactttaagcaagcggagcaggaagctgtgttgtcgagcactgttatgcatgtggctgtgggaaccccaaaccgcctcatcaagctcatagaggcaggagctctgaagcttggcagactacgatatgtggtggtggatgtcgccatggatgccaaaaagagggtccagcttcccgacccacgatcggccccgtcctccctccgcagaacggtcctggacatggcggagacgaaatccgacttctggacgctgttcgcgagccatctgaaacccaagttcgagtctggagcacaatttgtgctgacgagctgcaaagtcgacaaggatgggccccagtggtctcacgctaacggcctcacgagcgggatggtcagtaccatgtcgggggacgatgccccacccccacatgcttacgtcaccagccagcatggagttgggaggggtgacaacatnnnnnnnnnnagctga

SEQ ID NO: 1606 - DNA, 405 bp, Chlorella protothecoides
atggcatggagacccgcccggtgcgcccatgcaggagtgccgtgggatggctgtggcccttctttcctggccaagctgtggtccattgctcgccgcccctcgccacccctccccaccaacccaaccccaaccctccttttgccccccgtcctccccggcccagggttccagttcagggagggagcgctgcacgtgctggacccaggccagctggcggcctcgcacggcctgtacgcggggaagagcgtggagcggctgccggcgctgaagggccggcccttcccgccggaggcccaggccgtcacgcgcatggcctggcacccaaacgccggggagaaatggggcaggctggccacggggtgctgggcggggatggtgcgcgtgcagaccatctaccgacgctga

SEQ ID NO: 1607 - DNA, 213 bp, Chlorella protothecoides
atgtggcaggcggcgctggacgccttcacccagatgcgcagcgagggctgctggcccgacgcggtgtcctactcgctgctgatcgcggcgctgcgccgcggcggcgcctgggcccccgccctgggcgcctacgagggcatgctgggcgccgggctgcgccccgacgccggcgtgctggccagcctgctgggcgcgctgtgcgcgggcgggctg

SEQ ID NO: 1608 - DNA, 714 bp, Chlorella protothecoides
atggcgaaggcgagtctgaaacccaaggcggcatccaagggcaaggcgaaggctcccttaccggcaaaagctcctgcagccaagcagcctgcaggggtaccaggtgcgtcgatcatcatgtggtggatggctccttgggtttcggccatgcccaaacatgtcgaggatgtcagtgctcccgttgcgcatggtgcacccccatgccttgccccatgtcctccactgtgcttcccaggtgtggagaagaagaagagcaagcggaggtaccatgggcccccagccccgcggcaggagaagaagcctcgtggacccgccccagtcaaccctcccggctcgaggcaggcacggaaggcggaggaggaggccgcccaggcaaccactgccaccatcgcgggcgcccctgccacgcagcaggcggactggttgtgggaccgataccgcgcggagtccggcgccagcgagctggagaggcaggggctgacggcggggtgctttgcgccggcccacccctcggagtggctggaagagagcctggccagcctgccggagcaggcggcgttcctggggaggggcgggcagcacgtgcccgtcggctcgcctgccgtcctcgtagtgacgggggcggccattcgagcggtgtccctcatacggcaaatgcctgccgtgaacaaggtgggcactttcgattgtctggggtgtgttgcggcaggctga

SEQ ID NO: 1609 - DNA, 951 bp, Chlorella protothecoides
atggagggcgtggaggcggggctggcctgcctggactcgcgcgccgtggcggccctgctcaaggagctggccaaggccggggcggggcaccgcgcgacggagctgttcgacgcgctgcgcgcgctgccccccggcgcgccgttggcccgcctggcggacctgtacacctacaccacggcggtgagccagtgcggcgcggggcagcagctgcggcgcgcgctggagctggtggcggagatgcgcgcgcggcgcgtggcctgcaacatccacacctactccgcgctcatgggagtgtgcgtgaagtgcggggagtgcgacctggccctggacgtgtaccgccaggcgctggacgaggggctggcccccaacgcggtcaccttcaacatcctggtggacgtgcacgggcgcgcggggcgctggcgcgaggccgccgccgtgctggacgcgttcgccggcgcggggctggccccggagtcacgcacgtacaacgcggtcattgcggtgtgcgcgcgcgcgggcgcgccggacgccgccggcgaggtgtacgcgcgcatgctggcggcgggggccgcgcccagctcgaccacctacacctccctcatctccgcctacggcaaggcggggcgggtggaggaggcgctggccgccgcgcgcggcatggccgcgcacggcctggagcccaacgtcatcaccttctcctccctggtctgcgcggcggagaaggcgcggcgcggggacctggccctcgccgttgttgccgacatgcgcgcgcgcgggtgccgtcccaacgtcgtcacctacaacgccctgctgggagcctgctgccagggtgggtcggcgtccacacccgcgtgcggctggggtgggcttggggctgtgcaagcgggggaggccaccgccactcccccccgcccccctccctggggcggccgcaccttccaccctccgtaa

SEQ ID NO: 1610 - DNA, 294 bp, Chlorella protothecoides
gacaacttgattcacaaggatgagttcttgtgggccttgttcaaagccaggcgggacagcctatttgctgacagggtgagatgtacagtcacctgcctaacatttgcaggggctgttcattgtgcctttgcaatatgcgtcaccatgtctcaggatcattatggtctcgcggtttttgaactcttcgacatcaaacagaatcaggtcttggactttgaggagtttgtctgctccctgagcgttttccaccctgacactcccctcgaagagaaggcctcatgtaagcctgggtag

SEQ ID NO: 1611 - DNA, 423 bp, Chlorella protothecoides
  modified_base (104)..(113): a, c, t, g, unknown or other
gctggacgaggcggacacgatgctggaccgtggtttcgggcccgaggtgcggcgcgtgctggcggcggtgcgtggcaagccccgccccgcgcgctgcgtgctgnnnnnnnnnncggtttcgggcctgaggtgcggcgcgtgctggccgcgggcgagggcctgcaccgcggcgtggcgggcgcgcgccacgtcttccaggcgttggagccggggacggacaagatggcggcgctggcggcgctggtggcgcgcgaggcggcgcgcgggcgccgggtcatggtcttcgccaacacgctggcctcctgccgcgccgcggagcacgctctggcggccgccgggctggacaccgcctgctaccatggcgacatgcccgccgcggcgcgcggcgagagcctgcgccgcttcggcggcgcgcgcaccggg

SEQ ID NO: 1612 - DNA, 441 bp, Chlorella protothecoides
atgggcatgttcctggcgcctgtcgtcggcacgctcatcaacggcgcagccaaccgtgtcagcatcggcacccaggtcatcatccgcgcggagctgaatgctgccatctacgccaaggccctgcgcctgagcaacagggcccgccagcagtctgacactggacgcatcgtcaatctgatgtctgcagacgtgaatcaattgcagactttcttctacccctacgtccagcagctggtcatggggcctgtcaccatcattgcggccctggtcctgctctggttccagattgggtgggccaccttcatcggtcttgccatcctcctggtttacactccgctcaccggcatctttgtggccaagctgtcgtcctgccgccgcgagatgctcaagttcactgacaaggcacgctgcattgatttttggggggaggggccaagttga

SEQ ID NO: 1613 - DNA, 1272 bp, Chlorella protothecoides
  modified_base (196)..(205): a, c, t, g, unknown or other
  modified_base (1168)..(1177): a, c, t, g, unknown or other
atgagtgtcttggcagcatgtcgtggagtgcgactgttgccggggggcctccgtcaaatctccacagcgacccggcgcggcacagcggcgcctgagcctgtgcctgcggcttcccccagtctcgacgacactgccagtttccgcgcggcggacattcgctacgagctgtccgctccaaatgccaagctcaacctannnnnnnnnncttcccccagtctcgtgagtgagactcgtcgttccgtatcaccctggcatcgggaaaatccggcccagaaggtccccagttctccaacagaccacccctggccttcggccctccgtatctaccaccgatcctgggcccgtccccgcccacaggacctcaagtttggggctgtgttcacggatcacatgttcttgaccgagcatgtggcaggccggggctggtcgacgcccacgatcggcccttttcagaccattgctgtccacccagcggcccctgtcctgcactacggcctctgctgcttcgagggcatgaaggcgtacgccggcgcggacggtcgcgctcgcctcttccggccagacatgaacatgaggcgtttggctcgctccgcggcccgcctccagctggcaccctttgacacccagggctggcgccctctccctcggtgctgttcccttcacattgatggcccgagggctcctaccatgcctggcgccctctccctcggtgcttttttcttcacattgatggcccgagggctcctatcatgttggatcgtagtactcaagggcacaggggagtgcagcccacttgagagagccaggaagatgagggcattgcctccttacctgccgaggggtcttatgtccacttccgctcacaggagctgctggagtgtctcaaggagctggtgcgcacagattccgcctggcttccaacacaggacggatactccatgtacatccggccatatgccttctccacctgtgagccggatgagaagaaagtggggggctcaggaatgggcaggtggccgggaacttccaaagcagtcttcagaaggccagagtcttgtgagctaccctgagcatgctctggaacctggccataccattcccggccatgtggcctcgcccatgctccgtgcgcccgctcgcattcctcgcccccgtcgctctcgtcgannnnnnnnnncacctgtgagccggatgagaagaaagtgggtggctcaggaatgggcaggtggccgggacttctacagcagtcttcagaaagccagggtcttgtga

SEQ ID NO: 1614 - DNA, 1776 bp, Chlorella protothecoides
  modified_base (623)..(632): a, c, t, g, unknown or other
  modified_base (1405)..(1470): a, c, t, g, unknown or other
atggcgatgtctgcctacatcatgaagcggcaggcaaatgcactaagttgggctcggctggtccagccagcagcagtggaggctgctagctgtgcatggcacccggcatgccctggccctgattccacctcggaacagaggcagccccctggagggcccgggccctggacggtggactctgggtcctttttgaggcgagcctacagcaagggcaggccacatgcacagcatggcagggcgcaggagcgcaggcagaagggcggcaccccgcatggggccgtgtcggtgcacatacgagactttgatcggcccacgcctgtggccccaagcaagcctgtgcaggctgcggagcccgccaagccatccctggtgcaggccctcaaggcggctggctggtcgcgacaggaggtcctgaacgtccccaacgccctctccatggccaggatggtctccggccccgccatcggctggtggatcgtgcagggtcaggtatggtgtggtgcgcattcgttactcagtccttggtgccgggacaattgccagccatcgcctgctcctttgcaggcccatgtgttctctatcctggtggttgcgggggccgaagggccctggctggatccctnnnnnnnnnnggttactcagtccctggtgctgggacaattgccagccatggcctgctcctttgcaggcccatgtgttcgctatcctggtggttccgggggccgaagggccctggctggatccctggccccaggcagggtctcttggcaggtctttccgccgtccccagaccccccatcggacatccccctcccgtccccctttccaatagtgggaccttgcggcgcctgccctggcggtgtccgcggcctccgactggctggacggcctggcagcccgcaagctggaccaacagtcggttctggggtcctacctggatcccatcgcggacaaggtcctcatcggctccgtcaccatcgccctcacgaaagcgtccctgtgacgaggacatcgccgtctcctttgaacgtcctgggcctcggcctgcctcctcaaaaccaaacaggggtcgctccctgtcgcgctggcctttgtgatcgtgggccgagacgtggggctggtggcggggggcgccctcatgcgggcgcggcagctgggctggcgctggcccggggcggccgagttcttcaggctgggcgggggcacggccgcggcccccgtctccccgctcctcatctccaagatcaacaccgtgctgcagctggggctggttggggggtgcgccctgcaagggctactaggctggccgtcgggggaggcgctcctgtccctgggcatgctcacggctgggactacgatctggtctgcggcggcctatgcccgcgccttcttggcggcggggggnnnnnnnnnnnnnnnnnnnnnnnnnnnnnnnnnnnnnnnnnnnnnnnnnnnnnnnnnnnnnnnnnntcaagcagtgaggggctctggccccaggatcattgcaaaccgaggacgggagtgctgctttcccccaggcgtcgggtccatcaaccctcgcttcctagccccactcgcttgcgggacaggtcgttgccaggcccctaccccaccctgacaccggacccccggccactccacctcccccaccccgggtcatggggtgtggttccagcacacctgcgacccacgacgggtccaggggcaccagcgggggcagcaggtccaagtcctccaaagacgacttttacgtgggggacaactacaagcggctga

SEQ ID NO: 1615 - DNA, 3684 bp, Chlorella protothecoides
  modified_base (1269)..(1278): a, c, t, g, unknown or other
  modified_base (2798)..(2807): a, c, t, g, unknown or other
  modified_base (3111)..(3120): a, c, t, g, unknown or other
  modified_base (3373)..(3382): a, c, t, g, unknown or other
atgcggccctttggcacactgcaaccacaggcccgcttcgagacggtggactccccgctcaagcgccctgccggtcgcccgccgcggctgcaggtcccgggtggctgccgggagagctgccccagcgccagccccagccccaacgccgagcacgtcagccccgccggcggcggaagccgggccggcggccagctcagcgcgcgcagcagctgcagcagtcccagtcccagcagccagcagggccttgcctggctgcaggcggccgccgggctggactcgggccgccttgccagcgcctcgctgcgacgctgcgacgaggcctttgttggcgacggtggagcacgggctacccagccggtcggagccgagggtgcgatcagatcaggaggcaagtcagagacaggcgggcgagtgccaggatcagcgggtgggcaggggccaatggctttggcggctggcctcccctaccccccggcctcaccacctcgtctcagcccgtcggcgggaggggagaccctgctcgccgccatcctgtcccctgagaagccgggccactcgcgactgctgggggagatgatgcacacggccagtgcggcggggatgcccaagggcgggatgttgctcggggcgccgccgccccagcctgagcaggccccgtgcctgccaggctcaagcggggaggacggcgaggtgaagccgatcgagccggtgcctggagacccggcccggggcgggccagcatccaaccagtccccaccagagaatccagcgcccagcaaatatgtgcaggcggccaggcccaaggaagtactcgtctttgagagggagcgacacgctcctcgggatgatccactcccctcgcccacccctcgcgcctggaactgggcagctgccggcgccctggcggccgtggccctggccgcaggcgcgtgtccttctggcagcggcgcagcgcgaccctggcagctaagagggcgatgcgacgaggaaactgcggcacgggcggggactggggcagccccgcgagtcttctgcagaggcgcacctagcgcggcacttctccgcgctaaagttctggcgaggacctcgccaggcgcaccttgcagagggaggcgtcagggatgcaggcggtcttcctcgccggcggtggccgagagctgtcgccgggccctccaaccccccatcccctctccaatgcacggacttttcctgtggcaactgtcgtcaattttcccgtccctccccccccctacactccagcccgttccnnnnnnnnnntttcctgtggcaactgtcgtcaattttcccctccctccccccccccctacactccagcccgttcaagtgtcctttcgattgtccagaggggggggaaaccctcaggccaggtcatggagctcaggcgcgggggtgtcggtcaggggtgggaaacccggccgagtcgcgcagctgcctggcccgtccatcgtgcgcagggaaaatcaagtcggccgggtcagtcatacgtgcgacgccggcgcagaccccccgcgcccagctcgtgaggggagggaaaggtccgagtctcgatcgcgggcgccgcctcgcgcacgtcaggccgccaggttgccctccttgacggcaatgtcgcggtcgagcaccgcctcgtcccgcaggttgatgtgctgcagcgggcactccttgcctggcgccggcagcgtcgtggcctcggtcaccatggccagcaggttcttggcgcggttggtcaccgcctcctcgttctcctgccgcagcttcatcttctcctcgatggcgccctggctgacgttcaggtcctccagcacgcgcgcatacttctccggcaccttcatgttgtacctgcgatgtgggggggggcagccatgtgggtgcctggcgccggtggctgcgccaggcacgggccagggcacgggccagggcgccacgtgggctcccttctcaagcagtgaagcagggggtagcctgcacgcctccgcccgaggtcactcccaccccccccaccccccgcgcgccgcaccaggggtgctgcttgatctgctcgatggtgatgcgcttcttggcgtcgatggtgaagatgcggttgagcaggtccttgcactccggcgacagcttcttgatggcctccgccatgtgcggcacctcgctccaccgcttgctcacctgctgcagccagacctccaggtgggcctcggaggtgttggggtcggggtgctcggtgtgatcaaaggggaaggagccgaggagcatgaccaggaggagaatgcccgaggcccacacgtccacgctgcggccatcgtaccccagcttcccattcttggagttgatcagctcggggctcatgtacacgggcgtgccgatctgggtgaacatgttggcctcctcgctccaggacttggcgaacccaaagtcgcagatcttgatgatgggcgggtcggaggagtccaggagcgtgttgtccagcttgaggtcgcggtgggccacgttgtgggcgtggcagtagctcaccgcagacaggaactgcttgaagaagtaccgcgcctcgtcctcggacaggaacaggcccagggcctgggccttctgccacttgtcggccacgtaggaggtcagggacccgccctccgcgcactccatcaccaggcagaggtgggagggggtcaggatggcctcgtacgccttgatcacattggcatgcccgaatcccagctccgcttggatctggggccaggggggggagggtgcatgtcaggggggaggatgggcctgaggatgggccccccacnnnnnnnnnngtgggagggggtcaggatggcctcgtacgcttttatcacgttggcgtgcccgaaccccagctccgcttggatctggggccaaggggggagagggtgcatgtcaggggggggggggggacatggggatggggcgccatgcaggcatgccacgccggtgtgcaggaggagcgcccaagccaagcaggcggggccggcctggagatcctccagcactcggccacgcaggcgtgcgttggcgacgcagggaggcaacaacgcgatcatcaccgggtgcaccgcttgccgtacgcagcgcaaggagtcnnnnnnnnnngccggtgtgcaggaggagcgcccaagccaaacaggcagggccggcctggacatcctccagcactcgaccacgcaggcgtgcgttggcaacgcagggaggcaacaacgcgatcttcaccgggtgcaccgcttgccgtccgcagcgcaaggagttgctggcactgcaagtccgtctgggccagggagcccctcaccccccttccaccggaccagccattccacgccctggcacccgtccagatcccaacaagtcnnnnnnnnnntccgtctgggccagggagcccctcacccccttccaccggaccagccactccacgcccgggcacccggccagatcccaacaagtacatgccacacctggaattcacggactatgttggtgagcaagaccttcgggaggggtctccggatgaatttgatggccacctcgctcccggtattggagtccttgaacagccatgtgtcgcccgtgccgcccttgcctgcgccagggggaacccaaagttcgagcagcgggggtggatgggggaggaggtctgctaccacatgcccggcccgcacctag

SEQ ID NO: 1616 - DNA, 312 bp, Chlorella protothecoides
atgctacccatcagagggctggctgcacggcatctccacgccgtccaggcgggactgccgccccccgccctccccgacaagctggggtttggcgagcgcccccaccgccacgtcctggacgacatgacgcgcttccaggacatgtgccgagagctgggtgtgggccctggcgacctcgtctccctggccgatctgcagaagggcagggcctgccaccgcatcgccagttgcctgtgggacctggcctccatcctgaggcgcggcgggcacgctgaggtgtgtgagagtttgggtgagaggggtgctgcgtag

SEQ ID NO: 1617 - DNA, 768 bp, Chlorella protothecoides
atgtggcctcgtccatgctctgggcgcctgctcgcattcctcgcccccgtcgccctcgtcgcaaccgctgatgagcgcatgcgcctcactttcttccccaaaccccctttcacccgccaccctctcacgtcgacgcggacgacgctgggcatcatcatgagccctgtgggcccctatttcccgtccggcctcacccccatccccatcttcgtggacgaggtgcatcgccgtgcctggcccggcggcgtgggcgattccaaggtgggtggcaactacgcgcccaccatcctgccccaggtcgaggcggcggagcggcacggcacgccccaggtggtctacacctttgcgcagccggggcaggccccggaggaggccgtgtttgaggagtgcggctccatgaacgtcatgttcctgctggacaagggctccggccaccgtgagctggtgaccccccccctgcacggcaccatcctgcccggggtcacgcgcgactccatcctggccctggcccgcgccatgcccggggtggaggtgtcggagcgcaccatctccatcggcgaggtggagcgcgcggctgcggccggccgcctgctggaggcctttggctgcggcaccgcctgcatcgtgcagcccatcagctccttcgtccgcgccggcggccagctgatgcgcgcggccggcgacggcgcctttgtcgcgcgcatgcatgccgccctctgcgacatccagtacgggcgcgtgtcgcacccctggagcatccccatctga

SEQ ID NO: 1618 - DNA, 258 bp, Chlorella protothecoides
atgaaggtgccggagaagtatgcgcgcgtgctggaggacctgaacgtcagccagggcgccatcgaggagaagatgaagctgcggcaggagaacgaggaggcggtgaccaaccgcgccaagaacctgctggccatggtgaccgaggccacgacgctgccggcgccaggcaaggagtgcccgctgcagcacatcaacctgcgggacgaggcggtgctcgaccgcgacattgccgtcaaggagggcaacctggcggcctga

SEQ ID NO: 1619 - DNA, 693 bp, Chlorella protothecoides
atggagtgcgcggagggcgggtccctgacctcctacgtggccgacaagtggcagaaggcccaggccctgggcctgttcctgtccgaggacgaggcgcggtacttcttcaagcagttcctgtctgcggtgagctactgccacgcccacaacgtggcccaccgcgacctcaagctggacaacacgctcctggactcctccgacccgcccatcatcaagatctgcgactttgggttcgccaagtcctggagcgaggaggccaacatgttcacccagatcggcacgcccgtgtacatgagccccgagctgatcaactccaagaatgggaagctggggtacgatggccgcagcgtggacgtgtgggcctcgggcattctcctcctggtcatgctcctcggctccttcccctttgatcacaccgagcaccccgaccccaacacctccgaggcccacctggaggtctggctgcagcaggtgagcaagcggtggagcgaggtgccgcacatggcggaggccatcaagaagctgtcgccggagtgcaaggacctgctcaaccgcatcttcaccatcgacgccaagaagcgcatcaccatcgagcagatcaagcagcacccctggtgcggcgcgcggggggtggggggggtgggagtgacctcgggcggaggcgtgcaggctaccccctgcttcactgcttga

SEQ ID NO: 1620 - DNA, 525 bp, Chlorella protothecoides
atggcacggccccaagaggaactgcccactttgctccatgatatggacatccacatcttcgacatcttcgacatggccaaatgcgatggcagatgccccatgaccgttttcatcgagtgtgttccgcgagggcaggacagctgcagcgcggatagcaacctcaacatcggtgccaacaacaccggcatgaataacaggggcaacaacaaccaagggtggtgcaatctaggtccgtggttcgatgatgccgtcctgtacttccttctcctctgccatgtcttatgcctctgccctgcaccgaagagggtgtccgcagcgatagtgcctcagcatttccgagaatctagtctacttgcccacaccccccaccgatcagggctgctgcacacctcttccctctaccccatccccttccaggcaacaacaacattggagactataacaggggcagcaacaacaccggcaccaaggtgttctgcaacaatctacagcaggccagtgacagatgcactctggacaagctga

SEQ ID NO: 1621 - DNA, 687 bp, Chlorella protothecoides
atgtcttcaaaactcgctatgctagctttcgtactggcacttggctcagtctcgctggctgcggtaagtcgacgggcgtgcttgtcaagaatcgtaccggtgcgcccttgcccccccttgtgctcctatcgagaccagcaagaaccttgcgcgaaggagtcatccccatctgccaccacatcatccctgcaaagcgatggagcacttaggctagtacggtcccccaccacaatctcgcagcgttggcggccagctgtatttcatctcagacagaagcgcttccatcttctgttggagttaccgagcacagaccgccttggtcgtccaccatgcttcccaaacccccccccaaatagatacaaaggatttgattggggagtcggtatgttcttggcgaatcccattgagcagctacctatcctcctgcccggattggacatccatgtttacgacttattcgactcggtcccctgcaatggcacgtgcggcatgacccagtttgtggagtgtgttccacacgaccagaccaactgcagaatcgatgaaacattcaacatcggcaacaataacgtcggcctgaataactggggcaacagcaaccaaggatcgtacaacatagtggtgcttgagttcaggtgcaccgcccttcctgagactccagcctgcttgcctgtgcccagcgtctag

SEQ ID NO: 1622 - DNA, 540 bp, Chlorella protothecoides
atgtttttcccttactttaaacctcccccaacttgcaggctccagcagtgcggagtgcggtgcgtgcagctgctgggctcgcagtccatggagcagcgcaacacccagattgaggccttctccaacgatccggacgtccgcgtgttcctcatgtccctcaaggccggcggcgtggctctcaacctcaccgccgcctcccactgcttcctcatggtgcgctggggggatggtgcctttgatttcctactggagggaatgcatgcatgcgctcctggcaggcctgcgccgacgacagtatcctcagggcatgggctgggtggagactggtacatttttggatcttctttgtgcaaatccttgggagttagccccagctcccatgtccttactcatgcttccaccaaaaccatggttcccacctctcccaataggacccctggtggaacccagccagcgaatggcaagcacttgacaggatccacaggctggggtgagaggttgcttcaggaagatggggtgtatgaacagggttggtcgtaa

SEQ ID NO: 1623 - DNA, 297 bp, Chlorella protothecoides
atgcatcacaggttcaaggcgttttcttcagggcctgcacccaggagcaggctcgaaacctgggcgtcgtggggtgggtggcgaacacacgccacaacacagtcaagggagtcatccagggcgaagcagcatctccacaagccgttccctgcacctcagctggttatcgttacatttgcacaggaatggctgcgaaaaaaggggagccctcactcaagaattgagagggcagagttcacaaacgaacgcactcttgaggggttggaatttgatgccttcagcacagaacggctttag

SEQ ID NO: 1624 - DNA, 1026 bp, Chlorella protothecoides
atgtttcggaagcagtcctgtcaaactcccaatcgcgatgcagttccgagcaatatgaatgacaagtccggaaacttggtgatcggagggaaggcgctgcgcaactcctgtgtacttttcgaatcgctgacacggggggaccctgactggagcttcgcatcaccagcttcacctcagcctggcaggaatcagacaattccagcctgggcgtgcctcctgcttcctcatggcggcgacccggtccggggctcagcccaagaggaagaggccagaggtcgtccagaatggcaagtccgagacacgaagaggacacacagcgaaggggaatggcaagatctcagcttcacctctggcaataaaggcagagcccagcaacggtgcatattacttgatgaagagcgagccggactccttctctatcagcgacctggagaatcgaaagaaccagaccgagccctgggacggtgggagcaacatctggagctttgttatgcaccaccgcagcgacctcgaatgcctcagccggcaatacttcacacccctgttcttgcaggcgtgcgtaatcatttggccaagaagatcatgcaaggcatgcgtgcaggcgacaaggcattcttttaccagtccaactgcaaggagccgggggtgatcggtatcatggaggtggttcgtgaggcataccctgaccactctgcctgggaggtgggagggaagtactatgacccaagaagcacaccagaggaaccgcgctggttcatggtcgactgcaagctggtgagtcctgatggtgttgacgcctggataccagttcgttcctgcactataggtacgcaggttgagccgcgtgattggcctccaggagctcaagcagtacaaagatggcgacctctctgggatggccctcttcaagcaatcgaggctgtcggtgcagcccgtgaagaaggaggagtgggattttgtgctgagtctagagtcaaaggacccagagggcgaaacatgactcacctcgcaacatggatcatctga

SEQ ID NO: 1625 - DNA, 252 bp, Chlorella protothecoides
atgacctcccgctacttcgaggacctaaacgtcaatgccgaggtcgatgtcgtcattgttggggctgggtctgcgggcctctcgtgcgcctatgagctgagcaagcacccggatgtcaaggtggccatcatcgagcagggcgtcgcccctgggggtggagcgtggctggggggtcagctcttctcggctatgtgtgtgagtctaggcacggggacgggtggactgaagcaagggttgggcgcagggtgttga

SEQ ID NO: 1626 - DNA, 204 bp, Chlorella protothecoides
atgggggatgcgccgctgcgtgtgatgatttcaggagcaccggctgcaggcaaagggacccagtgcgccagcatcgtggaagatgtgggtgccggggtggtcaatgggagtggggggcactttggaaagggggaagggagggcgggcagtatagacttaggtggcaacgggattcttgggaggggacattggcacggtacctga

SEQ ID NO: 1627 - DNA, 927 bp, Chlorella protothecoides
atgaagaagactgggggcaccctggccatcggttgcttggcgttctgccggggcggggttccactccatgccacccttccttggttgcctgttcctgataccatgctctgcccctgctcctgtcactttggccacctggatttccatgaccttgtgggcctgttgaatccccgtacggctcgagtgtgccagccagcccacccccctcctccctcacaggagatgggccccatcggcggtggcatcctggcggacgaaatgggcatgggcaagaccatccaggccatctccctcatcctggcgcaccgccgggacggcgagctgagcaccggggcggagtgtaggcgcgtgggtgcggagggtccagaggctgcggcctcccaggccggcccggcgaggcccaggctgcgcctgcggggcgtcgcgcccgaggccatggcgccgatgcctgggtcctcgccgccgaggcccgccaccgccgtcggcgacggcctgctggacccctcccccggcccctcgccggcgggcgccgagtgtggcgcatgcgcgcacgggtcgccgcccgacaccccgtcggcagccgccgctgccatcgcgccgcgcagcgactcgcacatcggggtgcggcacggggacggggccgcatcttcgggactggtgccttccggcgcgacgctggtcatctgcccgctggtggctgtcatccagtggcgggcggagatcgagcgccacgtggcaccgggcgcgctgcgcgtcgccacctaccacggcagcaagcgcaccgccgacccgcacgtgctggcaggggcggacgtggtgctcaccacctactccaccctggagaacgagttcaggtgggtgcctgagtgtttccaggaaaggggcgcggagggtgcagtgctccggggtttctgggcgctgctttga

SEQ ID NO: 1628 - DNA, 699 bp, Chlorella protothecoides
atggtggtgggagccctgagcagcggtgaggcggcgcgccggggctggctgctggacggctacccccgctcaccggagcaggcccaggccatcgaccgcgcgggcatccgccctgacgtcttcctcctgctcaatgggtgggacattgggacctcaagcgcaggaagtccaccccaccccacccgcttgaacaccgagcctgctgatgccggatgtccctggggccacgtggtcagcagctgctccggccccctctgtcccgtacccgacgacgccctggtggcccgcgtcgtggggcggcggctggacccggtcacgggcgacatctaccacctgactttccgaccgccgccgaccgaggtcgcgccccgcctcgtccaacgcagcgacgacacggaggaggcggtgcgcacccggctggccacataccacgccaacctggacgccgtgctcggtttctacccagaccagatcgtgcagcaaacaggcggacacagcggcgcaggcgctccagaccagcactggagggatgccactcgctcggccctgtccttgacttccatcgctctgcacccccttcccgcactccctcgtccccagatcgacggcgccaggtccatgccggaggtctacgctgacatccgggccgccctggatgccgcagtggcgagcaaagctttgcgcgtggccgccgcgtag

SEQ ID NO: 1629 - DNA, 390 bp, Chlorella protothecoides
atgacctccaccctcctgtccaaggtcctcgccgccccaaacatcaagctcttcaatgccactgcgggtgagactgggtggggcatcggggaacatagtactgcctgcagcacctcaaaccctgggttccctcgcaagatcctaccctcccgcaacgcctccaatcacacagccgaggacctgatcgtcaaagacattcccgcaaagggcggccgccacgtggcgggtgccgtgaccaactggaccctggtgtcgctcaaccacgacacccagatgtgcatggacccaaacacaatcctgtccaaggtcatggtttcttccaccggccacgacggccccatgggcgcctcaggtgaagtgcggtgcttctgttcatacttagacggataa

SEQ ID NO: 1630 - DNA, 330 bp, Chlorella protothecoides
atgcgggcggtgcgcttcatcattgccggcagcgtggaggagcgcatcctgaagctgcaggacaagaagcagctcatcttcgagggcactgtgggccaggacaatgctgcgctggccaggctgaccgaggacgacctcaacccgggaatcgcattccgcttaagtgacacacatagcctcctccttggtccggaccccgacggaccagcaggcacctcagtgcgtcgcctgcagagtcttctgctctggggtctcggcctgcacctcgccagcctcctcgcgctgcctgcagtgggtggaaagggtggcgatggggtcatggtaaagtag

SEQ ID NO: 1631 - DNA, 789 bp, Chlorella protothecoides
atgatcgaagcctggggcacggtgcacgggtcagccctgctgaacgccaacgtttgccatccctgcgccttccacccagcccgggcgcgggccacacgatgcctctttgctgttcatgagtatcgaagatcgctgcggccagcatgccgtccccgcgagacggacgctgcgtgtatggaacctaagcttgccaagcctccccgctggctggaccgtgcgataagtgcgcagaccacgcagaccatgctggatcagctgcgcgagtggcatgccgtctattctacatgcatcgtccccaggaacgctcacgatgctgtggagttggccgactgggtgcgtctcgtccgcaaggccaatcgtggcggctgggtgccagcagaactccgtgctgccctggacgagctaggttttgagtgggatgtccccttgctggacgcacagtggcactcctgcttccacgccgcaagagcctccaaggaagctgcagaaagtgggacggcaccaggaggggacgaggggctgttctgggagggtgccgccacatggcttgcacgccagcaaaccctgtatcgtcaacagaaactgactctgcggcggctgcacctgctcaagagcgtcctaggggagagactgggcggcacagatgtgggtttcgtgggcagagccctgccgcctcgcatggatgatgccaccctctgcagcatcaagcattgcaaatcctgcaggcgagaagtatgcgaggcaggccggacctctgcggcgcaatcgccatgcgatgctgaaagctga

SEQ ID NO: 1632 - DNA, 1206 bp, Chlorella protothecoides
atgcccaaagggaaaacagggaggaaggacggcaaaacacaggctggggcaacggggaagcatgacgccgcacagaaaacaaaagctggcaagaggaagaagctgggggaggagccacaagccgatgcagaccctgacagcgatcacccgacgaacgtggcgcgggaggagctccgtgcactgctggcggctggtgcgagcggggggccgcatggcgcggtacgtgccggcccgggattcggcggcaggatcgagccagagtccgccgcggcggcggccgccgacgagatgatcgcgcgccaggccgccgccgtcctggatgaggaggacacagatgagccgagctcggtcatccaccaggtgtgctgggcggtggagcgaggaccagggcgggggcgtcagagcacatgcacttggttctctcctgcacagcagccatcctcccgtcagggtggggcgccgggtgcatgtgcaaaccctgagggtcctggatgggcggcgcatgcagctgggctgggacgcgacccaggctgccacctgcctccatgcccatcgccgcgaagagcctgccccgccacggtccactggcggcgcatcgtgctcgacgaagcccacagcatcaaggaccggcgctgctcgacggcacgcgccgtgtttgcgctgacctccaggtatcgatgggcgctctcgggaacacccctccaggtgaggcaagggagcagggggaggctggcatcagcaaaaaggcccaagtactggcggggggtaagcgtttggatccccagagggctgtttgagtgttgttacagagctgtgctgagcccccatgcctccccccaaccatccaccgtgcacgttcagaatcgcgtgggcgagctgtactccctggtgcgcttcctgcgcatctcgccctactcctactactactgccggtgcgtgaggttgcctgagagtgtggctggggatcggctgggtgcacaggaggtggagtctggggcagatgaatcctgtcaacctgcaatcatggcccatgatgcctgtctcgctcgaccgctgttcgcctcgcatccacggtgcttcgtccaccccccgcgtcgggtctcctacctcagcggtaccaaatttgaccccggctggggctgcggctcgcagcggatgcacctcatgcagccgctgcgagtcgcagccctccatctttaccgttaa

SEQ ID NO: 1633 - DNA, 630 bp, Chlorella protothecoides
atggacgcggcggaggccgacttctatgaggccctgtacacgcagagccaggcacagtttgactcctacgtcgacatgggaacactcctgaatgtgaggcggcagggccgtcggcttggagaatgcacatgcagggttgggggcgaagttggtcctgggctgactggctgcggagggcctgcttgtatcgtggatccatcttggctggtggggagctgtgatgtgtggagggccagacatggtcctgcactccccgtgtgggggcatgcacgaggggaggatgtacaccgcaaggtcatgctggggcgtcacaagcaccccgccgctgcatcgacatgccgggcatgtctgtttgcagctgtctcccctgcagccaacccgccgctcatgccaaccatccctgggccccccattcacccctccaggctgcgacaggcggtcaaccatccctacctggtggttcacaactccacggatgcggcgggcgtggtggcaggcgggtttggggccggggccgacggcgtcgccgctgccgtggtggaggaggccacccatgaccacgctttggtccaggggctttgcagcatctgccacgacccgctggaggtagtgggcatgcgaaggagatga

SEQ ID NO: 1634 - DNA, 108 bp, Chlorella protothecoides
atgtcggcggggcgcgacaacgcggccaagcagtgggtgctggacggcgcggacggcgcgccgcgcctgctccgcttccgcgcgggccacgccgcgccgcccgcgctg

SEQ ID NO: 1635 - DNA, 1974 bp, Chlorella protothecoides
  modified_base (116)..(125): a, c, t, g, unknown or other
  modified_base (281)..(290): a, c, t, g, unknown or other
  modified_base (584)..(593): a, c, t, g, unknown or other
  modified_base (929)..(938): a, c, t, g, unknown or other
  modified_base (1064)..(1073): a, c, t, g, unknown or other
  modified_base (1366)..(1375): a, c, t, g, unknown or other
  modified_base (1624)..(1654): a, c, t, g, unknown or other
atgcatggaaccctccctcctgccacccttttcaagagggagcaagctgagtgggggggagggtttcatgcaaggaaactttcagaaagggccgccacgaagcgtgcgtcgccgcnnnnnnnnnncacggcgatgagctgggattcggtggaaggaccacctcaaacacgggggtcatctggaagctcacacatcctgagcaaggctgcacaagttccagccctccgccccgttgacctgctcgagcgcatcggagcggttgtaaacgttttccagatgcnnnnnnnnnncatcgaccgcaagaagaacatcttcaagctcgctcagggtgaggagtgctgggctgggtcggggtgtgcggtcgaagggagcaagctgagtatctgggtgcatggagagtccaccgaatcccagctcatcgccgtggtgatccccgccaaggactggctgaaggaaaatggcgggaaggaggccctgaacaagccagaggtgggttgtggggtgtgcgctgatggctggtgctggggtgccgaggggaaacgcattgcatggacgccccatctgaggcgcggaggctgggcccnnnnnnnnnncgggaaggaggccctgaacaagccagaggccaagaaggccatggtggaggagctgtccaagacggccaaggccaacaagctcaagggctttgagtttgtgagggcggtgcacctggacgatgagccctggacgccggaaaacaacctgctcacgccctccctgaaggtgaagaggccccagctgaagagcaagtacgaggcggagctgaagcagctgtacaaggacctcaagttggaatgcatgttcatcgggtctgagacggcaggaatgtcgacttcgtgccaaggcagggctgcggactttcctaggaaccccaaaagggtgagggtatccannnnnnnnnngaggcctgccgtcagctacatgccccagccaagcatgatgtgactgtcgacctcgtgccaaggcagggctgcggattttcctaggaaccccaaaagaactctattttctccaggcattcgagtggnnnnnnnnnntactcccccactcccactcattcagactctgttttctcctggcattccagtgactccgcctctccctcctctgtcccttccgagcccctcgcgacggcttaagtcacctgcctcaaactttacaaccgttgacaatgtcccgcgccggtctcattcttgcattggtatgcgctctgagcctgggctccggcgcctacggccacaggtgagccttatgaggcttgaggatggtccgccgatgcggcgactcgattatctcgcgacaaaccctagacctcgcggacattttcacnnnnnnnnnntcatcaatgggccagcggccacagccttgctcaaagccgtcctatacggtaccgtagcatgtacatgcactgggactgcttggaaagcgctctggcgtacactcaccggcccgacgaatcttgtccatgcccgcacgcagggaaacgtgattgaattgtaccagcgccagtgcgcgggaatcgacccgacaggggggataagagcggccgatgggtgcataattgtgcattccccgatccacatacacnnnnnnnnnnnnnnnnnnnnnnnnnnnnnnngctcgcgcgcttgctcggccgctttcgcaccacttttagaagtacactacatctcccaaaccctcccgtgcaggtggttcaaggcgaccgtggatgacggggtcaccaccgcggaatggtattctttctaccatagcagcaacggcttctgggagctgaatgtgaccggggcagaggaggttacaggcatcagcctggctcagatcacggccggcatgatcaccaccggtgagggaggggaagggtgggagggggctgggccttggatcaggagtaccttgcaccttgagatgggaactcgagctgcaacgactggatag

SEQ ID NO: 1636 - DNA, 969 bp, Chlorella protothecoides
atgctccctctctcaacccctctttgggcggcccaggccctggcgcacgaggcgcaggccaccttcttcaacatttcggcggcctccctgacctccaagtggcacggcgaggcggagaagctggtgcgcgcgctcttccgcgtggccgccgccgcggcgccctccatcatcttcatcgacgagatcgactccgtgctgtccgcgcggcgcggcgacgagcacgacgcctcgcgccggctcaagaccgagttcctgagcgcctttgacggcgtggcctcggggggcgcccacctgctggtcctgggcgccaccaaccgaccctgggacctggacgaggcggtggtgcggcgcctgcccaagcgcatctacgtccccctgccgggcgcggaggggcggcgcgcgctgctggagggcatgctgcgaggccagagggccgaccccggcatcccggccgtcgtcgcaggcctgaccgaggggtgggggctgtctcaggccgtgctccagcgagaatgcctgctctttgagcgcgtcaagtggggtccatcctcgatgaagtgttccaggctgctgcggagcatggccaggcatgagcatgctgcgaagtgcacgagggcgagccgttgccggcaccacatgtgcaaatggggcccgtgccccgtgcacactgtgccccagatcacagggtcgggtccttgcggacgcagttcagcattgcccagccatcccctcgcccctcctttcaccatgcacaggtactcgggctccgacctggcggccctgtgcaaggaggcggccatggcccccattcgggagctgggccgccgcgtggccaccgtgccggccaatcgcatccgcggcctgaccgtggccgacttccgggcgggcctgcaggtgatcaggccctccttgaccccagagtccatggcccagttcgaggaatggacggccaggtacggcaccgccacctag

SEQ ID NO: 1637 - DNA, 1425 bp, Chlorella protothecoides
  modified_base (18)..(27): a, c, t, g, unknown or other
  modified_base (758)..(767): a, c, t, g, unknown or other
atgccctccacacagatnnnnnnnnnngggggggggcacggaatgagttctgtgggtctccatgcggatgctgtcagtccccggcttctcgtacaagtgcccagtaagccctcctcacagacgcatgtgctgcgcgagaagggaatcatgagctccctttcctcggctttcctggtcaacatggcggcggccctgcaagacagccagtgcctgtacatgctcctggactttcagcagggcggagagtttttcacctatctccaggtgcagatcagggggaccatacagggtgccagcagcaatgcatctggggaagcaaaggctcctggaaccgcacagatccactctcagagtccagtgccaggttctatgcagcatgcgtggttgcaggactggagtacatgcattccaagggcgtggcctggaggtgagggggccaggcttgattggtttctgaggctggactcaaccttactcgtgtttccatccaaagaccaattgggaacagctccacatttgagtttatctgaacctagcagcatctcctcaaacccgtacacgattcattggaacagggatctcaagcccgagaacctcctgctggacggccgagggtacctgcgcctggccgactttgggtttgccaagcgaatcgcgccggggtcaaggagttataccctgtgtggcacccccgaataccttgccccggagatcctcatgcagtctggccacggtctgcctgtggactggtcaaatannnnnnnnnnggtctgcctgtggactggtgagctgggtggaaggtcaaatgatgtacctcctcccactgccaggtgggcgctgggagtcctcctctatgagatggtggcctggacccctcccttccaccaggaggagagggcagtcatgttccgagccatctgcagcgccaactacaccatgcctgcctacttcagcaaggacctcaaggacctcatcaggcgcttgctgaacaagcagcccagccgccgactgggcacggtgcagccctgtgccttccctcttccttcacatatcctcaaccccacctcatccggtctccctctcatcctattccgcttcccccatgcttgcccagggaggagtgagcgatatccggaagcatccctggtttgcagggttcgactggtcggcccttgtcagccagaggatgcctgcccctttcgtcccaaaggtaacaaagctctgattggcaggccactgctgacctgcacagatggtgagcttatgtcagattataggactcttcacagccccagtccccaccgaccaactgcgcaggttcaaggcccagaggacatggcgcactttgaggcagggcaggaggtggcacacaagctgctgggcagtggacgccacgcgtcggtgggcacctttgctgacttttga

SEQ ID NO: 1638 - DNA, 912 bp, Chlorella protothecoides
  modified_base (353)..(362): a, c, t, g, unknown or other
  modified_base (543)..(552): a, c, t, g, unknown or other
atgcagctttggcacccctccccgtcagatcccaatacctcccttctcccccccccccgcagggatgtgtgcccggcggtgcggtccacgacggtggccggggtgggggcctgggctctgctggcccccgccacctacatgaccgacacctacctcaagtacgtggcctgggcgctgtcggaccgcgacgccgcggtccgggccacggccctcgacgcgctgctggcgctgtacgcggcgccggagaacgtggccccgctgcacgcctttgccgcgaggttcaagccgcgcttccgggagctggtggacgatgtggacgacgaggtcgcggcgcgcggggtgaggtggggggnnnnnnnnnnggggtccacgagggcaagggtgggtggggctgcagggacgcatcctgtgggcggcaagcggcacagggtgccccgtgcacagcagcaggccagggcaggccgtgcctcgacactccccataccatccccgtgtcggccaagcccgcccgcgcgcctccagccctcacccccggggagccannnnnnnnnntcccgtgcacagcagcaggccaggggcaggccgtgcctcgccactccacataccatccctgggccggccaagcctgcccgtgcgcctccagccctcacccccggggagccaaccacccgaccgccaccacccccacagatccggctgctgacgcggctggcggtgctgggcgtggtgcccaccgccgacctccagggcctgcaccgcctgctgggcgatgccagcccgggcatccgccacgcggccgcggcgctggtggcctcaggcctggagagcgccgcggcggcgggcgcggcgggcggagggcacgacgcgcgtgccgcgctcctgcgcggcctgctggcggtgtgcgtggacctg

SEQ ID NO: 1639 - DNA, 888 bp, Chlorella protothecoides
cgcgacgcctcgccggtgctgcagtggaccgcgcgcggcggcctgcgcggcgtggaccaccactgggcacgctcccagttcgccaccgcgggcgtcggcgtctgtgtgtgggaccacgcgcgctccgacccgttcgccaccgcgggcgtcggtgtctgtgtgtgggaccacgcgcgctctgacccggtgcacgcctttgagtggggcgccgacacggtggcctcggtgcgcttcaaccccgcggagcccgacctgctggcctccgtcggcggcgaccgctccgtcgcgctgtacgacctgcgctccgccacccccctgcgcaagctggtcatgcagaccaagtccaacgcgctggcctggaaccccatggaggccttccacttcacgctggcctccgacgactgcaacctgtacacctacgacatgcggcgcctggatgtcgcgcgctgcgtgcaccaggactttgtgtccgcggtgatggacgtggactactcgcccacgggccgcgagttcgtggccggcggctacgaccgctccctccgcatcttcgccaagcacggcgggcactcgcgcgaggtgtacaccaccaagcgccagcagcgcgtgtttgcggtgcgcttctcgggggacggcacctacgtcttctcggggtcggacgacatgaacgtgcgcgtgtggaaggcgcaggcctcccagcagctgggcgtgacgctgccgcgcgagcgccagaaggcggcctacggcgccgcgctcatcgagcgacacaagcacctgccggaggtgcggagggtggtcggcaaccgacgcacccccacggccatctacaaggtacgggggaagtactgtattgttgggaggagagggggaaagggactggggagaggctag

SEQ ID NO: 1640 - DNA, 1026 bp, Chlorella protothecoides
atgcgggacaagatggaacccttgctcccagcggagttaccacggccccgagccgtcgattgcccccacatgggcaactgcacgaaatcacgtgcgtccaactgcttcgacgcggcacctgctgcttcctcccaggtcatgccatacacaaggggactcatcccattttccaccctatactcttatcatgtaggcacgatgtgtatggcggacaccagccttcgccgccgtgcaagcgctgcacatgccgacacctacccgcgacttaagaccctgcaccggggtggaaactcggtggtgtaccgggcccaatccccagccggcggcactctggtggccaagcggtatcacatccatgccatgtgctctcgagagcttggagccatgcgtcgggaggtgaggctggcgagtatctcgtcggactggcatgcaggggcaggcggccaccacaagggacccaatacttggatcgacccctttcgccctgggcccccgcagatgcgattgctgaggctatctcaggatgttccgggagtcgtaagactgctggaccagcacgagactgccctgacggcctgcatgatcatggtgagcaggggtcggggcccccgaccatccacccgggcgatgcccggtgacgggaacggtgtgcaagtaccatctgcgcttggtggggcacgcaggggcccggtccacgcctacctatattcattcgtcattgaccggctccatgcccgcgaatcgcaggaggattgcgacggaggtgacctgtacaacatgatgaggtttggggacgccctgtcggccgactgggtggcttccacggtggtcaagcccctgctccggattctggcttccctccacgccacctccatcatccaccgcgacattaagcccgagaacctgctgctggatgcaagggggagtctcaaactggcagactttgggctgtccatcgaccagcgcaaggagattcccttcctccgcgccggcaccctggactacatggcacccgaggtgggatga

SEQ ID NO: 1641 - DNA, 891 bp, Chlorella protothecoides
atgcagccactcgacgtctactcgctgccgaagacccccctgcccctccccgagagcatcgtcctgtatcagtacgaagtgtgtcccttctgctgcaaggtcaaggccttccttgattaccacaaggtgcgcgacatgggttcaaagggcgagcaacgaccccacgacccggcacctccctctccccagatcccctacacctgcgtggaagtcaaccccctgaccaaggcggagctgaagtggtcagagtacaagaaggtccccgtcgtcgtcatggacggcgagcagttcaacgactcctccgccatcatctcgcgcctgagcgccagcgtgggccggggcgccgccaccccggaccccgccgcccccggcggctggaggtcgtggctggggcagggcagtgccccgacgtcctccccgcccgcccgcagcggcacgcagggctcgtcggacgaggagacatggcggcgctgggtggactctcgcttcgtccgggtgatcaccgtgaacatctaccgcaacgcccgcgagtcctggcagacgtttgactacatcgcggagcacgggaactttgggtgggtgcagcgagaggctgcgcgcgtggcgggggcgggcatgatgtgggccctcagcgggcggctgaagaagaagtacggcatcgacggtgactcgcgcaaggagctgtatgcggtgagcgagcctgggctgacgtcggggcgcacattccatggtggcgacgctccagacctggcggacctggcagtttttggagtcattcgcgcggtggctgggaccgacacgttcaatgatctcatgcacgggaccaagattggcacctggtatgaagcaatgttcaaggcagtgggtgggagtgcccgccgccctgcctga

SEQ ID NO: 1642 - DNA, 981 bp, Chlorella protothecoides
gcgacgctcgcggcggggcgcagcctgccctcctcgctgctctgcgcgctgggcgccatccgcgagtccttcctgctcaccgacccacgcttgcctggcggccccatcgtgtacgccagccccggcttcctggcgctgacggggcacggcgcgggggacgtgctgggccggaacccgcgtctgctccagggacgggaggcctgcgccgaggcgcggcgcgtgctgcgcgaagcgctggcgcgcgaccccccgacggccgccacggtcacgctgctcaaccgccgcgcggacggcagccggtggtggaactgcctgcacatcgcgcccctgcgcgacgcgcaaggcgccgtgcgctacatcgtgggcgtccaggtggacgtcaccgcgcgggtgcgtggccaggagcaccgcgcgggggcttcaggagggggggctgaggtcggtgaggcagcgggtgtcacagatgtggacaaggcggcgggtgtcacagaggtggacaagacgaccggcgccgcctcgcccggcggctcgcctggcgcgggactcccagccaggaagacctgcgcggccgggggccactcctgccacttggtcagggggctggatccggccctgcccccgctggaccccgacgcctggcacgcgctgaaggctaggggcgtggcggggcaggttcggctggcggcacgagccctggggccctccggcctcgagatcacggtcacgcgaatcagcatcgccccattggctctaccagttcacccccctccccgtacctctgttgtgcaccaggtagcacccccattgctggcagttttccatgttttccctgcgagtccctttaccccagaccgcactttcatgacgagaagattttccaggacatctctcccccttggcaccgcacttcccctcctttttaacagtatggcaggcgacagatggagtgggggtgggcttggggacacgatcaaagcatga

SEQ ID NO: 1643 - DNA, 330 bp, Chlorella protothecoides
atgattacagtccggcatccatggctggggcatgtttgccaaggttcccatcaagcaggacagcatggtcatcgagtacaggtgagggggtggtggtggaaaggagggagcgggggcgcatgggatgaggccgagcacttgggcgacctcgtgcgccagcccctggcagacctgagggaagcgcagtacagggccaacggcaaggactgctacctcttcaacctggacgacgccattgtcatagacgccaccatgtgcggcaactgggcacgcttcacggtgagcggagcggcaaaggggtttggcgggggtggtggtgatcatggatag

SEQ ID NO: 1644 - DNA, 1290 bp, Chlorella protothecoides
atgtggctggggcctccaatcacatacccttgccctcacccgcccgtaaacctcctgcaaccgtactcgcagcgtgtgctgtacaacggccaggagatggcgccctcgcgctttgaggtcatgtgtggcaagccggacgcgaagaagtggaagatgtccttctggcgcaccgacgccgacggcgagcccatagaggtgagggggcggctgattaagccatgctccgacggcaaaccggccaaagtacgcatgcttgctctccaggcacaatgtccactgctctcctccttcatcaaccccctcacacagtccatgcacgactggctgtcccgctatggcctggatcgcaaggcgctggatgccctggcccgaaactccgcggcacatgaggcgtacgaatcccatgttgcaggcacagtggctcttgtgctggaggacatcctgctgtccttgggagcatccccttacgatcccagtgacgatgatgagggatctggcggcaaggatgaagccagcggcgaggaggctggcgaggaggcggcggtccacgacgagacccagaggcagcagccaagggcaccagggcgggagcttatcagcggcgtggacgagcctccaagggcaccagggcaggagcttatcagcggcgtggacgagcgtgtgcccccattagccgccacccagcagtctgccgcggccggcgagggtgaggagcctggtgtgaatgatgaagcggacgaggatgaggagacggacgaggaggtcgccgaggcaccgctggagccggagcggggtgcgccgtcagaggatcgccccggcgcccatcacatggctgagagcggggatgatgagggccctcagtcgccagcgcgcgaggcatccccggccgcgagtgcgcaggagggcgaggacagcgagggtacgcagccgtgctctcctgtctcgggccccggcacgagcgccggtgccacctccgccggcgcgagggcatgggatgccctcggcgagcgtggggcaggggaggaaagcgcgggcatggacgtgacggtccagggcatcgaggcggatgctttcccgggcgagcccccggccgaggccaagctggaccccggtgcgggagcgagaaccctggtcccacccgcgcccgtcattcttgccggtatgtgggtgcgggtctactggccggatgacagggagtggtacctcggtcaggtggtcggggaggatcctgccaacccagcttctcatcgcgtgctctacaagctggacggagaggtgggtcctgggtga

SEQ ID NO: 1645 - DNA, 1146 bp, Chlorella protothecoides
  modified_base (238)..(247): a, c, t, g, unknown or other
  modified_base (328)..(337): a, c, t, g, unknown or other
  modified_base (918)..(927): a, c, t, g, unknown or other
atgcgccggcaacgggccctccggtggcggcttgcggtgcgtgggcggtcagcgatgccttgccggcgtgcagcagcgagctggcatgccacggaacttgcaaatcccaaacagttcaccagcgctcgaatcacattcattgtgggagatgtctgtggcagtccaccgtcgttgtgcacataccgaggggatggaatcgagtccaccacacccatcatgctgccaagttcatgggacnnnnnnnnnncccggtggcggcttgcggtgcgtgggcgatcagtgatgccttgccggcgcgcagcagcgagctggcatgccacggaacttnnnnnnnnnngccgaggtaatggaatcgagtccactacacccatcatgctgccaagttcatgggacatgtctcgccacgtcaccacaatgtatccgagaggagcagatcgtggcttccagggactcgcacgttcacatgccggcccaggcgatcacaggcgcagcacacaccggagtcacgatggtggactgagggagatgaccctgtacagcgatgccgaggcgcagcgggagggcctgctgtcccccagccggtttcggagccgggtcggggcctcgctccacctcctgcagcggctggggctgacgcggcgcctggaaggccacacaggctgcgtgaacacagtaaccttcacccctgatggggaaggactcctgtctggcagcgatgaccagctgatcaagctgtgggactggcggcgcggggtggaggtcctctcctacgacagtgggcacactgacaacgtcttccaggcccgtgccatccccggcaccgacaatcgcaccgtggtctcctcaggcgcagacggccaggtgcgactggggctggctggcgagggcggctcggtgcgcacgcgctgcgtggcgcgnnnnnnnnnnccgcaccgtggtctcctccggcgcagacggccaggtgcggctggggctggccggcgaggccggctcggtgcgcacgcgctgcgtggcgcgccacaatggccgcgcgcacaagctggcgctggtgccgggggcggcgggctgggtgctgtcctgcggcgaggacggccgagtgctgtccatggacgtgcagcggggagggccggcgatcgctctggttga

SEQ ID NO: 1646 - DNA, 519 bp, Chlorella protothecoides
atgtattggcacacgctgcgttccttgcctggccgccggtggcccgagggtcgcaagcgttgcatcataactacaacccccaaatcctctccgcaggaggccgagtcgcgccagctggaggcggagaagaccaggctggagctcaaggtcgcggaggcccgcgggcagctggaggccgccggcgacgtgtcggagcgggcacggcacctggaggcacgccttgtcgacctggaggcgagggatgcacggctggcagagtgcgaggccgctgccgccacggcaaatgatgtcgtggaggcggggcggcagcgcctggcttcggcccagcgagagctcgaggcccgcgagtcggaggcggccgcacggcgcagtgagctggacacgctgtccgccgccattgaggaggtgcggcgcgagcaggaggcctggaccgacgacgccgagcgccgcgcggccgcgctttcttcggcggagcaggtgccgggagtttctctttggtgggggtttgtctggggatga

SEQ ID NO: 1647 - DNA, 426 bp, Chlorella protothecoides
atgtccaaccagccagaccgatacgagaagtttgtggttcctgatggagttaagaaggttgcctttgagcgagacaccaagattgccaacgcggggaccttcactgtacaacgagaggaccacaccatcggtaacatgatccgaacgcacctccacgaggacccacatgtcatcttctccggctataagattccccatccattggagtatcgcatgctcatcaaggtatgcttgagtgagaatgtcttgctgggagatcagagcatgctatctcatgggacaggagtgaggctgagatcacacccgcctccaccttgctcccgcaggtgcagacggatggtcgggaaacaccggtggccgccactcaaaaggcagtcgacaagctcgtggagaaggtccgatccatccgagaacaatttgtggtag

SEQ ID NO: 1648 - DNA, 870 bp, Chlorella protothecoides
atgtggttcggtttggacctccaccgcacagctgcatgctctcgcgacatgcgcctggcggtgcgtggctttgcaggagcattggctccggggcaaacgcgacgccggccacaccctgccggctcaggcgctctttccatcccgccctcaggtcgaatcgagtttgcgaggctcctccctccgaatatccagagcttgctcatccagccgatggggagggagggggtcatgctcctggccagcaatcgccagcgcggcttctcgagcctggacaaggtgagggcctggggatggtttggcatgctcacttttgggctgtggggcaccctggtgaaagaccttgcggatgggcgacggcgtgaacgtcggatggcagacagctgcagatgcgtcggcctgttgagcatgccacccccatgcgccctcccttcacaggcgtgggctgtgcgagtggcagagaaactgggtgcgacctttgacaggtcacaggagggcttgtctggggcatcaaagccgtcttatgggctacgcgcagagcatcagtggaacgcaacagggccaggacagacccaggcagtggtccagagccatgcaaatgtctttgggacacagcgcattgcatgcaggatccagctacagttccttgcttcaggccttgtgctcgaacgcatgccaccagccgggggcatagggggtgtagggggcggtccactccgaatccttgatcttgaactctggcactgggccgtcggaagcacaggcctcgtcagcatgcatctggcccaggtggatctgcaggacacggtccagccgcagcttcatgaacctggtctcagaagggcggagcaagggggttgctggcttttttga

SEQ ID NO: 1649 - DNA, 819 bp, Chlorella protothecoides
atggaggagtttccctcgtcaagcggcagcgaggaggggttcgtccccgactacgacttcgagtctagcttcgaacggctcaaggactcggcctgcttccccgctcggctgaccatcctgggcctcaagcgcaccaacaagcacctggtgatgcgtgagctgctgcgcgtgaagaacgcccagaccctggacgagatcaaggacgcggtggtggctgcttaccaagacctcatggcgctggagatctttgatgccgtggacatcgtgatcgatgggctggatggcaagggcaggagtggcggctgcacgcctgcgcaaaacaggcagcgacccagactgctctgtctcatcgaccctccctccttctcatgctccccaggctcagtggaggcgtccgcgacgctgaccaatcctctgggccatgcggagcgcctgaacctgagcggggagtggggctccaggagcaccaccacctacagcctggcgctgactcgcgcgcggccgcggggcctgccgtacctcgccaccgcccgactgtaccagcagttctcctcctttgagcgctggtcctccttcacggaattgctgaggggtgccgagacctccctgtcgacggaggacgggcgccacctggtgggggccggcatcggctggtaccggctggccgacccggcccgccgcgcctcccgctccgtgcagcagcagtttggtgaaggggtccggtctgcaatcaagtacacgttccgccacaccacgttttctggggaggcctccttccccctggaaggtgggctgcgtcggtctgagtgtgagggatga

SEQ ID NO: 1650 - DNA, 504 bp, Chlorella protothecoides
atggcccaccctggacattccgtgagccctgcaggcgccgcgtcggacaagctggtggagcatactgggagcaacattacgctgacgaggcacgacgtggccaccttgggccccggcgcctggctgaacgatgaggtcatcaacctgacaatgacgctgctgcaagagagggacacctcggcccgcaaagcccaggtcggccttttgtgggcagatgcaggctgcggggcactgagagcactgcatgcaactgctttgaagctgtggggcaaatacaggctgcggggcattgagggcactgcatgcaactgctttgaagctgtggggcaagtgctgtgcctggcggggttggaacactcgccgctcctccaggtcaacacccttgccgcctcgcctcacccgcagaagtcgtggccgaagacccacttcttcagcacctttttctgcaacaagctgtacaaggacagagggtacacctacgcacaggttggtgctccccagtga

SEQ ID NO: 1651 - DNA, 1785 bp, Chlorella protothecoides
  modified_base (140)..(149): a, c, t, g, unknown or other
  modified_base (255)..(264): a, c, t, g, unknown or other
  modified_base (1247)..(1256): a, c, t, g, unknown or other
  modified_base (1650)..(1659): a, c, t, g, unknown or other
atgccgaccagtcctcgcccctcagcggggcgctacggccaggccggccagctcttcaccaagcagacccaggccatcttctacaactggaagcaactcccggtgcagcgtatgctcgactttgactacctttgtggtgnnnnnnnnnnggactggtcggcatcgcgacgtgggtggagcctgagagcaaagaaaagccctgacttcaagttattgcgtacaccatatccaacctcactcccgcaaggggatcannnnnnnnnncccaccgtgcatgtgcacgcatgtatctggaatgatggtgcattgcccgatgggggtttgcgggagtgtgcactttcgacggcggggttctcgaggcaggttcccacgtctcgacagtccaccaaaccgaatagtacaggcttgtgcgacatccacagatcagcaggtggcagccgtggttcagcattacctttacgacgtctcgacagtgcaccaaaccgaatagtacaggcttgtgcgacatccacagttcagcaggtggcagccgtgttcagcatcactttcacgtttaataagctggatgcagtgctatgtttgatcagcgctgtgcctcggaggctggcttacggagaggagccctgctgggagccaaaagcagggcacagccttgcctcacgtcgggatcggcgtcgaccgcttaacgcaaaagtcagctctcctggcgtcctcctgcatgctgcaatatatccttgtccgccaagcgagtgttgtagctggcttctggtcctcacagtcgaggaggggaactcagattcggagctttgtgggcttgatccattcgacttgaagttgaggcttcaccgtccatacagaggcacgtccggtcggccgaccgaaacttgcgacaggacttcactccggctcctctccggccaggcctctccggagctagcaccggcgggttcaacggcgtggctcgccccagtgagggtacgcaagaggatatatgttcgcacagccgcgacccgcccaggggctggtcctcgccctcgtgaccctcttcttcgtcaaggtagatacacaggagaagtcacctgcggcgaccttcccagcacattgcaagagaggtcgagaggtgtatccactgttcaaacgacaagcagctcgctgactattcccttaaagtacaccacacttgtgtcgattcacgcggctgaagctgcttcggtgaacgagtacacaactaccccccgagaacaacnnnnnnnnnncacattgcaagagaggtcgagaggtgtatctactgttcaaacgacaagcaattcgctgactacttccttaaagtacaccacacctgtgtcggttcacgcggctgaagctgcttcggtaaacgaggacaaaagaagcccccgaggacaagagtcacccgtgagcgtactgcagtcggttttggcatcacgaaagcttcccccgcctaatgcgaagaagattccgcctccctcaggccccaaaaggtcacctccctctgcaaagaaggccggtgtcacccctgccaagaagaccccgccacccctcactaagacgagtgcggcacctcccccaaaaaagagaccgcctcaaccagcgaagaaaaggctccccccaccagtcaagagacgtcctccnnnnnnnnnncgcccctcactaagacgagtgcggcacctctcccaaaaaagagaccgcctccaccagcgaagaaaaggctcccccccccagtcacgagacgtcctcaacctccagcgaagaagagctcccccccgg

SEQ ID NO: 1652 - DNA, 1755 bp, Chlorella protothecoides
atgaagggccagctcttagacaacctcatgagcaccccaggggctgattaccctcgcacagcatgtttgtgtgccagtcttgtgatcttgaagggaagtcctgctctgcatgtcacgctgttattcctggggcatatgccggtggaggccacccaggcattttccgcttgcccccgacagggcgccatagggcgcgcacatctcgaggacgatacagcttctcgaccaccgagtgactgcgccccatcctgcgccctctgtcgagcgcattcgcccgtgggcggggacacgcacggacatagacacatggataacctcacgaggttgttccgcattcgtaaaacatgcatggaactcctgcgggatcgagggtacctcatcactcaggtgggcagtgtgtgcacaagcaaggagtggcgcagtgccggcacccacttcagctacgcagccatcgccatctggcgcacctccgcgtgtccccctctgcaggaagaccaggacatgacaaaggaccagttccgggaaaagtatggggatgagccccgaaaagacgacctgaccatcctggcacccaaacaggacgacccaacaaaccagctgttcgtcttcttcccagaggaggccaaggtcggcgtcaagaccatcaaggtcctggccgagcgaatgagggcggagggggttcagcgggcgctgatggtggtggcgaccaacatgacaccatttgccaagcagtgtttgcaggagatgcagccaaaatacgtgatagaattggcatcttgccatcggaagaaaggagcggcctttctttatttgaatatattagcaccaacccagccatgttctcatctccaacagttcaaggaggaggagctcctggtcaacatcaccaagcatgtcctcgtgcccgagcatcgcatcctgagcgctgaagagaagaagacactactggcacgctacaaggtcaaggacacgcagctgccccgaattcagttcaatgaccccgtggccagatactatggcgtgcagcgcgggggcgtggatacaagttttgcatcttttgcgtgcgctccccgagcttctgtcggcgatgagttttgggaaggcgggtttgggtgctctgctcaaccgtccctaccttcccgcaggatagaaagggtgacgacccatggcccagatcccgcgatgccgacgcgatctgccagcgagccccgagcactgcatctggcatgccatagcactccagggtcgccagagtatcggggcgccctgcctgatgtccgaccggtcgaagccgtccagtccggagatactggctgtcgcgtgtgggaatgggcacgctattgccgtgctggggggaaggatggtcacccactccacagtgccaggtcgcagatcacgagccctgagcatgtgctgtgctctcggccccggaacttccctctttccatctcacccctacccctctctaccccctatcagactccgagatcggccgcatcgtggccacctggggctcgggcgatgatgggcagctggggcacggcgacacgcgcgagcgcgacgcgccccaggtcgtcctcgccctcatgggcaaggacgtggacctggtgtcctgcggcggcgaccactgcgtggcctcctccagctcgcgccgcgagacctacagctggggctggggcgactttgggcgcctgggccatgcccaggccgacgacgtgtggacgcccaaacccatccggggcctgtccgggttga

SEQ ID NO: 1653 - DNA, 561 bp, Chlorella protothecoides
atgcacaccctagcgctcaccgtggacggcgcggtgtatgcctttggccggaaccaggcagggcagcttggcatcccctcccagtacgacgcgctggagccgacacgcgtcgcggcgctggaaggcaagcacgtgcgccaggtgtcctgcggcggcgagcactccctggcggtggtggagggggggcagctctacgtctggggctggggcaagtacgggaacctaggtgaggggtggtgggggaaggaaggggacccggggggcgaggcccggaccattctacggcagcagtcgatccgtgggctgctgaggaagtggagtcccaatgcctcggaaacgagttggaccaccggctgccggtgcacgtggaggttccgggtgcccccaccatcaccaccgcctgctgcggctggcggcacactgcggccgtggacgccgaggggcggctgtacacctggggctggaacaagtacggccagctgggcctgggcaaccacgagtgagcgcggcgtggggagggtggaggatgggagtggggcgtgggaggccaaggttgattga

SEQ ID NO: 1654 - DNA, 1866 bp, Chlorella protothecoides
atgctgcatgcagatgcaagcccacaccatgtgccccacaccggcgcccttcccacccctcctctccaactccaggacctgatgcacgtgctgacatccacccccctggcaacactgtgcgaggcggcggcgctgaagcgcgacgaggcccacggctgcgtcgtcaccttcagccccaaggtcttcctgcccctcacccgtctctgccgcgactcctgcgcctattgcacctttgccgcgccgccccggcctggcgcacgctgctacatgactccggaagaggtcgtcggcctggcgcgcgccggcgccgctgtcggctgcaccgaggccctcttcacgctgggcgacaggcccgaggcgcggtatcccgaggcggtatgcgagctggcggagctgggccacgcctccacgctgtcttatgtgaccgcggcggcgggggaggtgctgcgcgccacgcccctgcttccccacgtcaacgccggggtcgtggctgggcccgcgctgtcggccctgcgcgccgtatccgccagccaggggctgatgctggagggcacggccccagcgctggcggcgccgggcggcccccaccacgactgcccggacaaggaccccaccgcgcgcctgcgctgcatcgaggaggccggcgaacgcggtgtgcccttcaccacaggcctgctgctgggcatcggggaggggagggcggacacggtcgacgcgttgcgcgcgctgcgcgcgctgcaccgccggcacgggcacgtccaggagctgatcctgcagcccttcgtgcccaagcccggcacgggcatggcgcgcacgcctccgccggacagggcctacaccctctgggcggtcgcggcggcgcgcctcatgttcgaaccggggatgagcgtgcagtcgccgcccaacctggcggcggggggcgagggggagtgggaggcgctgctccgtgccggggtcaacgactggggcggggtcagcccgctcacgcgcgactgggtgaaccctgagaaggcgtggccgcacttggcctcgctggcgcgggccaccgccgccgaaggcaagctgctgctcccgcgcctccccgtctacccctcgcactccaccctggaccagcgcgggcggtggctggacgggcggcgcggcgcgggaagcccgctggcggccgtcctccgggcctcggacgcctcagggctgagccgggggagcagttggtggccaggccgagatgccaaggatcgggaggagtcaatggaaggggtggaagccgggcgcacggatgtggacgatgctgcgccctctgttcaacacagcaacagagcaacgcatgcgcatgtgcccagccctaccacaagaagcgccgcctggcgggtgtccctgtgccgggatggggcgctcgaagccatgccccggcctgagcgggccagtaatgcactgacagagctcgcagtggcgctggcaagtgggcaatacgccccggcagaggcggaggtgcggctcctgctgggcgcgcgtgggaccgacttcgaggcggtctgcgcggcggccgacaacgtgcgccggcggctgcatggcgacgaggtcacctacgtggtgaaccgcaacatcaactacaccaatctctgcgcgtatgcctgcggcttttgtgccttctccaagggaccgtccgatgcaaggggaagcccatacctcctgacgaaggctgaggttgggcggcgggttgccgaggcgtgggctcgaggagcctcggaggtctgcatgcaggtgggtgctgcaggctcagggttggccccaaaggggggatctttcaagggggggagagggaatccgtggtttctctgcggattatcggagcgtagggcaacgtga

SEQ ID NO: 1655 - DNA, 2148 bp, Chlorella protothecoides
atgggcccgtctgaggctgcgggcctgctgagggccggctgcaacgacatgggaggggtgctgatgaacgagtccatcagcagggcggccggcgcctcccatgggcaggagctgggcccacaagccatggatgatctcatccgcacagcaggtagagttgcatgccatgtttgggaagattgcagggtggggcagcattgcatcttaggagtcgcggatctcactcgagtgcgccagtctgatgcttgccactccaacctacttcaaggtcgagtgccacggcagaggacaaccctctatggagtgcctccgcggtcccaagtcgagaaagcatacgctgcgacaccgctgatggcaagcactggaaggcgctctaaactgactgctatagattcacaatccagcatctcagctctatcgttggtgtccagaaggttgctgcccaagctccctgaattaagcacacatggagtcacgtcacccaaatcggagcgatgcgggacagttagaatgaatccaggttactgcggcgggtctctcgctcatcggtgtccgcgatgcaccctcctctctacaagaacaagcatccttcttgcattgaggtgggaagatgacaagttcttgctgtggagcctcggtgggttcttcccgggcccggtgacgactgtccgacaccatgcactgctcgcagggtcattgacgcgctcaaccgctgccacaaggagaggagcattgccaagttctggggcgtgtgcacagatcagaagcttgctctggacgcctgcttccgccaggagaagaaggacaacaggtcggtgtctgggtatgacgtatggcagactctttatgatgcagctccgccgtgggatgcagtcttcgtcgtgcgccatcgtcatgcacacttccttggcatacttggaccctacggtcactcattctggccgagcgcgagcgcctggaggtcaagatcgggactggggctgcgacgcccggctacggcgtgaggagccagcacgccgagacgtgaccatgcatcgttcctctgtgctggacgcctatgtggcggggtctggtgctgagaaaggggagaccgacgacgtcggcgctgccgccgcgaggcctgtggcaggcgcgacgccgccacaatgtccgtctgctgcgggaaacgagggattggaggatgcacaagctgacaaggacgagctttggaacgcaagtgctgggccaacacaggtgcaaagcatcccctcgcatgcccccgttgagcccgccgccgaagcgctgcccggaccaaacagaacgggagatcccacccctccgccggcgcgccggccccgggtgctgctggcagttaccggcagcgtggccgccatcaagaccgcgcagctggcgacatgtctgctggcctttgcggaggttaaagtggcggtgacgcgcggggccagggccttcctggagggcctggagctccccggcagttgcctgccgctcctggacgatgagggcgagtggcgggcctggcatggcgtgggcgacccggtcctccacatcgagctgcggcgctgggccgacgtactaatcatcgccccgctctccgccaacacgctggccaagctggccgccggcctctgcgacaacctcgtcacttgcgtcgcgcgggcctgggactttcgcaagccggtcctggcgagtccttgccacccacaagagaatgccaatgccctcaccccaccgccctatgaagctggcgccggccatgaacaccttgatgtgggacagccccttcaccgctcggcacatgcacgcctgtgccggcctgggcatgcacagcatcggccccatcgccaagcggctggcgtgcggggacgacggcacgggggccatggccgagccggccgacatcgcagaccgggggcgggcgctgctgggcgcgtgagcctggctacggcgctgaatgctttgcgcggggccatgtgctctgcttcattgccagccattgttgcgctcggttgctggtctgcctggcatatgcagggcgtcatgcctggcagaatgaatggtttgcactcgaggaatggtggtcgaggggttgagaggcgaggccgacaacaggaatgcgagcaaggggtccagcagggaacggggtga

SEQ ID NO: 1656 - DNA, 828 bp, Chlorella protothecoides
atgggtggatgggcttggagaccatgccgagcatgtcagggcatggagatctggtgctcaggtctcggagccgcagtgatgcaacatgttgggcctggagcatgcatgtccccggcctcgtcagcccactgccccagccatcttgcacccacacaggacttcactgctcggatcaagaagtacgaggcgatatacgaaaccatcacagaccgccgcctgcactacatcaagctcatagacatggtcacaggtgaggaaggaatcggcggcgggggaggagtgcgatgtggcaggcttggggcgcaggtatccattctcatggacaagccgcctggtgcgataggtgccaccgccaacccgagctcccagacgctcgatccaacgccagttgctagatccagcgccatgcactcaggcccacccagaagctcactcccacaggctcctccacaatcccaccatgcaggcaaggggtacatggacgtgaaccgtatctccggctacattccgggcaagatggtcttcttcctcatgcaggtggggggtggccattgcagcagtggtggtttgcaagggcctgggccagcgccgccgcatctggctcacgcggcatggggagtcggagtacaacaccatgggcaagatcggaggaaacagcggcctgagcctgaggtacggggaaagaaaggtactgggtgttttccagcagggcaaaagccggctgtgtggctggggcgtcactccttgagtgctttcaatgttctgggtcaagggctccctcatgaagaagaaccgcccatgtctcggtgtcacatgtgcatgttttga

SEQ ID NO: 1657 - DNA, 2067 bp, Chlorella protothecoides
atgtatgtgcaggcctacggcgactggcattcatggcaagccttccacactgaactggaggaactccttcttatctcatgtcgtgcaaatactgcaccaccagcccatctccaagcccaggctcgtctcccagtccaaccccgtcccccagcccgccaccgaccacctcgcccagcccctcccctgtcccgtcacccagtccttcgccgagcccatcacccagcccagcggcatcctgtgtcaacgtggtaccaccagacgggtacagctgtgcccagcacgtcatctggggccattgcaggatcatggtgcgtgcctccatgtcctgtccaagctgcagctggttgcaccatcgatgcacataccatctcgcccattgggcccccctccccacaccctgctcgcagccaaacctggatgatcgaggggaactactgtgccaggtcatgcaaatactgcagcaccacctcgccgtcgccttctccctcacccagcccccccgcctcgccctccactgctgcgcggttgtcaccctgcacggataaccctactccagatgggtacagctgcgcccagcaatcaggatggggcaagtgcagggccggctctcgtcatcctcgcagcgcgacatggatgctggatgggaactactgcgccaagacttgcggccgatgcacgacgccctgtacggacaacccgacccccgatggatacacctgtgcccagcaatcaggatggggcaaatgcaggcacccatcctcgctgctccctgcagtgctgcctggctgctggatggggactactgcgcacagacctgtggccgatgcacgcagccgtgcacagacgtgcccccttccgctgagtacacctgcgctcagcaagcgggctggggcaaatgcaggtgggtcgggagcccgagcatggtggcagcggtgccgtggtgcccttggcagggactgccgcaggagcaaggcgctggtgcgagtctctccctactgtgcccgcttcctctcacacacctctcacacccctcccctaacacccagtgagtcattcatgacgagcggcaactactgccagataacctgcggccggtgccccacagccagtccctccgccgccgcaaactctatcctggcgggctcggtctcggagcagtcgccttcaccctctgccttcgcagcaccgtcgcccgtcgcgttcgggcctccgccatcgctggaggaggacagcgtcgacttcttcgaggacgagccgccccagctcatcagccagcggttgtcagcaccccttgctcctgtcagccagctgccacctgcggaggaggaggacactgatgccttcctgccgcctgtggcgcccatcactctcaccgagcagtctccggcagccgtccccgacgaggtccttggcgggtttgaggaggacgacgagtcagacctcttcatggaggacaagccgttggggcccatggccgaggccgtgacagggttggaggtggtggcgatgccccccgtgctgaccggcacctggccctccccggcgcctgccggcggcgcagccggcgccccggcctccgaggaccagccggaggtcgaggagggcttcagcatcgacagtgtggtagtgccctccccgcccctcacccagacccaggtcatcatcaacagccaggtgccggaggccgcctccccgcccgccaacgcgtcgcaggcaagcggcaccggctgcgccagcgacacgccgcccccgggcctgtcctgccaggacgtcaagttccaggggctatgcatgacaccggccatcctggacgccggcctctgctccatcacctgcggcttctgcgcccccagcccctcgcccctgccccccatggcccccaccgccggcaacgattcggtggtcacagactcggcgcggtcccccaccttggtgtcctcggcgctgaaccgcgccgtcatcagccccggctgcgtcgacgtcgcgccgcccggctacgcctcctgcgacgtgagcgctgagtggtggatgattttttgtgaaggatggaggggaggacctgggtga

SEQ ID NO: 1658 - DNA, 672 bp, Chlorella protothecoides
atggacagggtggtgccgctggcggggtcggcgccgccgcctgtggcggtgtggacctccaccctggcgcgcaccatcatcaccgcctcagggctgcccttccccaaggtgcagtggaaggcgttggacgagatccaggcggggatctgcgagggcatgacgtaccgcgagatcgcggcgcggctgcccggcgagtacgagctgcgccggcgcgacaagctgcgctaccgctacccctctggcgagtcgtacatggacgtcatccagcgcctggacccggtgatcagcgaggtggagcgggagcgggagtgcgtgtgcatcgtggcgcaccaggccgtcctgcgcgcgctgtacggatacttcatgaacaggccgctggcggaggtgcccagcctgaacatcccgctgcacaccatcatggagctgacgccgcagcccgacggcaccatggccgagacccggttcgaggtggacgtggacctcgccgcggcgagggaggggctggcgggtgatggcggcggggaaaagggcggcgaccaccagaaggctgcccgcggcatgccgcgctccgcctccctcgccgagctgcgcgccaagtcctttgtgcgtcagctcgatgcgtttggcaggctcagctccgactccgacgacccgggcaggctcatgccctga

SEQ ID NO: 1659 - DNA, 1203 bp, Chlorella protothecoides
atggcgctccagcctcgcccacagcagcacgccgcgctcctaggcgtaggccacgccggcgggcgcgccgaccaccctgtgcaccgccgccacgaccttctccggctgcacgatggtggccgcctccagctcgtaggcgtaggcggtgggcacgtcctgggaggagaggcgcaccacctcgtggtccaggtcgttgaacagcgactcgtggatgaccgcggagagggaggcgccgatgccgccggtcttcatgcactcctccacgatgatggcgcggcgcgtcttcttgaccgaccggctgatggtctgcatgtcgaagggcttgagggagatgaggtccaccacctccgggttgtacccctccttctccagctgcttcaccgcctgcatcaccacgtagcgcatgcgcgagtagcagaagatggacacgtcagtgccctcgcgaactatctcggcgcgctccaggcactgggtgtattcggggccctccacctcgcccttgacgttgtacagcagcacgtgctcgaagaagatgatggggttgtcggagcggatggcggccttgagcagggccttggcgttcttggcggtggacaccgccacgagctgcacccccgggatgctctggaagtagctctccaggcgctgggagtgctccgcgcccagctgccgccccacgcccccgggcccgcggatgaccatgggcaccttgaactggccgccgctggtgtagtgcagcatgccgcagttgttggagatctggttgaatgccaggagcaggaagcccatgttcatgccctccacgatggggcgcagccccgtcatcgccgcgcccacacccatgcccatgaacccgttctcgcagatgggggtgtccagcaggcgcatgtcgccgtacttcttgtgcaggccgtaggagaccttgtaggagccgccatagtggcccacgtcctcgcccatcaggcagaccgtggggtcgcgctccatctcctcgtccagcgcctcgcgcagggactcccacatcatcagctccttcttggcggccgccgtccgggtggaggcgcggttcaggggcccggggcctgcgcgggtgacagattgagggtcggggtgggtccagatcgggggcagggggtcgtaggaagctggtggcgcaccggcgcgcggtccacggagatccacgcaccccgacatcacctttga

SEQ ID NO: 1660 - DNA, 1473 bp, Chlorella protothecoides
  modified_base (190)..(199): a, c, t, g, unknown or other
  modified_base (967)..(976): a, c, t, g, unknown or other
atgggcatcgttctcacccagctctgcctctcctccagggctgcggcctcttacccgcactcccaccccatcacgacatccgttgccaccaccactcacgcagcccgggagcgcgctgggcggcgcgctgtccgccggtcccagcgagcgctttggcgtgcgcgcgacgtcccgcttccccttcctgcgnnnnnnnnnncagtgggggttgctgagtggaaaaggggacctctgaatgcgtccctggggatgctcggccacgcgagcatggctcagaggagtatcctctcacatcttgtgagccgcctcaggaggtgggcatctttctcacccagctctgcctctcctccagggctgcggcctcttgcccgcactcccaccccatcacgaaatccgctgccaccaccactcacgcagcccggcagcgcgctgggcggcgcgctgtccgccggccccagcgagcgctttggcgtgcgctcgacgtcccgcttccccttcctgcagcccgaccgggtgcgggacgcggaggggcgccgccccggcgaccccggctacgaccccaccaccctcttcctgccccccacatggctgcacgacgccaagatttccgagggccagcgtcagtggtgggccttcaaggcggccaactttgacgcggtcctgctcttcaagatgggcaagttctacgagctgttcgagatggacgcccacgtgggcgtggagctgctgggcctgacctacatgaggggggagcagccgcacgccggcttccccgaggccgcctacgcgggtatggcggccacgctggcgcgcgccggggtcaaggtggtggtcatcgagcagaccgagaccccggaggcactggccgcgcgcaacgagaagcggcgccagagcggccagaagaagatggaggagcagagaaggacgagggatcggaagcgatggtctttcgcgggggcggccgacnnnnnnnnnntgttttggtgcatgtgcgggagagggggagacggtggagggacccccggaggggcagcatgcagatggaggagtggagaaggacgagggattggaagcgatggtctttcgcggggacggccgaatgctgcatggggccttctctggggcaccacacccatgcgcatgctcccagacccactccagccgtcgatgacctccacggccgccacatcaaaccctccgccccacccccacacatgcacacccaccaccgcgcccctcgctccaggtgaacgtcgtgcgccgcgagaaggtggcggtgctgacgcccggcacgctgacggacgcggagatggtgtcctccaccccggaccccacctggctcctggtcctggtggagctggaaagcacggcgaccgcgggcgtcgctcacgacggcccccccgggcgcgtgccggcctcgctgcccggcgcgtcgccgggccccggggcggcgtgcgaccccctggcctcccc

SEQ ID NO: 1661 - DNA, 975 bp, Chlorella protothecoides
atgtctagctccaaaaagcctgtcgccatgggcagtggacagaggtccattgcctcattctttggggctggcaagcgctcgagccctcgcttgaagccctcccccagcaggcagaagggcagggccagcccagccagagccttggacctcgaggccgggtctgagccaccaacagccgcagcgaccgcggtgaccactgggtgcctgcagccgactcccaaggcctcgcctcctgcgggcgatgcatcttcgcagggcgccgcgcctgcgccgggcgcccgggccgccaagcgcaacgcccccccagtctgcgagggccagcgtctgcgcgtcttctggccggcggagaaggcctggttcgagggccgggtaggcgaggtgcaggagcgcaagggcaagcggcgcgcctacgttgcctacgacgacggagatgaggagtgggtggacctggagcgcgaccgcttcgaggtgctggagccgggcaggaagcgcgcccgcgccaaggccgcccaggtactggactctgactccgaggccgagccctctgcctcccagggctccgaatttctggccagcgaggaggagggggaggagagcgacgacgacagcgtgagcatggccgccagcgaggcagaagaggagggcagcgaggcggagagcgacgtcaaacccgcgcgaaagccggcgggcggcaagactgccagcgcggcggcaaaggcctcccctggagccggtgctgctgcagggagaaagcgggtgtcctcggccaccacgcaggcgaccccatgccccgcatcgcagtccaagggggggctgcccccggcgaccccagcctccggtctgagaccagctgcaaggaacctggcggaagcccttgaaaccccgagctttgccacgccggccacctctgggccggccgcgacggtgaggggtgctgggcagtgggggttgctgagtggaaaaggggacttctga

SEQ ID NO: 1662 - DNA, 486 bp, Chlorella protothecoides
atgcatggcggagcgcgctcggtgctggcatcggggccgccgcatggcgctggagaatgccggacccccgaccggctcttgaagggtccttggcgtggtcgaccatctgtgcatggccggtcatcaacgcaggccagcccccaccccggcgacgctgccggcaatgatgcgggctcgggcatcctgtccgtggacgaactagatcggattgcgaggcacagccgtcaccgcctcacccagtgcacatcatccccagctgcgttctcccatgcatttacacgcaggggcctcagcatccgcttgacatcgcttgggcccgcctaccgaatagcatgccgcgatgagggtggtgccatcctgggagtcacccagggtttcaaggtgcccctcttcccaattctgcatgcggacaccatgcaagtccagcgtccccgccgcatgggagcaggtagtttctgggccgtggtggaattgctgcgctggtga

SEQ ID NO: 1663 - DNA, 285 bp, Chlorella protothecoides
atgttccctttggctgcctcgttcggcggctactacgccctgtacgtggcggttctgactgcgtcagtccgcctggcggtgttcctctcctgcctcgtctccgcggaccggctcatcaacatcagcaaatttgtctacttcaagatccgtgccaggctgacgggccacctcccggagcacgactgggccttcccagacctgccccatgaccccgctgcataccccaaggtaggtggacgagggactctggggggcaggtctgtgctagctttccgtccaatgtga

SEQ ID NO: 1664 - DNA, 453 bp, Chlorella protothecoides
atgcaggtggaaaaccagccggcgggccggcacccaggtggagaaccaggcggcgggccggcacccaggttcaagcggcaaggcctgcacggcctggggctgctcctgtttgtggccacgctcgcccacgccgctgcgtgcggctgccagcgcatcgagatgctggccatcaacgacgcaggagcccggccaggaccggaacatcacgcatatatggaagacctttcaggccctgcccgcctgcctcctgcagaggacacgcatgcccgcctggtgcggtactaccggcgcctgggcttcgtggcgcgcagggacgtccgcggcgagcggctgtcggatgtgccgcacctgctcgtctggggcgggcgggggctgcgcatggacggcgacgtggcggccctcacgcggcggtgggccccagtggtgagggccggggcccagtccgaggtgtga

SEQ ID NO: 1665 - DNA, 222 bp, Chlorella protothecoides
atgttcaacgagcgcgccgtgtgccaggccatcatcgactgctgctgcgagctgcactggcccacgcagcgcctgaagatccaggtgctggacgactccaccgacactgtgacccgccagctggtggatgacaaggtgctggaatggtcggagcgcggcctggacatcgagtgcctgcgccgcaccaaccgccagggctacaaggccggcgcaatgaaggag

SEQ ID NO: 1666 - DNA, 837 bp, Chlorella protothecoides
atgacggagtatcacacgatatacaaagggccggagggggagaccacacagtgggatgacatccagaggaagctgggcaatcgcccagaaaaggtgtgggcggctccgacgaccgtggacccggtctggaagccccaggcctacacccccgaagcagagccgacccgtggcaccgagcgcctggacggggaggacgcggaggggctggaggaggcggaggacgagttcagcgatgaccgcttcctggagcagtaccggcagcgcaggatccaggagctgcaggccagtgtctctcagccgcgcttcggcagcctggaggagatccgccgcgacgactttgttgcgcaggtcaccaacgccggggagggtgtctggggcatctggctgggcgtgtgctcccagctgcttggcatctcgctcccactcccccaccccccaacccgccttggagtaataagcagccccaccccctccacacaccacagcacgagggcgtgcggcatcatgaaccagtgcctgatggagctggcgccgcgctaccccgcaaccaagttcctgcgcatcgtggcgtcaaactgcatcccggggtaccccgacgccaacacccccacgctgctgctgtaccgggggggcaagtgcgagcagaccctggtggggctggagcgctttggcggccaggccaccagcccagacctgattgccatctcactgaaccggtttggggcggtgtgcggcgaccccgacgacgccgcggtggcggcggagcagctcgcgggggtggtggcggccgccgccgctcggaggggtgaaggcgatggggagggggactcggactga

SEQ ID NO: 1667 - DNA, 1422 bp, Chlorella protothecoides
atgtctgtgagatacccattccctaattacaccatcagcacaataaatccaactgatcgtgaaatctgcacgcccaccgcacctgatggaggctgctactttgttgcgctcgccatctgctatcccaagggagttgctacctgcgaggcagacccagattttgggaacacaggaaacaacaatgacgggatgtttaattatggaaacaacaatggtggcagcttcaatcatggaaacggcaacattggctctcacaacaggggcagcaacaacattggcagcaatatcgtatgtaacaattgggcgtcagatgctccatgcccgatagcaaacctaaaaacaactgagaccatcaccttggctggctatcctccaccccctcctcccccgtcacccccgccaccatccccgcccccctcacaatgcgtagtatgcagcggtcctgggacgattgtgttgggggaccctctccccttcactgttgagatcgtgccacccccacaactccattgcaacaggtacctgggcagcctctacctggcctcctcaaccgacccagacgcgtactgccggaggaaggggtacacagcagcaggatattgggagtcggtcatagtgaccccagatgcaccgttcagtcagttccagatcgccaccctccaacctgagacgctggaaatctgcacccccactgaagcataccactgtccagccctcactgtggtggagtgccttgccaagggagtggcgagatgcgtacaggatgcgaatgggaacctgggcaacggcaacgtgggatttcacaacatcggccacagcaatcaaggcagctacaacaggggcagtctgaacctgggagattacaaccgcggaaacgggaactgggggacgaacattgtgtgcaacgacttagtggctcaggatggagcacagtgcagcatagcggcattgaaaacagtggccactctggtcttgtacccttatcctcctccctccccgcccaatgtcccatccccatccccgccacccccaaatgtgtgcgactctcgcaatcccatcctggctctgcccacgatagagtacctgggcaccctatacctcgtctccgccactggcttagacacttactgccggtgggtgcctttaaactgggtttggggcccagactctagccaatcagttgtgcccccagttgcgagggcggaagactacatcttgaggaagggcatgcgccttctttatccacttccagccctgtactccttactgcctcacctttcccttccccccttccatgtggcaggaggaaggggtacacaggagcagggtattgggagatgctcaacgttgccccgggtgctccgttcagtcagttccagattgcctcgctccaccctgagacgatggagatttgctccctaa

SEQ ID NO: 1668 - DNA, 2598 bp, Chlorella protothecoides
  modified_base (370)..(379): a, c, t, g, unknown or other
  modified_base (639)..(648): a, c, t, g, unknown or other
  modified_base (818)..(827): a, c, t, g, unknown or other
  modified_base (1384)..(1443): a, c, t, g, unknown or other
  modified_base (1900)..(1909): a, c, t, g, unknown or other
atgccagcgagctgggcgagggtcgacgccgcgcccagccctcccaggcccgacccgatgatgatggcatcccagggcttctcctggggctgggggcagcccgcagcagtcacagcgacggcagcaccccctgcaaacttcattatggtctcatggaggtgtttctggaatgctggatcggtgtccgacccctacggaatgcaattgcgagtattcgaccgttcgtctatgcacagatcgccggcaaagcactcgcagcacgacttcgaaaacctttcccaccgggccatcgatctcgcacccgctgtgacaggagcaaggatggtccagggatcaaggatagcatgcgtcgatttcaaactgaaagttnnnnnnnnnnccaccgggccatcgatctcgcacccgctcatctggcctggatcggtcgggcccgttcgccgaggtctggacctgcgacactcgaaagcatgcacgcggtttgctacagcttccaataggaatgtcgatcctcgactcgttcagcgaggcctgtgtgcgacaggaagcctgctcggatggccgctccctgccgtggctccgaggcctgctgtcctacagcaggactggcaagcttacagaaggccgaagacctggcctcannnnnnnnnngtggctccatgtgctgtctcccacgcattgcatcccgttgagtgcctggggaaccattcccctgcagtgcagaaggccgaagacctggcctcctcagcatgcagcatcacaggccccaagctccccgtgctgcagggttgctgcggcacaggatgggggactcctcctcnnnnnnnnnnacaggccccaagctccccgtgctgcagggtcgccgcggcacaggatgggggattcctgctgggcgacgtgagggaggagctggcggtccaggcgggccaggcccaccgcgaccccgccggcccccacgctgccgtgcacctgcacccccacccggccctgggcgtggatgtgcagcacctctcctgcagcccctgcgggacgctggccgcggtggcgggcacctcccgcgagaccccggagctgagcgagctgtgggccgtcagcctgcacgcccccgccgtcccccgcgctggctcggcgacgcccccgccggcctccgcggtggccgtcgaccggggtctgttcgccgcgcgcccgggcctccgcgtgctgcagctcgcctggcacccgctcggcgacgggcacctggcggtgctcacgtcggacgccgcctggcgcctctactgcctggacgagccgagcgtgccggagcagactctggagctcagcctgggcagcaggtgtgcttcaagcgctgagtggacaggggatcaggcaagggcctgtgtactggcgnnnnnnnnnnnnnnnnnnnnnnnnnnnnnnnnnnnnnnnnnnnnnnnnnnnnnnnnnnnnctgtggcggctgccgccacagcgctggcagacagccacacccctctcccaacatggcatcaatcagtgcacgcactttgcctgcctgcagccgatccctggatctccaccccattcattcgctccctccttcccatgccaggcatgctctggggctgggaggttcggcggagcgcccgacagcctttgcgtttggccctgcagaggcctgggacaggtttgcgctctacttcctctccaaccgcagcaacatcttccgcgtgccgcctgggtggtgacccggggttgcggtgccgctcctgtcctgggtttcgagtctcaggccgtgtcccgatttcacccgagtgttttgatgagtgttttgctggggctggggttgaccagcgtccctgctgcatcaggcacgtgcggccatgggtgtgttgccccagcctgcatcaccgcaaggtcaccatccnnnnnnnnnncgtgcggccatgggtgtgttgccccagcctccatcaccgcaaggtcaccattcccccgtgccggcaacccaccaggttgtcgagtgccctccgccagcctggcggccctgggggaggacctcggcgaggctgacgaggccacgcactcctggctgcagcgtgcctttgctgcggggacccggtccggggtcgcaatggcgcagcgccacgccctgggcgcccacgtgccggtcctggtggggccgctgagggtcgcgaccccgggggagggccccctgccggccgggttcgccggcctctggggcgattccggcgccgtggccgaggacctgctgctcgccaggtttgcgccggggtgcagcgcaatctgcgttgccgccgcgagcggcggggtcgcggcgggcgtgctcgccagccccgcgcgccccgcctggcaggagggccggccccagtgcctggcgggccccggcggccgtctggacgcggtgcggtcgcagctggggcccgggactgcggaccccggcgaggggccggggctgctggtgctggacctgggggagcccgccgggcggagcgtgcgcctgctgggcgacgccgccgcccgagaacgcgtccacgtgctgctacgcggcggcggctgcttcgcgctggacctggcctggctgccgcgcctggcggcggacgcgggc

SEQ ID NO: 1669 - DNA, 1377 bp, Chlorella protothecoides
atgacccatcagtttcgacgccccggaggccactggttcacctgcggcacccactacgtgggccagatgggggagggggatgccatgcgcgaattcatggactttgtgactgggggcgtcgtctgggaccccctccccgacacctttgacatgttctgcttcaagtcggatggcgcccagttctcgcagcccactggcgccaaacgctggatggagcgcctcatcgaatccttccccgctgagcagaaggcgaggaggccggtgggcatgcagagcggcatggagtccctccttgccacaggcagggccggcagctggcaagggggtacaccagggtcaccaaaccctctgcctgccaccacacaggccattcggcgttactttcgcgacatcaagcgggtgtacagctggtaccgcttctacttcctgtcgaggagcatgggccggcccttcagcagcatcctggcgacgtgtacggctcccaggcggcgcgcctttgcccagcagacctgccagcagtacatggacggcgctttcagagacaggcggctgattggcgtgctgtgcgcgctgtggggtgactatgggatcaggcccgacttggtgaccttcatgcagcatgccctggtggcgggcaacaactttgagggtgcgcaagtcgcatcggaaggggccacacggctggttctcttggctctgcaccggcttcggcttggcacatactacccgcgcctggggtctcgagccctggccaagggcgcactggccctcatcagagccaagggtggggagatcctgctctccaccagggtcacacagatcgtcctggacgaggcagggagggccgtgggtgtccgggcagtgcggggaggaaaggagggcgtgtaccggggccggcacatcatctcaggtgtgcgctgccgcgtgctggacatgtgggaaggactgggtgggggttgttcgaggcgatgtactgagggcagtcgcaggtcaacacagtccttggaaacagcgcttttaatgcctctggtccatcaccttatccacacatgttcatccaaccatcctcacgagctgacagcgtctgccgccccaacattgccccactcctgtaccctccccagcggtcggggcatacaataccttcaggaccctgctgccacacccactgcacgattgcttggcagacaccaggctccagcatgccgggcatgccgtgatctcgatctggctgggtctggacgcctcaccgcgggagctgtacggcatgcacggcgaaaaccgctggatctctgcagactaccgccattcgcaggcccggctttacgatcccaaggtgtgtgcacggaaatgagtgagggagcactggctgggtga

SEQ ID NO: 1670 - DNA, 2232 bp, Chlorella protothecoides
  modified_base (359)..(368): a, c, t, g, unknown or other
  modified_base (984)..(993): a, c, t, g, unknown or other
  modified_base (1243)..(1252): a, c, t, g, unknown or other
  modified_base (2058)..(2067): a, c, t, g, unknown or other
  modified_base (2180)..(2189): a, c, t, g, unknown or other
atggcaggtatagaggagccccttgctggcgaaagtgcagaagtctggcgtgtccctgtcaaatcaactgttcttggcaccatcaactggctctgcacacttttctcccacgaaccactggctcaggttcgcgaggtcacttacgcctttctcagctgctccgcgctcaaggaaaaatatgccggccatgcgcacagcctggaggtgtgcctgttcacggatcccgcgtacttcatggggtgggaggagcggaatgatgcagatggaaggcaggattatgtgcagacctgggagttgaggaacgtgggagctggaatgcacatcctacacctggtcctcaccaaccacattctaccagnnnnnnnnnnatcacaggtgcaggtgatggtttgggaactcgccaatgaggtcaagaagaacatcgtggcggatgccctggactttgtggaccagttcgtccctgggcttaaggaccacgtcatcttctcggagtaccatgttccccagcacatcaggccagtgcagcaccagagatcagccattttacccttccaccctggcgcatacctgccaggttgggacgcccgtcacctggaactctttctgcggctggccaggcggtaccatgtacggcgtccctccgaccgggcagagattggaggccgaagcggctcttcagcctcggacgtctgtggagaacctgtggcttgccggtgtgtggtcgttgatgcgtcagtgtgtcaagtacaggggatgcgaagccgcgtgtgccttgaatcctcggccacttacagatgggttggggtccattgtgttgtgccactatgggtcagtgcccaccatctacatgtgagcccatgcatcgaccccaagagcttgcctggatccatcgccctctgcctcggacatgagaacctcagccatgcagtccatcgctctcgcccccctccatgtccatcgcatcgccaggctgcgacgccaatnnnnnnnnnncatgtcaatccatcgctttcgtcaccctccatttccatcgcatcgccaggctgcgacgccaatgtctttggtctggctggtgccatggcgggtggggtgatggccgcaggcctcatcttacacccgcgcctggggtgcctggctgccctgcccgccatgcgtcgctgcatgcgtcagcctggtgagggactgctgacgggagaagaggctgccaaagttcatgcacgcatccagagggtgtggcatgacnnnnnnnnnntccgcgcctggggtgcctggctgccctgctcgccatgcgtcgctgcatgcgtcagccagggtggggcctgccagtttggccagcagatgcgatcccccttagactggccagtacatcaccctgctcatggcgatcgacaggtgcgagtagaggaggggtgctcagttgttcgaggggtcaatctcaatgtaagtcctgcaccactgctcctgaacataagcgactgccgcccaggccccatgcatggctcaaactcagacggacccgcctcccattcacaaaaagacagagtggaggtgaggaggtcctactcaatctcctccctccccctcgccctgccaaagctgtcggtcaccatcaagcgcgtcgccgggggggtggcttccccctggctcctggacaccctgcagctggggtcaaccgtgcatggcctggcgccacagggcgactttttactgaggggtgctgcagcatgcaagcccctaggtcggagttcggagcccgcggtaatgccacccagtggaacctctagagacaggtgcatggggtggcgtggtcctcgttccagtcaggggcgggagcatgggcgccacagagtgtgcacatgccgccacacagacagctccgatctgacccgccccaaaacaccctacacggcaggatcaacgctgcatcaaaccccatgcacatattcatgggagcaggcagcgggctcgcccccctgctgcccatgctggaaacggcgctgcagctcggccaggccgttgcactgctgggttgccaccgtgacgcagaggaagaggtgnnnnnnnnnntcgccacacagacagcttcgatctgacccgcccccgaacaccctacatgtcaggatcgacgctgcatcaacccccgtgcacgtattcatgggagcaggcagcgggctcgcccnnnnnnnnnncttggatgccgcactgcggcactgcaggccaccggccggctga

SEQ ID NO: 1671 - DNA, 927 bp, Chlorella protothecoides
atgcaccagcgggctcaaatttcggcgaggggtcgaggtcgatcctggctcagccgcctggcctggtccctggaaacccctgccccacccacccgacccccctccccccgcaggacccatcggggcagcggggagcgccaggtgactctggaagacctcaagcgtgtggcacacctcagccaggagcgtgcagcagccgccctgaacgtgggtaacacccgcttcaagtcagcctgtagggagctgggcatgcggggctggccataccgcaagatcaagtcggtccggagcctgctgtacgccatccagaaggagccagactctgtgcacccggacatctggcctgcgatcctctggcgtctggaccggctggtcgaccaccacttccacaaccccaccgagcccctgaccgaggagttcaaggtgctgcgccaggcggcatacaagcggaggcacggccagaagcggaggagcggcgacggcgccgccgcctgctccagctccgagcactgcctcgatgaggacctaggtgccgcgatgcctgctgggcatctgccggtaggccaggccccgtgcacggggtaccaggcgttcgaggactcggcgcagtcgccatgcaccccccccaacgccagggagagggccctgcgcaggcttggacccgccggtgaggtcatgcaggagggagtggcggagtcggggcctgggctgcgtccagagcctccctctgccgacgcttgtccgcacgccggccaaggggtggcagggacaccggtgtgtcagctgctccctgccgcccttccttccccatcagcacccgacctgtggtgctcgctgacgtggaccagcggcctggagtttgcacctgagcccaacgaggcccgtgaggatctggaggatgtgtacgctcagaccgcatcctcctga

SEQ ID NO: 1672 - DNA, 216 bp, Chlorella protothecoides
atgaagtttgcagggggtgctgccgtcgctgtgactgctgcgggctgcccccagccccaggagaagccctgggatgccatcatcatcgggtcgggcctgggagggctgggcgcggcgtcgaccctcgcccagctcgctggcatgcgttgcctgatcctggaacagcactggatacctggcggtgggtttctggctcgggatggggggccttgttga

SEQ ID NO: 1673 - DNA, 1023 bp, Chlorella protothecoides
atgtcgtgggaaaacagaacgacgacgaactcgcttggtgggtgtgcagacgaagtgcgtagcccaaggctgctcccaggagatagcacggggcattggactctgaggattcacaacaaacgccggagggacctcaattggtatagagagcgcgtcggtacccctatggggaacacctttcgacgcctgttcgatggcctgtttggcaatcgggagatgcgggtagtcatgctcggtgagactgagatgggggcggggatggcctcaagtgcatgcagcagtgcgatgctcaccgcgaacgcgcccttctgcaggcctggacgcggcggggaagaccaccatcctctacaagcttcatataggggaggtgctcagcaccgtgcctaccatcgtgtgcctggcggtgcaacttctgttttccactggatgtcgtcgtaccttcccttggtcccccacaacacaggcttcaacgttgaaaaggtgcagtacaagaacgtcatattcacggtctgggatgtgggcggccaagagaagctgcgtcctctgtggaggcattacttcaacaacaccgatgcccttatctatgtcgtggactgctgcgatcgcgagcgcattgggcgggcgtctgcggagttcaaggatgaatgcctggcaaagcatgtcattctgtcacaaggcaatctcaacaagttacccctcctgcccccacagcaaatcattgatgaccccctgatgcgacattctgccatccttgtctttgcgaacaagcaagacctggtgagagcttgccggcttgtgctggatcctgaaggggttgggcgaagtcgagcacctggagcactcactccggcggagacttgtgaggccatgggcttgccagccctcaagggccgcaagtggcatgtccaaggtgccatctccacaagaggggaggggctgtatgaaggtctggactggctgtcgggagtgctgaagacgctacaggcgggtagtgaaagggacggaaagggggatggagcatga

SEQ ID NO: 1674 - DNA, 510 bp, Chlorella protothecoides
atgttggctctccgctcggcgccggttggtgtcgtttcctcccggccagccttcgctggcaggatcagggctcccaaggcgcgtgtgccatcgctgctcacaccccacgctaccgccctcccagtcgagatcaagacggtagctcctttgggcgagcgggtggtcgtgaaagtggtcgaggccgagcagaagacgcagggcggcatcctcctgcccagcagtgcccagaagcgccccacacaaggggaggtggtgaacgctggcaccgccaaggccctcaagaagggtgacaaggtggtctactccaagtatgccggcacggaaatcgagctgcagtcggaggactttgtcatcctcaaggtgtcgttgggtttgcaggggcttgccatgcagtggctggggatcaggcatttgtttgtggtcacgcatgcctggaacatgctttactcaggtgaagtgccacagcatggtgccctccctcacctgcctggctgcctggcttgtgtgtga

SEQ ID NO: 1675 - DNA, 1689 bp, Chlorella protothecoides
  modified_base (876)..(885): a, c, t, g, unknown or other
  modified_base (1396)..(1405): a, c, t, g, unknown or other
atgcgtcttccacgctcgctcgcaaacatgcacgctactctttgtgagctttcaattcataacccacagcctgcccccctccctgcatcctccaggtcaaaggccgatgcagcggcgatagacgcggagctgatgggccccgtaccccacggccacccaccctcgcgtcctcgtcctggcgggcccgggcaacaacggcggcgacgggctggtggcggcgcgccacctgcgccacttcgggtacgaggtggccgtggcctacccgcgccccacacagcggccccccttccagggcctggtgacccagctgcggcgcgcgggcgcgcgcctggtgcccgtggaggacctgggcccggacgcccacgcctggcccgccgacgtggtgctggacgggctcttcggcttcagcttccgcggcccgctgcgcccgcccttcgatgcgctggttgccgcgctggcggcgggcgcgggagccgccgcacgggcgacgggtgccggggacgccgtgctgcgcccctgccccgccctcgtctccatcgacgtgccctccggctgggatgtggaggccggggacgaggcagggcacggcctgcgcccggacatgctcgtctcgctcacggcgcccaagcgctgtgcggcgcgcttcgccggcgcgcaccactacctgggcggacggttcttgacccccgacctggccgcccgctacggtctggccgacctgccccccttccccgggacgcagcagtgcctgcgcctgggcggcgcggcggcggcggcgacgaggggtggcctttccggctccgcacacggtggtggcacggcgggcagtgcccccgctccggcgcccgccccgccgaccacggccccgccgcacgnnnnnnnnnnggtggtggcacggcgggcagtgcccccgctacggcgcccgccccgccgaccacggcctcgccgcacgccgacctgcccggcatgcggcagagctacacggcggggactctggaggaaagcgacgcgcccgccgacccgctggccctgttccagcgctggttcggcgacgcgcgcgcgcacccgggcgtggccgagcccaacgccatggtgctgagcacgctgggcgcaggcagcgcccccagcgcgcgcgtcgtgctgctcaagggtctggactcgcgcggcttcgctttcttcaccaactacgccagccgcaaggggactgaattggatgccaacccagccgcggcgctgaccttcttctgggagccgctgcagcgccaggtgcgggtggagggcctcgcccgccgcctccccgccgccgagtcggaggcctacttcaacagccggcctcgcggtagccagctgggcgcctgggccagccgccagagcgcgccggtggcagggaacggcnnnnnnnnnnggaggcctacttcaacagccggcctcgcggcagccagctgggcgcctgggccagccgtcagagtgcgccggtggcaggaaacggtcgcgccgcgctggacgagcgcatggcggagctggaggggcagtacgccgacgagcgagagccggtgccctaccccgagcactggggcgggtttgtgctggagccgcacgcgctcgagttttggcagggccggcccagccgcctgcacgaccgcctggtgtacaaacggcggggcggggaggagggcggatggaccctga

SEQ ID NO: 1676 - DNA, 2373 bp, Chlorella protothecoides
atgttcctgccacacaagggccagatgccggcgaagttgagtgccttggtgacaaaacagcctgctgctcccacgctctgcagagggaggagggcaaccctcggccccaggctccaacagcaagagaaaacccctgggggtcacagacgaggcgacgcagtcgatgcgccgcgccttccagctccggcatcgcggggtacggcgcaactgggacctccccagcgacttcccatcaccggcagtgctggaggcgtacctgtctccgcgtctggacacctccagagacaggctgatctccatttcaccatgccccacgagtcagaggctgatctccgtttcaccaaaacccacgcaaaacccttcgtccctgcccctcccaggttcctgtttggaaggccggacctggcgctgctgaggagtctctgcaccgccaggttggagtggaccccggtgcaagccgacgagctcctgctcccggtcctgaaggcctgggacgagcgagaggtgggtgggtggactcggatggtattgaggggagggcgctggctgcaattgtgctgggcctgggcggggggctggctcatgatgagcatgccggctcatcccagcccgccgcctctctcatgcccctgcagcatgtcctcacgttccacacttgcagcaccagcaaaccctggagccgttccttgctttccggaagcggtttgcgaagatccagtccaagcgactgcagcatgcggtgcgcgggattgctgggaagacgacggcagagttggagctggcagggagtccctccgcagaggccgggacagcgaggaagccgagggcagccaggtcccgggcaaagacagccaaacgggcccagtctgccgtgccagctgcccaggcagggcaagtaggggcaagcaggggcaacgaggatgtcagggcgccagcggagccggggaggatccttccaccaacagcacacagctccagggccagccccacgccatgcgcagcagggtccagatcacttctcgtggtggacgcatcgcaggtgcaggtgcagcccccgacaccctgtgcaagaaagcgatagatcgtgactttaccgacgtcacggagaatgaatgggcatcgcctcccctcgccaacccagggggatgctctttccagcgttcgcctgctggtgaaccaggtcgtcacgagcaccgacaccaaggtttttttgcctcacagcaatcccgcgcacctcgccacccacaacagagcgccggggctgcgtcctcccagctgatccagctcctgagcagccccgcatcgcagcatggcagcctggatgccgtgctgctggacctgcagcccctccttgggccgggaaacgggaacccatcctccacgctcctggatgcccactcggggctgggcgccgcctgcgccgcctgcctcgtgcagcgcatccgcgactcccccgccccggaccaggccctgggaagccttctgcgggccctcccgcggcccgccgccgcctccctcctgcgcggcctgggcctcgggtccagggccgtcaacaccagctggggcgaggccgaatggagggcggcggcggcgctcgccgcgcgcggcgcggccgccctggacagagaggaggccgggtgtgtggcgcaggcagccgcgggcgccctcgacgccgcgctgtcccccatcctgctccccgcctcccggccgcgcggggtcgccagcccgatcccacccacgccgcaggcgacggccgccatggccgccgtgggcgcggccgccgccgccgcctcgggctcgctggaggcggaggagcgggtgctggccctgcacggcgccgcaatcctcggctgcctggccgccgcggccccgctcgtgtttggcggcagggcctccaccgcgctgctgctcaccgccgcgggcgtggccgcctcgctgcgcgtgaccctggccaggaggggcagtggggagggggacccggcgacggaacacccagccagcgatggtgcagggcacccttccatcgtcactgaaggccccaggcccctcattggggtgcacgatgcgcttgctttcctcgcgccgctgttgaccgaggcgcagcgcgtggccgccgccgagctgcgcgccgtggtcggcccacgtctgggaaagcgcgccgcgctggaggcgctgctggacgtcgacctgggcgtgcccctgacgcgcggcggcggcctggacggcgcgggcggggggcttcaggcttcgcgccccgcccacggcctcctgctggcactggcggaggtgggggccgccagcctagccgcggggtggggcgcggggtgcgccgctgcgctggcgacgctgctgcgccccggcgcttcggggggg

SEQ ID NO: 1677 - DNA, 930 bp, Chlorella protothecoides
atgggtgtgaagaagctctgggatttactggagccgtgtgggtgccgcatcagcatcgaggccctgaccggcaaacgactggcagtaggcgcaggcggtggtcgtcagcacttggcaacatgtgtcgcatggctgcctgcctgcacctcccacgccccaactccactccgaccccccttcccccactggacagatgcatctgggtggctatttcagttcatcaaggccatgcgagacgagaggggggacctcatcaggaatgcacacctggtcggtttcttccgcagaatctgcaggctcctattccaccgcatcaagcccgtctttgtgtttgatggtgccccccccgccatcaagaggatgactgtcattgccaggcgcaggtgttggggctgtgctgggggtctgcagcctcgatgggtttgcctgcccggccaggaccaggccaggagggtccaggagaagcactggccatcacacatcgctctcatgctcatcatgcatggcacatccccatccaaatgcacgccccccccgccctccaccgccaggcagcgggagcagcaggatgcacggctgcgacgcaccgcagagaagctcctgctgaaccagctgaagcagcatgccctcgcccaggtcgcctcgcagggagggtctgatgtcctggcgcagatggctggtacacagaagtccaggggcacgaggcccgaccccttccaggaggtggtcgtgcaggacactgatgccgctgcaggagggcgcgccgctggcgcccagccccacgccgtgccggcccagtgtgtgcccgagggacctgctctgggggcatcggcaccccagcctggcgaagttgagcaggagctggaagcccatctggacctggacctggatcagctcggtggcgtggaggtgagaggactggcgggctga

SEQ ID NO: 1678 - DNA, 2313 bp, Chlorella protothecoides
atgctgaagctgcgcgaggcgcaggtcgtcgcgaatcgggagaaatttgccgctgcgcaaggagcccccctggccttttcccaggtccagatggcgcaatacctgaaggccaccgcattccggtgtgtggaggactggcagggggccgagggccttggagcctgccctgctgtgcacgaggagggagcctgctgggcaggctccaccaccccatccctgcaaggaagcgtgatcccggctcgcatgtggctcgtgcgccaggtcaacgagatcaaggaggcggtgaacgcggcggcggggttgctgggcgcgtcccgccggatagcgggcgagcccgggcgggagtacgtcctgctgcgggatgaggaggcgctagacggccccggcgtcccgggggcccagggggcgtccagcccgccagagccctcggccgcgccggcctcctccgccgcgccgccgtcatccggcgggcccctgcccgcccaggacccattggtgctgactttcggggcgtcggacttggaccccgccacagacgcgagcgaggaggaggtcggctgggaggatgtggaggaggagccttcgctgccaggcatgctggcctctcccggaggctcgacggagcccgtccccgatgtgggactgcgggagcagcgcgatctgcactggcgggaaagggccgcgagacggcagcgcttctggagcctggcgcagggcttccggcaggggcgcgcactgagcgactggggcaaggccggcgacggcgcccaggggtcgtctttggggattgggcgcagaagggggtgtgcatggactgccgttccacccgtgtcaacgatggcaaaacctgcagccacggttttcatcctccatcacggcatcgcagacagccctgcgctgagtcccgggagggccgaggacggcactcgcgatgaggaggagcaggcactccaggcggccatcgaggcaagcctgcaggagagccgggaggcgtgggaagtcgccggcggcagcggcccaagtggcagcgggccggcgaggggcgggagggagagcggctgggtcgggacgcttcctcccgagacagcccttcctcctctggcccctgactgccaggcatcattcgctggagcatccgagacaaaccaggcgtcgcatgcgcccgcttcggggtctgaggaagactgggaggatgtcgccacggagcctgctccgcccggcctggccccttcccgggtcgcagcaggcgtgaacactgcgtcggaaactgagctgaacaggctgctctccggcgccagggcctccgcgccagacaagcccgggcaagggctggcagtgggcttgagtgtggagactgtggcgccgccgcatgttggagtgagtgccagcgcagagaagcactcgcctgcagaggagcttgtatcggcgattgcctccacagtcagcgccctcgctgcaggtgcccaggtcgaggcgatcttgacggaggctgggccgacgggcggcgtggagatccaggcgctggactccccatctggtccgcaagtttcgcccgagaagaaggccctggagaccaacacagcggggatcgtcgagggagggaaagctttgaacgccgtggcggctgacccactacagcctgatgccggtgagcttcctgccgacgcccctcaggcatcagcaatgaatcatgtgctggcggcggcaccccttctccaggaggcagtcctagcagctgcccaggcaccactggtcgaggactctgcgcccagccctgcagcggcagctgaggctgcagatgtcacagagttcttgggagacatggagccggatgcggaggaagaagaacccctgacgttcgtcgacgactttgggccgggaattgggccgggcgaggcggaggccggcctggaggcgctgcgtcacgaggcgttggggctgaggcaggcgcagcgtgcacagcgtggtcaggccgacgcccccacagacgagatgtacaccgagatccaggacatgctgcagctggctgaagcgtgcaggctgagttccctcgcccctcctttgaatgatgagtcctggtcctcctccgccacaccgatggctgctctcacacagatgtttggcgtgccctacatcgtggcacctggggaggcagaggcgcagtgcgcctggctggatgcggcggggctggtggacggcgtcatcaccgacgacaacgatgccttcctgtttggggctcagacggtgtacaggtgcggcgcgcaggggtgggcatgccagggagtgcgacctggggaatgtcatgattgttga

SEQ ID NO: 1679 - DNA, 1938 bp, Chlorella protothecoides
  modified_base (1410)..(1419): a, c, t, g, unknown or other
  modified_base (1652)..(1661): a, c, t, g, unknown or other
  modified_base (1814)..(1823): a, c, t, g, unknown or other
  modified_base (1903)..(1912): a, c, t, g, unknown or other
atgacagggcacgacggctcaggccctccgaggcgctgccctccagggttcccaaaggtgtgggcctcctttgtcgaggcggtggttgacacggctcatgccaacggccccgcggctccacggcgtgaccctgaagagacgatgcccctcctagatgtccctgcgccccctgccctcttaaacaacccctttgcgctgtcccgtttcctgcctcaggcgcccagcctagccacggtgctgcccggcgtggagcgcctgctggccatcggcgacctgcacggcgacctggacaaggcgcgccgtgctttccggctcgcgggactagtggacgaccgcgaccgctgggccggcggcgccgccaccgccgtccaggtgggcgacatcctggaccgcggcgacgccgagatccagctcttcttctggctggagcggctgcagcgccaggccgccgcagccggcggcgccctgcacgtgctcaacggcaaccacgagaccatgtcggccgcgcgcgacttccgcttcgccaccgccggtgggctggatgagttctcgcgcttcgcgcgcgcgcacgcgctggagctggccctcaaggcgcggtgtggctgcttcggcgcggacggcaacacggccgccgcagccgccgcctggcgcggcgagatgcgcgagttccggcgcgcggagggcgccgacgcacgctacgccgcgctgcggcccgggacgggtcccctggcccgccgcttcctggcgccgcacccgctggtcctgcaggtgggcgccaccgtctttgcgcatggcggcgtgctccccgtgcatgcggcgcagggcctgcccgcgctcaacgcggccgcacgggcctggctgcagggcgcggcgggggagcgcccgccgcgcatcctcaccggccgcagcgccgtggtctgggcgcgcgactactccgcggaggacgccgaggcctgcgactgcgccgggcttgcagagtcgctggccaggatccctggcgcggcgcgcatggtggtgggccacaccatccagcaagaggtgggggcggcggcggccaagcctttcatactcgaccatagcacccttttccccccaaaaatacaacatccagggcatcaacagcgcgtgcgggggccgagtcttcagggtggacgttgggctgtctcgtgggtgcggggacgggctacccgccgtgctggaaatcaggaacgactccgtgatgcagaggctgatggaggcgcccgcgccgagccccctgccgcaagggctgggtgcccaggaagccgccgagcagctggggcggcaaccagtccccgtgccggcttgagagagggggggtggataggcgtacctgtgatcctctctatcccctccccaagccgctggttcaataggcaaaagctttccacnnnnnnnnnnacctccctgcaccacagcactgcctcaaaggcttgtacacaaaggaggctgagtggaatgagagcgagcagagctcccatggtcggaggtgcgggatgctgtgcgcacagcatctgggttgaggtggggagagactgtccttggcagcatgcacggcaggtgaggatcggagcagacgggaggggtggattcgtgggagcatttctaggaacggacaggaaagacactctcgnnnnnnnnnngcagacgggaggggcagggaagggctggtcggactcaggggtcccgtgcagggctgccgagggaggaaaaggtacatcatcagctataacacaacagcacagtcagtggcaacactgcaggacaggactccaatgcctcagagaagcctctgnnnnnnnnnnaatgggccatctcactcctgcgacagtggcctctgcccctccaaatgatgctgccgggcggggtcaacacggtttgggcnnnnnnnnnngaccctgcaagcttgctgggagctga

SEQ ID NO: 1680 - DNA, 738 bp, Chlorella protothecoides
  modified_base (114)..(123): a, c, t, g, unknown or other
atgccacgcctggcgtgcagcggaagtgcatggcctcagagatccatgcccaggcaccgctcaccaactcacgcattgccccccacctccccccaccctttctacgatccaggnnnnnnnnnntgcccaggcaccgctcaccaactcacgcatgccccccacctccccccaccctatctacaatccagatatgccctggaggacgctgccagcgactaccagtacgggctggagtgcctcttccgcttctactcctacggcctggagaaggccttcaacctgcagttgtaccgcgagttcgaggagcacgtgctgcaggtgcagaggattggtgggaagggagggacggagcgatggactccggggcatgggatgctggctgcgcttgatggggccagcggtgccagagtggatacccagcccagagcactcagcggtggtgtgctcgagaagatcatcagagcacctgactatgccaacggattcctgtatggtctggagaagttgtgggccttccacaactaccacggcttccccaaggacaaggagctcgagatccagcccaaggtacagagccggaagcagggtgtaggggctgtcagcgcccctcggctgggagagggtgagggaggggccgcttgccgcacagcatgctcacctttcactggggagatcatgttctgtctggcatgtgaagtatcaagggcagcggcctgggatgtcaaatctccatgctaa

SEQ ID NO: 1681 - DNA, 678 bp, Chlorella protothecoides
atggcggaaggcctgtcggtgaaccacgctgccgagccagacctgagcccgggacctgcaggaaccccaaagtacctgcgcacgaaggaccatgtgctcagcatcgaggatgccctgggcaacgtgggacgacatctgagcagactgcagagggagcgtctggagtacgagcccctggtgcccgaggtcctgcaaggcaagccggcgaggtgtcgagttccgacatgcatgccggagttttctggacctcatgagattgtggagcaggaaacacggcaggcggcggcaaatcacgaggccatcgccaagctgttcccccagctctgccgctcccccctccacctcctgcgcctggtgcccggagagcatgccccgcatgccgagggccaccgccctctccgcatcggggtggtgctgtccggtggccaagctcctgggggccacaatgtcatcacaggcatctttgactacctggccaagcagcacccctgcagtgtgttgatagggttcaaggatgggccacgcggcattatcaacaacgaccacaagctcctcaccgcaagagaactggtgcgtggaggagttgaggtattgtcgggcggcttggttgatggagcatgcagtgcatgttctgtgacgtgcgtagcccaccttgatgctcatttgaatcgtaactga

SEQ ID NO: 1682 - DNA, 1500 bp, Chlorella protothecoides
atgatgcaggcggagccgtctttctgggcccagatctggcgcacggtccgcgtgctgggcctggctttcctgctcatggccggggcgggcgcgctgatggacgagcgcggcctgtcacgcggcgtgctcaactcccccgacctgaagccgcaggtggagacggggaccaagttctccgacgtcaagggcgtggacgaggccaagggcgagctggaggagatggtggagtatctgcgcgaccctgcgcgcttcaccgccctgggcggcaagctgcccaagggcgtgctgctggtgggcccccccgggacggggaagaccatgctggcgcgcgcgatcgcgggggaggcgggcgtccccttcttctacacctccggctcggagttcgaggagatgttcgtgggcgtgggcgcgcggcgcgtgcgcgacctgttcgctgcggcgcgcaaggcggcgccctgcatcgtgttcatcgacgagatcgacgccattgggggcaagcgcaaccccaaggaccagcagtacatgaagatgacgctgaaccagctgctggtggagctggacggcttcaagcccagcgagggcgtgatcgtcgtcggcgccaccaacttcccccagtcgctggacaaggcgctgatcaggcccggccgcttcgaccgccacgtgaccgtgcccaaccccgacgtgcgcgggcggcgccagatcctggaggcccacgcgcggcgcgtgccgctggccgccgactgcgacctggacgtcgtggcgcgcgacacgcccggcttctccggcgccgacctggccaacctggtgaacgtggcggccctccgcgccgcccgcgacgccaaggccgccgtgggccaggccgacctggagtttgcgcgcgaccgcatcctgatgggcgccgagcgccgctccgcgctggtcagcgacaagatccggcgcctgaccgcgtaccacgagggcgggcacgcgctggtggcgctctacacccccggcgccgccgcggtgcacaaggcgacggtggtgccgcgcggcggcgccctgggcatggtcagccagctgccggacgccgacgcggagctgagcgtgacgcggcgccagctcctggcgcgcctggacgtcgccatgggcgggcgctgcgcggaggagctcatcttcggcgagggcgacgtgaccacgggcgccagcagcgacctggtcgcggccacgggcctggcgcgggccatggtcaccgactacggcttctccgcgcgcctgggcgccatgagcatcccctttgcggaggccagcgccgaggcgcaggccgccatcgaggccgaggtgcgcgcgctggtcaccgccgcgcacgcgcgggcgcgggacctgctggcggcgcacgagaaggagctgcacgcgctggccgccgcgctgctcaaggaggagacgctgtcggggcagcagatcaaggacctgctggccgcggcggggggcgggccggagctggcgcgcgccgcggagcagtag

SEQ ID NO: 1683 - DNA, 780 bp, Chlorella protothecoides
atgagcctaaattacacatgcaccgtcctgcagatcgccgatgtggtggtggcgagggccgaggctgggaagaactacggcgtggtgctggtgccggaagggctcgtagagtacgttcatgacgtctctgccctgattgtggagctgaacgagctgctggccaaggacagcgccgacccgcatgacctccctgccgtggccgcgagcctgaccccgccctcccgcgccgtgttcgagtcgctgcccgccggcttcaagaccatgctgctggaggagcgagacccgcacggcaacgtccaggtgtcgcacatcgagaccgagaagctgctcatccggctggtggagggggagctggcggcgcgccgcgcatccgggcgctatgccggcaagtttgctgccatcccccactttttcggctacgagggccgctgctccctgcccaccaacttcgacgcctcctactgctatgcgctgggccacgccgccgcgtccctggtgggcggccgccgcactggggtcatggccaccgtgtccgatctccagctgccggcggcgcggtggcgggtgggcggcacccccctagtggccatgatgtgcctggagcggcgcaagggggcagtcaagcccgtcatccgcaaggcactggtggacctgaatgggcccgccttcagggcctttgccgccgtgcggcgcaagtgggggcttaccgactgcttccgttccccggggcccatccaggttggaactgtaatctcaagttggccgaaacgggagaggtga

SEQ ID NO: 1684 - DNA, 207 bp, Chlorella protothecoides
atgcacacagatggccccataacagcccgattccacatcggggatgcccccatggacgtccaggccgctgcagatgccggggctgtgccactgggcgtgaccaccggcatctacaccaaggagcagttgctggtggcagctcccagcgccaccatccttgaaggcctaggggatctgtcgaaagtcatggacatattgaggcaataa

SEQ ID NO: 1685 - DNA, 1257 bp, Chlorella protothecoides
  modified_base (545)..(554): a, c, t, g, unknown or other
atgaacggcaagcgcttcgcctggcagggcgtggcgctgctgcccttcatcgacgaggcgcggctgctggccagcacgcgcccgctggagggcgcgctgacgccggaggaggccttccgcaactcgcgccgtctggagcaggtgtacgtcgccggggcccacccgctggcgcccgagctggttgagctggcggaagggggggggggcggtgcggcgggcggggaccaggctcgggccgccgcccgcgccctcgacccggagctgagccagggcatgggcggcgaggtgttggcccccgggggcgaggcctgccctgcggtcctgcccgcgccctttggtctggggcccgatgtctcgcccaacgcggtggtctgcgctgcataccgcctgcccccgcacgctaagcatgtctgcgcgctactgccgggggccgtggaggagcccgctggagccgggccttctgccctcccagggcatcatccccaaggcgaggactcatgcctgcacccccgttccaatccggcaggagcccatcgtcacggctnnnnnnnnnncaaggcgaggactcatgcctgcacccccgtcccaacccggcaggaggccatcgtcacggccgaggacctgcaggccgacaagccgctgtggcaccaggacacccgcggaccgggccggggcggcggcagagggggacccccgcacggcatgcacgtgggcgacgccgcgcggcgccacatcgccgccgggctgccacggcagcagcagtacgggcagcagcagccgcagtacgggcagcagcagcattacgggcagcagtacgggcagcagcagcagtacgggcagcagtatggccagcagtatggccagcagcaatacggccaaggaggagggtatgcacaggctgccccgcaccctgcctacgctggccagcagtatgggggagggtacaaccccccgccaggtccacggggtggcggctacggcgggtatagctacggcggcgccgcgccgcgccagccgccgcagtatggagcatacgatgccacgccgcaccagccgccgcagtacgggggccggggcgatggggcgccctcccggcccatgcagcgctttggtggcgggcatcaagcctggggagggggctcgcagtaccctggggggccacaatactcctctgacgcgaggggcaggcccccgccccaggcccctgcgccatacgaccgcaacaacccatattctgcgctgcagaggcggcgctga

SEQ ID NO: 1686 - DNA, 366 bp, Chlorella protothecoides
atgccacgtctcgtatcattcgatgtcgatggcaccctgatcaagagcattggagccagggccaaccagctgcaccgggaggctttcactgctgccttcaaacaagtgtttgggattgacaccacaatcgacgtgatcccgcaccacggctccaccgacaccttaatcctggtggcagtgcttgtagtgcatggaattcccaaggcagagcacgatggccgcgccgccccctcccaggccatggcctctctcccagcgcttcagcaagccatgaacagctactttgctgcaaacatcgaccgggccggggatggcttggaggtgttgccgggcgttgtcgatctactcaaggcactcaaggtgtga

SEQ ID NO: 1687 - DNA, 546 bp, Chlorella protothecoides
atggaggcgcccggcatgcagcatgcgtttccggtctcacacctcccttccctcatgaattcaggtgtcttggcgccggtagcacgcggtaggagccgggtgcacatgcgggcgcagggaaaattgtggggcgatgtgcccagggcaggtctctgtttcaaagcctggccacacagcaatgcacagcccaggctccacgccatgcgctcctcacccgtgcgtctcccccctcctccccttcccttcccaataggtcgcagcatgatggtgtgccgcgcccaggcccagcccgcccagaagcgcgtggccctgggtggccttgtcggtgcggctgtgtccctgcccagcctgttggcgactcacccggcgctggcgctggtggatgagcgcctgaacggcgacggcactggccagatcctgggcatcaacgacgcctccctgttctgggtgctggctattgtgtttggcctggtctgggccgcgtactacaacagccagagggacctggggggcgacaagggcgacgactccgggctcacgctctga

SEQ ID NO: 1688 - DNA, 609 bp, Chlorella protothecoides
atgaaaacacccccacacatacaccctttgcaggagcgtttcccgcccgagctcctcaacaggctggacgacatcgtcgtctttgagcgcctggcgccccagcacctgcatgccattgcagagctggaaatcgcggcgctggcccggaggctggagcccctgggcatcctcggcttgacggtgcgtgcggggcatgcctgctccaggcgtccaggaggagtgacacagatgcacccgacgccagaggcatcgttgcgatgccatgccccaccgaacccttccaccccccacccgcaggcctcggcggagctcagggccttcctcgcgcgcgaggcatgcgccgacgggcgcggggcgcgggggcttcggaccctggtctcgggcctcttggccgacgccgtggccgacgcgctgctgacagggcaggtgtccaggggacagggcgtgcacttgaccctggtcgctgatggacaggtcggcgtgcagagcctgccggccgccgtcgcgccgctggagaacaacgtggtccccgccgcacccaccgcggggtcggtgcccagcgtcgagcggcgcgctgaccggggccaggatgcctggaccccggcttag

SEQ ID NO: 1689 - DNA, 930 bp, Chlorella protothecoides
atgacggggctgccgggcgccgctgtgatgcgtgtggcggggggcgacacactgcatggggtctcggcagttggaggcggcatcggacttgccgtgacccttggctccatgccccatggccagattgacgcagctggtgtgacctgtgtgctcctgacgccagccgctcggtcccctcgtcctatccaccccactcttcccaccatccaggaccgcatagtagggcaggacgccgcatgccaggccgcggcgcgggcgctgaccaggtcgggcgcggggctgcgtgatcccggcaggccccaggccgggctcctcttcgtcggcccccctggctgcggcaaaggcctgctggccgaggcgttgggcgagcgccgtttcggcggcagcgtgctgcgcctggacatgagtgagtgcggccagcggcacagcgtgtcgcggctgctgggcgcgcccccgggctaccaggggtacgacgacggcgggacgctgaccgagcccgtcaggcgagtcaaggtggctggtgggactgtggtgtgtgttggacggcctgagagggctcagggttgtgagtctcgacgagcggcggcggagacgtcgtcgttcacgcccatgatgcatgagcagcgccgctgcagctgcggcaacctccctcattcaatcaacggtccccccttccaacccccacaggcgccggccccactccctggtcatcctggacagcatcgagaaggcgcacccgcacgtgctcaacctcctgctccagatcctggaggacggaaggcggtggtgatcctgatcagcacctctcacgaagcctctggccggggcggcctcggcttcgagccggcacccgcctcccaggccgaggccgaggctgccgccgcccagcgtgcgcggcgtgagatcctggacagcctcaaggcgagctag

SEQ ID NO: 1690 - DNA, 861 bp, Chlorella protothecoides
atgccgccgtcttgcgcaggcccagattccccacgcatgggtatatgcgtctcactccctccccaccacttcctggccccctgtccctcgcttcagaaatgcgaggagcggttcgccaagtcgcgcatggtgcattccatcatgcgccatgtggccgagacctgcggcgtggagctggatgacctgtactcccaggtgggctggcccctgtaccgcctgtacggccatgcctacgacgccttccgcggcatgatccccgaccccgagcccgtgctggagcgtctgcggaccgaggtgcactccggcgagactccggcggtgctcacgcccgcggtgctggatggcatcctgaagaacatcaagcggcgcatgacgccgcagcccatcaagatccgggcggacgtggagatgacctgcttcgcctacgacggcgtggagcacatcaagggcgcgatgcgcgccgcgctggcacagtccagcgaggagtgcgaggtgtccatcaagctggtggcgccaccgctctacgtcctcaccacccagaccctggacaaggcgcggggcatcgaggtgctgacggcggcagtggaggcctgcaaggccagtgtggaggcccagcgcggcagcctgcgggtgaaggaggccgccagggcggtgtccgagaaggaggagaagctgctgcaggaggagctggaggcggccgaggcagccaacaggtgccccgggcttgaaccacccatcgacatccctctcgccaactcccctcgattcgacagggagattgctggggacgacgagagcgaggaggacttcgaggagggcatgtccgtggatgtggatgccgcaccggcgctggccatgtga

SEQ ID NO: 1691 - DNA, 354 bp, Chlorella protothecoides
atgccccgttccaggttctatgagagccgctacccggagatggacgacgtggtgatggtccaggtcaagtccatcgccgagatgggggcctacgtgtcgctgctggagtatggcggcatcgagggcatgatcctgctctccgagctgtcccggcgccgcatccgctcggtgcagaagctcatcaaggtcgggcggcaggagccggtcatggtcctgcgtgtggacaaggagaagggctacattgacctctccaagcgccgtgtcaaccccgaggacgtggcggtacgtgtgctggggacatggaggggcttcgtgtggttgcttctgtttgaagggggtgagggctgggcctga

SEQ ID NO: 1692 - DNA, 531 bp, Chlorella protothecoides
  modified_base (507)..(516): a, c, t, g, unknown or other
atggccatgcaatgcaccttgtacctcacgacgccccgcggcgccctcctggggagggcctcgagggggtgtgcccccagcctcaccccccagctccgaacggtcccgccgaccaggacgtgcatcccaccccgccatcggccgcacgcctccaatggcggtgcgctggatcctgaagacctggctggcgcaagcaccggcacggcacagccctccctatccagggtcccagcagggcaggggccggcacgcagcctgtcagacgtggtggatgccggcatcaacctgccctggcccaagctggcctcctgggcggcggccgcctttacgttttaccagctgcgcgaattctttggggtgcgtggtgctgagtctctttggcggcgaggaggaagaacggatgggaacctgtcagtgcctggtgggagcaagacctacatgggtggcgatgggatgcttggtgcctgccattcccctcaactcagaaccccaagcacccacccctcnnnnnnnnnnggtgcgtggtgctga

SEQ ID NO: 1693 - DNA, 711 bp, Chlorella protothecoides
atgactcgccagggcaagagggcaagggagcacagtcgaacacccaggagccccgataaggtctcacgtcaggcctcagaagcgcccctgcccaccccagcccaagaccagggccccacagccccttccaccgagcacagactcacccgacatcgggccagggtctctggcgagacacccctgcccgcccagcccgaaccggagcgcctggcacatcaccaacctcgggagggggcccaggccgaccatcagccaggcatggacaggaagtccagcgccggaatgcacgtccccctgcaccctccggtgggtctgagggggaggccatgcagcgaccttgctgcatggtcactcgcatctccccctccccaaaaaaacaattccccgtttactccccagcatgaggaggaggaggaggaggagaggctgcagcgcgggcacagtgcgctgcagggcctgctgcgccggctgggcgccgggtttgaggacgtgttccacaccggcgcctcgtccgccgccggcggcggcgcgtaccaccccggcaacgcacgcgtgcgcgccgcgctgggccagctgcgctcccacgacgccggcgagcagctggctgggctggccgagctatgcgagtacctggcggtgtccaccgaggagagcctgctcaccttccccgtggacaccgcagtgcccctgctggtgagcgtggaggggtga

SEQ ID NO: 1694 - DNA, 390 bp, Chlorella protothecoides
atggagcgcttcctcctcatcgcctccagcgaggacgtgacacacgccatcaactacactgagctggatgcggtgtctcatgtccaggtggcacaggcgctgccggggcctgccgcgcggggcgtgtctcaaatccaggtggcacaggcgctgcgggggtctgccgcgcggggcgtgcctgcgctcgcagcaacatcccgactacacacccatcgtcacccacgccaggtcatcgggacagcgcggacgcagtacctgggggtggcgctgcagaaggtactgcggcagtacaccaatgccgcagccaccttcaccacggagattctgtccttcacctcccgatttgccatccaggtcttgtttgggcggggtggtggaaggggaatctga

SEQ ID NO: 1695 - DNA, 957 bp, Chlorella protothecoides
atggacgagtcggctctggatgcacacaacgtgcaccgcttcaggaccatgtcccacgccgcgctgcagaagcgcatctggaagatcaggcggccggagaagctccgttcgttcatcaataggtcccccaagattgatggagagagtcccaaggcaacaggcactgacaccgcctttgccctctgcctcccacgcaggtgctggaaggcttccaggaggccgagctcgcggaagaggctcggctggccctgggcgaattggaagggagttgagtcctattctgagaagcgctatcatggccctgacccggctcggctggcccagacaggcacgcctgccgcggccctcgagtgtgcttgccacattacatggcactctccaaacagtgcgagcagctgctggggacccgctccccccagctgccggggcggcgatctgacgggcacggcccaccggcatcaccccgctcaactgctcactccccaccccgagtcaggccaggcccaggtgccctccctgcagcattgcggtggccttgcgcagcgcgcccagcgtgccccacatggacgccaggttgacggccagcgcaccgcccgccacgcgcaccgccaagcggccagcgcccacctggccctggcaggcggagggcaggcgatccaggtaggccgcggtgcgctggtgcaggctgggcagggccagggctttctcccacttgtggcgccaggcacgggccgtctcgcccgcgtcgtggatgcggtcgtcagagtagccggcttcctggcgccgcagcgcgtcggcggtgcgcttggcgttggcccgcgtggactgcagcgccagccggttcccggggtcggcgccgccggggtccagcccagacagcagcgccagcgcgtccttgtgggtcaggggggtagattgggagcccagacgctcctccactttcctgaagaggtgtaa

SEQ ID NO: 1696 - DNA, 1296 bp, Chlorella protothecoides
atgctgggccggtgggctgttcacggcacgcgcttatcacgcgcctgcacgggacgcgccttccactgcaccccgcccacccgtgaccgcatcgccgtgggcatctccggcggcgtggactccgcggtggcggcactgctgctgcagcgcgcggggcacgatgtgcagggcctgttcatgcgcaactgggacgagggggaggagaccgggaaccgcaactgctcagtggaggccgacgcggccgcagcggcgcgcgtctgccgccacctgggcatccccctggccgaggtggactttgtgagcgagtactggacgcgcgttttcgagggtttcctggcgcaggcggggcggggcctgacccccaaccccgacctggcctgcaaccgccacatcaagttcgacctgctggcggagcgcgccgccgcgctggactgcggcgccctggccacggggcactacgcgaggctggagcccggcgacccgccacgcctgctgcgcgcgcgcgacgcggcgcgcgaccagacctacttcctggcctcggtgcggcctcaggccctggcctacgcgtgcttcccgctgggcggcctgaccaagcccgaggtgcgcgcgctggcggcgggcgcggggctggccgaggcggcggggcgtcgctcctccgccggcatctgcttcgtcgggcggcgccgcttcggcgcctttctggagcagtacctggcgccgctgcccgggcgctaccgcgacgtcgactccggcgccgacctgggccccgccgccaacctgctggcgctcaccctgggccagcgcgcgtcggtcggcggcggcccgcagcgggcctacgtggcaggcaaggacgtgtgcgcgcgcgtcgcgcacgtcgccagcggcccggaccaccccgcgctgcgctgccgcgccgcgctcctccgggcgccgcactggctggacggcggcgccgccgccgcggcgctggcggacggcggggagctgcgctgcctgtacaaggcgcggtacgggcaggagccgctgccctgcacgctgcgcgcgctggggaggggggggttccggacgagcgcgctgtgcacgctgctggaggaggacgagcggatcgggccgggcttcctggtcgcgcactttgacgagcccgcccgcgccatcacgccccagcaggcctttgtcatgtacgacggcgagcggtgcctgggcagcgccctcatcgccaagccggggcccagcctggccgaggaggccgggggggggtgcctggatggcgcatgcccggcagcggcggacgcctga

SEQ ID NO: 1697 - DNA, 261 bp, Chlorella protothecoides
atggcggctgtggctggaatcctgttcacagaggcagtcggtctgcccccctggtggaaggcgggggcggagcagtaccccatcgacaacaagaccctcatccttgtagagattgccacgtttgcggtgctggagggcctgcgggcccggggctgggagaagaccggcgaggtgcgggtcctgaagcaggcaacggtgtttgagttgtgttacctgtgcaaaggacggaaaggggagagtgtggtagccgggcatgtttga

SEQ ID NO: 1698 - DNA, 378 bp, Chlorella protothecoides
atgtcgtacgcgcctccccgccccaatgggcgtacccgggctcaggcggaggtcacagacaacctcagcccggcagaacgccatataatggagatggcgaagcgggaacaccgagatacgactgccgcggccaagcgagctgcccaggtgagtggtggaggcgtggggcttaacctccatgttgccgagctgcagggtcacgcagccgtgctcggccagcaggaagacccgcccagcctgcatatagctgacgagactgtggacgctgggagaaacaccttggtagagatccatcggcaaggcgagcagctggatcacatcgagcggggcctggaccacgtgagtgtgggtgtcatgtgcagtgaagaagtggtatga

SEQ ID NO: 1699 - DNA, 789 bp, Chlorella protothecoides
atgcacaaggccccttccgctgcgggtgcgaccacctcaacccccccacccccaccctttattcataaccccacgttcctcttgcagcgtcagcagaaagtggagctgctgcagaaactgctggatgcgctgcatgccaccaagctgctgcaggggcgcgcggagctgatcgacgcccgcgtgcccatcatcaagtgctgcatggccgcggccggcggcctccatgtcgacatctccctcggcacggccaacggcgcggcggccgcgcgctacattcgcgctcaggtgctggcgatgccaccgctgcgcccgctgtgtctggtgatcaaggccctgctcaggcagaaggggttcaaccaggtattcaccggcggcatctcctcctactccctctgcaacatggtgcgcctgtggagcgagggttacaagctgggcgaggtccccggggacccaggagaagtgagctcggagctggagggtgtgttcgccttcctgaccgacctccactgcgaggggctgcatggcgagagcgccggccccggcccccccggggcgagcacggcggacctggggcggctgctgtggggcttctgcaacctgtttgggtacgccttccgctacagccaccaggccgtttcgccagcgcggggcggcatctgcaagaagatcgggccttggaggcaggaccaccggggctggctgctggccgtggaggacccgcaacagatgggcaaagacatcggttcagggagctacgagatccgagccatccgggagatgtttgccgaa

SEQ ID NO: 1700 - DNA, 1368 bp, Chlorella protothecoides
  modified_base (871)..(880): a, c, t, g, unknown or other
atggggcgagctccaggcaagcctcgcacttcgttgcaaggaaaaatccaggctggactgaaaagcgaggcgtctaaaccagctcagcctaccaaggacgccttgggaacttttttgtcatgggcactgcagaatgcaaacagggctagtatagagtggccgtgcatcgaaaggatgctgggacggagtcactcactatttgtgcctcttcatgacacttgcacaggtgtttctggagtaggaagcaaggagagcaaggtcgccctctttgagggccaagatgttgacagtcgaggcctggtcgccgtcaaaggccttgcctggtctgccccatgtctgcagctccccattccaccctgtccacaacaccacacccgcgcacaggatgtgaaggccggagagatcctgctgcgcgtgccggcccgcctcgccatcacagacgctgacaaggacgggccgccgccgccctacccgggggcgccttggagcctgaccctggcctcgcgcctcctgtccctcagggaaggagcggcagggagcgcctgggaaccttacctggaggtgctcccgcgcaatgccccctccccctggctggacgtgacctgggaggcgctgcaaatcgtgcagtacccccccgcccgggctgaactggatcggctggggtggatcgtgcacgagggcattgccgccgcccgggcccagggcgcaagctggagcacggccgacttccactgggcgctcggggtgaggccggtctgggatggcctggcctgctgcgtggaatctcccatgggagcaggagtgtcatgctgtgcatggatcggtgtggcgcatcatgcccagaatgcccgaccccggaactctccccctnnnnnnnnnnctggagcacggccgacttccactgggcgctggggaacgcccgaccccggaactctcccccgctccatcatccaccaccacccttcaccccttgcctgcgaggcgcagctggtgcattcccggacgtttggctctgctggaaagcggggaggggtgggcgtacgcatgctggttccccttgtggacatgatcaaccacgccggggacgaaacgcccgagagctggagcccaggagccgagcccgtctccagggacaacgcgaggtgcaggggggcgcgtggggggcaggtgggtttccaatcttgcggtgcgcatcggaccaatggaacctccaccccctgcctcctccctctccaccatccacagatgggacatggtgccgcagctgggtggaaggtggaccgtcgcagtgtctgccacccaggacatcgccgcgggctccgagctcctgctctcatacggtgcgttgaggcgctgtggcgcctgtga

SEQ ID NO: 1701 - DNA, 396 bp, Chlorella protothecoides
atgtcggaggtggatccgggcgctgctgctcactgcactctcgaactcgggtggacagtcgggtatcaggccggcagtcgctcctcacaccggaggtgggcgcagtgcgcggatacagcccaggctcccctcgcactcatctactggcgaggggctctgccttcctcactcagcatcatgctggtgctggtgatcggcgatctgcacatcccacaccgtgtgccagacctgcacgagaagttcaaggccctgcttgtgcctgggaagattcaccacatcctctgcccgggcaacctctgcacggaggtagggccaggccaacgtctttttctgctcaatgcttcctgggacgtgcaccttgcagattccaatgggccctttctctcctctccatga

SEQ ID NO: 1702 - DNA, 405 bp, Chlorella protothecoides
atggccgccgctggcaccttgccctgcgggcgacctcagtgctgcctcccctcccccccccaacaggtccagacctacggccagttcagaattggcatgtgccacggccaccagatcgtccccgtgggcgacagggcggccgccgccatcctgcagcggaagctgaacaccgacatcctggtgctgggccatacccatgccttccaggcctacaagcacgaaggtcgattcgtgatcaaccccgggtcggggacgggggccttcagcaccatcacgcccgatcccatccccagcttcgtgctcatggatatcgacggcccgagggtgactgtgtacgtgtacgagctgcacggcgaagaggtcaaggtggacaagatcgagttcagcaagcctgccagcctctag

SEQ ID NO: 1703 - DNA, 885 bp, Chlorella protothecoides
gttctacgcttcggacaacgagctgcaccgcctgttcaagtcggtgaatggcatcatcttccccggcggcctgaccgacatctggctggacaacccctacgtcatcgcggcgcgcaagctgtggacctgggcccgcgaggccaatgacgcgggcgacatcttccccatctggggcacctgcctcggcttccagctgctccacgtcctggaggccaacgtctccttcactgagctgctgatccgcaccgactcggtggggcacgcatccaccctggacctgacggaggctgcgccctcctccgcgctgttcggcggcatcagcccccacctggcgcgcaaggtggccgaccccgcgctgaacatcaccatggagaaccactacttcggcctccctcccgagcactaccagcgctggggcgtgctgggtgaggccttcaccgtggtgtccaccacccgcgatcgggtgggcgtggagtacatctccaccgcggagcacaggcgctaccccttcttcgccacgcagtggcacccggagaagccgccctacgagttcggcatgaaggccatcccacacagtctggacgcggtgctggtctcccagcacctggccaacgtgtttgtggacaccgcgcggcggtcggggcacgagcccgagtcgcacgaggaggagctggtcatgctcatctacaacaccaagccctacttcacgctcaaggactcggtcatggaccgctcctacgacgggccagacatgacctacttcttcgactcaaaggatgatgcgccagacaacgggctgcgtggcgccgagccgcggggctcaaccagctttgcggggcgggtgtaccgtggccaggaggcgcctcacctcaccgcctgggcatg

SEQ ID NO: 1704 - DNA, 1596 bp, Chlorella protothecoides
atggacgacgagcaggaggcgacgtggcgggcgtgcgggagccaccttaagctgcactggctgtccagcccacgaagcgtgctgctgtccagcaagcccacgcccagcctggcgccacgcactgtggatgccgtgctgtggctggtgcgccgtgggctgacggtgtgggtggagcccggggtctatcgccgcgtgcgcgcggcggtgggcgccgcgctggcggaccccggcgcggggccccccggttcgggggacgagggactgagcagcgtggggagtggggatgtggcggggtcgccggggcccggctgcggcctggacgccgggcggccgccgcgcgggcccggcagcgctggcgccgggggcgcctccacgcccaacctgtgccgcctggcggacgaccaggtggacctggacgcggcgctgcgcacgtggaaagcacgccgcggctgttgggggcggggccggtccggccaggcaggagaggtcggcgaggaggcggggtcgggcggcgaggaggcggaggagtatgatgacagtgagccgctctggggggatgaccatgaaatggagcagagcgacggccacacggcagctcagcggcgctcctcgacagcgtcccgatcggcaccgcccaccgccaacccctacgcggacgtggagggccccgaacccttgcccgcccgtgtggcttcagccatcgatctggtggtgaccctgggtggcgacggcaccctgctctgggcctgctccctgttcggggacgcgcccgtgccgcccatcgtggccttcgccatgggctcgctggggttcatgacgcccttccccgccgcgcgcctctgcaccgtgctctcccgcgtcgccagcaccgcccacggcttccccatcatgctccgccaccgcctccaggcacaaggcagatgcgccgccgatgctccatcctcacacattcacatcaagctctgtgacccgtccccgccccccaaagaccaacaacacaccgcatcgcagggcacggtgttgcgcgaggcggcgggcgaggcggcgtgcccctcccccccgctcatggtgctgaacgagctggtcatcgaccgcggcaccgcgcccagcctgaccaacctccacgtttacgcggacggcgcctttgtgaccgtggtccagggcgacggcttgatcgtggccacgcccaccggctccaccgcctacaatctggcggcgggggggtccatggtgcacccgggggtgccctgcctgctgttcacccccatctgcccccacaccctctcctcccgccccctagtcttccccgagcacgtggccctgaccatcgtggtcccgcgcgaggcccgcgccggggtatacgcctccttcgacggcaagcaccgcgcccgtgccggggtgtacgcctccttcgacggcaagcaccgcgtgctcctggcccccggggacggcgtggcggtgcgcgcctcgcacttccctgtgcccacggtgtgcaacctggacgccagcaacgactggttcaggagcgtgcgggacgggctcaactggaacgcgcgcgtcgtgcagggcgcgggggagaaggcggcaaaggcgtga

SEQ ID NO: 1705 - DNA, 363 bp, Chlorella protothecoides
atgagcctgagctcctccgaggcggatgattttccggatgaagagaccagcccgacaacgttcggccagcgtctggtgggcttcgcctcgggattcggggaggccctggcacggaccgctgcctccgccacggtcctcctctctgacgcccagctgcgacgccagggcgcctcggtgctgagcgcgggggccagcaaggggcttcgcggggtgcagtccggcgtggtggcgggggtgcagcgcctgcaggccgggcccaagcagctgcgtgcagccctcgcccgcgtccagcagcgcatcgaggaggagcgcctggccgtgctcctacgggtgaggtggggctttcttctgggagggggatga

SEQ ID NO: 1706 - DNA, 312 bp, Chlorella protothecoides
atggacacttcaggcccaggtatcttccggacgagccatcgagcccacatcgcgacgcgcagggctggagcaggggcatccgccaggctcgccatgaccagtgcagcccggctgcaggccctgtggaaccaccccgccgggcccaagaccatccacttctgggcacccaccttcaagtgggccatcacatttgccaacatcgctgacttctcccgcccggcagagctggtgtcctatcctcagcagtgcgctgtgacggccacgggcctcatctggtcgcgctttgccacccagatcaagccggtgcgttga

SEQ ID NO: 1707 - DNA, 1437 bp, Chlorella protothecoides
  modified_base (806)..(815): a, c, t, g, unknown or other
atgattggcgaggcaggcgtgggggcccaatgctattgctcccgttgcagctcccgtccagttttcaattccagatctcaggcgggcgcggatgacctctccgcagagttgcatcctctgaccgtcgggacaggcatgggcgcaggccagagcaaagagaatcatgcaattggcagcaacggcgcatcagagctgagcactagcgaaggagactcgtcttgtccggtgccggagtcccttcgtgtcaaagcggtgtacaatgtgtacaatcagcgcatcgacgagcttgccccagccaagaccgaaatcctggaccccagcaacaacatgcctgccgagcccaaccagcagccatcccccggccagaagaagctgctgtccacacagagggtggtgtccaatatccccaagggtaacacggagtctacctgggtgtacccctccccacagatgttcttcaacggtacgtgtggcttgcgtcgtccggggcacctgtttcgccctgatacaaggcctcacagatgttgcagcacggcagaaggacaggcttatacactccttgcacgccttccagtagtatccctctccccatgcccctcatccacccatgccctcgttggcagccctgcgtcgcaagggaaagggcgacgacatcgaagaggacgacatggactctgtcatccacgcccacaacagcatgaacgagatcacatggagccatgtgatggcctgggaatcgctgcaccgggatcactgctgtgcgccctccctgctcagagtatagcgagtatcttaattttgaggcnnnnnnnnnntgggaatcgctgcaccgggatcactgctgttcgccctccctgctcaggttcaggggacggccagatgacctcaggtgagaacgggaataggggaggaatgggttcggacgcatggaaacctccaaggctcttccacctgcctcgtgtctgtgaatgcacttgctgccagcgtgtatggcgccacttccctgactcctcatccccacccacccctcgcagtcccctggctcgcatccggtcctggtttggggggccgttaccctttgaccgccatgactggtacattgatcggtgcgggcaggaggttcggtatgtcatcgacttctacttcaaggatgagctggctggtaggcacaggggctgtggatccggggaaaatggcctcgcgccccatgccattggaacatgggctcataatctgatccctgaggcatttgagctgcgggtgcgcccggcgctggactcgctggaggccggtctggaccgggtgaagatgcagatctacaccacctttgcgcagtatggcctgccttgccccgtgactggccaccccagcggggctgcggcggggaagatggggcagggtcctggccctggagaccatgcggcagggtcacagtga

SEQ ID NO: 1708 - DNA, 939 bp, Chlorella protothecoides
  modified_base (161)..(170): a, c, t, g, unknown or other
atgcccctcccctgtacaaatcgctgtcagaagcaagtggcgcaagtggccaggggacggtcatggtcgaccaaatggggaggcaggaggaataaacgatgtgctgctgtgtccccaggatgttgttacagcccacccgagggtctgctcgcagccgaatnnnnnnnnnnggtcgaccaaatggggaggcaggaggaatacacgatgtgctgctgtgtccccaggatgtcgtcacagcccacccgaggggtctgctcgcagccgaacacctgcctcgcctggtcgaatccctcagtccgcccagatgttgtccgccagctgccagatctggaggatgttgtcctccgccaccgaggccatcacccactcgtccgtggcattgaaggcaaagtcagagatcttggcagtgtggccgccatggatgaagagcagctccggcgggccgtcctcggcgtcctcaggcgactgcgtgttgggcatatggtggatcggagtttcgtggcagctccctcgcaacatccttggcccggccgcttgcaggcagcgcactggcacagcaacccatgcggcacgcagggggctcagcacgccatgcccctccaaatccagcctcaacaccctgaaacccacccccttcccccacccacgcactgcatccctcccagggcgcccacctgctcgtcgccgatgcgcgccaggtcccagaccatgagccggcggtcggcgccggagctggccagcacggtctcgtggtgggggctccagcccacctggaacacctcctcgctgtgggactccagcaggtgcagcttgcgcgatgtgttgcgcaggtcccacagcgccacggtgcggtccgccgaccccgtggcaaggatgaattcgttgtgcgggttgaaggccaagcagttgacctcagcgccgtgcgcctccagcgactga

SEQ ID NO: 1709 - DNA, 1404 bp, Chlorella protothecoides
atggcgggcgggcggtcgcccggcgcccttgtatggggccgagcaacgggtcgagggtggtcatggccggcagcgcgggcaactggttccccggagcagacaccccggactacctcaacaagctcccagcgtgagtccttgatattgggaagggcccggcccaccgagcagacagatcgacatggatggggttgtcctacttgtgagttggtatgctacgtcatgacccgtttccacacttctgcaccgcaggtcctacggattcgtctcgctgatgctctttcctcaccaccccatgtatccccccccctcccccccccaaaagacccccttcgtctcggctctgttcctgagaacctgacgcgcttccaggagggagagctcatcaacgggcgatgggcaatgttgggagtggcaggtgagatgggtgcttcggggaaagagggcacaaagtcttccctggtgcaatgttgccgctcatcattttcatctcaccaaccctgtcggcgcccccgcaccacaggcatccttggggcagagctcctgggccagggtgactggtactcagcacccctccccgtcatcaacggcgagcctgccacctactttggggtccccatccctctgaacctgggcgaactctccgccatcgtgagtgaagcgggaaagtttgagagttgtcctgccagcaatgctcgattggttttggacaaaattaggccttggtgtgaggccatgccttccacacatgaggtacaaggctcggtccacatcccaaggcatttggtgcatcgcgcaggagttcatcgccatcggctccgtggagatcctcaggaacggcgccgagggcgagcgtcgcatctggcctggtggtcagttcgaccccctggggctgtccaagggcaacctggaggagctcaagaccaaggtgcgcactggacgacagttcgcagtgtgtcctgggcatccaggctgtgcttgctggtgaggaaggctcagcccccccttggccccctctgctgccgtaggagatcaagaacgggcggctggccatgctggccttcctggggatcatctcccagcacgcagccaatgggctcagcccactccaagccctgggcacacacctcggcgacccctgggctcaaatgtggtgtcgatcctggctggctgtttatgtgggattcttcctcttcatccgcgccctccttgaagtcccttgatgaaggcttgaaattgtcctgcctcgggatgtggacactcgactcatccacatacccccctttccctgcgcgcagccaacaactttgcgacaaacagcgtggcggtgcccttcgactttggcatctgagtgcctgctggttgaccgcgtgcagcctgcgtccactcccttccccatgctga

SEQ ID NO: 1710 - DNA, 969 bp, Chlorella protothecoides
atgggtgtggctttgcagcagtcctcttccaagcccagggcacacacctgcgccgccatcgcacagaaccccggccctcccgccccgcaggccgccgtcctctccgccgtgtgcgcgctgctgcccttcatccccacctacgccgtggcgctgcctggcagcgggctgctggcggcccaggggcacatccccggggcgatcgtgctgctgctggtgcattggggcgcctactacctgggcgacacgctcatcctggaggacatcccaggggggcacccctacctcctgtccctgggcatcctggggggaatctggacctttgacaaccccttccaggtgggcagtgtggtgctgtctagcggcttgattgcgggcctggcacatccagtgccacactgtgataacacgcagctactcatccaggccgaagcaggcgatgtagcagtgccacgcctggctgcgccgaggaccatgggttcaaggtccgggtctcacccaaaccatgttcctcctggcaccaatccacccatctccacacctaaatattcagggctgcctctttggccccatcctgctctccctgctgtcggccttctacaggctgcacggggagttcatgggcatggtcagcgccgacggcgagcggggcgggctggggttgaccaccccccgcgccgccgtgcccgccctctttgcatcgccattcgggacgaagggaggggagcggggcccggcaccgcactccccgccagccccagtcctgcagcccaccccgcccacgccgcgtcaaggcgcgcacaaggggctggagctgtcaccagtagacggctgcgaggacagggtgcctgccagagcccctgccccagccggcacagcctctgcagagaatggggactccgcatcggacacctcccccttgaaggaggattcggtgccagagagcttcagctttgggtatcacccccatga

SEQ ID NO: 1711 - DNA, 636 bp, Chlorella protothecoides
atgcagatgaaggaggagaacacggagcagggtgtttccaagcagcagctgatcctgggaacacacacatcagagggggagcaaaactacctgatgcgtgcagaggtgtccctgcctctggaggagacggagaccgacaacagagggtacgacgatgagcgcggcgaagtaggtggctttgggggcaccaccggccgcatcaacatcgttcagcagatcaaccatgatggcgaggtcaatcgcgcccggcactgtccccaggcgcgtcttatgcgaccactgaccctcttctcctcggccccaccctcgcagaaccacttcctcattgccaccaagaccgtcagcgcggatgtgtacgtcttcgactactccaagcatccctccaagcccgcgcccgacgggctctgcaagcctgacatcaggctggcggggcacaagaacgaggggtatggcctgtcctggagccagctccaggagggctacctcctctccggctcagacgacgcccaaatctgtgtttgggacgtcaagggcaccacccaatccaaccgggtaagcggaggcggtcggccggggcccaggaagaccgtgttggtggtgcaggtttcttgcggggtttgccacgacgctgattga

SEQ ID NO: 1712 - DNA, 570 bp, Chlorella protothecoides
atgactgtgcagcccctggcaactgcccggccctgtttcgcgagggcactgggggcaggccccctggtgggcccacgcccctccggcacagctcagggctggaggatcgcggctgagaagaccgagtctgcgcccaagaagaaggtggtggatcggcccatctggttcccgggcaacgaccccgagattcccgactacctcgatggcaccctggccggagactacggcttcgaccccctaggccttggctccgagccggagcagctgcgctggaatgtccagtctgaggtctttcacgcccgcaccgccatgacggcggtggccggcatcctggccgtgtccatcctgcacggcgccaaccccgcggtgccgcagtggtacgacgcgggcaaggtctacctggagcagaaccccaacgtgtccctgggagcgctgatctggaccaccatcgcactgagtgggtttgtggagttcaagcgcctggcggactggaggaagcctgggagccaggccgaccagtggttcctggggatccagaaggagttcaaggtgagccagggtgtggggtga

SEQ ID NO: 1713 - DNA, 258 bp, Chlorella protothecoides
atggacttcaccaccatgcggcgcaacctggcggcggggcactacacctcctgggacgcgctggaggtggacctgcagctcatgttccgcaatgcgcagacctacaacccgcccggctccgaagtgcacggctacgcggcggggcttgctgcggtcacgtcgcgcatgctggacatggcgcgggcggggcgcaccgacttccgcgcggctgccgccagcgaggcgcggcgcgccaacgcggcggcgcgcgccgcggag

SEQ ID NO: 1714 - DNA, 342 bp, Chlorella protothecoides
gaggccggcgacggcgccgacaccgcgggcagcgggccggcgcggggcgcgggcggcgaggttggcgacggcgtgccgcgcagggaggcgctggagaagatcctgtctcgcgtgcagaagaaggacacccacggcatcttccgcgaccccgtgacggatgatgtggtgaggacctggatgatgtgttgcatgactgttggaaggggggggggggttagagggcctgggcgctgtgtaacaggggttgtgtttggcatggtcctcgcagaagtgccacccggggctcgccacccgacccccatgattccttgggtgcatgcacgacatttggtatcagtctga

SEQ ID NO: 1715 - DNA, 1749 bp, Chlorella protothecoides
  modified_base (1002)..(1011): a, c, t, g, unknown or other
  modified_base (1112)..(1121): a, c, t, g, unknown or other
  modified_base (1189)..(1198): a, c, t, g, unknown or other
  modified_base (1408)..(1417): a, c, t, g, unknown or other
atggcagccggaagcatgtcaggtgagtctgaaggaggctttgggaagggtcactgccttctcggtgctgcagcaaagcatcgggaccctgtgcccgcgattgctgcgcctaatcacgttcaatgcatcgggaccctgtgcccgcgattgctgtgccaaatcacatcgtaccttgcccctgccagggaggcatgtgaagcatccctcaagcgactcggggtcaattacattgacctgtactacctgcaccgcaaggacccggcaacgcccatcgaggaaaccatggcagagttaaaggtgtgcctagcgatggtggggcctgggcctactggtggaggagggaaagatccgccacatcggcgtgagcgagcttactgccagcgatcttcgcaaggcgcatgccattcatcccctcacggccctccaactggaatggagccttttcacccgggacgcagagattgtggcaatgcttggcatgccacagctgattggctgcaacgcgcaggattggctgcttatcatgcacaagtcttgatcagttcattgcacggctcgcacaggatgaaatcatccctctctgccgcgagctgggcatcggcatcgttgcatttgctcgcccactcgaccatctggaattcatcagcagtagactccctggctcaaaggttgcaggggttggcttaccaccctcattccactgccacagactcccccttgggccgcggcgtgttgtcggggcagatcaagagcatcgacgacctgggcgaagatgactggcggcgaacgcagcctcgcttccaggctggggcctttgagaagagcccgatcgcttatcccacacctccattcgccctttccagaacctggaactggtcaagcaggttcatgagcgtgcagccgccaagggcctcacgccgggttgctggtcttcagcaccttgctccccctaatcatgtgtctccgctctaccccgtcaggccagcttgcgctcgcctggcnnnnnnnnnnttgccaagggcctcacgccgggttgctggtcttcagcagcttgctcccccaactatgtatctccgctctgccccgtcaggccagcttgcgctcgcctggcnnnnnnnnnntgtgggggagaggtacgacccggtcctcatgcaggtacgcggcgacggcagcaagccagtgggttggnnnnnnnnnntgctggcccagggggaggatgtggtgcccatcccggggacaaagcggctacagtatctcgaggagaacctggctgccaacgaggtccggctgagcccccaggagctgaaggagctcactgagctggcggatgccgcgcaggtcgtgggggagaggtacgaccccatcctcatgcaggtgcgcggcgacggcagcaagccagtgggttggnnnnnnnnnnaacggagtgatcaaatggaggtgactgggttgatgtgggagcatgggcgtccttcaggcactggagacactgctgactgtgaagaacatctccagcatgcactgaaacaatcctccaacaacgtgctccctgcagagctcattcaatggttgaaggacctgctggaagtgatatcggtacagaaccccaagggcaccaggaagaacctggaaagtgctgcgagcttcagtttggaggctttgaccaaagctctcccctgtgatgtgttgcaatatcaaggctggattccaaattcttgtgaccatgaagcttcggcgtcaaagtatgtgtag

SEQ ID NO: 1716 - DNA, 522 bp, Chlorella protothecoides
atgaaagcctgcgagatctggtttgccatggatccggcgtttggtctggagatcgcagggatgtcatggggctaccacaactccggccctcccgctgggaccgaggaggactacatcaatgtaagaccaggaaggccaggctctaggcaggtgatccacaaggccattgaatcaggatgcatgctggacaccagcgacatctatggccccttcaccaacgaagagctcgtggggaaagcaattgccactataccccgagagaaggtgacccttgccacaaagtttgccctttactacaaagaggatggttccatggctgtagatggcagcaggaagcatgtcagggaagcctgtgaagcgtccctgaagcgacttggggtcgactacatcgacctgtactacatgcaccggaaagaccctggtgtgcccatcgaggatacaatggcagagctcaaagtgcgggcaggacgggggagtgggcagcattgcacgattcttatcatagaccaacgctccccatga

SEQ ID NO: 1717 - DNA, 888 bp, Chlorella protothecoides
  modified_base (496)..(505): a, c, t, g, unknown or other
atgaaactggtggaagctgtgaagaagctggcagattcaaaggatgccacagcaggtgagggagggagagttggcgcattggtggcaagtgctctacccaatggaattgcttgtgctccaccaagaaggtgtcacgggccaatcttttgcgtagctcaccgtccctgtgcctcgcgctgccagctggcgctcgcctgggttctggctcagggagatgatgtggtgcccatcccggggacaaagcgcgtcaagtacttggaggagaacctgggggcgttggacgtcaccctgactgcagaggatctggccgagctggcacgcattgccgacccctccaatgtcacaggggcacgctacagcgaggcggcaatgaaggcgagtctggctcttgttcttgtttgtttgagcagaggccatccggggggccaactggtgcaaggtctttcaaggtatttgacgtcggcaatcagccgattcggatcctcctatttccaannnnnnnnnnatttgagcagaggccatcggggggggcaactggtgcaaggtctttcaagttatttgacgtcggcgatcagccgattcggatcctcctatttccaaaccacctttcacctcacagatggcttactccagaaagagcagaacgaatatcttgtggcattacatgctgtaagtattacagtggaactgaaaggaaggtggaccccactatgcagtactcaggagagccattatacatccacagatcctaatacaatcaacgcagaaattattctaccgcctcagaacctggtgcagagtgttctcgctacaggtaagtatctacaatctcggcatgacatgctgtcaatcggagtggaatgtcgagcgttggggagcttgaaatga

SEQ ID NO: 1718 - DNA, 531 bp, Chlorella protothecoides
atgcgcgcgcacactagatacaaatacaagcttgcttccacaggcatggatgccctggctcgtgcgccaacctacgagtacacgaccctgaatgagatcgttggccacctggaggagcgccaggtgtcccagtcgtcaggcgcattcaggcccagacagtattatcccaacatctacctcgtcgccctggagtgcagcaccgttcaccagtgtcgcgggggtacaggcacgctggattgggaaacgaaggaagcgtgtcgtgaccacatcaacaacacccaccagacctgtatcccaacagatcggtactgcagcctgaaggtgatcgacccctcatgcgccgagaacccagagctgcagcatggtgtggagttcaggtgcttcatccccccgggaaacccaggaccgtgccttgacaagcctggggacatcctgagactgcacagagtcaaggtgccacatgtgcttggggtgggagtgagagcagggggccggcgcacagcggcatctcacaccacgcctgcgtcctga

SEQ ID NO: 1719 - DNA, 855 bp, Chlorella protothecoides
atgtcaggcttagatcatcttcttgcattattggtcgcagaggcgactatcgccatgcatgcgttgtgctggtttcggatggggtccgcacccaagaagtttgcgcgcgcgcgtgcaggaggaatctcaaggccacttgcacagggcatctttgctgggggcagagcgagcccttgtgcaagtacctgcagccagctcgatacgtacgcaactcggtccattacatatctttggcaagtttcgaggtgcggagcggcagggttgcaggcaccgagactcagccggagcccagggttgtccccgacccctggccatggcgtcatcttccgccgtcaccgaccagttgttcgggaccctagggcacacggaaggcgcgctgtaccagctgccacctgcaaccctttccaccccggcccctcacccctccccgcccgctcctttgcagcaaatgaaaggacgttcctggcttggctgagcatggccaccacgctgggcaccgtggccactgccatcgctggcttttcagtggaggatggggatgcctcggggcgcaagagctccatcagcccccgcaccgtggagctcatcagcatgctcctcctccccatctccgtgggcatgattgcgtacgccctcttcatcttctacagccgcagcgagaacatccggaagaaacggattggcttcttcgatgagaaggtggggcccctgtccgtcgcgatagtcgtcatgataagtctgacgctcattcttgcatccgccatcaaggatgtgtgtgccccactcctgtatagtgttgtaagaaccgtggctctctcatcaatgctaccctgggctagcattgacgagaagtga

SEQ ID NO: 1720 - DNA, 1140 bp, Chlorella protothecoides
atgcatggcgcccgcatgttgcgcgcagaacgaacattattcctatgtgagccattggtgctctttgcgccacctattaagcgcatgcctgggctgctgctggttgccaccccgcacacaggcagagcactcagagcggctccaacccaacacctcgttctgaatcgcgagccctcgagccaggctcacaacattgctctgcgtttctctgctcctggttccctgctcctcaaatccccgccgcgccgcaccctctcgggcttcgtgcgggccatggcgaaggaccaggacctcaaccccgccaacacctcggcctatgtccaggtgtgctcaatgaatcatggtggccatgcgcctctcagtgaccctcctcatggtgcaagcctgatgtcctttagccgtttcagagtcaattgcgtgccttgccgttcagcatgcgcccgcactgaaactgagcctcccgcttcccctttccccaaattgcaggtgctgggcgtgggcgctgatgccccctcctcctccccctctgtcctcctcttctttgaccgccagcgctacctgttcaacatgggggagggcttccagcgctactgtgtggagcaccggatcaagctggcacgcatgtccgccctgctcctcacccgcgtatcggcggccacagccggcggcctgcccggttccctgctcaccatggccgactcgtccgccggcgggctgctggccggccaggccagcatggcgctccatgggccgccggggctgtctgccctggtgaacgcctaccgcacctttgtgaacctgaaggacgtggggctgggcatgcaggagctgcagcacgcccagcccgccgtcgccaacgagctggtgaccatcaccccgtacctactcactgctggcgaggctgagggggcggctgctgcgggcggcgaggtgtccgcgctgggtgcaggaagagagggtccaacgtcgacttccgatgctgaagtgacggcagggagcacaagggaggccgctggcaaggacggcgaggagcgggccgccaagcggctcaagcccggtgagccaggacctggggcggtggcctgctatgcggccgagctcccagacatcccgggcaagttccagccccagaaggtgtga

SEQ ID NO: 1721 - DNA, 1233 bp, Chlorella protothecoides
atgtcctctctccatcaggcggctgcctggaacgcggtgacggccagccccacctcggccttcctgcttgcagaccatgccggcagcgggaagacgctggcctacctgctccccctggtccagaggctgaaggaggaggagcagcggctgggcctggccgccgtcacgcgcaccaacagcccccgcgtcctcatcctggtccccaccaccggacggccggctgtcgtggcccgctccccccataacaaaattcttcaccccactctcgtcactcttcccccctctccctccccttcccaccccccccatccagagctgtgccggcaggtggtgggggtttgccgccggctgtccggcgcggggttccccctgcgcatcacgggcctgaccacctcggcgggcaaggacagccagctggcgcagctggcggcgggcgtggatgtggcggtgggcacccccgcgcgcgtggcgggcatgctggaggacggctcgctgggcctggccgccctttcctgcctggtgctggacgaggtggatgtgctgctgggcaacaccaccttccccgagcaggtggaggcctcgctggcggcgcctggggcctcggacgcggggctggtcgtggtcaccgccagcctgcccggcgacctgcacgacgcgctgctgcggcgctggcccggtctgcgcgctgtgaccggcccgggcctgcaccgccccgcggcgggggtggaggagcggctgctggactgcagcggcggcgaggaggtgagcgaggagagcgggttcgcgcgcaaggccgacgcgctggcgcggctgctggccggcagccgcgccgcgcgcaccatcgtcttctgcaacaaggtggagggctgccgcgcggtggagaacttcctcaagcggcgcgagcgggccggcggcgcgcgcgtgttgccctaccacaccgccatcgcgccgccgctgcgcaaggccaacctccgcgccttcctggccgcccccgggggcggcgagggtgaggcgccgctggtcctgctggccaccgaccgggcctcgcgcggcatcgactcgggcctggcggagcatgtggtgctgttcgacttcccgcgggacccctccgagtacatccggcgcgtggggcggacggggcggggcccaggcggcacggggctggtgtcggtcctggtcctggggaggcaggttggtagtggcctttgctggggggcggcggggagtggatag

SEQ ID NO: 1722 - DNA, 471 bp, Chlorella protothecoides
atgttctacctgtcccgctctgtcgacgctttcttcctgaaccaggccgtccccgaccaggtcatcgcacaaaaggtgtcccaggtggtcgccactggcgtgcgttgctgcgcctacctggcgaccttcctggtcggcgccaacgctgtgggcctggcaggcggggtggaaagcgcagcgacatggagcctaggacgggtctgtggagcatggtggggagtgcccagcgtgcatcgtgccttgggcgacggtgacgtcgaggcaggtccctccagcgtatcctcactcgccgcgtacgcaggcctgacggtgcagctgctgctgttcgggccacaggaggacgagggcgcggcaaagggcggcgcgccgggcggcccgtcgctgcccaaggtgtcggtggtggacgacatcggcgccatccgccgcgcgtttgccgaggcggaggagcagggccgcggcgagcgcccctga

SEQ ID NO: 1723 - DNA, 450 bp, Chlorella protothecoides
atgcaggcctgtgctgtgtcgcggcgcatgcaatcgaccgcggccgtgacgcggctcaatcacctggccattgccgttcccgacgtccgggcagccgctgctcagtatcaagccgtgctgggggccagggtcagcgagccccaggccctgcctgaacacggcgtgaccgtggtctttgtgcagctggaaaacaccaagctggaacttctggagcctcttggggaggcctcccctgtggccaagtttctggaaaagaaccctgctgggggcatgcatcacatgtgccttgaagtttgcaatgtcaaggcgagcatggcggccgtctccgagcgggtacgcctgctcagctcagagcccaagatcggcgcacacggtaatcccgtcgtcttcatgcaccccaaggacatggcgggggtcctcaccgagctggaggaggtgccgcggagctga

SEQ ID NO: 1724 - DNA, 837 bp, Chlorella protothecoides
atgggggctgtgccccgctgccatgctccctgcccgcgctccccgatcaaacaggtggaggcctgcttcccgtgcgtcggcacggccctgccagtcatcttcccccgcgcccccgccggccccggcgccaccgccctgccctacccctccgtgggctcctgggtcaatctgcgcaatgtgggtgcccgcgtcgtggacggccagctccagggctttgtcactggccgcagcaagtgggcaccgcgacgggacgcacaggccgtcatcctgcctgccctgcacacccgcgtggccgccaacgccgtcgcaggcgcgacggggtggagcttggcggggcgcgacggggtggggcttggtggggtggatggcgatggcagggcgtggcccaagctggggtgtgggtgtgcagcggtggcaggcacaggcgaggcggctcccgcctgcgccagctggaagctgcgtggctcgctcgacggtccccgcccgcgcgatgcccagaccccgcaccaagccaaaccctgcgcagactggagcctgggggcgccggtggtcgcgacgcccgtggacgcggaacggcccctggacacgctgcgcacgctgcgtgtcgggcccgcccccgcgcgctaccgggtcagggcgcaggtggtggagttctgcccgcgggagcccaccgccatgtggcagcggggcaccgaggaggagggtctcggtgagtggggcacccgagggtccagtgtcgtggggcaaggtgctcgccagcggcgcggcagagcctgcatgcagcttgcaccggggggcgcaggggagctgcagcatgcgcccctgtcggctgcgtga

SEQ ID NO: 1725 - DNA, 411 bp, Chlorella protothecoides
atgccaacagccgggcctgagcctggggccttgcccaccctctcactcgacaggtctgggcacaacgcctacaaccgcggcgggggacgcggccttcgaaagggccaggagccccgatggaagcgcagggaggggccccagggccctgggccgccaggtaactcagaggggcggcggccgttccgcggcccccccggacggcgcgagcccgtggatgaggggcgcgaacccccccgccccgccgacttcttcgctgcatccagcttcgaggacctgggggcgtccgaggacctgatcagggcgctgtccaagaccggcgtcaccaggccctcccacatccaggcatggggtttgtggggggatgcattgggcgtgggctgccgtgacagtgcagctgctgatgggttttga

SEQ ID NO: 1726 - DNA, 1320 bp, Chlorella protothecoides
aaggcgcccccacctccccacaagaaggcacccccacctcaccccaagaaggcacccccacctcacccaaagaaggcgaccccgccgcctccgaagaaggcgatcccacctccccacaagaaggcatccctgcctcccaaggaataagacgcccttgccaccgcacccccaacagactcctgctgggcagtcgtgacattgagtcccgacccttcactcgagcagggacaccacgtccttcctcaggcttgagatgtgcacagcttgatggcttgggttcctgggatagcttggtcgcttttgctcgtccgggttctcattgccgtggcctgggaccccacttgtgcaccctgacacttgccttggtcgtgttcattggccagagtattttcatttacgatactccgctcaactgttgtaatcattataatgtggctgccggccgcaatacgtccgcgactagacttccacgttggggagcccacaaagaagagaaacacacgcttcaacctggcacacactgtccgccttacctggaaatgggtccatcaagctgtgtgtgtcgcctcggcacgttcgggccgcgacccgtggccctgctctgggcgctcttggtggttcggcacgtaagccttgcagcagcggatgcggcgaccatcactctaaactttatcgagtgcattgattcctccagcgagggcacgcctacaaacgtaatcacatgtacagccagtgtgacagcgtccgagatgcctctcaacgcttactggatcgactacacctggggtgacctgcagggcgaggtcaaaataggtgccaagcagctcaccagctttatcacctggagcggcccagggacctccatcgaggggtctgcttacgcatggtatcagaccttaaacgggacatacattcgttccaccaggattcccatcgccccgttcaagagtccccctcctccacatccagcacccccccctccaccccctcccccatttcctccctcgcccccacccccagagattgctgtcttcgactatgccttttgccgcagaatatattcagagaggatctattgcaccatttacatgaccttccagcagctaccaacaagtgtggtgcttaccttcaagatggcagacggcacgacagtgcaggaacagccattgaccaactccaaaacgatgacgtacactgcaatgttcgttggattttcgccttttgggacagtagaagccattctccagttgggcaccgtcatcactgttgggccctacccaatcagcgacgactcccttcctcccccgccccccagtccct

SEQ ID NO: 1727 - DNA, 5514 bp, Chlorella protothecoides
  modified_base (1269)..(1278): a, c, t, g, unknown or other
  modified_base (1850)..(1859): a, c, t, g, unknown or other
  modified_base (3882)..(3891): a, c, t, g, unknown or other
  modified_base (4186)..(4195): a, c, t, g, unknown or other
  modified_base (4721)..(4730): a, c, t, g, unknown or other
  modified_base (5092)..(5101): a, c, t, g, unknown or other
atgtcttacccaagcgcatcacagcaccatgccctcttcctgaaatcaggcccaagctccagcgtggacacggcctgctcctcctccctggtggccgcccacctggcagccgccacgctcacccggggcgaggccactggcgcggcggtcactgggtccaacctgctgctggacccggccaccatggtgggcattgcgcgcctgggcgcgctctccacctcgggccgctgcctgtccttcgaggcagccggcgacgggtacggccgcggcgagggcttcctggcggcggccctggccgcgggcgggggcagcaatgctgagaggcctccgcacgcgcttgcagcgctcgcggcgtccgcggtgaacctggcggggcggggcagcgccctcaccgcgcccaacggccccgcccagaccgccgttgtgcgcgcggcgctggcggccgccgggatcagacccggcgcgctcgccgcgctcagcgtgcacggcacgggaaccgcgctgggggacccgctggaggtgggcgcggcgggagcggcactgggaccaggcgccccgctggccctgctctccaccaaggcgtgcctgggccacaccgagggcgcggcggggctgacgggggcgctgggcgcgctgggcgcgctgcacgcccgcgctgcgccgcccaccctccacctttgcgtgctgaatccgcacgtgggcgccgcgctgggggcggggggggggtccttctccgtgctcctgccacgccagcgcgccccgctgctgctgccacgcggcgcggcgggaaccagctcctttggcatgagcggcgtcaacgcgcacgccatcttggatgccgggcgtgtggcgatcagtgatgaggtgaagagcggggcgcgtgacgagcgcctgatggagcgccggcgattgtggccgcgcccggcgcccagcccggccctggagagggccctggcagagccggggacagtccgcttcgacgtcctgctctcccagccgggcctggccgacctcctggaccaccaggtgcgagggtggggcgtgggattcctgggtgctgggccaggcactgctcccggccgccatgagtctggagctgatggcctcgggcgcggctatgcttgtgcatggaaatcccactgcacccggaagggcagagcctggcgcactgctggtgggtgtgaccctgccatccccagtccgcctcggcggcaccgcaccgctgcgcctgctggtacgggaggaaagcgcgagcatggagtctggcannnnnnnnnnaagggcagagcctggcgcactgctggtgggcgtgaccctgccatccccactccgcctcggcgccaccgcaccgctgcgcctgctggtgcggggaggaagcgtgagcatggagtctggcgggcacatcaccggcgccgggagcgtcgccaccgtggcgcacgccatggtggcgtcctggcgtgcaccacattgtcaagctgcgccaaaccctgcgcgggcagcagtcctctgcggcatctccaatggcccatcgggtccctccagtggcatgctgggctgcctggcgggtggcgccactctgcctgccgtcctccatgcagccagggtggacgccgggctgcacctgggcgccacgattgctgccaggatgacggtgccggtctcctttggtgccgtggccgcgagcccggcaatcctgcccccctggcagcgtcacagggaggcctgggtggaggccggggacttccaggccgccgggcatcggggaccggcatctgccagcttcgggatgcgcggctccagcgaggcgcggctcataaaagtacagagcaagcccctgagcactactgctnnnnnnnnnncgaccacgaggggagcggcaggtcgagcggggcgcaggaggtggctcacatggtgtacatcacgcagtggcaggcccaagatgctggggttgctgctgccaccagcagatgcgccgcactcatgtatgcagcagcaatccggcaccaccagcaacgtgagaggattgatggcgcgcgacagcacgccaacctgcatcccaacaagtcagcagcgcaggagaccctctggctggctggggactcggcgttcaacactgcgcagccagcagcagcactggctctgctgcagactctgagcctgggtgtgggtcccttgacaagtctcagcctctggggctgctccctgcagccccagctgagtgccacgggggcgatggcacgcgtggcagcccgcgagcgacctggtggtattcaagtgcacgccgcgggcggcgacctgcacgcagtgggatcgcgatcctttgtgagaccgtctggcggcccaagcatcatcccaccgcacaacgatgacgacgccgacgatgacgatgatgggtacggctcctggcggggggcaggcggcgtacgcatgcagccgcggctgctgccctgggtgggaccgggcgaggcgctgcgcggcaatgatgtcggcgcctcgcatggcgttgcattagtcaccggcggcctgggcgagctgggcggcctggtgatgcggcacctggcgatgactggccggcacacggcgatccacgtgctgggccggcggcgacgtgctaatgcgttggctccgctggaaagcacgagcctgaccagcgccaccctggaacccaccctcagcctcttccacgccgggggggtgctcgcggacgcgccgctcgccgcgcacaggccggctcagctgagagaactggccgctcccaaggccggagcggggattgcgctgctgcgctccacaagcgtcctgcctgtcctcgtgacggccctgttcgcgtctacatctgccacgctgtcgccgccggggcaggccgggtacgcggccgccaacgctgagctgggcgcgctggcggcgcgagccagcgaccgcggcctgcccgtgctgtctgtgcagtggggggcctgggtggtgggcatggcggcccgctccccagccctcctggcgcggctggatcggatcggggtgggcctggtccgcccagccgcggggctgcgggcactgcagcgattactcatcgccaggccgggtggggcgccgcctgatgtgctggccagccccttccactggggccgcatggcggccgccggggagggccaggtccgccctgccgtttttgaactggcggctgaggcgcagggggagcggcagggagctgtgagacatgaaggagttcacaccaacgaccccgccaatgactgccagctccagggtgtggacgcgggaggcactgctggccgagatcctgttggtcctggcgaccctcctgccgacggaggtgcgtggttgtgttgtagacaggaaggtgttccaggggtcttggacgcaagggagggatgttatgcgggcaggggtgcccacaatagcacagccggcctgcaagctcaccccacatgtccaaaaccctccatcacatgtgcacaggtggcagaggacaccacctttgcagaggcgggcctggacagcctggcggcggtggaggcgcgcgacatgctggcgcgccgcctgggcaccgccctgccggccaccatcctgtttgacaccccgcaccccgcagcgctcgcggctgccctcgaggagcagctggctgagcgcgccgaggtggtgcccatgggcgctgctgacgggctcgctgcattggcggggtcgccggtgcgatcaacatccgtggccatctacacaaccgcttcgaggttccccacgcctgtcggtaactcgccaggtgcgtgggcgtggataagggtgcacgctttcttgtccggcgaaaaggcgctggcagccactgtccagttgcagcaaggtcaaatagaattgcgcatggtcactcctctnnnnnnnnnnctggcagccactgtccagttgcagcaaggtgacacagaatcgcgcatggtcactcctccatcacctacaccttctcttctgcctgaccatgacagatgctgtgggcctggttccctggtcgcgattagcaggcgccgaggcggccgccatggacccccagcaccgcatcctgctggagctggcgggtctgagcctgcaggagctgggcgatggcatgcgggtggacagggacacgaccggcctgcgcagcctggacccagacgcccagtcatcctccctcacccttccactctcnnnnnnnnnncttgcgatgcgctgaggggatgcacaatgtggcgtcagggcctgcgcagcctggactcagacgcccagtcatcctccctcaccctttcactcttcatccaaaatctccccaacctggaccatccaggcgtgtacgtgggcagcatgtaccacgagtacgcgggtgtggcggcgcgcgtgggcgccgcgccctccccgctcgccgtcaccggcggcggcccctctttcctggcgggccgcgcctccttcgcgcacggcctgggcggtccctgcctgtccctggacaccgcctgctcctcctccctgatggcgctggcgctggcggcagacgcgctgcgcctgggccaggccagcgtcgcgctggcggctggggtgaatgccctgctggacggcgcgaccacggccgccatctgcctgctgggcgcgctgtcgccggtcgggcgctgccgcgcctttgacgccgccgccgacggctacggccggggcgagggctttgtcacgctgggactgggtccattggccacagnnnnnnnnnncgccgccgccgacggctacggccggggcgacggctttgtcacgctgggcctgggtccattggtcacaagagatgagcatggcaccctgctccccccaccgctcgcgcgcatggcgggctgggcggccaaccaggcgggatcccgcgcggcgctggccgcgcccagcggccccgcccagacgcgcgtcgtgcgcgacgcgctgcgcgccggcggcttggaccccggcgcggtcgctgcgctgagcttgcacggcacgggcacgctgctgggtgacccgctggaggtgggcgccgcgggagcagcgctgggcgcgccggggtcaagcccgccggcgctgctggcggacaaggccatgcacgctnnnnnnnnnnggcgccgcgggagcagcgctgggcgcgccgaggtccagcccgccggcgctgctggcgggcaaggccacgcacgcgcacacggagggcgcggcgggcctgacggccacgctgtgcgcgctgtgcacgctgcaggaccgcagcctggcccccgtcctgcacctgcgcaccctgaacccgcacgtggcgggcgcgctcggcgactggggacgaggcccgggagggaaggcggccgccgcgctcccccgccagtacgccgggctgcctgggaacggcaggggcctggccggcgcgagctccttcggcatgagcggagtgaacacgcacgtggtcctggcaccagtcgacaggcttgcgctgggatctgcagagggatcagcttgggaggtgggcggcgatgctgtatggaagactag

SEQ ID NO: 1728 - DNA, 750 bp, Chlorella protothecoides
atggagcagcccatcaggcaggctggattcctcaccgaggttgagagtttcgacctgagcctgtttggcatgtcctccctggaggcctgccttgttgatccccagcaccgcctgctgatggaggtgagtatggtgataaccaaggaaagcagggcgcttgctcgtgcagggctggggcccatgctgtggctcccgtctctttgccatcgtggcccttccagcgccccaaatacactcaacacacactgtgaaccccaagcatctcctcgattaccatctcccccatgcaacccctgcctgccaggcgtgctggcaactgctggtgaaggactcggtctccagcctctggggctctgccacctcggtgcacgtcggcatccagcagatggagtacggggcccagtcagcgccccaccagacctccatcggcccctacaccgcgacggggggcagcctgggggtggccgccgggcgcctcgccttcctcttcggtctgaagggcccggccgtcgccgtggactccgcctgcagctcggcgctggtggcgctgcacctgggcctgcaggcaacgaggtcggctgcagcgccggtcaatgcgctggcagctggggtcaacctgtgcctgagcccggggacgtttgcggcggcagcggcggccggcatgctcagcccccaggccaggtgcaagaccctggacgcctcagcggacggctacgtcaggtggggaaggatcatggagtgcaggcatga

SEQ ID NO: 1729 - DNA, 2193 bp, Chlorella protothecoides
  modified_base (174)..(183): a, c, t, g, unknown or other
  modified_base (243)..(252): a, c, t, g, unknown or other
  modified_base (432)..(441): a, c, t, g, unknown or other
  modified_base (629)..(638): a, c, t, g, unknown or other
  modified_base (1123)..(1132): a, c, t, g, unknown or other
  modified_base (1562)..(1571): a, c, t, g, unknown or other
  modified_base (1971)..(1980): a, c, t, g, unknown or other
  modified_base (2051)..(2060): a, c, t, g, unknown or other
atggaatcggggaggccagtgcttgagcatttgaccgaaagcatgtcagagagtccatcagacaagtgcatacgaatgcataccattgtccgagagtccatcagacaagtgcatacaaatgcataccattgtccggtaagctcagcgcgccaggcaggagaacataaaacccannnnnnnnnngccttcgtggccaccgcttccgccctcctcgaggccgtccttcctgggacgggtgggggnnnnnnnnnnatccactcgctccaccatcccctggaagggagggcgctggaggcgcgcggagcagccgccctggctgcggctcgtgcgcgggcgcccccccgcccctcgctgcagcagcgcatgtttgacgccttcgtggccaccgcttccgccctcctcaaggccgtccttcctggaacgggaggagannnnnnnnnnaccagctgccagccggatggcagcgccctcagccaccccgcccgcctggatgccgccacccatgtcctcagcagcctgccccggcccgtgcacggcaagcccggggggctgctgatgccggtgggcatccgggccgcgctttccaccgcctcagctgggactggcctgccacggtcgggggacgcacnnnnnnnnnnagggagcacggcaggcggcgcggcggcagtgggccgcctggaggatgctgggcagaggcaagagaacggacggcggctccacaccagctgccagccggatggcagcgccctcgcccaccccgctcgcctggatgccgccagccatgtcctctgcagcctgccccggcctgtgcatgccaagcccggggagctgctgatgccggtgggcatccgggccgcgatttccactgcctcagctgggactggcgcgccacggtcaggggacgcaaatgctggatgggcgacgggccggggccaggcccagcttctggacactgtgcttgcagacatcactctgggacagagtgatgtcaccctttccagctttgagctcagggtgagggatggtgtgagaatgggtgtgatgaggaacacaggctgtgtgggtgtgcatgaccaggctttggcagctgtccatgcccaattccgacaccacctccgcagtnnnnnnnnnnagggatggtgtgagaatgggtgtgatgagggacgcaggctgtgtgggcgtgcatggccaggctgtggcagctgtccatgcccaatgccgacaccacctccgcagcctgcgacggcaagcatcagaccggcgccagctggcattcctgatgcaacagcatcccctaccagccttcgagcacggcgctcagagcctgagcctgccattcctgccatgctgccagaggaccccgctgcccccagcttggaggatgctgtgagttcgactgtgcagatggtcgtggagaagctgctcggtgcagccataccagcggatcagccatttgccgaagcaggcctggactccctagggagctcccgctacaaattcttgcttggctatgcttcatggctgtcaacaccagctgccgccccacaacaacaaccaaggtnnnnnnnnnnatggtattggtgtgcatggttgcattcacagttgaaacaatggctcgagggagcacccgcttcaacttcttgcttggctatgctccatggttgtcaacaccagccgccgccccacaacaacaatcaaggcgccgtcgatctgaggaacgacctggctggcgcttttgggctggacctccccgccacagccagctttgactaccccaccagggacagcatgcgggacttcatcgtatctgagatgatagaggtggggcgcaccgtcccagactggggaccaggtcccttgactgtccagtcaatcatgacagaggtctgtggaggagagagaaggaggtttgtagcaggggcttcgtgtacggttgttgctgtcagggtcacgtttgctgttatggggaannnnnnnnnncactcccaggaccggcagcctgcgctcccaccccacatcttgccaccatcagtccctggggcaccccctcnnnnnnnnnnagagagaaggaggtttgtagcaggggcttcatgtacaggtgttgccctcagggtcacatttgctgttatggggattcaagtctggcatcgtgcaccttccaatgactgcttatttcacagtgtctcatcctga

SEQ ID NO: 1730 - DNA, 1992 bp, Chlorella protothecoides
  modified_base (172)..(181): a, c, t, g, unknown or other
  modified_base (368)..(377): a, c, t, g, unknown or other
  modified_base (904)..(913): a, c, t, g, unknown or other
  modified_base (1341)..(1350): a, c, t, g, unknown or other
atggacccccagcagcgcctcctcctggaggtgagggcgatgggcatgcaggatgggtcacccctctgcctgctccctcaagtgaagcagtgcaggggtatgtgtctgagagacaatgcctgggtgatgactttggtccccaagtacagctctccgccggccctcaaaaacnnnnnnnnnnattgcaggggtatgtgtctgagagacaatgtctgggtgatgactttggtccccgagtacagctctccgccggccctcagaaatccgtccgctccaaacctccacccatcaggtgacacaggaggccttcagtggcgctttcttctctacgtcgtcccagccccccacctcaacctctgtgcatgttnnnnnnnnnncacccatcaggtgacacaggaggccttcagcggcgcattctcccccacatcgtaccagccccccgcctcaacgtctgtgcatgtcggcatccagcagatggagtatggcgggctgagcgccgcctggcaccccctgggcgccacctcggccacctccacgcctttcagcgtggcggcggggaggatctccttctcatggggcctgacgggtgccgcagtctccctggacaccgcctgctcctcggccctggtggccctgagcctgggtgcgggccgggtagaccccggcgcccccgccctggtcggggcggtgaacctgctgctggcacgcaacacctccgccgccgcggcagcggcaggcatgctgacgcaggatgggcgctgcaagaccctggacgcggcggcagacggctacgtgcgagccgacacggtggcggcactggtcctttgcagccctgtgggtgcccgtgacgacggcggcaaacgcgccggcccagctgccgtcatcctgctgcgcggctgcgcannnnnnnnnngccctgtgggtgcccgtgacgacggcggcagacgcaccggcccagccaccgtcatcctgctgcgcggctgcgcggtgaaccaggacggccgctcctccagcctgaccgcgcccaacggccccgcccagacccgggtcattcgcacggggctggagctggcggggctagcgcctccccagctcgctggcctggagctgcacggcaccggcaccccactgggcgaccccatcgaggtgaacgcagccgtcgcagcgctccccggcgcgatcaggctctcggccgccaaggccagggtgggccacgccgagcccgccgcgggcgccgtgggcctcctgcaggccgccgcccagctcagcgcacacagcgtgcaccccctggtgggcctggcgcgcgtcaacgctcacgtggccgcgtgcctcgccagccgnnnnnnnnnncgcacacagcgtgcaccccctggtgggccttgcgcgagtcaacgctcacgtggccgcgtgcctcgccgacctgccgcgcgggcagcctgcgccggtgctggcgcgggagggcgctggcagggcggagcgcctgggtggcgtggcctgcggcgtcagcgcctttgccttccagggcacaaatgcgcatgcggtgctggaccgcagacccgggggcgagggcgcccccaccccaagctccgccacgccctggatgcgggagcggcactggttcgggccggcagccctgctcctcttaagttcagtccggccccgcccagacaacatgctgcgcttccggctggaggttggcgcagcgcgggcagcgtacctgctggaccaccgggtggcagggcgctgcgtcctccccgcagccgccatgctggagggcatggcggccgctgtggtgccgggatacaacgcgggtatcgccgtgaatgtctttgtggagcgcctgagcatcagcgctcctttgatgctgcatccgggcaggggcatggaggtgggcgtggatgtcgatgttgccagggccggcatgcagctggccagcaggactgcggcgggaggaggcgggacccagcttcacgccacgagccaggctggtga

SEQ ID NO: 1731 - DNA, 3885 bp, Chlorella protothecoides
  modified_base (236)..(245): a, c, t, g, unknown or other
  modified_base (2596)..(2605): a, c, t, g, unknown or other
  modified_base (3248)..(3257): a, c, t, g, unknown or other
atgcctgctggccgccacggcggcgaaccaggacgggcggtcctcggccctcaccgcgccctccggccctgcccaggtggccgtggttcgcgccgcgctgggcgccgcccacttgatcccggccagcctggcggcggtggagctgcacggcacgggcaccgcgctgggcgaccccatcgagctgggggcgttggccggcctgaccccggcccgcgccggcccggtcctcaccgcgnnnnnnnnnngggcgaccccatcgagctgggggcgttggctggcctgatcccggcccgcgccggcccggtcctcacggcagccaagtcgcgcgtggggcacggggagacggcggccggcagcacgggggttgtgcacgccctgagccagatggagcgcggcgcctacgcagcgatcacccacctccgcgggctaaacccacatgtgcagggagccgtcggccgccgtgcgttcctcctgccccgtcaggaggctcccctgaaccggacagagggcgcgagggtggcgggagtgtccgcattcgcgttccaggctagttgtcaggggggaaccaatgctcatgtgctgctggacgcaccatcgggcactgcattggatactgaagcaattttgccgcccattccatggcagcgccagagtgtgtgggtgtcgcctgcagcccacccatggctcaccgtcgccagcattggttccagctcacgagcagcctccttccatgcctacctgagccccagctggagttttgcggatagcagctttgagggagggagcatcctcctcccaggcatcgtcatcggcctggcttctgcagcgctcatggtgctcaggccctatgccactccaacaaatgcaggcaggacaggtcttggatccatctcgctgcccaccaccttcgactccttggcaacgagaattgaagtgggggtggactttcttaccgccacagtgaatgtggcggccgctggccgaaatgatgtagctctactagcaggagcaatgcagcagattgggccctggagaggcaaatcctgcaagcgtgtggaccctgattacgatctttcctgccgcaaggggtcacccattctgcctgagttgctgctgcatggagtggtgaaggaggcactccccgtgaacctcacttgccaccttgcccagagcggcaagcaggacagcagcgcctgtacatcatggaggacgttggacacgcttgttgccctgggtcagcctggtcactgcccccatggcttgaccgcactggacgccctgctgccagaagagcttgctggagacacatctagctgggcgagcatgcaggcgggtttggatgctgctaccctgcctggatgtaggctcaagggaggctgttccaagcctcttgtcaggggcggtcaggactccctctctgagttgctctacacgacagagtggtctccggttgactggccgcaagatagtgatcactctgcacgctggctggcgctctccatcgcacaagacacttctggagataatgcaacaccttccatgacgctacccgccagcctgcaacaactgcgtggctgtatgctgggcgtcacgcgctgccaggagacagctgcgccagggtggctgccccctcgcaacacagagctcgtcgtcagcaccgaggcaggcctgcatgccctcctctcctccagcaaggtacaagctgtgttggtcctggcgcctccagcgccggagccctgcctccacgccgccagcatggcctgggcgtacacggcggccgcgctttgtgcgctgggctctgccgccaagaggcacagcctgagcctggtcagccagggcctgctgggacccgccggttcagaggcagccgcgcatcaggcgctagccctaggggtcgcacgcacccagttcatggaggacaggggctcgtacggcgtgaccctggacctgggggacggggtcacagccgcccagttccgggcagtcatggcggctgggcgggggacggagtacgttctggcggttgcaagcggccgcctcttctccgagcacctgcggcgccacgtgactcctgccggccctcaccccgccctggaactccagctgcaaggcaagacagcttttatctgtggaggcacgcagggcctgggcctgcgcctggccaggcagctgtccagggccggggtcaagtccctcgtgctcaccagccggcgcggcaagctggctgcccaggaggatgaacgcttctttgctcggcatggtgagtcccgcttcatgtctgggatgagtgtgagcagggtagggttgaaaaggggtggcgttcgattccacaaatgccccatgcgtcagcttgaacttccctctgcacactgcaccgaggtctttgttctgagccaggacgcgtccagtcccgcccagaatgcggacctggcacattggctggcctcccaggacctgcctcctgtagccctgtatgcccacgccgcgggtgtgctggcctacgacctcatccctgacctgaccagggacgctttcttggcggtggcccagccaaaggtgactgggaaggagtacccaaggaatctttggattcttnnnnnnnnnntgaccagggacgctttcttggcggtggcccggccaaaggtgctgggcgcggtgaccggcgtagatgcagaggtgacgctgctcttcggatccaccgccggtgtttggagccagtcgggcgcggctcactacgcagctgccaactccttcctgagggccagggcctcacaccgcgtggtcacgctgtcctttggccctttctctggcgcgggcatggccgcctccatgaggcatggccgtctccatgaggtgaaaatggagggatgtgcagaggtgctacccacacagatggacgtgggatcgtgcagggttcgctctcacatcagcctcagaccttcatcaatctccgccttgctttcctcgcagcgcttccatggaggcggtggggctggggatgctggagccggcgcagatcctgcacgccctcaggacggtgctgaggcagggcctccgggacgccgtcgtggcccgcctgagcctccccaccttttgcgccgtcaactcgatcaagggcccctggagcttcctggacgggcttcaggccggcgagcggagcgagacaggggagccacggctgcataccttttcaggccagcagcaggaagccgttcccgatcgcgagcccccacggcctcacatcgagnnnnnnnnnngcgagacaggggagccacggctgcatacctctccaggccagcagcaggaagccgttcccgattgggagcccccacggcctcacatcgatcagacggagctgctcgctctcgtgcagggcgttgccatcgaggtggtgggcgcagacgccctgacctcctccggcatgtttgctgcaggtctggatggagtggcacactccgacgtcaagccctcatccccctgcccgtccaacacccggccccaggagccttcgactccttgtcggcggtggagctggcgtcaaagctggggcagagcctgggcctgacgctacccgtcaccctggtcttcgacttcccctccatcccatccatcgcgcaagcggtgtctgagcgcctgggaggtggtgcggagctgcctgcgccagcagggcaagccattgctgcgcccactcaaccttccgatccagccagcactctcgaccaggctgtctgggtcgcagccatggcggcactcaccccaggcccactacatcaggcattctccagtgactgcattggcctggtgccgtggagccgctgggacgcagaggccaggccctccaaggtatgttgtttgggtttgggtttcctcatatttgcggcgtaa

SEQ ID NO: 1732 - DNA, 1317 bp, Chlorella protothecoides
  modified_base (141)..(150): a, c, t, g, unknown or other
  modified_base (362)..(371): a, c, t, g, unknown or other
  modified_base (1294)..(1303): a, c, t, g, unknown or other
atgagtggcgtcaacgcgtgcgcgctgcttgaggcagccggtgcactggaggagggtgcttcaaaagacctcgcctggatgcgcagacgacactggcccctgccgaggtcccacgccattctgtgtcgctttgcgtccccnnnnnnnnnnacactggcccctaccgaggtcccacgccatcctgtgtcgctttgcgtccctagcgatgggctccatcaggtaggggcatgtggatgtaagagttgtgcggcacggccacacagctgggaacacaaagtcggtggtgaaactacacagtggaatcaagtggtccacgcacaccttctcgatgcctggcccatcgattcctccttgcccctcannnnnnnnnncgatgggctccatcaggtaggggcatgtggctgtgagagttgtgcggcacggctacacagccgggaacacactggcggtggtgaaactacacagtggcatcgagtggtccacacacatcttctcgatgcctggcccatcgattcccccttgcccctcgccatcccctatgccaggctggaggggcggctgcagtcgccatgcctcgctttcctgctggaccacgtggtccagggcatggccatcctgcctggcgccgccatgctggagtgcgggctggccacgctgtccacgctggggtccaggggcaccccgcttccacacggcttcctcgccgccgtcagcatcccggccccgctgcccctggacggcagaacctccgtgctgtcctgcgaggcggaccccgccacaggcgcactgagggtggcatcagctgctcaacagggcaccgcgaccgcgcggaggctgcacctcctggccaccggttgcagggcgtcccctgcgacggggccgccagcatgcactgagacagccagcaatcctcccacggctgccgctgcactcctggccggcctgacgagcattgcgctgctgagcattctggaccaccccccggacatccacagcctggcggcagccagcgagacagccgtcatcgatcccgcctggcaggtgcaccccgccctggcagatgcggccctgcacttgggccccgccaccggagacgtgggtgtgcaggaaagcgtggcacgcacccgagttgtggccggcatggaggcggctggccgccctcctgccgtgcaggcgggccctgccatgacaacgggagcctgggtcacggggcgacgcgcccccatgactccagacggcactgtcatcactgaccacagcatccagcccctggcacttagcgtggagggactcnnnnnnnnnngggccctgccatga

SEQ ID NO: 1733 - DNA, 1017 bp, Chlorella protothecoides
atggggtcctcacgctgctgtcagcccaaaacacagctgtgcaccgctgctcattcctccagtcgtactgctgctgattcctgtgcatgccctcattcaacattggccagcctttccactcccctgtccatcctacctttcccattcctcctttcccacccccccaaaggcccctgcctgggcatggacacggcctgctcctcctcgctggtggcggcgcacctcgcgcgcgcctcgctcctccagggcgaggcgggcgcggcactggcagcgggcaccaacctgtgcctggttgccagcaccccaatccacctggcccagctgtcggcgctatcggcggtggggcggtcctgcgccttcgacctggccgccgacggctacggtcgcggggagggcgcggtggtcgtgaccctgggcctgtgtgactcgcatggcactgcgcgccccctggcggccctgcgcgggtcggggtacaaccaggacggtcgttcctccagcctcaccgcgcccaacggccccgcccagaccgcgctggtgcgggcggcgctggccgcctgcggggcggccggcgctgacgtggcgctggccagcgtgcatggcacgggcaccccgctgggggaccccatcgaggtggctgccctggggcaggccctgggttccgccctggggagcggcggcggggacccgccccccgcgcgtggcgtgcacctggttagcgccaaggcgcggctggggcacaccgagggcgccgccgggctgcatggcgccctggccgccctggcctgtttgaccctgggggcagtccccgccaacccgcacgcccgctccctgaacccctacgtcgcttcggcgctggaggcctggacgcagcgccgccgcccggggatcattccgagggtgagggagggggaggcagaaggcattcttggctgggcttgcgcagggaattcgtcgtacccaggggggtggaggattcaatggctattgtgggccgctaatgtaggtggcgtcctctga

SEQ ID NO: 1734 - DNA, 2883 bp, Chlorella protothecoides
  modified_base (17)..(26): a, c, t, g, unknown or other
  modified_base (633)..(642): a, c, t, g, unknown or other
  modified_base (837)..(846): a, c, t, g, unknown or other
  modified_base (1122)..(1131): a, c, t, g, unknown or other
atggcagggcctggatnnnnnnnnnnattcctcgccaggcccctgacgaccctgcatctcggcaccctcaacccttacgttgcgaccatctttgacggagagcaccgaaggagcgaagatggcagggcctggactgtccggcggcagggcggtgccccagtcagcaggcgagggtttgttgttggggatggtggtctggaagcctgcagcatggctcagcctagaggtggcctcctggctggcaatcccgtgctcgctcctgctcgcaccatgcagcagccagggctgctgctgcattcgtgcatgcaggtccggccaccactcagcactccgcagacactttcacccctcccccagccaccccacaaacatgcagccacgtcaggcacgcccccacgcacgggggcccacgtcaggcacgccgccacgcacgggggcgtgagcgcctttgcattccagggtaccaacgcgcacgccgtgctcgcggccgaccccggcgccgagctcgtgccggcgggaggggtgctggcccacgtggcgcggccgggcgtgcactggtgcctcccggtctggcaccccctgctgcagcgcgccaccgcgccgcccgccggtcccgcctgcgtcgcggcgcgnnnnnnnnnngctgcagcgcgccaccgcgccgcccgccggccccgcctgcgtcgcggcgcagctggacctgcccggcctcgctttcctgcacgaccacgctgtgcaggggcgcagcgtgctgcccaccgccctgctcctggaggcggcggcggcggcggccgcgctgctgggcgggcccacatctaccccgggggggtccgtcannnnnnnnnnggcggcggcggccgcgctgctgggcgggcctgcatctgccccggagggttccgtcgccctcggcgcggtggccttccccatgcccctcacgctggccgcacagtccctcgtgctggaggtccagctggagaggcgcggaactggccagggaggcaggtgcagctctggtgctggcgcctaaagcctcaaatcatccgggcccggcacaccggtgcctggcccccggtctcggcgagcggactcgggcgcactcccacgccaacctcccgcccgcannnnnnnnnnaaagcctcaaatcatccgggcccggcacactggagcctggcccccggtctcgacgagcgggctcaggcgcactcccacgccaaccccccgcccgcgtgcgccgcgctggattgcgccgggcggccgcgcggcccgcacgccgacgcgtgggccgacccagccgccgccgacgcatcgctgcagctggcggcggccctgacggcccccagggggcctttgaggctccccgtcggcatggaggcctacctgggccgcccacacgcctcgcccgcccacgcccgccccgcctgggtggccgcggtgcgggcggggtgcgcgacgctgctctcgcaccgagtgctgtgtgatgctggcgccccgctggtctcactgcacgacaaccagtttgcatccctggaggaatgggcggcgcgggccgcggcggcggcggccgcgtccgaggcgccggcggctgcttcgagccgggcggaagccgaggcgcgggccaagggccagccgagccacctggagagcaaggccgtggcccggacggagccggaagtcaggctgaagctggtccacatcgtgacggagctgctggggggggacgtggaggaggaacagccgctgatggccgcgggcctggactccatcggtggaacatcagtggacaccatccattggtcaccctttcccaaactccctgtctccgcaggggcagtggagctgcggaacgccgtggcttcggcctttggcatggagctgccagccaccgtggccttcgaccaccccaccattggtgccatggcacagctcattgccgggtcgggggttgatggggggaatggggagggggaaggccaggttgtgcatgctcccatcgtccctatgcagggtgcggaggggctggtcggcatctggagcgcagcgactcgagctgtgggcggagtggcggccacaggaggtgcgagatgggatatgggtgctgttcatgagaggctgaatgggatgcagcggcactcgcgcagcactcgcggtgcgtggttttccacacatcaagtcaaaggaggatgcagagcactgattcccctgtcccttcccaccaacccagccctctccctcacccagccccacttctcatccatctccagactttacaaagagtctctgggtggaggaggacctcgtcagcgtggcccctctggagcgttgggacgtcgacaccctgctgcttccagacgagatcaagcacgtgcgtttgaaggagtcatcgtggggtggccagtggtcgtgcgctgcctgcgatggctgatgcgctccccgccccacccccactcccacggcccacatcacacaccttcatgcgcagtccaccgggccgcgttttgcggtgtggacctcggaggtggccagcttcgacgacgcgctgttccagctatccaccaccgacgcggtgggcctggacccgcagtgccggctgctgctggaggaggcggtcgcggccctggccgggacgcaactggcctttccccccgcctcggcgggcgtttatgtggggtcggtctggaccgagtacagcgtgctgcaggacgccctgcgggtgcccgccaccaccgcggccctgacgggcagcgggctgaacttcctggtcggccgcgtgtcttacaccctgggcttccaaggtgggacgacggggatgtgcgtcctgggagggttgatgagagtcattgccagcctgggcatggtgcagatccctgttgtgagagacagtag

SEQ ID NO: 1735 - DNA, 1107 bp, Chlorella protothecoides
atgcccaccctccctccctctcaccacccccaggcatctgccatggacgcccagcagcggctggtgctagaggggtgctgggaggcctgcgccgccgtgctgccctcagaccagccgccgcccccggctgcggtggcggtgggcatcagctacgcggagtatggtgcacgtgcgcgtccccacggcctcagcgcgcacagcgcgcagagcgggacgctcagcgtggccgccggccgcgtgtcctacaccctggccctggccggccccgccctctgcgtcgacaccgcctgctcctcggccctggtcgcgctgcacctctgcgccggctcgctctgcgccgcggtccccggcctggccgccggggtcttcctgggcctggcccccgacgccgtggccgcgctggcgcgggcgggcatgctggctcccgccgggcgctgccggacgctggacgccggcgccgacggctacgcgcgcggcgaggcctgcgtcgtgcacgcattgttgcctgcggggggaaagtggggcgccgagagaggagggcgcgcgctgctttgcgtcgctggcagcgcggtgaaccaggacgggcggtccagcagcctgaccgcgccgcacggccccagccaggccgccgtgctttcctccgcgctggccggcctgccgaggggttccgccctctccgcgctggagctgcatggcacgggcaccgcgctgggtgaccccatcgaggtcggcgccgcgctgggggttgcgctgggggagcggggttccgcgctcaccgcgctggagctccatggcacaggcaccgcgctgggtgaccccatcgagatcggcgctgcgctgggggttgcgctgggggaacggtgtgccgggaatcgtgccccaaccgtgccgctggagctcatggcctccaagactcgcgcgctgcacgctgagcccgctgcgggggcggtgggtctcgccgatctggccggccgcctgctgggggaggacaggtggggccagggtgggttgctggatggtcttggagcaaatggggaggctgggcgttgtcctgcccaggctctgtcaagtggagagtgggatgcgccgaggccgataatacattaa

SEQ ID NO: 1736 - DNA, 438 bp, Chlorella protothecoides
atgacattgcccacgaaatccagtgcatgctgcaatcatcgagtggtccaccatggtgccaccctcgcatcacccaccatgatgcatctccatggttttgagtcccacctcgatctccctaaacatcctcaccctcgactcatcagagcttgcctcatggtcttggaggcggtacattggatgctcctcggccagccatgctcctggctgcaagcattgtgcgtgggtcctggcgacctcccagcacagacgccagcagtctcctatcaataccccacatgccatcctcccaggtctgtccctgcctcacgttgggacctggacactgagtggccagactccggtctggctgtcaagcgatttggtgcctttgttgacgatgtcgagctctttgatccagccctttttggcatcggcacccaggaggtgggtgggtag

SEQ ID NO: 1737 - DNA, 1017 bp, Chlorella protothecoides
  modified_base (110)..(119): a, c, t, g, unknown or other
atgcccccccactcattgccatgttgcatcatgaagggacagtgggtggtcacaacggatgaagaagatcaacaggaatcagtgcctcgtctgactgtccgagggcgatnnnnnnnnnntaggggaacaagggtattccgtgctttccctttctgctcacggatgccacccccactcgttgccatgttgcatcatgaagggacagtggttgtcacgacggatgaagaagatcaacaggaatcaatgcctcggtctggacaggtctgtcgtccagtccctgatcatgcgaagcacgcgcatgtcgaggacgcacgacgacgcacattcgctccaccaactggaccgagggagtcacactgtcggcggccctgccacagtgcagactgttgttattccgttgaccgcatcgtcgctgcgatgagccagtccgtcttccaacccgtaggccagaagcggctgaccaacattgcggtggtgcgcatgaagaagcatggcaagcgctttgagatcgcttgctacaagaacaaagagtgttgcaagatccccatcgcccctctatacttcctccgtcaccgtcctcgattcgcccccctacatctctctccgctctgcagcgagaaggacctggacgaggtgctgcagaccacgacggtgtactccaacgtctccaaggcggtcctggcgagccgggaggacctgaagctggtcttcggcacggacgacgaggacgcggtgtgccgcttcatcctcgcccacggggatctccaggtgtcggaccgggagcggaagctggagctagacaccaagttccgcgacgtggcggccgtgatcagcgagaagtgcataaaccccaccacccagcgcccctacaccatccccatgatcgagcgcgcgctgaaagacacccacttctctgtcgactccaaccgccctgccaagacgcaggccctcgaggtgggggcactgtcatgggggaaaggtgacggggggctgccatcgactgcagggcttccatga

SEQ ID NO: 1738 - DNA, 840 bp, Chlorella protothecoides
atggctgctcaagaaggaggcgtggcacgtcgtgctgctgggacgcagcgccaggtgcggttggcgccaggtgtggaggccactgactgcacaatgaaggccccaatccctctcccatgtcatcccactctacaatataatcgcaggctggcgccacgatcgacccacggagccgctctccgctcctcctcctccctagtgtccatggtggcgggcgacggcgcagcgtcggcggacgcggccgcgctttcctccctgcagcacctgcgccacctgggccttgtcgtcaactccggcggcgtgctgaccgacggcgtgctggcgcggcaggatgtcgctgccgtccgcgtctcggcggcccccaagctgctcagcgcgcaaagcatgcacggccggctcacggcgctccagccgctcgaccgcctcctgctctactcctcctccgcggcgctctttggcgcgcccggccaggccacctacgccgccgccaacgcggggctggaggcctgggcggcggtggcggctggcgcgggggggcaggcctccgcgctgcagtggggcgcctgggagattggcatggccgccgacgaggtggtgaggcagcgtgcccagcgcaccggcctcctgctgctgacgcccgcacagggcttgggagtgctggagtccagcctgaggctgctgggttcggtctccatgccggtcctggcagccgtgcctgtgatctgggggaccctgctcaaggtgggtgtgcacaggtctgataacgcggaagtagatgcacagttgagcagcagatcacttgcctgggttgcactgcaggatgtgaaatgcgagcgttga

SEQ ID NO: 1739 - DNA, 480 bp, Chlorella protothecoides
atgacgcacaccgctcgtcaagcacgtggctctgggcctacccatcgggccgcctcaaccctgccgatgatcctagacgctgtacaggagctggtgggaggcaccctgccagacccacaccagcccctgatggaggcggggctggactcgctgggggtggtcgagctgcgaaattccctggcgaccgccaccggactggagcttccagccaccctggtctttgaccatgggaccccggctgccttggcaaagcacatcgatgccctgatgctgccactgggggctggcgatgaggaaggcgatggggacgtggaaccgatggaggacgtgcagccaacacctgatggcctgatgccgctgagcaggtgggatgtcgaccagtatgtgtccaacccacccagaggcttggaggcccgctttggggccatcttgccagaggcagacctctttgaccctgggctgtacggcgtcaactggtga

SEQ ID NO: 1740 - DNA, 531 bp, Chlorella protothecoides
atggactcagggcccctgaccctgggcgccaccaagtcctgccatggccacacggagggcgctgctggcctgaccggcgcactgcaggccctgtgcgcgctgtcagacaaagaagatggcccagcgttgtacacctcgtgcaaaggcagtgcgtcatttcactccacatgcctccacaccatgcgacaggcggcggcacccgtcctgcacctgcgcgacatgaatccgttcgtgggcacgacttttggcgactggccccggaggcacggccttttggccagcatccctcgccagctggcgccggcgccactgcaccagcccctggcgggcaccagcgcgttcgggatgagcggcgtgaatgcacacgccatatttgagtggacagaggccgcccaggagggcctgactccgagcgcaggcggtgagaaattctgggagagagtaggagggggtggtccgctgcagattggccaggtcctccctgagaacatgtcagctcggcctcacaatgggtgccgtccaggttcttga

SEQ ID NO: 1741 - DNA, 717 bp, Chlorella protothecoides
atgcgctgggcgtgcggttcttcaccctctggaagctgggttcctgtgacctggctacccggagatgagggtttgggatatgttgcactggccgctgcccttcctcaatgcaagtccctggtctcaaacttcaaccggcccccctcaaatccccacaaggatgactgggtgtgcccggactgcgagcagggcaggcccgtccctgcccagggccccaccacggcgcggtccagggtgctgacgcgggcgggcctggcgctggcccgcatcgaggcgctgtgggccatgggcggcggcgcacacgccgccaccctgcgctggtactgcctgccggaggagacgcacgccgggcggcaggctgtcgacgggacaggcgccctgaatcaagttccacgacctctccacacacacacacacacgcaactcaaaactctcatctgccaaccactccgcccccgccacgcttaccagacgcaccacgcggcgcgcgaggtgttcctgacctccacgcgcgacctgaatgaggtgaccaccctcctgcgccacgcccacgtcctgccatcgccggagttccgacacgcgccaccggagcttggggacgacgtcttcctctgcgactacgagtacaacgaagcctggcagggggggaggccttggagatggggaagggaacgggtgcgccgtgcacaggcctgggcacgggttgtgcaactgtga

SEQ ID NO: 1742 - DNA, 384 bp, Chlorella protothecoides
atgtccttctgctctgaatcacttcgcagggcgcctacggcgtctgcagatgctgatccagcagcagccagtcctgcagcagagaggagacgagcagctgcctcggcagcgccacaggctgcaccggcccaggagacggtgctgtaccctcgggggcccatcgctgggctgcccgacgagtatgcctctcgcagggagcgctgcgctgagctggacgacctgcaggcgggctggaccatccagctgtcgtccaagggcgagagcggcgtggtggacgccgccttcttctcccccaggggggcgcgggtgggcgcgtatgtggccgccaggcggcaagccctccaagcatccaagcaagctgccgtggacctgcagccagcatga

SEQ ID NO: 1743 - DNA, 1605 bp, Chlorella protothecoides
atggtgcaccgcaagcatgcgccgtccccggcccagatcaaggccatgggcatgctcaccagcgaggcgggcctgaccgtcctgcgacggctgctggcgggaagctgggaccgtgctggcgcggtgtggggcgctgtaccgcggtcgtactggcaccatgtgctgcagtatatggcagaggtgccttcgctcctggcggatgtcatggaggaaacgacaggcagcgcggtcatggcgccctgccaggaccacgtccaggagggtgcatcgactgcgcaacagcaccacctgaagggaggcgatgtcgagcctgggctgcgagcgcttgttgagagcgtgctcggggtggaaagcttggagccaggtgttcccctgggcctgcagggcctggactcattggcggcactggagctgcgccagaagatccaggaccccgcaggcgccctgctggccaccgtggtggcagaggtcagggagggcatggtcaagacagcacgagcccagaaccccacaggccacaccttccagatcctggccacaacgcccataagtgcaagcagcacccctgaagcgggggctgtcactaggggagacacccatggacctgcgccgcctcgtcacccgatgcagaagccactcctgcgcatgttctgcctgccctacgctgctggggtgtccgccaacgtctttgcaaggtatggcgatggcagcgtgacccccagcagccatgggtcccatcagccccatccccactcgcaacgctgcaggtacccggagcggctgcccgcctggatcgaggtctggccggtggagatcccgggcaggggtcgtctcgccccccagccggcgcatggccaggtccaggacctggccgcctacctggcgcacaccctgccactggacgagctgccctacgtcctcttcggcacctgcctgggctccatcgtggcctatgagctggccgcactgctggaaagggaggagggccggcggctaccgctggccctcatcgtggcggccgtggccccgccccacctctatgctcgggctgtcatgcgcctttacctccagcgggccatgagtgagatgagggagtgggttgggctgagatcccgcggccctcacagaatgggcaagaaggcgtttgcaaaggatgcacagtgtgacctctccaaagacaccctgctcaaggcctttgaggccggaaattttgccggggtggaggagatgcggaggaacgaccgcctgttctggcgcgtcgcccccctaggcgtcgctgacatcagcatggcggtacggtaccaccacgaccctagcgtgccgcccctggcctgccccatcgtgtccctggacgggcggctggacgggaccattgaacgtggggccatgcgagggtggggccggcacaccctcgccgcccacacccacatccccatcagggcgggcgaccactactttgtggccaaggagtatcaggaggtgggtggtgtggataggagttcgcgcggaggaggtgtggggaaacctgttggtggctgcaggggatgctccgggcgaggaagcatgcacgttgtggtgttgtttgcaagtgtgagcctttcgtga

SEQ ID NO: 1744 - DNA, 588 bp, Chlorella protothecoides
atgcccatccacaacgtggagctgcgcccggggaagggcggccagctggcgcgggcggggggcaccgccgccagcatcaccaagaaggggtttggggggcagatgcgggagggagggaagcggggcacagactggcatgccgcacccctgctgcagtgctacttttgctccaggcctccacgcggacttttcaacacataccccccctcacctccccccccattccccatacataccaaaaccaacaattcaggcaccgacgggtatgcgaccatcaagctgccctccggcgagcagcggctggtcagcctggcctgcacggccactattggcgccctgggcaacgcacagcacaagaatgtgaagcatggcaaggccggcgcgacgcggtggcggggccggaagccgcgcgtgcgcggcatggctatgaactcggtggaccacccgcacggcggcgggcgcggcaaggtcaagggccgcatctcgcagacgccctggggcgtgcccaccaagggccaccgcacgcgcgacaagggcgcgcgcaccaactgggccatcgtcacctcccggcacaaggccaagcactag

SEQ ID NO: 1745 - DNA, 477 bp, Chlorella protothecoides
atggaggctgccgcctccatcacgggggccaccctcgacgcggactcccccctcatggccgctgggctggactcactcggagcagtgcagctccgttccatgctttccacccgcttcagccttgacctgcccgtcaccctggccatggactacccgaccccggctgcgctcgccgagttcgtcgcggccgaggtggcaccggagggcagcataggtgtgactgcccaccctgcaccggcttcaaatgcccctgggcagcagctgcaggacagctgcacgagtgtgctgggggtggcagggtgctaccccggcggcgagggccagggtttggacggctacagatccgcggcccaagccggccaggaccttcccacgccagtccctctggctcgctgggacctggaggcatactacagcccggacatctctggtgaggacagggaggtaccctgcctgcgctgtctctgctctacatag

SEQ ID NO: 1746 - DNA, 741 bp, Chlorella protothecoides
atgtgcggtgtgatccatccccggcaggccgtagtaagcaagggaccggtagttgcaggcaagcgggagcagaggggcttgggccccaaggtccggctggggaatgacaagctggaattcgtcccggccagaacactcgccaagggtggcaagcctactgctgcggccaagacccttgccaaggtgcagctcttcccagcagccccccacgccaagaagaaggccggacctgcacagagaaaggccagcctggctgccaagaccgtggccccagaggagaagcagcagggcacagagcggcgtgcagccaaccgccgaacggctgtggagtctgtcgagatcgacaatgtgacctttcgtaccggtgactccgtgtatgtcgtgctggacgactctgccatccaaggcctcaggtccggggatgtgttgggggggtggcatccaatggccgctgtacggtgttgcgatctggattccatgcgcaccgcctgcagccctgccaggcaggagtcctcaccccagttccttgtcaacccagcctgcctgtgtcacatatcccccaaggtcgctttcctccactcacacagcgacgacgaggaggaggaggcctgcgctacgtgcggcgaggtggaccgcgccggcgtcgacatgctggagtgcgggcgctgcctccgcggtttccacctctgctgtctggacccgcccctggacgccgtgccagaggtgaggaccgttgcctag

SEQ ID NO: 1747 - DNA, 636 bp, Chlorella protothecoides
atggcagccttcattcttgagcgactggcaggggcgcatggtaggaccgccacgaccccgcggccatctcagaacctcgttttggagcgcgggcacgccggtctgtcgggcgacggcgtcgccattgcaggcctcgcctgccgcctccccctcgccgccggcgggctgtccgatcttgccttggcgctggcatgcggcacagaggccacgagcctcgtcccgctcgctcgctgggacgtggaggcgcactactccccagacccgggggccgcggggcgcagctacgcccgctttgccgcctttctgggcgatgtggccggcttcgacgcggccctcttcgggctgggcagggcggaggcggcgggcatggacccgcagcaccgcctgctgctggaggagacggcggccgcggtgggaacggtgaccatgccctcctcgactggcccggtcggggtctacgtgggatgcatgtaccaggagtacccctacgtcctggccgccgcggaggcggggctgagctcctctgcggtgctgggcaactccatgtccttcatggtgggccgtatctccttcacctttggcttcacaggtatcttgggatgcgtggaggagcagcgatggtggtgcagggcttag

SEQ ID NO: 1748 - DNA, 303 bp, Chlorella protothecoides
atgggcctctgcgcggcctggcaggcgctggcgcagagcgcgctgccgccgctgcccacgctgcgcgcgctgaacccccacgtcgccgccgcgctgaccgagtggccgcgccgggccgggcggcgcggcggcgcggggcgcgccccggcgccactgccagggggggcgggggcgggtgcctttgcgggcgccagctcctttggcatgagcgggaccaacgcgcacgctctggtgagccgcgcgggcgaggaaggggactatttgactgcagcgcggcccaaggcctggcgccgtagcaggtga

SEQ ID NO: 1749 - DNA, 744 bp, Chlorella protothecoides
atggcagctgtgctggcggcggagcacgaagtcgacaacactggggagaggcaggaggtccaggctcagacctgggaggatgtcgggcggcccatttcattcgatacaacagccgccaagaaggccgtgcatctagtaggcttgtcctcgcggcttcccagcaccccgggtggccacctggcggaggcctgggccgtgcttgaagaaggcagggacctgcagggggtcatccccctggcccgctgggacgcctgggccgtgctggaagaaggcagggacctgcagggggtcattcccctggcccgctgggacgtggaccagatctatgcacctccagggaccacagccgcccagcgcccgacttcctacgcgcgcttcgccgcgctctgcgacggcgtggaggccttcgacgccggcctgctgcgcgtctcgccgggcgaggccctactcgtggacccccagacccgcctgctgctggagggcgtgcactcgctgctggcgggctccagcgggctcgaccccagggccaccggggtcttctctggctgcatgtatcacgagtacctgtctgtgctggcggcgggtggctcccagcagctgcccggcccggcctttgtcgggagcggggcgccctacatggaactaagggttggggtcaccgtggtgcttctgcatcatggtgtcgcctcctacggaactggcagcgctcggcagcaagccgcctacttccgacgctggtgctaa

SEQ ID NO: 1750 - DNA, 396 bp, Chlorella protothecoides
atgagcaggcaaccgtggcacggctatcattatcgccaggctctactcgtacattcccctgttcacctcacaacccctcctcaaatcccaacaacaggggtgctggagctgcagcggctgctgcaggaccagttcttggtagccttgccggccacgctggtgtacgaccaccccaccatcgccgaccttgccgccctcgtttcccagctgaggcggggcaggacgacgacgcgctcagccacaacatccaccacggtgcagctgctgcgctccatcgtggcaggggtgctggggcgggaggtggaagatgacgagccgctcatgcaggccggcctggactccctgggtaggttgccggctcccaagaaccaggggacaagagggctgctgtattag

SEQ ID NO: 1751 - DNA, 1710 bp, Chlorella protothecoides
atgctgcctgacatctctaccgacaggcagccaggaggcttcgcggcgcaccctgcgcaggtggacgctgccacgcagcttggaatcactatggtcgacctactccagaccacctcaacgccatccagagcctccctcagcgtgcccgccggcctggaacgctaccagcgcccggcgctggtgggctggaagtctgttcccggctgcatgcccgccggcggctggggcgagggtggtctggacgggcacggcaacaccgccagtttccgtctgggccacgccaccgcagttcgaggactgagatttgcggcgatgacaagtggcgcgaggagcagggcggcggtcgtcgctcctgcgtccctcgcgctgcgggtggcagaggcgcaggtctaccggccctgggctgatggaggtgaaagccgggcgcagggcgctcaagtgcttatgcacatgcatggcgctgcgatcaaccccaggcgtccacatgatctgctggcggcgctgcagcgggcgccgggaaggaccctgatggcaagcctgactacgagaagctggaccggtggcggtgcacctgcatctccactagcctccagtacctcagcagcggccgcgctcttcagagtggcggcgcgtgaggttggcaagccttggcgccatcttgaagcgagctgcctcgctgcttcccagcccatggcattcgatgctgcagagggcaaaggcgtgatcctcgtgcacggcggtttattggtgccggacatggtcgacgccacccggcggcggtcgactccccaccgccttgccctgccaggtgcttgcgcctgggtgactggcgccggcggagagctgggccggctggtcgctcgctgggcgacgcactccggagccggtagcctgctcctgctgggccgcggcagacccagggtcgggcatgagcgcgctgcggcgagcgccctgagagcgggagcggcaggagtccacggcatttccacctggctgacagcggatctcggcttcgcggctgatgtggcgtcgtgtgacagccggtttgaagcagccgccactcctagcgagccctgcggcctgctccttcacgcggcaggctgcctggcggatgccccactttctcaccagaccgcggcccacctgcggaccacggccgcgcccaagacggcccagctgcgccgcctgactccttgctcagctcccctctcgctagcagtggccttctcctcgctctccgcctgggcgggcacccccggtcaggccagctacgccgccgccaacgctgccctggacgcgcacgctgcgcgcgctgcgcacagcggcctgccctgtatcagcgtgcagtggggtccttgggcgtccgggatgacaagggatcgcccggagctggaggcgcgcttcgccagggcgggcctcggcctcatgctaccagaccagggcctcgctctgctgtctgccatcgtggccggcgggctcctgtcccagcccttgtttgcggggttgctgagcagtggtgagccggttggaggctcgatgccggtgggcggtgcacgagcggaggcggtcgtgcagattcctgccaggcccgctcggccgggcgggatccccacgattagtcagctcgtggaacgcgtcttgggcaggcgcctgaccgccgatgagcccctggtctccgcagggcttgactccatgggtgagcggggttag

SEQ ID NO: 1752 - DNA, 279 bp, Chlorella protothecoides
atgtaccccggcgaccccggcgacccgggagcggactgcgcgggcgtagtcttgtccaatcccggaggcggcggtgggctcaggcccggggaccgcgtctttgggctggcgcccggctgcctgggtcagcgcgtgcgtgtcttggcagacctggttgccccgctcccgccttcagtattctaccagaccggtgctgcgctgcccaccgtcttcatcacagcgatgctggcgctgcagcaggcagcctcctgcggccctcactccagggtgggtgcttga

SEQ ID NO: 1753 - DNA, 1614 bp, Chlorella protothecoides
atgtcggcgtgggctgccgcgaacgggagcacgccagctgagatggctgcagagcgggtgcccgccgagcgttcctcgccgggaagggccgcactcgcgaccaccatacaccgtgccgctctccctccagcgctggttcccttggcacacttgggcacccgccccggccgcgttgacgcggccacattctgcctggacccattcgccgcggacgcctgcctgcacctgggcgcgcacatggcagctgcggcggggcgggcgccggccgtgcccgccagcgtggcggccgtgagctgctgccaggctggaggaaaccgcggcccactggacctgcacgcgatggggagctctggaggaaagcgcggcccactggacctgcacgtgacggggagcgtggtctccggcgccgccctgagcagacaccgcatgcttgcgccgaccggggttgcgggcgacttcctggacctgggcacctctgcgggacctgtgcaggcagggagggggaggggtgcacgccccagcgccaggcaggtgcccttcacgaaggcaccggagagggccaccggcgaggcgcgtggggggcccagggctgcagcgcaggcgctgtacgtgacgctgtggcaggcctcccagcccggcgcggggcgtccagctccgggcgcatcccagcccgcgatctccgtcgcggtcgggggcaggcacgcgccggcggatgtgcgacctgctgggctggcgctgcgtggccgtgcaggcgccgggaccctggtggccaccctcctgggagcgctgcagggtctggcgcatgccaagcctcgcagcgtggccctggcgacccgaggcgcgcaccccggctccggccccgggctcagctccggcgcgagccccctgccctcggccgccgtcgggtggggcatgaccagagtagccgctgcagaggccccgcagacgcgctggagcctggtcgacggcgcggcgcctgggctgggtggggacaccggcggcagcgcggtgtgcgagggggtggcaactcttcccctcttggtggcccatgccctgcgcggcacatcctcgccagccatcgacgctgagcggctcggcacacacgttctcatcacaggcggactcggaggcatcggatcgctgctggcagcctggctgggagcttccacctcagtgcagctatgcttggttggccggtctggccgcgtcggggcaagcgctcagtcccctgcacctgtgttggacttccatgcggcctccagcgacgtttcagaggcgtcggcgctgcaggcgctgcgccactcctccgcctcgcttgccgtcctgcatgccggcggcgtgctgcaggacggcatcatcctgaggcagcgggcggcagcggcgcgcgccgtggccgctcccaagacgggtttcctgagtgcgctgacgaggcctggggtctgggggacgccgctgcaggccatctgcctcttctcctctgtttctgccttcatcgggtcgcctggacaggctgtgtattcgggcatcaacgcagcgctggacgcctgggctggacaagtggcgcgatctggcttacaaggtgatgggtggggtgggagtgtggtgctaggttga

SEQ ID NO: 1754 - DNA, 351 bp, Chlorella protothecoides
atgacagcggcctccctctctgtcctggccaggggaggcagctttgtggaggtggggaagcgtgacatccacgccgccagccgcgtcgggcaggagcgaccagacgtggcattcagcacggtcgccattgactttctcccaccacaggtcctgggcagatgcctcctgggcatgtctgcactgcttgccaggggggagctcggagcccttccgtgcacagcctacaccctgtcccagacggcaacggctctgaggcagctctccctctctcagcatgtggggaaggtggtggtccagaaccctggcatcaaggtgagcggagtatgccggggtgtctgctgcgacgtctga

SEQ ID NO: 1755 - DNA, 1089 bp, Chlorella protothecoides
atgctcagccccgccacccccgtggccatctgcagcctgcaggccctctcccgctccggccggtgcctggccttcgactccggcgccgaggggtacggccgcggcgagggcgtggcggttgtgtcgttgaggcggtggtcggcgacggcgacagacccctcagcaccgcagcccctcgccctcctcctcggcagcgcggtgaaccagaacgggcggtcggcggccctcaccgcgccccatggtccctcccaggcccgcctcgtccgcgacgctgtgggcgaggcgggcgccggggttgaggtagaaagcgtgctcgcgcacggtacgggcacccctctcggggaccccatcgaggtgggggccctactcggcgccctaccgccgcagagcgcgggccgagccctgggcctcggcgcgcccaagtccgccctggggcacaccgagggcgcggcggggttggcggggctggcgtgcgctgcggcggtcgccacacgcgcccgcatgccgcccggcttgcacctccgcgacctgaatcccgcggtggcggcggtggccgccggcggcgcacacctcccacgccagggcaggggcatcgcgcgctcgaccccaggcctgtgggccacggggaccagcgcctttggcatgagcggcgtgaacgcccacgccctagttgccgggcccggcggaggtgccgaggccacaagggccgccggtggcgccctcccggtgctcctgcagcccacccgcatctggcccctgcccgcaccgagcgtgctgctgctgagcgcgagcgccaggagcgcctccacggtcacgatgcagtgccacctgcattccgccggccagccagcggtcatgtttgagcgctacacgcttcatccaccggcggtggctctggagatactcgatgcggcggccctttgtcggggaggtggctatgccgacgcaccttcaggatgctccaggggccgtgctgagctgcaccacctgcctcgccactggccgaagcgaggtccacatcttgccgggccaaggggctgcagggcaggcgtcccttgcggccgtggcctctatcaatcacataaatga

SEQ ID NO: 1756 - DNA, 2514 bp, Chlorella protothecoides
  modified_base (262)..(271): a, c, t, g, unknown or other
  modified_base (1948)..(1957): a, c, t, g, unknown or other
atggccagacgccgcgccagctctttgacgcgccgcacccgcgccgtttggtggcacctcgcgcgtgggatgccaatggggagactccgggtgctacgcttgccccatcactatcggttggagggcctgcgcccatcccttccgcccccacagccacgagcgacggcatggcggggctgtgcctctccctcatggcatctgtgctggcggcgagggaggaggagggcgcgagggcggagcccttcacggacgacagccagcnnnnnnnnnncccattccgcccccacagccacgagcgacggcgtggcggggctgtgcctctccctcatggcagctgtgctggcagcgagggaggaggagggcgcgggggcggagcccttcacggacgacagccagctggcgctcctggacgccctcgaccttgcgccagggtctgttggagtcgttgagggtggcgacggggcggaggacctgggccttcgcggaggcacagccccctccgacactcaagatcagcacccggcctcgccagtgccaccaccactggcgagagctcccggcgtgtcggcccagtggccgcccgcccccgcgcccgctggcgtcgagccggccccctcccccgatccgcgggcgcggctgggtgccttcaacgccgtctctgcacgcctggggtccctgagagccgccgccctggacgcggcggccgcctcccgacccagctccatgttccgcggcctgtttgaccgcagggcgtctgtggaggctgaggcggcgggccgagttcagtcggcagaggagacgggccccagcacggcagcagggccgacaggccaccccaagtccgtacagccagtgggtcccaaaagggtctcctcaccggaggacgcgccactgcaccagactcccctggtgtggaaaggacggcggcatggggcagtcgcgtccgccgccccgccgtcttcctccggcagcgcatccccgctctcatccctggacagcgactccgaggaggacgggggcccaggcatggtagcagagactgaagcccctgcacctgctgcgctggcgccctggtgggacgacctcgtgaccctggcggtgccgccagggctcgccagcccccatgcctcgccgcaggcctcgccccggccccgggacgccaaggtgctgcatcggctaacatttggcccggcgcacggggtcactgcactggcggtcgcagcgggggacggcgccaggaatggaactccgacagcctttgccgcgacgcagtccggccagatccgggcggtcgagctggagagcgggaagcaggtagttctcttgggtggctgggttgttggctgctgttgtcaacaagcaggagggctcttgcgtcgatggctcttgcgtcgtccgagcacacacatgtgtgtggcccgccccgctgaacgctgcagccccgcgctgatttggtgggcaggatcccttgttcctggcctgccgccgctccacccacctcaatcaccccccaccctctcaaccctaacatcgtgttccgccttatcccaaggtgcgctgcgcgtcgctatccgcgcagccgctgacgtgcctggccctggcgcgccccgacccgcgcggccacccactggcgctggcgggcggctacgacggcgaggttcgtgcctactgcgcgcgcactggctgctctgccggcggctgggtgccgggggacgatgcggtgagcgcgctgtgcacgctgggatcgggcgtggtggtcgccaccgccagcggcggtctggcggcctgggagacgggcggcgggcggcatccctggcgccctgtcgggcggagcctgggcgacgggggcgccgtgctacccctgctggaactggagggactgcagggcgagggagcctggtctttggctgcactgcccgcgggctctcacccggggccgctgatcctnnnnnnnnnngcgggggcgccgtgctacccctgctggacctggagggcctgcagggcgagggcgcctggtctttggctgcactgctcgcgggctctcacccggggccgctgatcctggccggcacggaggcgggcgcggtgctgggctgggacccacgacgcggcggggccccggcctggcgctccgtcttgggccaggacatcgtggcagggctgagcgtagacgccggcagcgcccctcgcgtcagcgccgctgcggccgacggccggctgcgcctgctggacctccggcggggtggggcggtgatggcgagcgcggcgctgggcagccccctgctctgcgccgcctgcccaggacctggctggacggcggcgggggacgaggagggcgcggcgtggctgtggcgcgcgccggggggcgggcggccggcgcgggcctggcggggcgaggcaggggacgccctgaatgctctggccctggggccgccgggcccggatggaagcccacgggtcgcgctgttcgggactgagggaggtagcctcctgtgcgtcgatctggggttgtaa

SEQ ID NO: 1757 - DNA, 273 bp, Chlorella protothecoides
atgtggagcgtcctgcgaggcggtcctgtcaagtgcatggtcagctgtacacctcggcctccaagcgccgaccatgtgcaggtcctggatgccgcattgaggacgctgggctcgcaggatggcggagactactttgcggggggggagtacaccctggcagacattgcagccagcacccgcatctaccggccaatagtcctggtggaggatcactttggcatggacgtccagaggctcatcaatgagcatcgcctggaccggtgggccatgtga

SEQ ID NO: 1758 - DNA, 228 bp, Chlorella protothecoides
atgccagccaagtatgcgtccctgcacccgggccccgatgcccctgccaaggtccccatcctggacgatgccgatggcacagccctgtttgagagtctggtagtggcatactacctgaacgacaagtacccagagccggctctgctgcccagcgaggcggccgcaaaggcaaaggtgggagacgtgcgtgagggggcctggctcctctgcccgtggtcttgtgtctag

SEQ ID NO: 1759 - DNA, 468 bp, Chlorella protothecoides
  modified_base (110)..(119): a, c, t, g, unknown or other
cgaccccaccccccgcgcgcccgtggtcccggccggcctcaagcaccacggcctggagcagctggagtggggtgtgcgtgtggacgagttccactccctctccccgctgnnnnnnnnnncgccggcctcaagcaccacggcctggagcacctggagtggggtgtgcgcgtggacgagttccactccctctccccgctggccaagtacgtgcaccccgcggccgcgctgaagctgcagcagctgtgggacgcggggaaccgcctggtgtccgtgctgaacgacgcctccttccagtgcctggcgcagctcgacgcgcaggccggcgtggccaccgtggtggagacgggggaggcgctgcgcacgctgccgccggacgacctcgtcgccgccaacgccgtcttcgcctccatcgccgcgcgccacccgcgcgccgtgggcggggccgggccgggcggggcggggtcgggc

SEQ ID NO: 1760 - DNA, 204 bp, Chlorella protothecoides
tggacctaccaggccatgctgcacgaggtgctgggcatcgtcggagggtgcgtggaccttcgccacgtccccggggtcaagcccgagtttgcgcaggccgtgctgtccaccgccgcggaccccttctttgccaagcacgcgggcagcaactttggggaggtgggcgtcgccatcaagcagctggtggacgacctggcggggtga

SEQ ID NO: 1761 - DNA, 1494 bp, Chlorella protothecoides
atgttgtcactccgtgcgcttccggtgcatgcgggctgtgcatgtcgcttgctgggctgtgagaagtgttctagatccctgatctggaccagcgaggccctccccctgtcccatgacccccagataacagcgcccgctgctgtcgtcgggcagacccggcccgggccctgcccagtacaggagcgtaaatttggacgccttaaaggccagccactgtttggagagctgcggccccgagcgtcggtcatgccgggtgtgagactcaagaaccccaccgtgggcaacccgcctgcaagtcctccccgaacccgcacctgccgccatgcccgcgtggtccgggcgtgccacgccgcccccgacagcggtgggaggcaccgcgacccgttcccacgcacgagcatcccaggcagcacccatgccccgccccagaaggcgcgggaggtcggcgccggggtggacaattctgtcgaccaggcccctgccgctgcgcaggctgcgctgacgccggccactgcgtcggatctggaggaggatgcggactggcaggactggaaggcagtcatggcccgcacgcactccctgggtctgtatgattggctggtccctcccccctattctcgcccgcaaccccccgccctggttcccgcatcatcacccaccctctcacagctcccctcatcaaccctaccaacgccaccacaggccgaggcacacgaggaggcgtgcgccgcgctggacagctcggtggccctggacgcctacgcggcagccgccgcgctgcgcgaccgcctggccggcatccgcgcgcaggactgcctgggcgaggcgctggccgagctggaccgcgcggtggcggcggagcggtacgccgccgccgcctcgctgcgcgacatggcctgggcgggcctgcccggctggtggtcagggcgcggcgaccgcggcgacgtggcggggcacctcatccgcgtcagccggcggtacgggcactatgccgcgcacgccttctcgggccgcgacctggccgccgcgctgggctgggccccggacgcggtgttcgagtacgtgagcctgggcggcggggacgaggatgctggcgcgggcgaggccgacccggccgcgcaggcggtgctggagatgcacttccgccgcggggcgggcggcgcactggaggcgcaggccgtggcggtgctggggcccgcggaggccgaggaggtggaaagcgcggacggcgacgagctggccgaggtggtggtggcggtgcagggcgtggaggtgctggacagcgacgacgagacggaggaggtggagagcgaggaggacgacgaggaggaggagggcctggaggtgggcggcctgctgcgccgcaccgacgacggctcgcgcgcgctgcacgcgggcggcgacgacggggccgaggacggagccggggacgacgacgacgaggaggaggcggcggcgctgggcttcgcggcgcccggctcgcgcgcgcagctg

SEQ ID NO: 1762 - DNA, 600 bp, Chlorella protothecoides
atgaggagtggctgtgcaacaaacgcacccgggctccccattgtcacccgggccccgctccagtcccgcctggcccttccccggtgcgcagagggcgcggcacgggagacccttgaggaggccggcgctgctgtggaaattgtggcgccttacgtgcactttgacatccccggcatcggccaggcgtacctcctgtttcgtgcgaggctggcaccgccattcacctttgcagctcaggccccggaatcgctggagactcgcctgtttcccctcgaggacattccttggaacgaggtgcgtggtggtggggttgtgggcgggtggatgcatgccctagaactttggaccagcctcgacctggttcagcatgtgcccaatcatgccatgcacaacgagcagccaactcctgatcccatgttccgccccgcaacagctggctttctctgcggtgagcctggcattgcgttactacgtggaggacaggaggagccagagctggcgcatgcaccatggcgtgatcaggaagcaggcgggggcggggcccaacgacccaggttccttcaagctgacagattacatggggttgccattgggagctga

SEQ ID NO: 1763 - DNA, 1866 bp, Chlorella protothecoides
  modified_base (1696)..(1705): a, c, t, g, unknown or other
atgaagccggcagtgcttctgttcacattggcacttggcagcgtcaccgccctcgacttcgggttgccatgggcatctctgaggccctcgcgctcaaggagtcacagggaggaggcccagatcacttccatgccgggctacccacacacacccttcccatcgcgacactacggcggctacatcaatgtcgacgcctctaggggtcggcgcctcttctactactacgtggagtcagaggatgactcgagcagtacccccctggtcttatggctcaacggcggtccagggtgcagcagtttcgatggtgtgtgggttgggtcttctggtgtgaacggtggctttgtcaaggagcatggtcctttcaaggtctctttcaagggccgaccagatgccactggtgagttgaagcagaacatcaggctggatgacaaccccttcaggtgcctggctggtggtggagggtggggtgattcgggatgctgggtggacaccaagcccaccgcgtgcttctgcacctctacactccaaacgtcagcaaggccacttactccccccctgccgctcccaacgtcagctggagcaaaagcgcgcacatgctccaccacggcagacctgcaccacttcctgcgcctgtggctgcaagagtacccggagcatcgtgagaccccattctatgtggcaggtgggtggcctggccagctcacatgtctggaagagggagttgagagggcacgggctacaggaacccaaccattcatgacagaggtttgtgaggccaggtctgatgggtctccacccctcctcctgcccctgactttgcaggcgagtcgtatgcaggcgtgtttgtcccgctcctggtccaggccgttctcaatggaaatcaggaatccggtcgggcccccatcaacatcaaggttggtatttcggagactgggcgatgcagccttgaagctggggccagggaggggactggggcaaggcatgagctccagcgtgtcgcacagcaccatctccttgagtaggtcacggcctttaagacccgcagctcgcatctcaacatctccagtgctgccatcgcctcgccgccctctcacctgcgactccttcaccccccaccagggatacctggtgggcaacccggtcgctgacacggagctggatgccaacagcgtgcctgcatacctggcctcccagtccctgatcagccaggccatgtacgaggcagccgtgaaggcctgcgacgggggtcgcttccacggcaacccttctcgggcctgctctgaggcccaggacgccatggatgctgcgggtgagcgtgcatggggttgcgacgtattatggtgcttgtgctgtgcgtgggatgcaggctgggcagggccggagccacgagtcatgggctggcctgtggtgggccgtaccgctgtggccaggaggggcgggtaccactgcctccggaaatctcattcttccacgccatcacagctgcatccattcggcctgcaagttcacttccagtgcactgacacgcacccttgcacacccacgctgcagtccgcgacatcaaccactacgacaccctggccacttgctaccacggccggaacccctacatggtcggcaagggccccgaagcgatggatgccgagccacagatggccggcgtccggcgcagcgcgcacagcgcggggcgtttggnnnnnnnnnnccgatggatgcggagccacggatggccggcgccgggcgcagcgcgcacagcgcggggcgtttggctgctcggctggagcagcacatgctaggccacacccctcggtgcctggatcaaaggtggggatgggtcaggtggagaggatctcctcctcctcctga

SEQ ID NO: 1764 - DNA, 1692 bp, Chlorella protothecoides
  modified_base (181)..(190): a, c, t, g, unknown or other
  modified_base (593)..(602): a, c, t, g, unknown or other
  modified_base (780)..(789): a, c, t, g, unknown or other
  modified_base (987)..(996): a, c, t, g, unknown or other
  modified_base (1534)..(1543): a, c, t, g, unknown or other
atgctcctatgccctggggtctgggctccagggctcccactggatgtgcatggccaccccaagtgcccagtgagcttgcaccgtcccatgcctgaccatcggccctctgtgtctccccgcgcgcccccaaccgatccccaaccatcctccaaccatcccctggtcgccgcgctttccacannnnnnnnnngcccccaaccgatccccaaccatcctccaatcatcccctgcctgccgcgctttccacgcaggtcctggacgccgtaccgcgcgctgttcaccgtgcgctccatggtgctgcgctacgtgaacatggtggagatcatggcccccatcttcgagatggaactgttcgatcgcatggtgcgccccaccctcttcgacgcctactttggctggggcctggactggctgtggcccgccctgctttcctaccccccggacaaggtggccgtgatcgacgaggtgtgcgtgtaccaccccaagacggaccggaagaacagcgccctctacaagctgggtgagcgtgatcggaagagggagggggatacgcaactggtggagtggagatgcaactggtggggtgagatgtnnnnnnnnnngaacagcgccctctacaagctgggtgagcgggatcgggggagggagggggagatgcaagtggtgggggggagatgcaagtggtgggggggagacgcaactggtggggtcgcgatcgacagagttgccgtttcagcggcggcgacgcgctgggcgcggacgtccctcggtcgatgtccnnnnnnnnnntgcaactggtgggggggagatgcaaatggtggggtcgcgattgacagagttgccgttttagcgacggcgacgcgctgggcacggacgtcccctggtcgatgtctcggatgtcgctcgcatgccgaggtgctcatgtgtctcggcgggcgacccgctggcgccatgggcggcctccctcccccaaagaagaacccatannnnnnnnnncgaggtgctcatgtgtctcggcgggcgacctgccggcgccatgggcggcctgcctcccccgaagaagaacccatgcagcagctgtcaagcgcgccctccccttgcctcggtcgcagaagcccccatgaccgcaagggaggaggccaacctgcacatcaaggagtggggctggtcgccggagggcagggcagtgcgggtgagtgggcttgggagggccagggatgggtcagcggcctggcatggtgcaccggagcctcgccagggcccgccaccgcgccttggacccccaaactcaggcaccctgccccaccccagggcttctcctcgtactcctgcgacgtgatcagcgaggtggcgcggccctcacctatcgcagcacccaacctggtgagagggccccgtgctcgctatcctcagcatgcaacgcacagggagaggcacaggccagtgccgccggcctaccagggagtaggtgtcccccccagcgggaccccccacaaacccccccaccagaactttgaaacaagaagcccgcagnnnnnnnnnngcacagggagaggcacaggccagtgccgccagcctgtgagcgactgccaccccccacacatgcttgcacacgccctgtgcagtccaatttcctgcccggcaacaacaccatgccctccatcgtcgcgggtggcatcaagcactggctga

SEQ ID NO: 1765 - DNA, 945 bp, Chlorella protothecoides
  modified_base (776)..(785): a, c, t, g, unknown or other
atgctgctgttgcaccgcatgatagggaagcagcagcactcaggaccctcaacgagtctaagaagtcagagtgcgtggggaactgtacgcgggggtgccatgcttgatgcctttggacgagcgctgggtgctcgagagcctggggtgaaatgcgcttggcgcaggggctggagctaccgggcaccaaaccattcttgcccgtgctgcacaacatgtcccccatcacttcatggtagcatcacagccaccagagtgaccgtctcatgtatccgttgcaggcgagctgagcgacgccatcttgtggtggtcctgggaggggacagattcaatgcctcatcctggatgaccgacccggagcacgccacatgggatctgtacctcatatactacggcagcaaccctgctaagagctgtccactctgcacaaaggtgagagggtcgagccggattgccagagtgtggagaggagcgctgaaggaggagccagtgccctgtcgttacatgctggccagccccactggccacagcaccccaccccacccgctaggtgtttgccggccagggcgccaaatggcggctggcctggcgattcactctacactccgactggcagctcatccggaaagcatacaagagtgcggaggggtttgtgtggagggttgtgtgtcgatgtcgagcagagttgtgagggaaggcttgtgcagcctgacgtccatgagcggcaggttgatcggacaggtcgccctcgctggtgctgatccacatgcattccggcnnnnnnnnnnagcatacaagagtgcggaggggtttgtgtgcacggccatctccttcatagatgatgaccttgaggtggccggtggggaggtcctgaacacagccctcgccgtgtttgaagcctttgacctgctcattgcccagcccagcgtctgcaacgagcctgggtga

SEQ ID NO: 1766 - DNA, 1077 bp, Chlorella protothecoides
  modified_base (1046)..(1055): a, c, t, g, unknown or other
atgttgcaccttcccccgacagcactcggctcgcctggtgactgggagctgctcgcccagggagcagccaactacgtcctccagcgacaagggccggaccaagatgtgagtgcgtgggcggcctgttttgaagcgagcaaagatggtccccatcacaacctccggagaccctcggtctgggcgcaggtgggttggcttctgcgcatccccaaaatccggcagcccccggatctggtgtctgcctttcttgagacccagatctgggcaccgttcctgcaaggcctgaattcaggaaacccggcagacctggatgagtcctacgtccgcctggtcatgggacccttggtggatgccaagtacctccctgtccaggttggggatgaagtgctcatgatgtcaactcccaaccctccctcgcccctctctcaacagcactgggtcccggtggaacctgccttcctcgtcacactggcgcagaggccatgcctcgagcggctggatgttgatgtgcgacgtgtcatgctgatgcgcgacagccgcctgctgcctgccgacaccagcagcggccgggacctgcgcccccgccccacggtctccgtcgagatcaagcccaagtggggagcgctgccgcacgcccacaccgtgccccctcagcaccgagtcgccaagctgggcgcctcacgatatcagctgcaccagcatctcaaggcggccaccggcgccatagaagtgcccagcgagtatgaccccctggacctcttctccggcgaagccggccgcgtctggactgcactgcaggccctgggccgctcaccgcagaataactttctcacagccgtggacgggaagccaggaggcctgcactccgcatccctcgccctgctgggcccctgccgtgctgtgcacgacacgcctggggcggcgctgctgactgtggtccgggacgtgctcgtgcaagaaggtacggcagagcgatcggttggattgaggggtgaggaaaggcggtggaatgatctggggcatggagctgatgggtttcatcgccnnnnnnnnnngtggggaaaggcggtggaatga

SEQ ID NO: 1767 - DNA, 1764 bp, Chlorella protothecoides
  modified_base (75)..(84): a, c, t, g, unknown or other
  modified_base (467)..(476): a, c, t, g, unknown or other
atgcattggcatgattgccggtatcatgcatctccgtggccaccatcgctccgctgccaggaagccgggctgaannnnnnnnnngattgccggtatcatgcatctccgtggccagcattactccgctgccaggaagccgggctgacctccttccaccaagaacacacacatagggcggtgggagtgggggcctccggagccgtttatgccggcgtgaacatggagtttccgggcgtgcccctgtcagcctcggtgcatgcggagcagttcctggtggtcaacgcgctacagcacggggagaccgccctgcgatacatcgccgtctctgccgcgccctgcggacactgccgccagttcatggccgagctgaacgaggtggtgagcgtggcgattggtgaggaaggatctgccgctgatgggatgtgcgctctctgtccaacggcagccgcccgcacggcatcgaggtnnnnnnnnnncgagctgaacgaggtgccgcccgcacggcagcgaggcccttccgaaccaggttcccgcctccctcctgccccaggaggagctgcggatctcatttggaggcaccccccctttgtccctggaccagctcctgccccatcggttccggccctccgacctgctgggctccggcccggggctgaggcccctcctctccggcaatctgaaggccggcgggccaggctccagctcagatccggcccccgacgaggccctcgcggccgtggattcgtcgctggatcccggtgtccaggagctcacacaggctgctctcgcggctgcggcccgctgccacgcgccctactccctctgccgctctggcgtggcgctgcgcctgggggcagagctcgcgggccccgccgtcagcggcggctacgtggaaagcgtggcgtacaacccctcccttgggccgctccagtgcgcactggtgtgcatgcgcctccggggccatgcggactggtcgcgcatcgaggaggtggtccttgtggaggaccgccaggcaagcgtgagtcaggaggccgtcaccgccgccacgctgagggccattgcaccccgtgccaggctgcacatcgtgcaccctcgctgacttggcgggcgatcagtcagtggtgtgctcaccacctgtgctgtccgtggaggggacccccccgcggaatgtcgaggatcatctcgggtacgctggcttgtgatgacttgacatgcgatcattggctcgtcatgtggcctatggtttacaggggttggggagccaataccaataggggccgtcgccccacaccaagcccagccaagcatgcacacctgcatcccagatcactccaggtcgtggtcggctgcgggctcgatgccaccggccacacgcatgatctcggcgtccagcgccaggtggcgcgccagcttggacaccggcttcctgtccaggtctatcacggtcagacggtagaacacggcgccgccgccatggagcgtgacccggcccggggcctccgccgtctgcggccgcatgggccccccgccagagctttctcgacgcagcgccaggagcagggcacagtcacgggccgtgcaggaggtaaggtagtcgcgcagcaggctcagggccgcctcaagtgctggagttggcggcagggtcccctgctcgcgcacctcgggcgaggccgcgtcgagcagcgcctggtactgcgcatgcacagcatggatgtccgtggagcagagccgctgtacatccaggatttgggccagggcatctga

SEQ ID NO: 1768 - DNA, 2421 bp, Chlorella protothecoides
  modified_base (702)..(711): a, c, t, g, unknown or other
  modified_base (1112)..(1121): a, c, t, g, unknown or other
  modified_base (1397)..(1406): a, c, t, g, unknown or other
  modified_base (2119)..(2128): a, c, t, g, unknown or other
gccggcggcgtgcgggaccgagacccctcgcccgcctggcgcggcgggctgttcgaccgcggcagctggaccgaggcgcaggccggctgggcgcgcaccgtggtcaccggccgcgcgcgcctgggcggcctgcccgtgggcgtggtggcggtggaggtgggcacggtcacgctgcacgtgcccgccgacccgggcatgcccgactccgcggagcgcatgatcccgcaggcgggccaggtgtggtacccggactccgccctgaagaccgcgcaggccatcgaggagtttggcctggagggcctgcccctcttcatcctggccaactggcgcggcttctccggcggccagcgcgacctgttcgagggcgtgctgcaggccgggtcgcagatcgtggaggcgctgcgcacctaccgccaccccgtcaccgtctacctggggccggggtgcgagctgcgcgggggggcctgggtggtggtggactcccagatcaaccccgcagccatcgagatgtacgccgaccccacagcacaggtaggagggttgcagtctcgttcctccttgcaatggtgtgctgttgggacgggacggctgcttcactggtcgcctttgtgtgtgctcgggaggaagagggggccggcaggacctgtcctgagatcatgtgatggttgcaccacccatcagcaccccctcgcacatctcctnnnnnnnnnnatgtacgccgaccccacagcacaggtaggaaggttggagtcccgtttttccttgcaatggtgtcctgttgggacgggacggctgcttcagtggtcgcctttgtgtgtgattgggaggaagagggggccggcaggacctgtcttgagatcatgtgatggttgcaccaccattcagcaccccctcacacatctcctggcccagggggcggtgctggagccccagggcgtggtggagatcaagttcaggaacgcggagctgattgccgccatgcaccgcctggactccaagctggcggagatcaaggtgaggaaagggggggatgggaggatggttggatgtcaggcggtgcaccggtctgcagcaagggggccccttgggtgcttggagcgggagcgccgcgnnnnnnnnnncgcaggtgtgagactctggggtttggggggtccatcgatggcatctggtgcccttgcagcgcagatggcacaaatgttcgtgcaggttgaagcctggcgatgtgaggccctgcacacccgctgcgatcagcgctgtggagtgaaggtttgcgtggccatcgatgctccgcaccacctgcccctcgcctgccctgcgtgcacatcccctcgccgcaagccctccaatcattgtcaccgacgttcgaccctccccatcccgccagatgcacgacggannnnnnnnnncgcaggtgtgagactctggggtttgggggggtcgtccatggcacccggtgcccttgcagcgcagatggcacaaatggtcgtgcaggttgaagcctggcgatgtggggctcttcacacccgcagcaatcagctctgtggagtgaaggtttgcgtggccatcgatgccccgcaccacctgcccctcgccgcaagccctcccgtcattgtcacccatgttcgaccctctccatcccgccagatgcacgacggtcccgtccgcatgctggccaagggcgtcatccgcggcatcgtgccctgggcctcctcccgcgccttcttcgctgcgcgcctgcgccgcaggctggcgcaggagtcgctggtgcgccaggtggcggccgcggacgcggagctgtcccccggcgaggccctcgcccgcctgcgctcctggttcctgtcctcccccctgcctgccgcggacgcgctgggcgaggctgcctcccgcgggaccgtgctggcgcgggccgtggacgacgcggaggcgctgtggcgcgacgacgcgcgcttcctcgcctgggcggaggcggaggccggcgcctctcgcatcgccatggagctcaaggtggaaacgggatggcgggggggtgggggaggggacgatgtgaggggggcccctcatcgatggacatgcgagtttgctgcgcgggcaaacgcgctcgattccctgcattctgatnnnnnnnnnngagctcaaggtggaaacgggatggcgggggtgtggggatggggcgatgtgagggggggtcccgatcgatggacatgcgagtgtgctgcgcgggcaaacgcgctcgctcccctgcatcctgacctcgccactccttcacctcctgcgcaggcgctgcgcacgggcgtcgcaatgcggagcgtggaggagctgtgccagacgccggagggcaccctggggctggtgaggggtctggacgacgccatcaagtccaaccccgccctcttgctgcagctgcgcagcctgctgaagtga

SEQ ID NO: 1769 - DNA, 270 bp, Chlorella protothecoides
atgcgagcgctggtgtacagtggcgaccacgacatggttatcccgcacacctccaccgaggcctggacggcggggctgggcctgcggctggagaggggctgggcgccctggcgggccgacggcgggcaggtgggcggcttcgcggtgcactaccgcggcctggtctacgccacagtgcgcggcgcagggcacgccgtgcccgagtccaggccgcgggaggcgctggcgctgttcacgcgcttcgtgcgggggcgtggggcgccggcctga

SEQ ID NO: 1770 - DNA, 426 bp, Chlorella protothecoides
atgcccgacgacaaggtcattttcctctccgacatcatgcccactggctggcatggcgcagagtgcggccaggtgggagagggcgacaacgtcgccatctggggcgccggacccgtcggcctgctggcggcccagtcttgctacgtccgcggtgcagccaaggtggccatcatcgactcggagcagtacaggctggactacgcggttgctaagctgccaggcatccacaccgtcaacttcaaggaggtcaaggtgctggaggccctgcacaagatcttccctgtcggaccggggcctgatgtggccatcgaggcggtggtgagtggccgaagttttcctgtgtgtgacgatgtgaagcatgagcagcatcagtcatggagtgttcaggtcctttggctctgggtgcgccttgctggcatggcttaa

SEQ ID NO: 1771 - DNA, 231 bp, Chlorella protothecoides
atgcagagccagttctcctgctgtgactccaccaaccccagcaaggagcaggagttcttgtatgggcataacacagccggactgtacagccacatgactggaggctgggatggcggccaggcagagtacgcccgcgtcccgtttggtgagtttgcactttggggtgtcagcctgggcgaattcctcctcccagctggtgcttgcacatcaactctcgggccctatgcctga

SEQ ID NO: 1772 - DNA, 516 bp, Chlorella protothecoides
atgaaggatgcgggggtgcatgagttgctggaaagcgaggaccaggtgctgagcctgaggcaggacctggatgccaccatcggcctgctggacgacctggaggacaacctgtccatcttcgacgccaagatggggctgatgcgccaggacgtggcaggcttccgcatgcctgctggtggcgggggcgcgcccgttccccgacctggaggccccgccacccgccccacgcctgcgcctgcagccatcgaggtgcggaacaaccagctggagacccagtcgcgcaacgacggagcgctgctggacaccctggactcgctgctcagtcagctcgcactggggccggacaccgagaagatcctcatgcaccgccagctcagcatgtcggggtgggtgatgaacagcctctgtggacggggggttgttttccacatcgaactgcatagtcccgccacgccactgccatcagtgactgccatcaggaggggttggtccatttcagtgctggccgttccataa

SEQ ID NO: 1773 - DNA, 201 bp, Chlorella protothecoides
atgccctacgaggccgcgaggggggacctcggccgggcgctggcgcagcgattctcgctggcgggcatccctcgcctcgtggtcgtgggtccagacggggcgatcgtgtcgggggacgcacgcgccgcggtcgccgcggaccccacgggcgccaacttcccctgggctggacctgcgagcgctgtagccacgggcgggtga

SEQ ID NO: 1774 - DNA, 1179 bp, Chlorella protothecoides
  modified_base (324)..(333): a, c, t, g, unknown or other
  modified_base (423)..(432): a, c, t, g, unknown or other
gcggcgtgcaggccctggcctgcgccggcgccggggtctgggtcggcacgctggccggcgcgctgtgcctgctgtgtgcggacgacggcaggccgctgcgcggctggagggcgcaccgcgccgccgtcatggcgctggccgccggcccgggccgcgtctactccctcgccgcctcgggggagatcgtcgcctggccggcggcgctggccagcttgcacagcgccgctgtcccctctgcacagtgggtttactttgggggagggaatggtttgtgggaggggtcagcgtgcatgtgttttgtgttttaccatgggagctatgtcnnnnnnnnnngcccccccccaaaaaaactctcctccaatagacggctgtggagggaggtggccgccacaaccttcagccggcgcagcctgcgtgccctgnnnnnnnnnnagttttttgggggggagggaatgctttgtgggaggggtcagcgtgcatatgttttgtgttttaccatggaaactatgtcttggtccatgcaagggcctgcatgctgcccaaatgtgtgctcatctggaggcaggcaggcggaggccaagggcatgtcggcgtccacctcgcccaccttgcctgagtccgctgaggtgtgctctacatccctcatcgcccccgcccccccccaataaacatctctcctccaacagacggctgtggagggaggtggccgccacgaccttcagccggcgcagcctgcgtgccctggccctgacctggaacgtgaacgagtgcaagcccgacccggactcgtcgcaggtgttccgccacctgcgccgcgcggcgacgccggcgggcggcggggagggcccggccttggtggctgtggccctgcaggagattgagatggggagctccagcgtggcgctggcggcggccaaggacgccatctcctaccgcatgcaggagcgaggcaacaccaacgccaagttctggagcggcgccgtgctgcgcgcgctgggcggggaagccgcctggcagctggtcggcctacgccagctctccggcatgctcgtcctggcctacgcccgccacgacctcaaggtgattgtttggtgggtggaatggagggagttgggaaggaggagggtgggagggctgtattttgtggaggcatccctggtgaggaggtgggcggcctag

SEQ ID NO: 1775 - DNA, 2409 bp, Chlorella protothecoides
gcgccgacggggccggcacccgatgcgctggggcccagcctcccaggcgcagggcgtcgggggccggcggccccggaccccggcgcggaggggcccgagggcggcgccggtccgcgctccctggtgccgcaggtggcggtgggcgccgacggccgcatcgtcatcgccgaggccagcctgacggtgcaggcgcaggagcgggtggagaaccggcggggggtcaccgacgagcacttccgcctcaactcctacacctacgccaaccgcctgcacaacgagcgctggggggctgaggacaccgagctcttctacaagccccggtgcatgcgcgccggtgcgcagaccctcaggcggctggagtgggtgtgggaagtccggccacccgctgatgcgatttgtgcgcatggcctggtccttgccgttccccctgtctcccagtgctacgccgcaccgcagccccacctccccctcctcccgcacgccgcgcaggcactcagccagtttgggacggacttcacgctgatcagccacctgttccccggccggcaacggccccacctgaagaacaagttcaaacgggagtccaaggtgaacccgcggcgtgtggatgcggcgctgaaggccagcgcaagcgcgaccgccaccagctaccaggtgtgtcgagggtggggtccggtgtgggtgagggggttgcatgaggaggaaagggagctgggtggcatgttgttgcattgcaaaaggactgcgaaaggactgcagggtctaggaggtggcggctcgttcacatctcccagtgcggaccccttcccaggacatgatctccatgctgaaggccagcgggatgaccgttcgcagcacggagggggaggaggatggggaggcagacaggctcccggcggaaccctcgcagccgctcagcttcccggagcaggcggcgctcagccctggggagctgcgtacgagcctcctagaacctgtggatccccagaaggcctgacgctcggcatgattcgtttccacaggcctttcatatggatcagccttgcgcctctcaccaccagcctggagtatgggagagcaatagtggtggatatatctgtcataatcagtagaggggtggcgccaccgagacttccagagggagggtcaggagttgggacgcgtgctgtccaggctggcttccaaggtcgccctcctccgacacgacgaccgtcagccgtgcgacaaggtctctgttcttgtgcagagccccgctcccggggtcaaactccaaatgcagctgcagcggggtcgggtccagaggattggcgctgctatgccaggccccacatccccactctcaacagccgccacgagaattgcaaggggtccgagcccctcctgcaatcagcgcatgggtccccgcttggcgccattcctaggctcccaccttgcccacgctgcccctcagctgcagtcggtccggggtcaacttcacggcgtcttcatcgtccagcggcgcccgccccgccatctcctcctctgccaggccgtccaggatctggttgcgcctcgcacgccgcgcctcccagtcgttcaccgacaggtctatgcccagcagggcatacacaggcttgtggtcggactcggcgacgtcggcccagcagccatactcgtggcaggtcatcagcacaacgtctgggcctgccgtggcttgatctgcccaggcgtctcgctcatcgggcaagggctgcaaggggagggggaataaggggggctggagaagcgcatggacctgaacaagagaaccccacccctccccaagtagccccgcacctctggggagggaaaggcggggcagccgcggaaaaagatgcggtcgcaccaggccgggaccctgcgcttctccgacgagtcgtaggcaaaggggttggccgaggccttgtcgaacttgtaggtggggcggaaggtgatgggcccctcccgcatgccacggaaggtctgccccgccgccatctcgcgccggcactggtcctggggtggcaaggcaggaagagggagcggatgaagagaaagaggggaggaagggcacgcttggcatgcctgccatcaacacatgcccgcacccctctgctgctgaagtctctacttgctccttgtgctgggcagcaggctggcacagtcgttgcgcacggccctgtcccggatgtcctcgtaggggccgtcgatgcggtagttgaagtcccccgcccagatcagggcctccgccttctgaacagcgtcgccctgcaccaaggggtcctgcgccgcagcggcctcggccaggttcgccgcactggccccgggccccagcgtggtgagctgggggcccgacgtccccgcctccgcttcatctgggccgtggaaggtgagaggggaggctgtgagtga

SEQ ID NO: 1776 - DNA, 1530 bp, Chlorella protothecoides
atgcggaaggagcaggtgccccacggataccacagaataaactcaagagagacttacctccatcttcgagctgtctggtggaggtctttcccgcttacgtgccccttccccctgggaagtgggtggttgcgccatgtcgactgtgacccgagtggctccgtgatcgttcgatctgagccggatcgacggctcgaattgcttactagcatgccaagtttgcgagcttggctatgcttgctcgccctgatcctgcatgcgagtctacctgtcgtcgttgttgccgagcagggcaggaacaagccctttgcggtcgtgaggcctgttgctgatcactccaagctggagctggatgagactggcctggcggtgctggagggcatccagggtccagtatccccagtcgtggtgatcgggccctaccgctccgggaagtctttcctcctcaatcagctgatgggagtgccctgcggtctagaaccgtgccaccctccttcacaccttccagatcaaggcttcggtgtgggtcacagcaggcacacccagaccaagggcgtgtggatgtggggcgagccagcagagcggctggacgcaaagggcgatccagtgcaggtggggagggggtgtatgggcgagcttcagtccctgcttgacatgggtgtgggtagatctgatcctactgagaaggttgacaagtccgagaggctgccaggcgctctggccagcttctaccccggctccttctacccccagctactcctgcgctgggtgtacaatctcgcccctcacaaacacacctgtttcttctgcatccatctgcctcccgcactcctctccccatccacccacaagcacccacccagcaaccccccaccctctcctgctccccagctgctcttcttcgacacggagggcttcgagagcaccggcaaggccgacgtgtacgacgaccgcatattcgcgctttccacggtcatcagcgccgtgctggtgtacaacctgccggaggccatccgcgagtcggacctggagcgcctgtcctttgccgtggagctggccaaggccttctacgccgacccggctggccgggagcccggcggtttggcctcccccccgacggccctggagccgggggccatgctctggctcatccagcgcgactttctccagggcgacagcctggaggagacgctagcggcggcgctggcccccgtgcccaacccggcgcgcgacccggggctgacgcagctcaaccgcatccgcgtctcgctgcacgccctggcccgcaactcctcggcgctgggcctgccgcagccccacctggaccgcaccgcgctctgcggcctggccgacgaggagctggcgccggggtaccgcgcggcgcgcgctgcgctggaggcgcgcgtggccgccgccgccgcgcccaagctggtgcgcggccgcgcgctggacggcgcggcgctggcgcggctcatccgcgacgtgggagggggcgagattgacgatgacagggcgagtgtcaaaggcggggcg

SEQ ID NO: 1777 - DNA, 819 bp, Chlorella protothecoides
atgatcgaggagcggggcctggcggcgggcatcgccttccccaccggctgctccctgaaccatgtggcggcgcactacacccccaacgccggggacaagacggtgctgggatacgacgacgtgatgaaggtggactttggcacgcagatcaacggccgcatcatcgactgtgccttcaccgtggcgcacaacccgcgttacgcgccgctgctcgacgcggtgcgcgcggccaccgacgccggcatccgcgccgcgggcgtggacgtcaggctctgcgacatcggcgcggaggtgcaggaggtcatggagtcgtacgaggtggagctggacggccgcaccttccccgtgcgcgcggtgcgcaacctgaacggccacagcatctcgccctaccgcatccacggcggcaagagcgtgcccatcgttaagggcggcgaggccactcgcatggaggagggcgagttcttcgccatcgagacctttggctccacgggcaagggctatgtgcgcgaggacctggaggtcagccactacatgaagaactttgatgtgggccacgtacccctgcgcctgccccgcgccaaggccctcctggccaccatcgaccgcaactttggcacgctggccttctgcagacggtacctggaccggcttggggaggaaaagtacctcatggcgctgaagaacctgtgcgacgccggggtcatcgacccttacccacccctggtggataacaagggctcatacgtcgcccagtacgagcacaccatctacctgcaccccacacgcaaggaggtgctgtcgcgtggcgatgactactga

SEQ ID NO: 1778 - DNA, 618 bp, Chlorella protothecoides
atgaacatggaatcagcaggcacgcaggcaatgaaggtggcgtgctggcggaaggaggagcagctgccggccctgctggcggcactggacgagaacgagcggccggggcgcggcgccccgctttccaccttcatcctgaagccggacgccggcagccaggggcggggcatcctgctggcgcagcgccgcgccgacctggaggcctggtgccccgagggcggcggcgtgcccgccggggtggcctcacgctacatcgagcgcccgctgctgctcggggacagcaagtttgacctgcgcctctacgtcctggtcctgggcaccgcacccctcgacgtcagcatcttcacggaggatgaaagtggaaagcggggcgctgcgccccggccgctcgttttcgtccagcgccgccagcagggccggcagctgctctggaagcagcagggtgcgcggcatgaagtcgtatcgctccggcatgacctgggcgagcctggccaggttgcgcgccagccccttctttcgcgtcagctcggccatgccgggcagctttttggacggcagttcagtatccaagctgtgctggtgggccggatctgtcgtaattggccgctcctcgcatga

SEQ ID NO: 1779 - DNA, 447 bp, Chlorella protothecoides
atggtggacgcggcacccaccctcgtggaggaagtctctgccccagagccttccgtggaggcagaggccgcagcgcccgagcagtcgaagagcgctaagcgccgggctaagaagaaggccgcagcagaaaacgctgcagccaacgacggggccggggctgagggcgccgaggtcccacagcccgggacgcccccagaggaggaggagggtgcaggggctgccgacagcgacgaggagccagagaccccctcggtaggggatgtggtgaccaagaagaagaagaagaagaacaagaagaagaaggccggggctagtgcgggggccggcgctggggaaggagccgcagcgcccactgagcagaccgaccctccctccattcccatccgcctgctcttccccagcggcgtctaccccgagggagaatggcaatcttacaaggaggagtga

SEQ ID NO: 1780 - DNA, 282 bp, Chlorella protothecoides
atgtttctgcgatctcagtgtttgagcagcttccatgttccaacacccccacacccattgcccaacagccagctgtggcgcgagaccagcgaggagaagcgggcgctggaacggctggggaaggatgtgatcaatgaggtgcgccaggcggcagaggtccatcgccaggcaagaaagtacgtccagagcatcgccaagcccggcatcctcctgtccgacatgtgtgagaagctggagaactctggtgagtggggattcgatggggctgttgaagggttttga

SEQ ID NO: 1781 - DNA, 1338 bp, Chlorella protothecoides
atggaccccatcgaacagaagaagctgaagcgggtgagggagtctgcagggttggatgcatttgctgaggctgagctggagctggcaggccagaaatccaagaagtcaaggcccaccaaggaggtgacttgggatgtggcaacaggagggcagcaaaggccagtaagctgtcctcccaccatccctcaggctcatgagaacgaggatgcattctttgagaccctgtcagcagcggagaacctcccaaagtacgccgagctcctcaagttcaaggtgagcgcatgggaaaagaattgttctcgggatagttcttccaccacgctcctttacctttgtgtcctcctcacctttccctcagagttacagtctgtgcccctccgtcatgatctcactccactgccctcgctgacgcagatcctgggcgtcggcgcacgcgtctggggagcgatcatcgaggtgtctgagcgcgagctcgtggtctccatgccccacggcttgcgaggccacgtgccggcggcggccgcgggcgagccaggcatgggcgtggacctgctggcagccttcaacatcgggcagctggtccgggcccagatcacgcagctgacgggcgcagaggctggcgaggatggcgccgtgccccccaaagacgggaagaaacggaggaagaaggtctacctgaccctggcaccctcggccgtgaatgcaggactgggtgggtggagatcggggttttgtacaaggaattgtagggaggttgggggagagggtggaggaactataatccagcttgttgagcatgccctggccctcacactggctgggtctggccagcaagcaggcgtgcgagttccccccgctggcaatctgatgtccagacctaggcgcactcgtgccgggattctgcctctctgccagcgtgcagagcatggaggatcatggtgccgtgctttcctttggcatcaaggtgtagctgcacagggccaagccttgggcaccacggggttcctccccgccgcggcgttccccgagcgacccctgatccctgggactctgctggacgtggtggtcacctccaagaaagcgggaggccgcatcaccgtggacgccggatctgaggccgtcgcggccgccaagaccgaggagtggatcggcatgcacatcggtgaggcggctgctggaggggcggtgcattcgggggtgggctgtggggacagggaggtctgccggggacccctcatgcagtgcaccccagaagggccatgtcggcatccatcacaaagcctcccatgccccctccaggcgccctgctccccggctcactggtggccgccacagtga

SEQ ID NO: 1782 - DNA, 990 bp, Chlorella protothecoides
atggccaggagacctaggcttcagccagcgagagtatgtcggctctttcggccgggcaagggcccagggacgcagatgcaggcgagtgcatcaccatcggccctccctctgctgactcatgccaccctcaccatgccgctgctgccgcaggctgaccccctccgcaagttctacacctccctgctcgcccagcggccggccagtgacatggcccgcaagtggtgtgtcatgcacggcctgttgagcgaggccgaggccgccgcctacgtggacgaggtagccgccaagaagctggcggcacgcccggcgtcccgccaggcggcggggagcgcgagtccggcgccgaaacgagcggcatccgggcaggcccccaagcgcaagtccacgggatcaggcacgcagaggtcgtgggtcggggtgggcgcattacatgctggttgtgcgggacgcgtcatcgacctgagcgcctgcagggtacctcattcacccacccctcctgacaacgacccctctgccaccacccccccaccctgcagccaagactgcacccggggcaaagcacaagaaggaggaggaggatgcggagtggagcgacgacgggagcgagcaggaggtcctgccctccaagcagcggcggggcggcgtgccccggccccccaagcccccggccggctcggactcggacgacgacatcatactggcccgtcggccggcccggcccgcgcccgcgccgaggaagcccaaggcttccacgcgggacgtcgctttccaggacggcgggctgggggaggagtccccgagcgacgacgatgtccccctcctggccaggaagcggtgacacgctgcgccggcggcgctgaccctgcgacgtgcctttggtggctggtgtcgtgcgctttacacacgcagcgactgaggatcagcggggtgcacaggaagggagccaagaatcagggatggcaggacgcaatcaagtgtgggcagggctga

SEQ ID NO: 1783 - DNA, 1395 bp, Chlorella protothecoides
atgaggattcgtctgaagcagctgccgggtctgcttctggcgctgggcgtagccttggcagcatggcctacagacgctcagagcaccctcattcgattaaagacgggccaaattgcagcccatgggcctagttctcggtgcgtcgcatgcacaggacccccttcaggccatcatagatccacgaatgcgcctgctatactgcccacacgcccgtcgtaccacagagaccaagtgcaccgcctgctcctgaccaattcggagcctcagtcgctgtctcctcattggggccccctcagtcagaagcagcagtggctggtcactccccaacaaggagaatccctcacgagtgcagctggtgccgtggaggcagctgggggtgtgatcctgggacatgttcccgacaacaccctgctagtcatgggtcctcctggattggagcaggcccttcgcgcccgctccagaatcttccttccctctccaatcacagccaattccctgctcccgtacgaaccccagcacaagctgagtcccgagtgggcccccatccttcggaccctggaggccgccgcgcaggcaagcctggcgcagcagcagagcgtcctgtcgtcgctgccgatggccaccagcggcaccggccctgccctgcggctgctcatcactgccatattccctcctcggccggctggaggggcaggcgccgcggcgcccgacccagggcgggcagcggtggccgactgggctgccccattgcggaccgcctttgggggtggagtggatgtcgtgaggggtggaagcggggcggcggtggtgttgtgcccacccttcctcctgcaggcaagtggaagattggagaggaagggatggacccctagccatgcagctgcacacacccatgcaagccctagggcttgcatggatctgggcctgcgtgttagaatgcaggtcctcgtgcaggcagcaggtgccctgtgtcagtaccctgtctacacaacggttgatgcacagctttgcttcccccctttgctgctgcaggatgttctgacatggctggcagcccagcccatggtccactggatttcgcccctgcccaggatgcagctgcagaacaaccaggcctcggccatcacccaggcggggacaggtgcgctttctacgagccagaattcgtttgataacccagaggtccaccccatctgggcggcgggcatcactggcacgggtcaggtcatcggcgggggagactcgggagtaggtgaggcggcatcatgggttgtgggcaaggaggggggccctgtctacagccgccttcctcagaaagatgttggcggctgtctgggtgtccagcgagagagtgtgatggcagatgcaggtcagggccgtgatccaccgaactag

SEQ ID NO: 1784 - DNA, 702 bp, Chlorella protothecoides
atgtccatcacgcggcgcctgggtcaaaccctgctggcctccttctcctccgggctggcactcaccatcaccctctcccccgcgtcagccccggccaacgcctttgagaacctggcctcgtactcttcccaaggtgggccgagagagcgtccctgcgcacgctcgtgccccgtgactgccatggcacccgctgagctttctgggagtgcggtagttcatctgagggcggcaggtttgctgttccatcctgagaacccaccctcttcatccacacctcaacacacaggtccgactccggatggcagggtcaagccggacctggtggcgcccggctccctgttctcagccaagtcctcgacctcgggaacggagacctgcgagctccagggcctcgtggtgagtgagagtggggtgttggtgttgccgtgttgcggccagggatacattcaggcagccctgagcggcatgaggcgccagccgctccatggatcccctccagctactcacagcttccttcttataccgttagggcacttcgatggcgaccccggtggtggctggctcggcggccctggtgcggcagtatttcatggacggctggtaccccttcggggtcaagaacgccagcgcgggcttcaccccctctggcgcactcaccaaggccacactgatctcgggggcggcttccatgactggctttga

SEQ ID NO: 1785 - DNA, 1374 bp, Chlorella protothecoides
atggatatacctaaggaggttcttcaaaccctcgcaaatggacttccagtgagttgctgcatgcatgtccatggggcacccgccagtgataggctccagctgctgataaatccttcaaattccccaacagggcagagggctgtgcctgcaatgctcatgccactgggctggctcagcacgctgcaaagcctcacgtgggagacagtcccagagctggatggtaaggatgtccctgataatcaggcccatgcccccttacagcgtgaggcccagtggatggcatgcagactgtggatggcaccagcatccttgcatgtgcctgcctcgcgcacactttgtggtcagcaaggcagagtgggggtatcagcaggtttaagggtgcttgcctgtgatgcaagccctcctctccgcaaccctatgactctgccacaggtttgggccaggattaggcggctccctgctgatcatcctggctgcggtgatccgggacttcctcatcgtgggagcactggtatccctcggcggctggctgctggcgacgcgcttcctgtactccccatcgggccaggagcacgccatcgagcagcgcatggagctgtgagtacagtggggtgcttccgcctccgccattcatgccgcaggatgtacgcatttgatgtgcactgcaactccttgctcccgtggctgctgatagtgaacggtgggttggcgtgccaagtgccagggtggggcggggaagcctggacgtctgcccccaccctgagtgccatgcacgcggctgggggagaacaggcattgtgcccgggtgcatcccttgaagtgatactccaccgctcagcactgcaccccccgccccgtgcagtcctgcagctggtgctctcgccgctcctggtctcccagtcctacctggcggccgcggtatcgtgcacgctgtacgtcgcaggcgcctcctcctacctgtacatcaccttcctgggctacagcgtcctgccagggctcaatcacaccgtggcttgtggtgcggcaccccgcccttgcaatgtctttggggagcaaagttgttccctcaactgccagtgcgcggggcccaactccctcccatccccccctcctcccagctcctgctcctgcccgtgggtgcaatggctgtggcactcccccttgccatactggggaggttcaaccccacacgaacggcgctctggctctactatggatacgggagggcctgacgatcgcatccctgcggctctcccacccatgtgtaaacctgaagcaagagctcttgatgcgccagcaggcagggatgggatgaagccatcgatgccgaggtctttggcacccagggatcgcacgactgaatgtggggcgtga

SEQ ID NO: 1786 - DNA, 1398 bp, Chlorella protothecoides
atgcttgtggggagcctggactgcttcccagacttggagcttctggatccaacagtcgacatccatgccatgttccttcactacaataaattctattttgaagacagcctgggggcctgttcggtagagtggagctcgaaacgcatgacatcatgcgggggtgtatgcgagttccgtggtggcgggtgcaccatcaagctctctgagcccctgctcaaggtgagctgcacagggagtctatgtggacagttccggccagtggctgacataaaagcagtcctgctgcacgaaatgatacatgcacacaatttccttgtgggacccaaggatgatggcagggatggtgagcaggcctcgtgcctgtggtccctccagcagcctgggaaaccctggaagccacagacacccctcgtgccccacgcaggccacggctctgtgttccaagcacacatgcggcgcatcaacgcctgtcgagatcctgaccccctgcggcccctggaggggtacaacatcacggtgagtcacccccgtgggcgtcgcatgaggcctgaggcgccagcgctcgatccccgtgctcgatccttgcttggggtccagccattgtggccacgatctccacgccccagtcgatgctccacaggctcggctcaggctcatcgctgcctctgcctcactgccttattgcagatcaggcacagcatgctggatgaggtggcgtactaccagaatcatcactggagctgcccgcggtgtgggcacctggtgagacgagccatgaaccggcccccacaggaggccgactgctggcgcagggccggcccggcgtgcgccgatccacggtgcgggtggcatgtccatctgcggcactgtgggggtacgtacatcaaggtcaaggaacctgaggggtacaagcccaagacgcggaggcgggaggaggctggcaagcagcaggctgggccctcatcagcagccttgcctgggccaacaccggctgccacgcccccagctggtcacagaccgatcactgggtacttccagccggctccatcccatggggccaccgctggatcctccagtctcaggaacccagacagtatcgtacctgcagcatcaaacaatactgcagcaaacgtgcaggggcaacatggtcccagagatgcgcccttgaggcatgtgcgagtcaactgtgctatgaccgtacatgcaacaacccgccatgcaggtggcagcaaattgagatcaagaactccggatggatgtgaggaggacattcacagtaggagggcaaaacttgctgcagctgcactggctcgacttcaggcagtccctcctcggcccccttctcgccccccagccagtccccaccctggacaggaaactatcatagatttaacttga

SEQ ID NO: 1787 - DNA, 1020 bp, Chlorella protothecoides
atgttatgcggagggacagatggtcggtcatggaatcaccgccaggaagaatgcatggctgctgattcaaaccatgaactcgacaagtgctcactgcgcaaaggatggcatcagcagtcatggtcactgaactcgagaggtacgccctccagggcagcaattctttttcaaaggacatgcatagacatgtcatgtataagttgtgttgttaagatccttatcaccaaccctcgcaccctccacagacctgtcgaagatctggttgcggcggaggaggatgtcgaggagttccaatcgctcgagaagttggaggccctcggtgtcattaagggcgacatcaaaaaggccaaggacgcggggttccacacttgtgaatcgttgctcatgcagcccaagaagcggcttgtggagatcaagggcctatctgaggccaagatagacaaactggtggaggcatcaagaaacgcctgccccaactttggcataatgagcgccagagattttgagggacagagacagcgccagatcgtgcacatttctactggctgccaagcattggatgagctgctcggaggcggcatcgaaagcaaagcagtaggttttggggaaggcttctgtgtatgtttctcgtgtcaatccctggttgtagacacagccctttccgccatctctgcggtgcccacagattacagagatctttggagagtggcgaacgggcaagactcagctctgccacacgctctgcgtgacaactcagatgggagagggactggcccagcgttaaagctatcccccttgcttcaccacccgcctgcagcggccggacgtgtggcgtactttgacacggaaggaaccttccgtcctgagcgcatccggcccatcgccgagcgtttcaacctggatggcgacgctgtgctgagcaatgttctgtatgcacgggcctatacctttgagcagcagtacggtgagctgttggggatgatagagcctgcagatggtggtggggtgagggacagttga

SEQ ID NO: 1788 - DNA, 285 bp, Chlorella protothecoides
atggcgcacgcctccaccatccgcttgtctgtgcgcaagggcaaagccgagcagagaagactgtttgaccacacctctgcacccacgagacacaggctgatgaaggtggtggatgccccgaatctggccgaagccgaggcttcctacgccatcagtggccagggcatcatcgactacaagtgcgagggctgctcggtgctgtatcagtctcgtgcacagtgttggtaccttggtgacgggggtattgcaccagtgactcaaggatggcaatggtcaggcccctga

SEQ ID NO: 1789 - DNA, 462 bp, Chlorella protothecoides
atgtccgttctccggcctctcctgtgcagcttctccatctgcgactttgagggactgatggagcgcctggatgaagagctgtcctactacgatctgtccctggaggacctagtagatgacggcaaagaaatacactttgtggagtttgggatcggcggcggcaccaaccaggccggcgtcggggtggccaggactgctgaacaggcagcgtactaccccttctacggcatctacggcgcctacaggtgggcacaagcgccctgccgtcccttggtgatgctgcgcccgcctgcacgtcatcactctggcaggtccggtcgccaccccagcctcgtgttgctcccccctctcccgtcgcgcagttgccaggcagaccccttcaacatgtgcgacctggtgacgccctccccggtccgagactaccggcgcaagtactttgaaggcatctcgcaggtgacctga

SEQ ID NO: 1790 - DNA, 699 bp, Chlorella protothecoides
atggccagttcgtgggcagaggaccccaccgacgtcgcctgggaggagcaggaatgccatgttttcgaccacgaatctccccccaccctctcctccttgccccacaccgcagtgcaaggcagcgtgcacgaggtcaaggactacggcacgctgtgcgatctggacgtgcaccccgacattgtgggcgtagcagcaccccaccaggtggaaggtgaggctgcccagggcccggtgcctggcacccgcatctcggccctcgtcctcgatcgcaaccccgccgacggcatcgtggacctcagcctgcttcccaggctgaccgaggctgaggcagcggcaaagtccgaaccctcggcaaagaagggaaagcggaagggtgtggaggctgccagccccaagcagcccaagctcggcgaccagctggagtgcgtcattgagcttggctgggcgtgcaagggatgggcagaggggcgtcttgatcaacagacatgtaatccccccgccgccccacccaaaacacaggtgaaggagagggaagggtactgcgtggtctccctaccagccggctgccagccgcgaatcggcttcgtccccagccacgacttcaattcccgtgcggaggctgtgtcccaaacgccaggtgcagtgcagggccacgggcgagggggtggtggcatggtgcttgacgagtttgagggttga

SEQ ID NO: 1791 - DNA, 687 bp, Chlorella protothecoides
atggctgccctgcaattccctctctcctcctgcagtccaacacccttggcagtcagcgcccctgtcccacctcccccccaacacccctacagcaagaaccagcgggtaaaggccaggatcttgtatgttgacccggagtccaagaagatcgtgctcacgatgcagcgtgggctggtggccgggcagcttccgcccgacttcccggccatgggacaggtgtttgccgaggccacggtcttgcggatcgaccccgggctgggcctgctgtgcagcctgccctccgcggcgggccaggtcacctatcccccgggctttgcccacatcagcaacacgttggagggcagggtgaagagcctggaaaaggacacttgtctgggctgcctttgcttgatgttgtggaattcccaaggagcagcagacctgggtaggtgccggcatagttcctgcacaagacggcagcacatcctgctgccccaacttgccatgcccattgctgctaccacaaccctcccgaatgtaggccttcaccgttggccagaaggtcaaggccagggtcattgggttcaggcccctggacggtcttgcggtgctcaccctgcgtccctctgtggtcgagcagttgatcctcagccatgcaggtgcgccgagggcctgctttcttggggctggggggcgcaccttgggtga

SEQ ID NO: 1792 - DNA, 288 bp, Chlorella protothecoides
atgtccacgcccctgggtctggtgtggctgaggtgtcctgctggctggtgcacgctttgttcgggcggccctgccatgacccttgaaaagtgtccctgtgcatgcaaaggacaggccggcaaccccgtctcgctgctcacagatgctgccgggcagctggggcagctggtagccgtggagaagctggtcggtgtcaccctgcctgcccgtgtgagggaggcgcccctggtcatcaaggccctctacgacctcgacctggtggaggaggatctcatcttggcctggtga

SEQ ID NO: 1793 - DNA, 801 bp, Chlorella protothecoides
atgctcaagtgctctggccccacctctccacctgctctacaggacacatcgcccccggtgctggccttcaacggagggacccccgcctctgggtcgacctccgacgcccccatggtcaacgtcagcttcgccggccaggacccattgcccgtgaactacacctgcgccctggccgtggaggacgctgcggtcatgcagggcccggtcttcgcaggggccatcgcgcctgccatctggcccctgcagtctcgggccgcttgtgagagtccggccatattccactggctgctgccgggcacctggagcctgtctgttgtcgccgaggatgctgctgggaaccaggcaagccctgctgtgtacagctggacggtcgctttctctgctggccagcagtatgcgcgtctgaccaggtgggctcaaaccggcgtggaggggcctggagctgggatggggtgcatttcggatgtgccagcgtcgcaacagatcgagttccgcgccgcacctggggcacctgtgcttcctggtgccaatccattgagaatggcattctctacaacacccctccgccccccacgacgttcctgcagcggcccttttggtctctccagactgctggagagtgcgagcttcgaatttggcgtgtttgcggtgcaatccagtggcgcgtcgctcacccaggtggcgcagccatcgacgaggtgctggctggcggggccggggacgagcggcagcagcccctcctgggcaccctgcacctccccgcacatctacgccaacttgagcgagggcgcctacacgtga

SEQ ID NO: 1794 - DNA, 363 bp, Chlorella protothecoides
atgccacacgtggaagccatccatgtatacccagcccccctcgctcctgtccctaaacattccgccctccgccatgcctgcctgcagtacctactccagggcggttgtagataccgcgtgtccaccgtctacctctggaacctgcagtcttgggacccgcaagccatctatccccttccctttgccgatgctgcctcgcaagccgccaatccgaccgcctactacgaccccgtcgtagtcgccaccatcaacgcccacaacgccgaggctgcggcccgtgccgacggctgcgcagcgcgagcccccgagcccgaactcgaggcggagctagctgttgcatctatcgtcccgccagcgtgctga

SEQ ID NO: 1795 - DNA, 1143 bp, Chlorella protothecoides
atgtgtgcacatgcactaggaaggctgactctcactcactgcaccgcacgcagacacgacgctgcccctgccgaactcagaacgcaacttcacgctgcaagtggtggacagggtggaggttgccaccggcgacacccaccgctactgcgtgcgttctacggggggcccgctcaccgtgaccctggtgtgtggagtaggagaggggggagtgtgttcatcaagcatgtgaagagagccactggtgccctgtcgcgagttcactcaattcgtgcatggccagccaaggacctgattggctgcctgcctcacccggtggcaggcctagctcagataccttccccaccctcctcccctccatctccacaacccctgaaggtctggacggactaccctgccctgccctcggtgtccaaggtcctggtgaatgacctggacctcacagtgcgtgcctcaggcctgggtggcatcccgctgctgggcaacggcgggtccatcgccaacgagacgcagccggaccgggagaacaacgtggagcaggtcagcatgtccttcctgcccgtggggcccgtcgccatccaggtcgacgcccactttgtccacgcctcggcgggccgccagccctacgcgctcgccgtgaacggggcctttgccgggacgctggtcgtgccgggggacggcgagcagggaccagcctgcaccatcgtggtccccagtgagtctgagatggcggaggcgcgtcgggaggctggttcgctgagagcgtgcagagctgacaaggaggagcactcgtggctggcaaagcagcggggaatgcgcattgcttgcccaccgcccatcgtcatccccaaccacgctcctcaaccacctcttcttgcaggcatcaccaaaggcccgtctggccccacaaacgcctcgcccatcgtgtttgagtttgctgctgccggcaacgcagcgtatggcggcctggcgtgggagtgtcttctggccgacggcaatggcgccgtcggatccaccgggacccaggactggaaggtgcgggcgtggggggcaggcatggggccgtgcaagggaaggtggctggaatattctgttagacacgagcgcctgcgcaatgggtgctacagcttggcatcctcttgctga

SEQ ID NO: 1796 - DNA, 624 bp, Chlorella protothecoides
atgaccgacacctctgaggccgccatggctcggcgcgctgccgagcagctttccggtgccaccgccgccatggtcactcagggaaacctggaggcggagatggcggccgccaagaaggcggaggatgccgccaagaaggcagcggaggaggaggccgcggctgcagccgccgcccaggccgaggccgacgctgcagctgccaaaaaggtgctcttttgcagcctgcgtgggtgcagcggtatcgcctgccctcctctgcctgctggagtgccacgacatagcgcgctgagcgtgccgccgctggctcatagcaaggctcgcatctcctctctcaccgttgctgaggaggatgccaggctggcggaggaggccgccgcaaagctggctctggccagccccgaggtcgccgcgatgtccacgctgcgtcagctgctggcctccgggacggcgcccgccgagctggcggccacgctgcgcagcctggagctgcctggcgggcctgcggcccgggcctccgcgctctaccaggtcctctttggcgacgtggaggctggcgccaagctgtctgccgaagtggagggccgcaaggcgtatctggcacccttgtccaaggtggggcgttga

SEQ ID NO: 1797 - DNA, 537 bp, Chlorella protothecoides
atgggcagtgccagactcgggccttgcccagctgcacacaaccccactcatcccacagataccctcaaattctttgggtgtgagctgggagctcagaccaagttcgagaaggcatctggcaccagcatcgtgaacggggcgcacgacgccagccgcctgtcggagctgcttgagtccttcatcaaaaagtacgtgcagtgctactcctgtggcaacccagagactgttgtgaagatcaagcgggagaacatctttttgaagtgcaaggtgaggggggagaggaggcagctgtgtgaagttgtcgtatcagccctgaccatgttgagccagcattgtaatggacagtgcgttgctgcagcctcaggcccggccgccttgcctcatcttgcaggcctgcggcttcgtgtcggaggtggatgctcggctgaagttgaacaccttcattctgaagaacccgcccgacaacaagctgagcaaggccgagaagaagtgagcacaagcttggtttgtgagaggggtgcggaaagggcgaagtag

SEQ ID NO: 1798 - DNA, 1659 bp, Chlorella protothecoides
  modified_base (731)..(740): a, c, t, g, unknown or other
atggagcaccccctggaggctgcccccgcaccccaggagattcctctgaccagctgcctcggtactgaggttgaaacccttcagcatcacatggcgcagtgtgtcgcggacctcgaggccgtgaaggaggccctgctggcctgcccagacgaccctgagctcctggaggtgagaaggggacgcgcaggccaaaggtgcgctgcgctccagtcctcctggatccctttgattcggcccctgcactcagccaaaggtgcgctgtgcgccagtcctcctgatcccttcgattcggcccctgcactcagtacgcatccaggacgccctttcacacctgatgcccaggccaagcagctcctggaggagtccctggagggcgctcaggaggatgcgggcataccggacgatgggacgctgatccaaaaagatggctcccgctccgcctcgcccagtctaccccaggcagcgacgcccccgcccgccccgctgcctcacgccccgcgcgtggcgggccgtggcgcgcccaacaacgcccgcatcaacccccgcagccgggggaacagggacgcgggggggccgtcccgtcgacgctctccggcggccgttctgacctgcgccccgtggcgtacggtgccttggctccgtggcggcttgtccggcatgctccgcgcctgccccactgcatcctgccttcatccaggcgccccattaccccccccaaaatacccccaccnnnnnnnnnngggggggccgtcccgtcgacgctctccggcagccgttctgacctgcgccccgtggcacacggtgccttggctcggtggcggcttgtgcggcacgctctgcgcctgccccactgcaccctgccttcatccaggcgccccatcccccccccccaatgaacccccacgccagggcacaggccgtccctcgctcaatttccgtgacccgcgcgcctgcgtggcgctgacgcgggcgctgctggcgcgcgaccacggcctgcgctgggacctgccgcccggccacctggcgccgccggtcaccgggcgagccaactacgtgcactgggtgcaggacctgctggcgctgagcgcgccggagggcggggaggtgtgcggcctggacgtcggcacaggggccaacctgatctacccgctgctcggcgcggcgctggccggctggcggtttgtgggcgtggacgtgtcgcgcgccgcgctgcgcgcggcgcggcgtctgctggacgccaacacgggcgtggcacggcgggtgacgctgcgccgggtgcccatgcagccggagcagcgcgctttcttccgtgggacggaggccgcgccagagggcccgagggaggaggggggggatgacgggggaggggagcggggcgccgccagcggcggcgcgtgggaggaaatgcctgcgggagacgccgcgggcggtggcatcctcagcgccgccctgcgcgccggcgaggcctttgccttctgcatgtgcaacccgcccttcttcgagagcctggacgaggcggggcgcaacccggccaccgcctttggcggcacgccgctagagatggtgtacccgggtgcggcgcgggcggtgggtcttgtaggctgggggtgtgcctatcagcgttgtttctgcctggacgtgttgacattcaaggatgga

SEQ ID NO: 1799 - DNA, 2283 bp, Chlorella protothecoides
  modified_base (1175)..(1184): a, c, t, g, unknown or other
  modified_base (1260)..(1275): a, c, t, g, unknown or other
  modified_base (1999)..(2008): a, c, t, g, unknown or other
atgcgaccggacttcgtggagatagggctggactatcatgaaggagatgattcaccgctggatagcatacgcggggggattgatcggcgtacttaccctcggcgccccactacgggagcgttgaggggttctgccgatgactcgcccactctcgtgtggcgcctggatggtctcaacccacgtcagctctacctcgaactgatctcgcctggagtgccgtcccgaagagcatcgctggagtttgctgccagtatcttgccgtccatcggttggaggcggtctggcgaccaagctcacttggccatcatcaccagtgacgacctgctgcacagcatccaggtcgggcttgcagagagcgacatctgcaccccagcatcgcactccgggtcacccgacatctcttcaaaactgccttacagcctgacatcagcctcgttggagtctagactcagagatacaggtgaccctgtggcccttcagtacgtcaacgcctacctggccattgggacaacccaaggccgcatcctactagtggatgtcgagagcatcggggagaaggttacagagctgcggccccccaatcttggtctcagtaaggtgtggctgagtgatgccggggatacactaacaacgcagctgctatcgtttccagatcatggcatcagcacatacttttcacaggtgtttggaggggttttttcgcagagcttttcccagccggccatctccagtctcatgtcctttcctcgacccgaaggagagttcctgctggccatcaatgagcgtgcccatctcagcatctgggataccgctgccgccaaaatgctttttggcgttgatcttctgccagcagaagaaacatcgctggtaccaaagctcgcccgtgctgcaagcgagcctcttgatgctctcacctgcatcctcttcgtatactatgagaggagggaaacatcaaccagtgaaagcggagggcccggcaccctgcacacctatgagatattgatggaggaaaggggcaacgccctgctcaaggtgcggttctggattcaagagcgattaagttggacatgccgctctgaggccggtcccttgatcgtcatacactacaccctgcaccactcacgtaggtccatgtcgaggggggaaccaaactggaaggagatgtcaactccttnnnnnnnnnncaacgccctgctcaaggtgcggttctggatccaagagcgactaagttggacatgccgcgctgaggccggtcgctcnnnnnnnnnnnnnnnnaagaaattaggcgcatggatgagataccaaaattcaatgggagcccagtgcatccgctgcatccagatagattacacggactctgtggccagggatatgtctttcagtacaatagaagagcatgcactggcagcagtcccagctgctgaagacctttggtggtggcaaactttcaagaagctcgtacagcacgactggcctgaccttaaaatcgaccaagctttcactttcaagaagctcctacagcacgactggcctgaacttataatcgaccaagcttttgttagagcgtgtgtggacgccattctaaatccggcctgcttctccatcggctgccttgtggcgaccctcgctgcgatagggtgctcagcttccaatgacagcttgcacaccatgtcggctgtggagctccgagaatggatagtctcggtcctggacgcctattgtgctgaccagcgaaggcccgacaccgacctgtgcgagagcagggatgtcgattggagctactttgtcagctgttacgtcaaggagtggaccaagcgctttccaatagtcggcctcatcgttgctcaggagcatcagcacgaccagatactcgttgcaaggcgcaacgatatgacaactctaggtctggaagtgtttccacacggcagcaagcagggagctgaagtaggctcgagagctcggagacctgactttagtagtctaatatggacaatgaagnnnnnnnnnnatgatatcgtgctaatcatccaacggctatcacagggagctgaagtatgctcgagagctcggagacctgagtttagtagtctaatatggacaatgaacgctgcgctgggcggtccgtccattcacagggtactcgatgcggtgatccagtccaagggagtggatctgtacctgcacgtcctgccagcggtggagcggatgctatcaggttcttcgctcccaatagtgtcagcctctactccagaccagacgtgtgggcgtcgatccaaacttcgc

SEQ ID NO: 1800 - DNA, 948 bp, Chlorella protothecoides
  modified_base (136)..(145): a, c, t, g, unknown or other
  modified_base (634)..(643): a, c, t, g, unknown or other
atggcaggaggcccagctttccagtgcaattacattctcgtgctgcaggcgtccattcgtgtacgcgcaacgcaagacaatgtggcaggagtgaagttgcctaagttcgagtctttcaaggagggggcagacaccnnnnnnnnnnctgttgccattcatcgatggtattgtcaaaggatggcaggaggcccagctttccagtgcaatcacgttctcatgctgcaggcgtccattcgtgtacgcgcgacgcaagacaacgtggcaggagtgaagttgcccaaattcgagtctttcaaggagggggcagacaccaagcttgctctgatcggacttgggaacggcggaaagcagattcaggactgccgactcaacagacccgcttgggcaagcacttgccccaccacaactcgatacccggactttgggccatccttgtgcaggaagtcatttttatctgcggtggagcttctcgtcgagctggcaagtttgcaaactgccttcttgaccctggacgaggccatcaagaccaccaaccgccgtgtgaatgcgctcgagcatgttgtgaagccaaagctggaaaacaccatcgcatacatcaagggtgaactggacgagctggaacgcgaggagttcnnnnnnnnnnctctccagaagctgtttcacatgggtaatcaaagtcccagcctgaagggggaactggacgagctggaacgcgaggagttcttcagattgaagaaggtgcagggcaacaagaagaagaacgctgatctggctgctgccagggtgagtacagggcttggcaatgagcgtgttggggctgattgcaaaggtacacgaatgatttgccatgccttacttaagaaaagctccatgcacacacctcctgccatttgcccctttgagtgtgtaggagctggaggaggccaaagagacaacacacgtgcatga

SEQ ID NO: 1801 - DNA, 819 bp, Chlorella protothecoides
  modified_base (346)..(355): a, c, t, g, unknown or other
atgggaaccccgagcccgggcgttgcggggcgtgggtccagagtgacagtccaacggagatggtccctcccggctactggatgtctgtcgaccctgccagaacagccagatcagttgtgcatgtctttccggccggttaaatggggccacagccgggaccagatgcaccagctctgggagagtgaggcctttcgatgtgatgcgggtgtcgagtcgctggtgcgtcttggtctgctccctagcacgggcgttccgtcgtttgtgcacgctcgagcggggtatatctggtttcaaggagtgctcgccagctgggtcgtgctcctcctgcctgcaatgtgcacccagnnnnnnnnnngaagcttgagcggggtatatctggtttcaaggagcgctcgccagctgggtggtgctcctcctgcctgcaatgtgcacccaggtgtgcagcgccacgggcattatctccactcggttgcagactcaagtccgaatgctacgtccttgacgtgtcacctattccgatgcgctgaatcccttgtgttgggtctgaggtggcacgtcgaccttgccgagacgcaccaagagcttgctcaagaggcgaggctcttgagcaagtacaacgggctggcccctaagagggctctcctacagcagcggaagtccagcaagcactttgattccgctgattgggcgctgtccaagagcttgacggcgaacacaggggtgagctcagaccttgagtccctgcccccaaagcgatgggagccccggactcccacgctccagcggcgtagctcaaagctgagtgtagcttcgtcgtaa

SEQ ID NO: 1802 - DNA, 720 bp, Chlorella protothecoides
atgctgttgcacgaagcggaggccacagccacgcctcttcccaccggcctgcatggccgactcctggaattggagtacatcacgcagacagaggcgtcccgtaggcggtacagagcactctcccatctcccacttggaggtcaggcacaaacctccatctcactcacccctcccgcagcaacatttcggttgtgtgagctggacctcagtgattgctgttccgcagacactttggatgcattctcagaaggccttaagctccgcgctgctcggagggcacggctcgcaaaacaggccgctcatcagtcgcgtcgggataccatggctgctaccgaggctgccgccagagcagcctaccccgtgccacaagctgctccgcctatagaggagtgggggggcgagccaaagctgtggatcgacccaggtgctatcgtgacatctgcgacggtggcacagggaggagtatcctatgctcgcctgacccgagaaggatttacggcgtctggaccagagctgtcatcggcacgttcgccgggggccagtgtcccatctgtgccaagccctcaaggagcctgggccaaaaggcaagcgacgccgggggcacaacaagagggaacacgagtgacttggtcggcctccaccccgcctcacagcaagcaagcaagcggcgggaaggggaagaagacggtcgtgtacacaactcagcaacgaaagtactga

SEQ ID NO: 1803 - DNA, 1695 bp, Chlorella protothecoides
  modified_base (1581)..(1627): a, c, t, g, unknown or other
atggtcgtctcatacacgcccccgccaccctttgcacgtgcgttggcaggcccttccgccaccggcaggcaccgtgggccaggtttgggagctgtgaaggggggcggagctgcggccccggcgtcacagcccatcctgcctggggcccacccagagcgtgcagcgactggggccggtacggcacccaaaaacggggcgccccaggaagtaccagcctcgtcacagcctccgccaatggatgcggccatcgactcccctcgtgcggcgtcatcaactggaccaccagcggcggatgcagctattgttgggcctggctctgaggaggatggagcggccaaggaacctcgagcagcggaaggtgctgatcccatcactgcatcccgggccgcgtctggtgctgtaggaagctctgacgatccaaccccacagcttggtcccggcagccatcctcctgtggtgcagcaagggcctcccaaatcgtgggccgagctcgctgctgccgctggacgccggcccggtagggcgaggccccggccctcctctcatgccaccacgtgcgccgcagctcagcccacgccgcaccaggccgcaccagcgcctggggcggggaacgagcagagcagcaggcctgcaggggaggcgacgaccccgcgaactgtacctgtagaggctgagccgggccacgaggccgctgcgcctgcaatcgagcgcacagggccgacgccctcggacgccggcgcggaccaccctgcgcaggccaccgggtcaaagctcctcgccgcctcgacccggctgcagcagctctttgcgagcagcgactgggtggcctcagcagcaacgcggtacgagccgcggggcctgctgaacccgggcaacctctgcttcgccagcgccacggtgcaggcgctgctggccagccctgcgttctgcagcctgctctctggactggctcgggagggggccgagtcgctgcccaggagcgtgtaccccacgctggcggccctcgctgagctggcgggcgagctgcagcctctgggacgtgaggggaagccagggacgtcggctcgctccccgccagggcccacgctggtgggcaggaagctggcgccgccgcccccgcccgccggaggcaagcccccgtccaggggcgagacgggcgccgcctccctgctcgccggaggcgcgccctttgcccccggcatgctggccgacattgtggccgtcttcgcgcccctgaactgcacgggcggcgaccagcggcgggagcagcaggatgcccaggagttcctgaccttcctggtggacagcatgcacgccgagctgtctgcgctggcggagacgcggggctggtcccggtgcgaggcggagcccggcggctcggcgcgcggggaggacgacggggaggagtggctgacacggagcggcaagaggaacgtgcggcgcggggagtctggcgtcatgggaggggccagccccgccacggccctgttccaggggcggatagcctcattcgtcgcggccagtggtgcgccagcctccgtcacgctgcagcccttctgcgcgctgggcctgcacatcctnnnnnnnnnnnnnnnnnnnnnnnnnnnnnnnnnnnnnnnnnnnnnnnaggccgggggtgagacgggtgggtgggtgggtgggtggacggacagcaggcactgcgtgccgcggtga

SEQ ID NO: 1804 - DNA, 465 bp, Chlorella protothecoides
atgcggaagaagcccggcacgtcgtttgaggcttactttccgaaggctgacaaaggggctcttaagctgctcaggcgcttgctggcttttgatcccgccgagagacccacctcagaggaggccttggccgacccatacttccatgggttgagccagcccagtcgcgagcccagtgcacagccagtgagcaagctcgcattcgagtttgaacggcgcaagctgaacgtagatgaggtccgggatctcatctaccgcgaaacactggagtaccatccgcagatgctggccgactacatggcaggcggtcggcgccagccaaactttgtctacccctcggcaggtcagtacgtgctcagggctgactgtccagggtttatttgcaatgtaatgatgtggggatgcatccttaacatgcactgccgcgccccccctcccccccgcgtgtgcatgaacctgcataggtaa

SEQ ID NO: 1805 - DNA, 336 bp, Chlorella protothecoides
atgcggtgcccttcctcgtcatcgagtgccttccaggttgggaaaagggtgtcctttgagccatacatcaccatcaaggggcagtggctgacatcagacagcggtgatcatggcgcactgtacaagttgatcgccaccgtgagccaccggggggccgagagcagctccgggcactacacggcggatgtgctgcaccccagtggcaggtggctgcgattcgacgacggggacgtcctgggcgtgagttcccagcaggtgttcacggaccgaccatatcttctgctctatcagagattgacagaggaggacaaggctgcggtggcgcgacgaagatga

SEQ ID NO: 1806 - DNA, 558 bp, Chlorella protothecoides
atgcacgacttcaaggacatatacgtcgtgtttgagttgatggagaccgacctccatcagcccaagaacatcctggcaaactcggactgcaagctgaagatctgcgattttggactggcgcgaccagccttcaacgacatgccacagaccgtcttctggacagactatgtggcgactcggtggtaccgtgcacccgagctctgcggctccttcttcacaaagtacacgcctgccatcgacatttggagtattggttgcatctttgcagagattctcctgggaaagcccctcttcccaggcaggaatgtggttcaccagctggagctgatcactgacctgctgggcactcctgcccaggaagtcattgcaaaggtgggatctccgtttcctcgatgcagctgttggttcgaatggaaaatcgggcaggggactcgggtttcgaccgaggtgggcatgcccatccctctgctgttggtattagcacccggggtcatactgagggctcccgcttgctcatgcacctacccatcctgtccttggagtataggtgcgcaatga

SEQ ID NO: 1807 - DNA, 1047 bp, Chlorella protothecoides
atggtcggcgatgtagattctgtttcgtggaataatgatgcatacatgcagacgactcatcacagcccattgcctgtgtccaacagaaggacctggctggcgctatcaaggcgtggtggaaagggggagggggcagtgtgtgatattcactcgtgcttgctctgggcggcatatcgcacccacatgattgacaccccaatccaatctgccatcccctcagaggacggaatcttggtgctgcagctggtgaaggcacagacgggggtcacgtggccggctgccatcgcagggcacgaggtttcgcccgacgtccagaccactgaccagaaacggttgatgttggagcgcttccaggcagagcgcgctctttcctggtccagcagcccccccgagccccgccgtactatccccctcaaatcacccctcatccctccctcccctttgatcgcagcatcccggcttcgacttctcccaggccgagttcaacggcgtagtccccgacccctccaccttcttgaaggacctgccaggccactagaccatcgggttcattgtggaccctcgagtaggagcatgctgacgacacaggcgtccatggccgcagcgagctcgccccttgcgctcggacctccacgtccgcgactcgccacccgtggccaactgggcctggatgggcttcgaggtcgctgcggtgcagggcataagaaggcctctggcaccagccagcgcccatgctgcccagcacggtcctcaagggacgcccgtgggagcgacccgagatcatcgcagcgagctggcttcccggcggcttccctgtgcggcgggggtcacggtcgaccatccacgcacgacgccgtgcctcgcccctcgggccgcagccccctcgccccccgcgccgcgccgcctggcgcagatgccgcgccccccggccccgggccggacttggagatcaagatcgtcgggctgggcgggcgtggcgcggcggtgctggacgccctggcgcgggggccccggctccccgtctccgcccagctctgggcctgcgag

SEQ ID NO: 1808 - DNA, 570 bp, Chlorella protothecoides
  modified_base (342)..(351): a, c, t, g, unknown or other
atgtcggggggccagccgtttggccgctggtgccgagctacccccagatcgagggctgcgatcaagtcgagcggagccaatccagtcgggcgcgcagatgagcatgagtttgaaaacagagctgtgacatgtgcgcctagctacactgctgagagtccaccccgtatatgcattgttcgcggaagctcatttacgattggacggggtgcagcgcgaccccaggatcgggtgggagctgggcctaggatccccagcccgaggaatggacagggtcttcagcttagtgtggcagcttcagtacccaagcttgccattcacgatcgaaggcaagcatcgcgcccnnnnnnnnnnctcctcaatgcccaagcttgccattcacgcttgaaggcaagcatcccgccgacacacgcacgcagtgacatcaacatcttcatcgatctacctcccggagctcgtgccaaggacctggcagtctctttcacaaccgccaggctcacggtgggattagcaaacaccccgccctaccttgatgtgagtccatcgctctggggtaatgagcttctcgtttga

SEQ ID NO: 1809 - DNA, 1191 bp, Chlorella protothecoides
  modified_base (379)..(388): a, c, t, g, unknown or other
atgcaagcctcatctttgccgcacatgactccgcatccaaaacccctgcccacccttacacccccctattctcccatacacaccccaagtacacaccttggggtcgatctggacgtccacctcgtccacctccggcatgatggccatggtggctgtgctggtgtgcacccggccagaggtctcggtgctgggcacgcgttgcacgcgatgcacgccggactcatgcttcagcttgctgtacaccctgcggggatgggatgcggatggtggcccacctcagggcccaggtgctggcttcgccctgctgtcgacacccgtcccagccctcggcccgtccaccctgtccaaccccccagcgcccgggctcacttgtcccccnnnnnnnnnntctgctgtggacacccgtcccagccctcagcccatccacctagatcgcccccccagcgcccgggctcacttgtcccccgtgatgcgcagcaccgcctccttgtacccgccgccctccgccaggctctccgacaccaggctcacgcgccagccctgcagctcggcgtagcgctggtacatgcgcaccagctcggcggcccacagcgcggcctcgtcaccccccgtacccgcccgcacctccagcatgatgttgcgctcgtccagcgggtcgcgggggaggagcagcaggcgcagcgcctccgcctgcgcgcccagccgctccgccaggccctccacctcctcgcgcgccatggcctccatgtcggcgtcgccctccgactcgcgcagcacgtcccgcgccgaggccagctccgcctccagcgcgcggtaccgctcgtacccgctcacccgctcctgcatctccgccgcggcgcgggccaggcgctggtactcggtggggtcgcccgccaccgcgggcgtggccatgccggcctgcagctccgcgtggctgcgggccaggtcctccagcttggccagcacgcgatccaccaccccaacccgattgctacccaccgctgcggccctggcgacgatgtaatgccggggcgcgacgcgaggtggattggcggggcatgcggtgctgggagtgaatggccgaggccctgcacaggatcgagaggggcgcagggagggcatggccgcggcgccccaggccagggcacccgacggcagtgccgggctcatgatgggcgtcgagacgcctga

SEQ ID NO: 1810 - DNA, 474 bp, Chlorella protothecoides
atgactggcgatagctcggtcgcacgttatctggccggtcttcgcgcgcgcacgggtgttgactctggcatatactgccacggcagcggccaggtatacgagttggggcatcagggacggaatgccatgcactcctctcctctcccccgagctgggctgagctcagccggcgagcgcggtggcgcccgagatgatctcgatcagctcggtggtgatggtggcctggcgcgtgcggttgtaggtcagcgtcagcttgcccagcatctcctccgcgttcttggtggaggactccatggccgccatgcgcgacgcctgctcgctgcagttgttctccatcagcgcgttgtacagcgtggaggccaggttgaactcggacaggttctgcagcagctccgcgcggtcggggccctcaatctcgtactggtccagcaggccgccggcctcggcctccttctccagggactgcaggggtga

SEQ ID NO: 1811 - DNA, 945 bp, Chlorella protothecoides
  modified_base (412)..(421): a, c, t, g, unknown or other
atggctaagccacggcacaccgtgttcgtggatggcgaggaggaggcggccgcctttgaccctgcagcctacttcgacacccaccctgacttggtagggcgcgcctttaaccgtcccaggacggaacagctggccaaccctccccccgtggcggagggcgacacgctggcgggcgtggcggcgcgcagcgagcgacggcgggcgacggcgtacaaggagctgctgcagcggcaggcgcggggcgagaagctgagcgcactggcggcgcgcatggcgtacgccaaggaggtcgcagggaagggcaggaaacgcaagctgacgccggcggaggccggcgggcagaagggcgtgtttaagtggaaggcggagcgcaagcgtcagaggaacctgatgcgagtcatcggttgctctnnnnnnnnnncggagcctgatacctgcctccctgtaagatattacattcgagattctcagtcagaggaacctgatgcgagtcgtcggttgctcatgctcaccaggcaaccatccttcccgcgctacttagaccccggcaaacaattttcagagacacgggcgcagcgacatcgacatgtgacaccccccccccttcaattcccgtgccaaaccccagcccctaacacgcacggttcactcctagcaacccccccgagagcctggggaatcaggaaggatgctgcggcgggcgggtcacagcctcggcagcaggctctgccagaggcagggccagctcgagcctgcggtgcagggactgaagcccagcttcgctgtcgcagagtaagtttggagtgtgcctgcccggcagcgtgggtgtgcgtgcccgctaccccccggtcgagtcacctctgtcccatccccgtgccgtgcagggaggccgtcgagggagctcgcgatgcctccactctgctcggtatgctggcctggaggtag

SEQ ID NO: 1812 - DNA, 423 bp, Chlorella protothecoides
atggacaccagcgcacgaccgccctccctccctccctcctccttcgttcaggttctgcgcggcaaggcggaggcccgcaacccagatgagttctactttgcgatggagaaggcacggaccaaggacggcgtgcatgtggttagcaccagcgagcccaacaggtactcccaggaggagctgcgactgatgaagacccaggacgtgggctacctgaccctcaaggcccaggccgaggcaaaggtgatttggtggggcggatgggtaggtggtgggaggacgatgctgttgtggggtcctgtcgtacacactgacaagccgcagtcagtcccctcctcatcgttacctctccctctgaatctcacacacgtccacacaaaaccacacccttcgcccatcccttgcctcagaaagtggagaggctga

SEQ ID NO: 1813 - DNA, 555 bp, Chlorella protothecoides
atgtgtcgatttaatagagttgtcctagtagaagggtgccccccctctctcagtatgttttggcatggcatggttccttatgctggctacccatgtaatcctctgtatcgcgaggttgccacgggcaagcttattggtacaaacatccccttaaagtcggacgcattggaagggggaggggggggtgacctggccaccacagcacagcatgaagaattcagcggtggagctgggcagtgttgctggcgagggggacgcccgtggccaggcgcgatgagcgcgtctctgaagaatgccgtgaagcgtaaaacgcataaggagcgtgcacagcccgcactggacggcaaccctgcacccaccgcaggactgcacgccggaagtttgggctccttgagaagaaaaaggactacctacttcgtgccaaggactttcacaaaaaggaggatgccatccgggtgcgcggagtgtggtgtctctgtttcagtaaggcttgggaggctgtgtgagtgcagcagggccgtcagtctgcagtcactgccagtcctgcaggcatga

SEQ ID NO: 1814 - DNA, 1053 bp, Chlorella protothecoides
atgctgctgcgcgatccctacctggcctgcgagatgaacgagggccatgtcaacacgcgctacctccccgcctgggtgctgccgccaaacattgtggccacaacctccgcgcgggaggccatcgagggttcgcaatatgccatccacgccgtccccgtgcagcagacgcgctccttcctgcagtccatcaaggtggggcggagctggtgggatggaagccggggcgcagggggggggggcccgcaccacggccgcgctctgagctgggtctgcgctgtcggcggctgccctagggaagttggttgcatgggcagtggggatctgcaccgccagttgtggacccgcccatgttcaacctctgcaacactcgacagcaccccctcacccacacgcaccgtgcagacgctcctgccccccaccctgccgctggtgtcggtgagcaaggggctggaggtgtccagcgggcacgtgctgtcggatgtcatcccgtcggccctgggccgcaagcagcccaccgtctacctgtcggggcccagcttcgcggcggagctcatggactccaagcccacgggcgtggtggctgcctccaaggtgggcgggcgggtggtggtgtggtcaaggcgcagggaggcttgctgggggggctcggctccgtggcggcctcgaggtacccatgcacgcgccggccacggcgtgtgcgcctccagcagcgagcgcgctgcattgctgtcgacccgtcttatcccgggtctcgaccagaccagccatgtccggcgacggcaattgcaggcctcacacatctccgcacccctcacccccccgcccttcccctttccccaggacaaggccctggctgaggcggacaaggccctggctgaggcggtgcagcacgtctttgcctcgcccaccttccgcgtcaacacctccaccgacgtcgtcggcgtggaggtgtgcggcgccctgaagaacgtgctggccatcgccgccgggatcgtggaggggctggacctggggcacaatgccatggccgccctcgtggctcaggtgccctga

SEQ ID NO: 1815 - DNA, 468 bp, Chlorella protothecoides
atgcacatgctgggcgcccacgccgcctgcgtagcaggccccgcacgccgacgccaccccacgactccacccacgtcaccccactgcctcacgcaccgcccccgccgcccaccctacacaaagggctgcgccgagatccggtggctggcggagaagatgggcgcgcgcggcgcaacgctgtccggccccgccggcctgggcgacatcatcctcacctgctacggctccttgtcccgtaaccgctcggtgggcgtgcggctggggcggggcgagcccctggccgacatcctggggtccagccaccaggtggcggagggcgtggccaccgccggggtggtggtgggcctggccaggaagtaccgcgtccagctgccggtgctcaccgccgtggcccagatcctggacggccacatcagcgcgcgggaggcggtgttcgaactcatgaacctgccccagatcgacgagtag

SEQ ID NO: 1816 - DNA, 813 bp, Chlorella protothecoides
atgagcccggcactgccgtcgggtgccctggcctggggcgccgcggccatgccctccctgcgcccctctcgatcctgtgcagggcctcggccattcactcccagcaccgcatgccccgccaatccacctcgcgtcgcgccccggcattacatcgtcgccagggccgcagcgcaatcgggttggggtggtggatcgcctgttctctcccatgggccggcaggcggcatcccctcaccttgcgtcattctttacagcacctacctcctaacaccccccccccaaaaaacaaaggacccttacgtgctggccaagctggaggacctggcccgcagccacgcggagctgcaggccggcatggccacgcccgcggtggcgggcgaccccaccgagtaccagcgcctggcccgcgccgcggcggagatgcaggagcgggtgagcgggtacgagcggtaccgcgcgctggaggcggagctggcctcggcgcgggacgtgctgcgcgagtcggagggcgacgccgacatggaggccatggcgcgcgaggaggtggagggcctggcggagcggctgggcgcgcaggcggaggcgctgcgcctgctgctcctcccccgcgacccgctggacgagcgcaacatcatgctggaggtgcgggcgggtacggggggtgacgaggccgcgctgtgggccgccgagctggtgcgcatgtaccagcgctacgccgagctgcagggctggcgcgtgagcctggtgtcggagagcctggcggagggcggcgggtacaaggaggcggtgctgcgcatcacgggggacaagtga

SEQ ID NO: 1817 - DNA, 1617 bp, Chlorella protothecoides
atgggcgcaggagaggaggacggtagacgccgagcctacctccccaacgactcccggacccggtatgaggcgagcctggaggctggattggacgatgggcgggacgccgagccatacctttccgaggcagtgcgatcgcggcggtccccgcccgcagatgggcggcagcagcctcccccccactgggagccccctccgcagaagacacccagggaggactgggtctgcggtcggtgccaggcgctcaactttggcaggcgccaggcctgctttgtctgctcctcctcgcgcgagggcgtgcaggcggcaggcgcccgggaggtgaggcagcgtgcgtcgagcacgctgcgagtcaccggcctgagccggcacgtggacgggcccgccctccaagccgtgttccggcccgttgcagagggtgcgcgtggatggcagtgggcaagtccctcgtcaggaagtgcgggaggatctcaggaatgcaggcatgaggtcgctgccagcgctcttcgccggcacgccccagcctctgcctctcgggcaatgtcaaggaggtgcgcatcgtgcgaggtccaggtgggcccacagctcccgccgactccgcctttgtggtattctctagtcaccaggaggccagccaggcgctggctgcggtgcaggtgggccgacgcggcctgcctgggcggtctacgcgtacgagtcgcagttcatgccactgtttttctatcctgggatggaagtacatctcagccacaccataacccctgcctcctgcttcttcatgacgtggcgcagacccacacagaggcactggaggcacagtttgggccgctgaccatcgagtttgcggaggagggactgcgtgggggcgaggcagcgcaggtggagcttggacccaatggtgtcctggagggcaccagctgggagcccgccagctttgaggagcaggagaccggcgatgccgaggcagctgctgctccggttgccgtggattgcgagcgcccaggggatgggcccggctcgtcagccgtcatggaagcaagggggcatgggtccaccaccgaagaagcgagccaggctccctcagcggcgccggggttcgcgtacgaccccgcctccggctacatgtatgatcccgggtcggggtactactacgatgccaactccggcatgtactgccaccccagcctgggggtgtggggcaccctggatggcgagaccggcgcctttgcgccgtaccaggagcctggcttggccagcacgggcgtgagctccgcggcggaagccagcctggcggccgcccatgagacaatagagcaggagcggcggcgagctgcgggtgctgcgactgtggctgcatcggggccagggcctggtgcagctcaaacacagcagcccagacgatcggccgtgatcggcgccgcgccgcagctcgacgctcaggggttgtttgaggcggctcgcgctctgcagcagcgtgaggacgagaaggcccgggcagcctccagcgcgcacaggccacctgcagccaagtccgcacctgcgcccatccctgcgaccaaacctgcggtgcagggggtcgtccatcgtgggaagtgggcccagagagcgcttcaatga

SEQ ID NO: 1818 - DNA, 2430 bp, Chlorella protothecoides
atgtcaacccatcgaccctgctgctcatctggcatgggccagtgcgaggaggcgaggcaggtccacctcgccaagacctcggctgcaccggcggggtctcgaagactgtcggcgctccaggccagcggtcccctcttggttacggcgacactcggcgacggaacggctctaccatggccacagctgccgcacccgcctcgccccctgcgcagccaatcccaaccttcctcacgcgcccttcttgtacaccgtctcctccgcccccgcccgcttcgcggccagccgcgcggcggtgaacaggtagtcgctgaggcggttgaggtacacccccaccgcctcatccgtggccccagcccccaccagtgggaccacggcgcgctcggcgcggcggcacacgctgcgcgcgaggtgcagagcggcggcggcgtgcccgcccgagggcaggatgaagttggtcagcggcggcagctcggcgctggcctcgtcgatccaggcctccagcaggggtgtgtgggcgggatcgaaggccgcccggcgcagcttggcctcgctggcgctggccagtggcgtcgccaccgccgacccgacgtccagcagccggctctggatggtggcgagctgttgatttggatgtcaccatggctcggtgttaggtttggtgttgaagaagctgtgccatcaggatgccggggcgacttggaacacaccgtagcgcacctggagggccatgctggggtcgaggcccctgacatgctcccctgccacgccgatggcggagttcagctcgtcgacgtcgcccagggccgcaaaggtggcatcatccttggcacgacgctcgccggtaatgaccatgggcggcgcatcccatcaccgatcagccgtcagcaatcttcaatcgatctcttgatacctgatgccggtggagtggtaggatctgacggcgatgctgggcgcttagctggcgatcgatgtggggagaaggttcaacctaagcctgaatgtggatggcctccctggtcgtatcacatggacggcgaggctgtgtggacccgaatgcaaggaatgccggacccgctccatatcagattccccgacatgccatgtcgtgcgtgctgtcccgctggctggccatttcgaaactgcaaactgaaggatgccgacgacctcgccaatcaacggggccggaatccgaggggaacgcgtgatagagcagctctgcagagtatcgcccgtgaagatggcaggcagtggagctcctcgtgtcctcatcagccccactggaagccgcatgcggtcatggcgacggagctccctgtttcttcacaatgtcgcatccggcaacaggtgtgtgtcgttgccaaccataatgcatggctcaggcatcccgctgcaaagatggaaactgcaggctgcaatccatcattactgctcctgcaggtgatgatgtcacgtacctggccactgccagcaccatctgtgaggtcaatgtgcacaagccaagctacacatcatggtttgtgggcgacagcgtggtggaaggtacgccctgacagcaatgattgcagcgttggcgagctaagggcatatgggtttcaacatgaccttgaatacagcagggttctcatcaaatattcagtccctgacttaatgcccacccacagatgggtcaacctaccttgcaacgcccatggacccgctgtttctcattctgcccgccttggagcgagcctgcacccgagctccaaggccgtcatggaccagaagtactatcagcttgacgagacaaagaccctcaactggctgaagaccaaggtcgaaaacaccaagaatggactgcgatccctcaggtatgggggccaaactcctgcatgccgtcgacgcgagtgtgaagggccgacgagcgcaggttccattgtttgccataggcctccgatgctgcagcctgtgctcacgtcaactgatcgaattgagagttacacgctgcaggaatccagaagctcacatccgaaacccctgcatagcacccacagatcccttggctgggctgatgcggaggagggggtgctcctgccgtatgctgtgggcctagtgtgtgagtatcttcctccccaccgtgtggagagtctacgaacttatttgaatgttgggatggagccagccagccctgctgtggcaggcatgccctatccagtatctgaggtcgacacccagccaaaaaggaaaaaggtgagctgcttggggcggtatcctgttggatgcattcagatggggacagtgcctgcacgattgaccccggcggaggcagctaagctgaaggcagctgagtcacgacagctgaacaaggcagcaaaagcagcaaaggaggcagcaggcacgagaaaactgtctggtttcttcaagcccagggcaggcaccaaccagagtgcatga

SEQ ID NO: 1819 - DNA, 1014 bp, Chlorella protothecoides
atgcttgctttggacctgcagcaagcatggcgcacccaaaaaaccactccgtcgtctggcgcgcgatttgacttttcggacccgcgaggctctgcacgagcaagcgcggctgcaagtacgctgaccgatccaacacctcagcgagcatgggaagtctcctgctccaaggttgggccatgctggccgacggctgcgagcactgcggggtgggtagccatcagaggagaggcttggttgctacacagggtcaagagttccaggacggcacccctggctaccagagctcatcttcatgacatctgcacaactcccgcgcagacccctctgatgaggaagccaaactctgaggacaccgtgtgcgtcacctgtgaggccaggccggcgcaggccgcacctgcaccaggaccgggcttgcaggctgagatctccgaagacctgagcagcccggggtcggtgctccagggccccaccctggcccagcgcattcagcgtgccgccgaggacgagcgggagcaggagatctcacagagcctggcggaccgcatgctccatggctggacgctgctgggccagtcgtgtccgatctgctcgacggtgctggtcaggagccgggagcgccaggtgttctgcgtctcctgcaagatgccggtccgcctggaaagcgaggcgcagccaacgcagtctggcccggctgctcgtccgcctgccgccgccgagcagattggcgaggcgagtaccacgtccgaccagtctgggagcggcgccctcccaccccttggctcccctgaagcagcagcggcggcgcgggacgaccaagcggcccctgctcatgcctcgctaccggacaccggcagccagcttgaagctggcgtcatcatagcagacgccaaggcggcggtgctccggcaaatggcgcgggcgacgcacctgctgagcggggaggaccgggtggaggcgcagctgcacatcatccaggctgctgcgcaagccctgacggccctgagagggtgctag

SEQ ID NO: 1820 - DNA, 1860 bp, Chlorella protothecoides
atggggtggcggaccctgggtggtcaactcatgtggcaaggagagtggactctgtgcatcacctcagggtgcatggccaagcgcgaccgaatgtgtccctgggaatccagccgcccctcacccatcagaccccacgacccgccagcccctctaggggacgaccccctggacctgcccagccttggccgatctgaccctgatcccaacccaccgcctccccgctcacgtgcaacagatcctgccctcccaccgaggcctggccatccactggtgggggggcggggaggcgctgcacgtcaccgccgtccctcgcgtggcagggggccccttgggcagggtgaggggcgtgagcgtggagcgcgtgcaggcgcggtccgagacgggggtgtttgtggcggggcgtgtcagcgacctgcgcatcagccaagcgcacctgaccatggcctggcgctccgactggccgtacgcggggctggacttccggcccagcgaccgcggcgtggtgccagggaccacctcacatgccctgttcgtgaccgagggggcggcggtggccgtgcgggattctgcggtcgagtacctgcggcccctgcgccccgactgggggagcccgctcctgcagtctcaggggggaagagccgagctgcaggatgtgcacgccaggagaagccagcgggcgagcgcgcgcgccctgacaatgtgtcggcacgacattcatgcaaggtgataaacggtgcgcttgctcctcgggtcgactgcatacatacgtcaatttatgccctcgaccttatcaatatacgcagtcgtcctgcggtgagtccgctttttgcacctttcaggtcgttgacactcggcgacgggcagtgctgccggaggaagagggcggcagagcatgggcgagaaggagacggacggtctgctcgttccccgaggaccgaccaaggcgcccgtgcatgtagccaaacgcgcgcagcggaacaaggccctgtccgtcgtgttcgacccccaggaccacaagtgtgtcgcccagcggatgctgtcagcttgcagggcctgtccttgtgtggtcaggctccgccaagtgggttttggtgtccacaggagtacttgaacgggttccacaagcggaagcagcagcggcgcaaggatgccgttgccagggtcgagaaggaactgaaacagcagcgcctggaggagcgcgctgatgtgagggatgggatcaccgggtctatgccgcaagcctggggaagctggctgagcagaaaataccccgccccagttggaggacggctgcgacgcatgcgaccatcccctatactccactggcggggcgtctgcggcttccagcgtcgcgaggcgctgaaggagcggtactccaccctgggccccgacctggatccggcggcgccttccctggcggaggacgtggagcgcagggtgcatgtcttcagccacggggcggtggagagccgggtgacggtgtctgccatcgacctgaacagcagcgacgaggaggaggcggggccggggcccaatgacgacgatgacgaccgcgacctgggcgagtggccagggcctggagtcgccagggctaaaaagtccgcagtgcagagtggcggcggcaacggcgggggaggggagccggcgcgcgttcggacgcacgtgtccaaggccaccctgcgtgcgatagcgcggaccaagctaaagctggagggcaagcggagtgccgggggcttcaagcagccgggccccaagacaggcggcaagggcgggcgcaaggcggaggccaaggaggcgggcgggaagaaggggggaaagggagggaaacctgcgccccttaagagcaggggcaagcgatga

SEQ ID NO: 1821 - DNA, 1548 bp, Chlorella protothecoides
atgaagatgccacctcgtccaaccacaatcaatcctgatgaacctacatgttgggtctcggcgaaaaaattgggctttgctccggcatcgaaggcggcctggatgctcttgcggcgagccagcagctctgtgaccctgcggtgtgcgtcagctgatgttggtgtctgtccaagcgactggcagggttttccgacaatcaaagacagggtaaccagatcgaagatccgccaggaaaccattctacatacctggaggagtatttgcgggccagggacgccacgaaggacagtgcatcctcggtcaggatggactcgaactccggcttgtatgctcccaacaccgtcacgccctcgggggtggtgtaggagccctcgctcgatgccttctgggcatacatctttccgttggcctgaaaaaggtcgaaggccaggcttaagcggatgcatggctcgcgatcttggttccgatgccgcgccccgcgaggtatcgagccgtaattctgaggtctcactgaccttgcgctcgctctcagctgggaagtgtgtagcctgctgtggggagtatccccgcgacgataccgctgtagatggagctgggaaacacgtccgcaaggtttacgaaagtccgccgcgcccgcgcccacggcctcagtgtcagcatgggtcctcggatcctgactctctacctcgtcgtcctgtacacgtccacgcgctcgcaagcaggccggatctgcctggcatctggctaccctggcctggaccccactggcaggtcatccagcgccccagccctccaggcggggctggacgactgtgcccaaggggggcagctggtcttggaccggcccggcaccttcctggcaggggggctggtcgctcatggatcgatcgacatcgtcatcccgcggggcgtgcgattgctggccagccacaaggtgggcggagctcaggcaccccccccccctttcccttcgagcagcgctcggactacggccccacccagccagactggtacctgattgccctgcgcaactgcaccggatgcagcctgcgcggcggcggcaccctggacggggacgcccgcgcctgggacaaggttcgcgcgcccgggcgccgagcgctggtggactgggctgacccctcctgccccgtgcccagcgagtgccgcccccggctgctgggggtgctggactcccgccaggtcagcgtgcggggcctggccctgcgcgaccccgtgtactgggccctgcatgtcaggcacagcgtgcacgtcgcgctggacggcctggacatccgcagcgagtggggcgtggccaacgccgacggcgtggatgtggacggctcctgggacgtggacgtgcggggctgcaccgtgctcaccgccgacgacgcagtgtgcctcaaggcgtgtacgccggggcgtcccacgcgccgcgtcagcgtcacaaactgcacgctgcgctcccgctccgccgccgtcaaggttgggagcgagacccgggccgacatcagcgacgtgaccttcggtgacctcacggtgtgggcgtga

SEQ ID NO: 1822 - DNA, 651 bp, Chlorella protothecoides
atgaaaatctacaccaagaccggagacaagggcacgtcatcgctgtacaccggcgagcgtcgtgccaaggatgatgccacctttgcggccctgggcgacgtcgacgagctgaactccgccatcggcgtggcaggggagcatgtcaggggcctcgaccccagcatggccctccaggtgcgctacggtgtgttcttcccggtcgcgtgcgacacgcaacaaaggcagcatcccaagcctttccagcatgttgagggtctggaggggccgctgccacatagccggctgctggacgtcgggtcggcggtggcgacgccactggccagcgccagcgaggccaagctgcgccgggcggccttcgatcccgcccacacacccctgctggaggcctggatcgacgaggccagcgccgagctgccgccgctgaccaacttcatcctgccctcgggcgggcacgccgccgccgctctgcacctcgcgcgcagcgtgtgccgccgcgccgagcgcgccgtggtcccactggtgggggctggggccacggatgaggcggtgggggtgtacctcaaccgcctcagcgactacctgttcaccgccgcgcggctggccgcgaagcgggcgggggcggaggagacggtgtacaagaagggcgcgtga

SEQ ID NO: 1823 - DNA, 432 bp, Chlorella protothecoides
atgcaccacgactgcgcagacgaggcggccataagaaggcacgccagcgcgatgggcgcgggcgccagtgtgccgctgttcgcaggcatgctgactcagcgcccctgggaccaggtgcgccgcgctcacggcgccccggagcggctgcgggtggagggcagcgaggcggagcgggagctcatccggggctttgcggtgcagtacgcgtcggagatcgcgcacctgctgcgttgcatgccgcggcccctgctcctcctgttgaagaccaacgactgcctgaggtgcgtgcagagggttggatggtgttcctggaagggagtgagggtcaggggcccatctgatggctgcctgggtggacgatgcgactgggaaaccttgtgcggatcgaatcctttgcccaagccgtgcctaagtcagggcagctccccgtaa

SEQ ID NO: 1824 - DNA, 279 bp, Chlorella protothecoides
atggtgaccgacctggagggcctggcccggctccgggtgcccccggccgccgtggcggagcgggtgtctcgcaccttcaacgagatgatcttccgacacggcgatgtgcactgcgacccccacgccgccaacatgctagtccgcgccgcccctggggcgcctggtggctggcagctcgtgctgctggaccacggcctgtaccgccagctggacgacgcactgcgcctggagtacgcgggcctctggcaggccctcatctttgccggtggggagtcttga

SEQ ID NO: 1825 - DNA, 984 bp, Chlorella protothecoides
  modified_base (512)..(521): a, c, t, g, unknown or other
atgcaagccctgcgctggactgacggcccagctgattgcctgccggcgccggcggcgcggtgtccgccacggctgccgcctgtctcccgaggcccaccgaccaacagacccctcgatttccctcatgtgttcacatctcgcagccggggggaggaggggctgtacgactacatcctggtgaacgatgacctggagcgggcctacgccagcctggcggcggtgggcgagcgggccctcgcgggcgcggcgccggcgaccccgggggaggccagcgccgccttccgcacggcgcaggggtcggacgtgcaggaggggcctggccggcagccgcacgagtcgacgtcgggactccgtggtgtggaactggcgacgatagaggggcccggcgctgcgggggacgcggcgataccgatgcctgccggtgctgaggatgtggcgaccgcgacgccgcccgcagcaagccctgcctcccttttggtgtcctccgctcccgggagcattctcatggtccnnnnnnnnnnaaccgcgacgccgcccgcagcaagccccgcctcccttgcggtgccctccgctcccgggagcattctcatggtcctgcacgccggagccccgctgggcgccgagctgtgctgtcagttggcggccgcgggcgcgcgcgttgtcgccgtggcgggcgacgccccgcccctgctggccctgcaggagcgggtgcagggcctgggcgccgccgccgagcacgcgttcctccccgtcgtagcggacctggagcgcgaaggcgaggtgctggcgctgccccgcatcgtggcggagcgctggggcggggacgctgcggtgagcgcgctggtggtgtgcccgccggatgaaccgccgacggaagagaccaggctcctcgtggaggcgccggcccaggccgcggccgcggcgctggcgatggggctggcggggccggcggccgtggtccgcagcctcgcggcggcgggcggc

SEQ ID NO: 1826 - DNA, 2415 bp, Chlorella protothecoides
atgcttcaattgttgtttaagaagtcctacaaaagcacttgtgtcgcgcgcattcttttgcagggcatcgcagaggggcatcgcagagggtatgacgcaaagacggactggacggtgaccagcgccgttcagctcggtcttgcgatgagagcagcgcgctctgggggcgcgcgcgagcttgagaggaatccgggggccacctcagctccacccttacacaatatatacggaatcccggccatgccgacgatgagaccgggaggcggtgatcgatccgcacctcgttcccctgatgttgttggacaccgatcccgaaaccatccagtagtgcaggatgtcgagcacggaggtcgtggtggccccatcctccaagtcagccgtggtggctcagctggcgctactgctgggtggcagggggccatgggaacaggggggcacccagtccctggggtttgggctgctgccctcggccatgccatgccttttgtacccctaccattccgcaaacccccacctcaacctctcaacccctcctcccacatctccgcctgccatgcactgcaggccagagattccccgccccaagaaatccctggccaccggctccgcccggaagccccgccccgcctcgcagcgccgcgccctgcagcgcctgctgcccctgctcctccgcgtggctgggcccaaagtggtggtgctgctgggggtggtgctggcgcgcaccgcgctgtccaaccgcctggcacgcctgcagggctacctcttccgcgcagccttcctcaagcgcgtgccgctgttcatgcgcaacctggcggagaatgtggccctctgcgcgctggcagcggggctggagtcgacatcgcggagctgggtgtcgcggctggagctgcagtggcgccgcctgctgacgcagcgcagcagcgcatctgcgaggacatccccgccctcaccgagggcctggcctccctgctgggcgagctgctgtcggcgggcgtggacgccgccttctactcctgggccctgcacagctacacaggcacgcaccgctacaccgcgctgctcctggcctatgtgctcggcgtgggcggcgccatggcctttgccgcgcccaacttcggcgggctgttcaagcgccaggcggcgctggagggcgcgtatcgcgcggtgcacacgcgcctgcgcgccaacatcgagagcgtagccttctacgccggcatgcataaggagggcgaggtggtgcgtggtgcattccgcgacgcgctgcgcgcgcagcgccgcctgctgggccggcagtggcagtttggcatggtgcaggacctgctgctcaagtactttggcgccacggtggccctggccctcatcctgggccccttcttcggcggccacctccgccccgaggccacggtcagggggcgggcgggcatgctgtcggccatgcgctaccacacctcggtcaccatctccctatttggcgcgctgggcacgctgggcggcgcctcgcgcaagctcatgcgcctgcaggcctacgcggagcgcctggcggagctggaggcagtgatggcggagatcgcgggcggcgcgggcacggggccggagggcctgccccccgcccgcggccagctgctggcctgcgaggacgccatcgccttcgagtcggtggtggtggtcacccccgccaacgccacgctggtgcgcgacctcaccctgcgcgtccctgccggcaccaacctgctggtcaccggtcccaatggcgcggggaagagcagcctattccgcgtgctgggcggcctctggccgctcactgcgggggccatccgcaagcccggcggcggcgcaggcgacgcggcgggcgggctgtcgcacgagatcttctacgtcccgcagcgcccctacgtcaccgtgggcacgctgcaggagcagctgctatacccactgacccccggcgccggcggcgcggcgccggtcatcccggacgacgagctggccgacctgctggccagcgtcgacctggggcacctgctggcgcgcggcggggagtccctggactggggcgaggagctgtcactgggcgagcagcagcgcttgggcatggcgcgcctgttctaccaccgaccgcgcttcgccatcctggacgagtgcaccagcggcgtgagcgtggacatggagcgccgcttctgcagcatggtgcgcgatgcggggtgcacctgcatcaccatcagccaccggcccgcgctcatggccttccacgacctcgtcctggcgctggacggtgagggcgggtggagcgtgcacgccgggcaccgcgcgctgggggcgtcgggcgccgggcgaggcggtgctggtcccgctggcggtggtggcagcggcgccagcggcgcgccggcccccaccccaatgctctctggcagcgtggac

SEQ ID NO: 1827 - DNA, 1020 bp, Chlorella protothecoides
atgggccggcccaggaagcccggggcggggcgaatcgccaggtacttcgtctcagcggtcgcctgcactcttatccttaccagggagaacaagaggaagactcccaacacacacgccatgatggtgaagctgggccgggccgcaaagaaggccaagcagttcgaggtgcgcaagatcgttcggcgtctgaagctggcagaggccaacaagaagccggcgctggaggcgcagctcgaggcagcgaaagcagcaaacgtgcaggagctcgcctcggtcgcggggtcgcagctgggcctggtgaggggtccggctgggtcgctccccgacagcccagagtcatgctgggcggatggcccagagcgagcggtgtgcaccaggatgctctctgcgccctgcctgaaagccgtcattgtctccctcctggagggcgacgccgaggaggcaagagagggcaagccggccccgctggactctccgcctgccagcccgtcctcctcggacggcgaagaggccgctgacgaagtggacgaggaagcaggcgccgcgctcgcaaagctcctgcagcgcagcagggaggcggcagctccatcagactctgaggacgaggccatatccctggcaagcgacgtgagcgacctagagagcctgctgagctctagcggcgacgaggccgggccaagcgctgagtcgtcaaaggcagaagctgctgcgctgcccgtccaatcacagaaacgtgccaagggcgccagggtggggccgggcaagaagtctgccccggccaagcccaagaataggatggggcagagggaacgacggcggctggctacgatgcagtatggccgaccggcaccccctaccatagcaaaagaggcccagggcaagcctgacagagtcaagaaggctcctgcgcctgccttggatgccacagacctgcatccctcttggagggcaaagcggagccaggctgccgccatccctgcaaggcctgtgcctgccaccaagattgtgtttgatgactga

SEQ ID NO: 1828 - DNA, 2184 bp, Chlorella protothecoides
  modified_base (1201)..(1210): a, c, t, g, unknown or other
  modified_base (2117)..(2126): a, c, t, g, unknown or other
atggtgcaccgcacctacatgttctgcgattacccatgcatacattgtcatagatgggattctgggatgcaaaggatggcttcctcggagcttcaagcagggcctgctgggcttgatcccacattcccggatccgattgcagtcgcgcatggcagtggaaaagctgcattgatacttgggcatccctggaagggaaccgtgcggcgtggtgagagctgggccagtcactaccaatctaccggatcaacaccattgccctccccatcagatccagcatgctggcgaagtcttgccgctccctgtcgaggttttgggaatgctcacagaatgagtcttggcatctggaaactctatgtcagagtgcttggctccaccttggagcctccctttcggtatagcgggacgcatgcctgtggcaagcctcgattcctgacccctgcttcctacttcaaattcagccatctgacgtcttgcatcacattctgtccaacgagcgttgctgtggaggggagaacctggagcagacgctcccgtgcctcacccagggagatccctttcgtctccaggatggtaggtgtaatcctgcagggtcgtatgggagggggacctggtgaacttcgtcgagcaacgctgcggctcgcacgcccctccgagacgcaccctgtaatcgccgttagacacgaaaccacaggttcattgggtttcacgaagatgttgagcaactcgcggccatgggcatcctgcatggaggaagtggaagggggtcgacaagccgcgagctggtatttagagtgcctcagatgccccatgaccaccaccgccctctcaaaaccattatatcatatatattgccacccaccacaagtcctatttgggcaacggcgcgtgcattatggtccaagcccgtggcgacacactcgacatccagagcatatttcaaaatatgcacagatcccgcacccatcttggcatgaggagaggacacacgagggattttaccaaggtaccatccggacgggtcctgggacggtgttgcaaagcagggggcaagtagggtgccaggagcaagctcagttttgttcatgcaatcatgcgtttgacgcacacatactcaataacggcacacatactcactgtagaatatcagcacacagcaagatggggggaagcagggcctacccagcagctcagaacttggctnnnnnnnnnnctacagtagaatatcagcacacacagcaagatggggggaagcaagggcctacccagcagctcagaacttggctgcagcaaccttctcgtccacctcagcgcgaagcgggcgcgacattgtggtggcaacaacttctacggggtcagcgccctcgttcaccacctgagaatgtaggattgtatggagcgtgctttgacaagaacttggatgccctcaatgacagcacaatcgatgcccatcttcttggcaaagtgataggccgagcgggaggtcagcacaccctcagcagtggcccccagactggacacgatatcctccaacttctcgcccttgcccagacgcagacctgcagtgtggacggtgcgtgcggcagtcagcgagtagttcctcgcgagagcatgggctccaagaggcctcctttccccattgatcctcctcgcaaatcctccttgcacccactcaccaacagtgcggttgcggctcaggtccccacagcaggtgagcacgatgtcacccaccccggcgaggccggcgagggtcagggggttggcccccgaagccaccgccaggcgggtgatctcgtccagtccgcgggtgatcagcgcggcacggccattgttgccaaagccgacgccgtcggagatgccgcaggcgatcgccagcacgttcttcagtgccccggccagctccacgcccacgacatcgtcggtgcggtagcagcggaagcgattggtggacagcagctcctgcacatgctgagccagctggatgttcttggaggcgatggtgacggcggtggggatacccttggtcacctccgcggcaaaggagggcccgctcaggaacgccagcctgaggaggagaaatcgggggtgagaggggggatgaagaagccacttgcacgggnnnnnnnnnncggcccgctcaggaacgcaagcctgaagaggagaaaacgggggtgggaggggggatga

SEQ ID NO: 1829 - DNA, 2766 bp, Chlorella protothecoides
  modified_base (28)..(37): a, c, t, g, unknown or other
atggctacatgcaggaggctgcttccgnnnnnnnnnnctgcttacataaggacgcctagtactgcccttgttaccctcttcggcacccccaaacatggctacatgcaggaggctgcttccggctgtttcggtgtccttgacctaaaacaagtctgccggacgatggacatcggggaggatgctgtagaatccgttctcagccacctcgagtcatccctgggctcattacatgctggacggcatgacattgcctaccttccacagatatccctgcccgaaatatttcgcctcctccccaagacgggcatcaaagtcaaggtctcctttttcgctgacagcgccaaaagccttgccccacagcacccgagtattcaggtgcagccacggttggcaaaggggcgtgaaattgagggttgcaacgcgcttgtgacactctgcaagaatccccgcaacggcatatactctgtgtctgtcggcaaattggcgtcgttccttgcctgcacccccagcaaggctcttgtcagtttgcgagaattagctgcacgcaacctcgtcagcctggagatgtccaagcaggagggcccagcctttgagatcctacgaacgcccccggccccagcctctctcacaccagcgttggcagactggctggagcggggggtgaggaaccaagcttcacagctcgacatcgtgtacagaaccttcagccaggccgctaatcacaggctggccgaggcccaggaagtgagcctcaggcgagacgtggaggcttactttgagaatgccagcgtggaagctgccggctgcctgcaaccccacgagggagtcccgcttcccctgaggcccatcaccaaggacgtcgagacctccataaggctagtgctcaggacgctagctggccaagaagctaccaagcttcaaggcctgacggtggcccgcatgctgcttgggatatccagtcctgccttcccggcagacgtgtatcggcggaagctgcagggcttgtggggctcctgtacgaacgtctgcgcttgggaactggagtgcatggcaaccagaatctgcacttcacagacattcgacaacctcgccatgcacgccggtcacccccactacgacgagccgctcagcatgggacccgacgccgtagaccaggagacattgtgcaagggatctttcacttgggccgctgctctgactgccgattacgatcgccccggtgatgaacggcaaatccatcggagatggacgatggaggagcaggtgacgtttttcagggtgctccgcgagtccataggacagaagccggagaccttgtgcatcaagttggcacgccagatagagcacaagcagtacaaccaggtccgggactactattatcgcttgacgagacgtctgcgagcggtgttggaccctagcctagacctgaactcggccactcaagtgcagctccactgggcgatgctgcgactttgggatacggcgcaagactttgacattcgggacatgaacatgaccaaactgtgcaagacacctaaaaagatgagggagttctccaagatcgtctctcagaaagtcgcaagcattcttaagagcagacaagtgaggtacagtccgcacgagggccatctgcaagagcaaacgatcgatacaccggtcaccgaaagagcagcggatcaggtggcacgagatcctctgcgtggcgccgcagcaaatttcccaagtgttcaaaggagttcagcaccaacgggatcagtgctgggcccaagtgaccgggtcaatcagcttcccctaccacgagctaggaaggtcgatgcaattcacacacagcgccctcaacagggattcagacagcctgtcgaccgaaaggctgtccgtactagatttcgagtgcaattccatccaatgtaccaatctacactgatgcaaatggaagctttaggaaccaatccctatctggaaatatgctgcgggcccaagaagacgatatattccatcttgctacatttaagtagcaagtggaacgaagttcggacgtccgagaatgcagatatatacatctcagccgcgagaaacgataatggagccggtgctgaggaatggtccctgtacaacgtctcaagagaggccaagatgtgtgacattacacacgaatgtggagaagcacacatcgtccagtttctctacagatggggctctaagaccgcaggtcaaggcgggtctgtggatcagcgcattactgacagctacgactctgaggccgtcgatgaggtgcgatattacaactgtgattgcttctatactgtgcgcatcgctgcggacttgccggatcaccaacatctcgggcagaatattacaatagcagtagaagcagcaacaacaccaagagagacggaggaaagcatcgaaggtgtagaagctggcagctcatctcctcccacaacaagtttacataagaacggtgaagacaatggtggaaaccgtctgatgcaagaggacattctccatgcgggcaaccatttgagcgcagaacagccgttgggaccgtttcccttgtctggaccttctcagtatgcgcacggggtcactccaaggccgctatcttcatcagcggtccctccgctcaccatagatgggcttaccctgggattcgagagtctgctgggaccaataaatccttcatggcttgaaaatctccactccaaccagcctttgctgccactaggtgacagaccctttgctgatctattcaagggcacttcctga

SEQ ID NO: 1830 - DNA, 543 bp, Chlorella protothecoides
atggcagagaccagaacgtcgtacatcctttccctggtaacccctgggtcagccctggccgacacttcctcgatcctcatctactgtgcctttcgacacgatgccgacgttcttgcagcaaaacttcaggctatcggccatcgtgccaagtcttaccacgcaggaaaacactacaaggaaagggctgaaatcgaggcagacttcagggatcgcaagctgaagattgttgtggccaccattgcatttggaatgggcatcaacctgtctgacgttggcgctgtcatccatgccaccatgcctcggtccctggaggagtacgtccaacagatcggcagagcggggcgcaatgggagtcccgcctcctgttacactgtagtcgacgatggtgagtactgcacgctcaggtcactcaccagctctggccgcactacatcgtccgcggttgaggccttgctagaacatgtcttcaaacgatgggcagaggtccatgagaaggtgactaggctggcaggggctgggcgtgcttacataaggacgtcgtag

SEQ ID NO: 1831 - DNA, 1056 bp, Chlorella protothecoides
atgctgctgcaggcccttccgtctgcagtcatggcttccgccctgagcgacacgcgcaccaccgtcaccgtcgtgggcggcggggcatggggcactgccctggccgcccactgcgctggcatgggccacgatacttacctctgggccatggagaaggaggtcgtggatgctgtcaacaagcagcatgagaacaccgtgttcctcaaggcactgtgtattacctcggccatgtccatgcagcccaccgactgcgtacccaccacaccaccacacaccaccaccgggacacagggcctccctctcccagagagcctgaaggcgaccaacgacattgagtttgcgatcaagcacgccgagctggtgctgaccgtggtgcccacccccttcctcttcaagtctctgtccaacatcaaggacctgctgaccgaggagcacatcatcatttcctgcaccaagggcatcctcaacgacaccctggagacgcccgatgacatcatcaagcgcgccctgcccgagaagctgcactccaggctggcgttcctgagcgggccctcctttgccgcggaggtgaccaagggtatccccaccgccgtcaccatcgcctccaagaacatccagctggctcagcatgtgcaggagctgctgtccaccaatcgcttccgctgctaccgcaccgacgatgtcgtgggcgtggagctggccggggcactgaagaacgtgctggcgatcgcctgcggcatctccgacggcgtcggctttggcaacaatggccgtgccgcgctgatcacccgcggactggacgagatcacccgcctggcggtggcttcgggggccaaccccctgaccctcgccggcctcgccggggtgggtgacatcgtgctcacctgctgtggggacctgagccgcaaccgcactgttggtgagtgggtgcaaggaggatttgcgaggaggatcaatggggaaaggaggcctggacgaaatcttgaacaaggtcgagggtaccttgcaaggaggatggttctggaaaaaccttgcttggctgctgacgataaatga

SEQ ID NO: 1832 - DNA, 351 bp, Chlorella protothecoides
atgtgctcttgcgcggcgggcaggcggctacctcatgcgtccaccactctcctctgcatctcacctgctcctcaggttgtggtggacgaatgtcactgcgtcaccgagtggggccattccttccggcctgcatattaccggcttggtgcggcgctgaagcggatgctacctgcaaagtcactcctggctttgaccgccaccgccaccaagctgacggaggctgccatctgccagagcctcgggattcagaccaccctgcgagagacttgcttgcgtgagaacttgcgtctgcacgtcaaggtcaacacctcaggtgggagggccggcctgggctccctggtgactggataa

SEQ ID NO: 1833 - DNA, 1302 bp, Chlorella protothecoides
  modified_base (329)..(338): a, c, t, g, unknown or other
  modified_base (1076)..(1085): a, c, t, g, unknown or other
atgaagtttcagcaactgctgctcgtggcagcactgttggtcgctttaggacccgtgtctgcctactacctgccggggacgtatcctcaggagtttgcgaaagggagcaagatcgaaggtgtgatggtgcggcgccatgttcgtggccgagactcccacttccttgtcctgcgatcccgagcccgggcatcaacgtgggacatcgctcccttcacctgcagtggaggcgaactctctggtgtcatcggaaacggagattccgtaccgatactaccggatgccgttctgcaagcccgtcggtggcgtcaaaaaggcctccagcactgtgnnnnnnnnnnccgatactaccggatgccgttctgcaagcctgtcggtggcgtcaagaaggcctccagcactgtaaatccgggcaccatacttctgggcatacgcatcaacaactcgccctacagcttctccgtcatggtgggtggaggatgtttaagccagtggggtgtatcgatcacgggagctcctcatcttgggaatttccctgctctgtccctcctcatccctcccaccgctgtcacacctgacatcccctctctcctgatgttgctgacctgcaggaagagaccaagaccaaggtggtctgccagggcgaggactaccccggcggggcttacaccgcgctcacctccaaggaggtcaaggtgggcgttgcatgtggatgcgtctggcctcaggtcgcagggtcctgtatggccagggcatgcatgccgcacccagaccaagtccctccttccagggggactgtaccaggctctccctctgggcagttgcacccgtcctcaccggctcaacagcaagtgccctgggaatccactgcagaccctcaaggagaagatccgggatcagtaccgggtgcgcctcatcctggacaacctgcccatcaccacctacgacctggagctggaccccgagtccggtgggcatgggagggtcggggatgcctgggcccgcgccgcctgtggtgatgtggggcagggcagcttggggtcacgagtggagtgtgcgctgcgaggcagactggctcnnnnnnnnnncgccgcctgtggtgatgtggggcagggcagtttggggtcacgagtggagtgtgagctgcgagtccgccccggctacgaggttggctacaagctgaaggacaagtactacgtgaacaaccacctcatgttcaaggtgctggtacatgagtccgacgggcgctactcccgcgtggccggcgacgccagcctggaggctgccgctgcctcagatgtgcgc

SEQ ID NO: 1834 - DNA, 1056 bp, Chlorella protothecoides
  modified_base (557)..(566): a, c, t, g, unknown or other
atggcagacctgacgccccggccggaaggggtgcaggctgggatccaacggcctcccacacacgtcctcagggcacgactagcatatatagatgttgaaattttgcaccaccttgtgaccgtcgatggcagtggtgtggctctgctcccggattctcagagagcagggttctgcccgggactcggagctggagccttgtgcaggattgtcgtgatccttcgatccaacatgcaggaggtgctcgagggctcgctcatcaaggtgagacgtgcttggctatgccatgttggtcactggatgtgtcgacatctcttgcacggccacaacatgcgattatgcccgtctacttggaatcaggtgccatacgagaccctcaagcggacgacaagggagcgcaagtatgtcttggatgacatctacaagatcctggcagccctccccaccctcgcggagggcactgacggggcccagaagctccaggatatggcatccgccctacagcacctcaaaaccaaggctcctatttcctctccagtcctggctgcattctgtagacnnnnnnnnnnttctggtgtaacgagagatccttgtaggggccccaatatcggtatgcatggcaggctccttttccctctccagtcctggctgcattctgtagacacacccactgatgccactgcccccgtggcgcagctggagggcatagccgaggccgagaggggggacctgtcccgcctgctcgcccgcgtcaggtacctgaggcgcgtgggccagccggaggcaggccgcctcatcgactggaaccggccgcgaatcaaccggctggtcatcgactacctcctgcgccgcgggtaccgccagtccgccctgcacctcatccagacatcggggccgggggtgagcaggccatgcggcaaaggggattgggagagggcccaactcggtagccaagcctccctgaggatgccccggacgggggctcacgtggaggaccgcgtccagagcgggatgcgccggccgcacgcgcacactggtgtggccggcgtgcccgcctga

SEQ ID NO: 1835 - DNA, 300 bp, Chlorella protothecoides
atgcatcacctcattttgcccaccccctcatccgatctctttccgcaggcctactaccggcgaggggatgcagcgtttgccctggctcacttcaaggatgctgtgcgtgatttcaaagcagctgccagattggcaccccgtgatccagacctccgtaggaaggtacattgggctgggagctttgtgtgtggcagacaacagtgttggtgcgagtctgcagcccctccgcagtgcagctggtggtcccggctcactgcctccctccctcgttcccatgtgtgcacagctcgcagaggctga

SEQ ID NO: 1836 - DNA, 1575 bp, Chlorella protothecoides
  modified_base (1061)..(1093): a, c, t, g, unknown or other
  modified_base (1269)..(1278): a, c, t, g, unknown or other
atggcggatcagaagtcggacgccgaccagcaggtcgagatttggaaagtcaagcgggtgagtggggatgataatttgcatcggagggtatcagggaggcgccttgctctctggcgagctcccgcggtgagcaccccccccacaccgccgtcccctgctcccctcccaccccagctcatcaaggcgctagacaatgccaagggcaacggcacttcaatgatcagcctcatcctgccaccaaagtcccagggtttggaggggcctgcctatcaccacagccccacccccctcccaccctcctgccacttccccacatttccccgtttccaggtagcccaatctcaggccatgctggccaacgagtacggcaccgcctccaacatcaagtcccgcgtcaaccgtcagtcggtgcttgctgccatcacgtctgcccagcagcggctcaagctgtacaaccgcgtcccgcccaacgggctcatcgtgtacacgggcactgtgctgacggaggacggcaaggagaagaagctgaacgtcgacttcgagcccttcaagcccatcaacacctccctgtacctgtgcgacaacaagtttcacaccgaggctctgaacgagctgatggaggctgactccaagtacggcttcatcgttatggacgggaacggcacgctgttcggcaccctgtccgggaatagccgcgaggtgctgcacaagatcacggtggacctgcccaagaagcacgggcgcggcgggcagtccgcgctgcgtttcggccgcctgcgcatggagaagcggcacaattacgtgcgcaaggtggccgagctggccgtccagttcttcatctccgcggaccaccccaacgtggcgggcctggtgctggcaggcagcgccgatttcaagaccgagctgtcgcagtccgacatgtttgacgcccgtctacaggctgtgattctcgcagtggtggacgtgtcctacggtgagcctggacgagcgcagggggaggatttccgtgcggagggtggtgatgaggggtggggagtgaccggcagcttaccctgctcagnnnnnnnnnnnnnnnnnnnnnnnnnnnnnnnnntgtgccaaatggactggctagttgaacagcaacccacaacccacgctgcttctatagagtgcttgcttggcaaaagttgcatacgtttgtgccctccctattcgccctactgcactatatgctgcttcatcttgaccgtcctcacaatgagcccagtgcacgagcaaaacctccannnnnnnnnnggttgcatacgtttgtgccctccctatctgcctgactgcaccacatgctgcttcatcttgaccggcctcataatgagcccagtgcacgagcaaaacctccacattttccgtgggtgcctttaccagtttcctgcctatacaccgtggcagcagattaaatggcggccaccccacaccatgcatgcggcaccctcgcacgatggcagcccccccacagggctgccaccagttttaagggtgttgtacatcccttctccaatcacatatcctcccgtttcttttatccttgatgtctag

SEQ ID NO: 1837 - DNA, 786 bp, Chlorella protothecoides
atggcctttgtacagtcccttaagtcccacacacctttcttcaaacctccaggtggagagaacggattcagtcaagcgattgagctgtcggccgacaccctgtccaacgtgaaatttgtgcaagaaaagcggctgatcagcagtttcttcgaccagatcagtcaagatacgggaaaatatgtgtttggagtgaaggacacgctggcgtgcctggagatgggagcggtagaaaccctcatcatctgggagaacctggaggtctcccgctatgtattcaacacctcatcaggagagcaagaagtaaagatcctgaccaaagaacaggagacagatagcaagctattcaaggacaaggtcactggacttgacctggatgtggtagagaaggtgggcggactgggcgacagggtgctgcgagcgctctggggtcggggataccatgcagcccatgcaggggggagccgtggaacactcgccaggcgtgagcccatgcagaggggagccgtggaacactcgccgggcgtgaggtctccaatgacgtccccttccttcccccaccccctgcagcaacccctgctggagtggcttgccaacggctacaagaaattcggatgccagctggagtttgtgacgaatcggtcgcaggaggggtctcagttctgccgagggtttggcggcatcggcgggctgctcaggtatgcggtgaacaccgccgagtttgaggagcccgacgacgtggaccgtcccggctcggacgaggagtggacgtcagacgaggacatctga

SEQ ID NO: 1838 - DNA, 807 bp, Chlorella protothecoides
  modified_base (776)..(785): a, c, t, g, unknown or other
atgcaacatggaccatgttttgccggcttcaaatcatgccagtgcctcttcatcagccccaggacaaggtcaaggttcccagggtgcgctgccagaggcccagcaagccctgcatacgatcaaaggcattgccggctcagacatgcccctggaagcctctggccctgggaggctggagggagtactcaggccccaggcgtccattcggtggcaccggctcggcaccccactcccgcagcgtctgtctgggattcgccatcatgcaactcagcgggaattctctttaattggtttctgatatgcagagatgcacggtctattacacccggccgatcggatgtgatccgtcccggcatggatctccgcgcgcctggaggagaaccaggcgcacggcaggggctgggcctcgatcacgcacgcgcacggcacgggctgggcctcgatcacgcacataagcccatccccatcttgagcagcctgagacttaagttcagcatgtcgcgttacaagagcctggagctattcaagttcggcgtgtacgttactatcccaatcctgctagtgggagccatcgtctatcgccctgagaacctggaagccatcatccgcaaccgatcgtacgtcgtctaccccccggaagcgccacgccccccatctgctgagcagctgcaggaggtgaggcggcatgaagcagtgggactgagactggggctcgcaccaatgcgcactcgcttgacagcccccgtaactatccttgcagctgctgaagaagcagnnnnnnnnnncggcatgaagcagtgggactga

SEQ ID NO: 1839 - DNA, 609 bp, Chlorella protothecoides
atgaaacacgatgatggggtgcatgcctctgtcctgtggccgcatggcacacacccccgcccaaagcatacagcatccatccatcctcgcggcaccgcgccccacgccgcacttccatgctccatccctctctcccctcccccctcgcagctgttgcctgacggctcccgctgtggtttcttcatcggggacggcgcgggggtgggcaagggccggaccatcgccgggctaatcctggagaactggcggcgcggccggcggcgccacctctggctgaccatcgggccggaccttcgggtggacgcgcggcgggacctcgacgacgttggaggtcggtgtgcacttgggcctggctcccgcctggcgtggagggtgatggggaggaggggcattggggtcggcatgggccggagggagccgcctgcagtcttgtttgggaccagctgggcattcacctacgcacattcacctcccacaccaaccggcagccaccgagattcctctgcactcgctgaacaagctgccctacggcaagctggactccaagcgcatcggcatcaaggagggtgttgtgttcctgacctatgcctctctcgtctcccagtctga

SEQ ID NO: 1840 - DNA, 432 bp, Chlorella protothecoides
atgacgcagcttcaatcgcggtacaagcagctggtggagtggtgcgggaaggacttcgacggcctcatcctgtttgacgagagtgagcgtgtggggaggcggcttgggcaggggtcaagatgtgctgccggggctaaagatgggctaggcagtgtgaaggtttcacgggggcatggccgtcgaggcgccaggcagagaagcacaagctcggcccttgcctgccacggagcatttgcccaggcccatgcgcatactcccgccccggcctcctgctcgccctcaggtcacaaggccaagaacctggtgccagaagcagggacgcgcgccaccaaggtgggccttcaagtgagcaacctgcaggctgctctgccactggcgagagtggtgtactgctcggccactggagcctccgaaccacgcaacatggggtga

SEQ ID NO: 1841 - DNA, 297 bp, Chlorella protothecoides
atgaacccttttcgcacccccccaccccccgcgcagacctaccagccggccaagctcccctacggcttcccccaccccgacccagtggtggagacgtcctctctgtccgcagtgccaccgcctgacgtcaaatacagcctcggcgcccatccagagctggtggacgcgggggtgctgtcggcgctgcagctggagagcgtggtgtatgcctgccagcgccacgagcaggtcattcttccttttttgtgtgggggcgaaggaattaggggaaagaggaaacccggtcctggcaactag

SEQ ID NO: 1842 - DNA, 1260 bp, Chlorella protothecoides
atgcgcctcgcagcatccctggcgcaggtcggccctcccctccccagacacccccccaaccccctcttcctctcaacccacccaggccgctggctggagccggttcgaggacccacgaccagcacaccccctgcgctccgtgtcgggggacccctcctccctgccctccgtgtcgtcctgggggtcggagcatcccagcgccccctcctcctcccagggccaaaacccccgctccccgctgacctctgccgtggcggtggaggccgccatgcccgcctcagccttcgagccggcggccgggattgtgcgtcccgccgcccccccgccggcgctggcggggctggacgaactgcgcgcgggcacggcgtcgccctcctcgcccctttcgggcctgggcctggtgccgctggagggtgggccggtgctggcgggccagcccgtgccgacgctgggcggcgacacgctcccgtggcggcgccactcctcccgagccagaccgcgccggtgcccaccagcggcgcggcgccgccgccgctgcgcctggcgcagagtgcgcccactgccctgctcacccgtgcctccttcaagctgtacgaaacggggccggaggagctgccgcgcgacatacgctccagcctggagcacatgatccccgcccacgtgctggagggcttcgtgcgcatgggctgcgtgcacgtgaccctggactgcctggtggactgcggcgccacagggagcccgcccagcggccagagcctgctgcgcggcctggccgacctggcggcgcgcccgggctgggcggccgtgccggccatgcacgtgcaggtcgggggcctgctggcgcgcgcaggacgcggcgtgccggaccccggcgtgcgcgacctggcaggggagggggcgccgcgcgtcgaggcggcccgccgcgccctgcccctccccgcctcgagggcggtggagctgcgcctgacgctgcacgcctgcgacctgcgccgcgaccgcctgctcctcagatcgcagggtgaggcgactggctatggctgggagacctgcctggacgctcgaaggccaatccaagggtgcaccctccccttcttctccgccccctccatgcacaggggtatatctggagcacaagctgctgagcgtgacgcacgatggcggtggtggggcctggcacctcgtcgtagaggcgcgcctgccgtcgcccattcaggccgcctgcatccgctgcgaggtcctagccggagacaccctgtctga

SEQ ID NO: 1843 - DNA, 462 bp, Chlorella protothecoides
atggccggggagaagctggtggccatcatcagcgaggccgcctccgccggcatctccctgcacgccgaccggcgtgcagggaatcagcgccggcgcgtgcacctcaccctggagctgccctggtcggcggacaaggccatccagcagtttgggcgcagccaccgcgccaaccaggcctcggggccggagtacaagctggtggtcacgcccctgggcggggaggcgcgctttgccgccgccgtgtcgcgccgcctggagaccctgggtgccctgacccagggcgaccgcaaggccggccccgggaacctggggttcaactacgagtcgcgcgccgggcagcaggcactgaggaccatgtacagcgtcatcctgcagcagtcacacaagcccgacctgctccccgagacctgccgggaaggtgggtgccagggcggggtgcgagccggggacgtgggctggtga

SEQ ID NO: 1844 - DNA, 1128 bp, Chlorella protothecoides
atggcgagccccgatcccctgttctccgtccgtaacaacttttacctgggagcctaccagaccgcgatcagcgatgcatcatccctcacgggcctcagcgaagatcagaagctggagcgggacacctttgtgtaccgctcctatgtggagctaggcagctatgaggtgcgggggcccgccattccattcccatgcgcttccccctcccctcccttctcgcagccccaccccagccggccgcccccaaccgcacgcccacagatggttttgtctgagatcccggccgacgcccctccccccctcgccgcggtccgccagctggcctcctaccacaaggccggcccctccccctcctccccggtccccgacgccctggaggctggcctgtcggacggggccctctcctccgaccccacctacctctacgtcacggcgctggtgcgcttcctgcggggcgacgccgcgggggcgctgcgcctggccggccccgcccgcacgctggagctgctggcgctgagcgtgcaggtcatgctgtccctgcaccgccccgacgccgcggagcgccagctccgcgccatggccgccatcgacgacgacgcgacgctgacgcagctggcgggggcgtgggtggcgctggccgcgggcgggccgcgcgtgcacgaggccgccagcatctaccaggagctgggcgaccgcttcgcctggacgccgcgcctgcacgccggcctggccagcgcgcaggcgtgcatggggcgctgggaggacgccgaggcggagctgctgcaggccgtggaaaagaacccaaaggacccggactcgctggccaacctggccgttgtgtccctgcaccttggcaagcccgccggacgctacctcgggtgcgcagggtggacggcggcgtgggagggggggaaggggcggttgcgcgccgttctgtgcagaccggagggggagggcccttcggagtgcgggcctgtacggcgcaccacgagggccccagagcctgaaggaatcgccccttccactcgcagggtgctcaaggatgtggcgccatcccacgccctgctggagcggcgggccgccgcagaggaggcctttgaccgtgcggcctccggcatcacggcctga

SEQ ID NO: 1845 - DNA, 837 bp, Chlorella protothecoides
atggacgcggtgaacgtgcagggcacgcgctctgtcgtagaggcgtgcgcgcgccatggcgtctcgcgccttgtctacaccagctccgcctccgtggtcttcgacggctcgccgctcgtcaaggtggatgagtcgacgccatacgcggcccgccacatggactactacacgggcaccaaggcccaaggtgggcagggttttgttatagggcgcggtagggcctgcgtctctggtggtggggctgccatgtctgcctggctctcgcacggtgtccccgggatggcggcgggtggccttggacctgggcgctcggggcggtgccttcgattcagctcactttcactccaacccccctcaatgaccaggcgaggtggcggcgaggtggcggtgctggcagcgaacgggcgcggcggcctgcgcacgctggcgctgcgccccagcggcatcttcggcgagcacgacacgctcctcgtgcccagcgtggccagcaacgcggcgcgcggcaagctcaagtacatcatcgggtctggccggaactgcatggactggacctatgcgggcaacgtggcgcaggcccacctggacgccgccgccgcgctgggcgacgcgcgccgcgtggggcgcgtggcgggccgcgctttcttcgtcaccaacgatgacccgcgccccttctggggcttcatgggcgacctgtgcgaggggctgggctacccgcgcccctccgtccgcctccccttccacctcgtctacttcattgcgctgctcatgcaatacgtcatactgcccctgctggcccccttcaagaggatcgactccgacttcacccccttccggtga

SEQ ID NO: 1846 - DNA, 669 bp, Chlorella protothecoides
atgtgctgcctggatgatgaccgaaatcgtccctcaactgatggccacccctcggacccactgtcgctacagtcatccgcctcggatgcctccgtctcgggcaaggactctggtgacggtaaaactgagaacacctccggagaggaggaggaggagagtgaggagagtgaggccgagattggtctcgagtccgactctgagagctccaagcagggcgtcagtgaggaagacagcaaagaaacccctgaggcagcagccaaggtgctgggcggggtgtgggtgtttgccctggctggcaatgggggacctaaagaacaggcggcgctggccatcctgcgccgggaaaagtttgccgccgcccacgctacggcactggaacggcgcgaggccatcctggcggctgtggggaacctgggcctccccaacaaccccctggacgtgctgatcgacgagctgggggggccggagaaggtggcggagatgacggggaggaagggtcgccttgtgcgctccaagtcgtctcgcacggtcacgtacgaggcgcgtaacgcctcgggcgtcgagaagggtgcgcaggagtattgctgtctggatgtggtggcctccctgtgtggcagggagtgtctgccagggctgaagtgcagtggacgctggggtcggcagggctga

SEQ ID NO: 1847 - DNA, 633 bp, Chlorella protothecoides
atggccaccctggagctcgtcgccatggacatgaaggcgcagggcatgtacgtctcgcgcacgctctcctacgccggctccgagttcctcaccgtgacggtgcccttggaggagcccgtggcctcgcagtacgctgatgctgctcgcatgtggctggagctgtaccgggagttcatgtatgcggaggagcaggtgcggcctgtccataattttggaagaggggggaggaggagggtattgccattgcagaagggacacgctgcagtacaggtctggcactcatcatccgagcagtcgaaactggggcccccttcaccccacgcgtgcgcagctggaagcgctcgggcccacgggactggccaaggtctggcactcatcgtccgagcagtcgaaatcggggtccccctcaccccctcgcgtgcgcagctggaagcgcttgggcccacgggactggccaaggtggacactaagaaggggtcgggcctgcaggacgcacgcacactgcgcctgcgtgccttctggggctcccaccagcgcttctttcgctacatgtgcatggctgccaaggcgagacactgtagggtcctgccggcagggctcgcgtgcttgaagcaccggcatcccgagaagtaa

SEQ ID NO: 1848 - DNA, 759 bp, Chlorella protothecoides
atggtcagtcgagcgggctgggtgcagcgaggggggcccacacctgtccttcaaattggccgcaggggtgcgaccgtgctgggcatgctctccagggttccgacccacgtccatgtcggtgggacgacgaatgcccgcaaggccatgcacaatcagagcgatatcaagttccaatatcgagaaagggaacataaatatgctgctcacgccctgataatcacctttggggacttgttatcctcgcacgagacgatcacaatggctttcgactgggcagggtgggccctcaaagttggtagcatggtgagtgctggcaggcaagcacgcgatctagatgccatacaaaacctgcaatttttcatttgttccaatgtatccatccagggggcgggcgtcacgctcgcgctgcttgctgccctcgtctacttccaggagaagctggtgaggggtgccctggccatgggaggtgctgtcgagccggaacggccgccctcgttgcccccttcccttaataacgccctcctgctccatctcataccacagatatacgtcccgcgcctgcctggcatgcctgctgcctaccagttcttcccagccgagtttggactggagcatgaggacgtgtggctctcggtcccagatggcgtgcggctgcacgcctggttcatgtggctcaagggtttgaccccggagcagcgccgccggcgacccacggtcgtgttcttccaggagaacgcggggaacatgtcgtaccggtga

SEQ ID NO: 1849 - DNA, 510 bp, Chlorella protothecoides
atgggccagggcgtggccctggcccatggcgcggcgccgggcgacgcgctcgccgcggccgtgccgcacgaggcggcctgggacgacctgcgcctggagtccctcttcacgcggcccctcgccgccgaccaggctgcgcgcgcactgaactgcagcgtgtgtgcatcacgagaagacgcagtgccgctgcttgccgaggctgtagtacgagcaccgagagccccccgcaccctgctggggccgcgctgcctgggcgtcggcatcgtccgggccgtggacggcgagcggcggcgggtgctgctcctcgcccccctgccgcccgctgagctggcgggggtggacaccctgcagctggggcggctggagctgccggggccgctgctgcagacacccggcgcccgggccccctacatgtccgtgcactgcctgcccaccctgggcacgggggcgggtgccatccggagccggaacaacctggcccgggcgcggcaggcggaccggggcgactga

SEQ ID NO: 1850 - DNA, 252 bp, Chlorella protothecoides
atgtccagggcggcggtggaggagggcaagtgcatcgtcatcgggctgcagtccacgggggaggcccgcaccaatgacgtggtggcggagaagggagacgagctcgatgactttgtgtcaggccccaaggagctgctctcgcggctcgttacagagtactaccccatgccagccagccccgcgctgtgggaccaggaggacggtgcgtcgcagctgatgatcatagaactaggggagcgcgagggtgggtga

SEQ ID NO: 1851 - DNA, 756 bp, Chlorella protothecoides
cgcggcgagaccggcgcgggcgtgccccccgcggccgggcccgccccgcccggccaggcggtgccgcccaccacctggctgttcaacggcatgcaccgcggcatggaggtgctgctgtcggagctggagcgcaactcgcgcctgctgggcacgcccgagcgcgcgcaggtcctgctggccgcctgccagtcgctgctgctgggcgacccgcgctgcagccagtccctggtcccgcgcctgtgcggcgtggtgctggccgcccccgccaccacgcgccacctgctggtcaagtggtgggccgagtgcccggccgcgctgctggaggcgcgcgtggtgcgcccgctccagcgctacctcaccgacgagttgtacaccaccaagaagctgacggtgagcgtgatgaacgtgatcaaggtcctggcgcgggtggaggagggcagcgcggcggggcgggtgctgccccccgacgccttctacaacgagctgatcagcgagaagctggacgtgctggaccactacgtggcctggcgccagacgcacgacacgcccgcccacgcccccggcgccgacgggcccttcagcttctgctcctacccattcctgctcaacccccgcgccaagagcaagctgctgcacaccgaggcccgcatccagatggaccagaccgtggcggcctgccgcgccgaggccgccgcgggcggcgaggcggcggggggcgaggagcgcgtcgtgccggccaagcgccgcgcgccgcgc

SEQ ID NO: 1852 - DNA, 336 bp, Chlorella protothecoides
  modified_base (217)..(226): a, c, t, g, unknown or other
atgccaggggcgctgctggaccacgccggcggcggagtggatccgctggcggtggtgtcgcgcctgccccgccacgcccacatcccgcggctgagccagcgcctggtgcgcatcatcgccgactcgcgaaccaccgccagcctgcaggccggctgcgccgccatcctgagggccgacgcgggcgcgctggcggcgcggctgcgcggcgcgctcagcnnnnnnnnnngccagcctgcaggccggctgcgccgccatcttgagggccgatgcgggcgctctggcggcgcggctgcgcgtcgcgctcagtgccgcgctgccgcggctctacctgcgccg

SEQ ID NO: 1853 - DNA, 549 bp, Chlorella protothecoides
tacctggccgcgctctccacccgcgagccggcgctggcggcggagcacgccgcgctggcggtggagctgaccgccgagtatgatccggccgccctggaaggcttgctccttgcctcctccgactacccgctggaggaggcgctgcgcgtttgcgaggcacgcggaatggtgcccgagcaggtgctggtgctggggcgcatgggcgccacggaccgcgcgctacgcctcatcgtggagaacctgcgggacgtgggaagggtgggtcaaagagggaggaagggtgggggggcgtgcctcccggaaccggcgcccgggggtccatgcttgggtctccgacgcagggcagggacctggcaggctgtagagtttgtgcagaaccagcgggatgacgagctgtgggacctgctcatcacgctggcgctggcagacccggagctcacaggtggggggccgtggggcgaccaagaggcatgtgcagcacctgtggccctggaggggctggccgtgctttctgggcgtgattctgtctgtcgagatggtctggcgtga

SEQ ID NO: 1854 - DNA, 258 bp, Chlorella protothecoides
ggcgccgaggccgagcgccgcgcgcagcaggagcggctgtatgcgctggacgtggcgcgcatcgcggcgggggaagaccgccgcaccacgctcatgatccgcaacatccccaacaagtacacccagaagatgctgctggcggtgagcggcgaccgggctgggggccggggggtcgcgactctgtgccgtgccgggagtcctcctgtggccgcgggcctggacttgttcggccacgctgccctgcgccagcgccgctga

SEQ ID NO: 1855 - DNA, 504 bp, Chlorella protothecoides
atggccgctggtcgatgcgcatggcagcctccctggacctcggagcgtcggccctgtcgagcgaggcggagggcctcacctaagcgggccaaagcctcacagatctcaccactcaccatcctgccccccctcccccacaacacacacacacacaccaaccacctgcagctgatcgaggagcagttcaggggggcgttcgacttcttctacctgcccatcgacttcaagaacaagtgcaacgtgggctacgccttcatcaacatggtacgcccttcctccatcccggggctggtggcggagctgcacggcaagcgctggcccaagttcaactcggagaaggtctgctgcattacctacggccgcatccaggtgtgtgtgggtttggtggggggcgcggggacggtgtggggggtttacgttgaccgtcagggagggggactctggtgtcagccctctggcgcagggtggggcgagggagggcagggtgggccgcggccgcgatga

SEQ ID NO: 1856 - DNA, 3087 bp, Chlorella protothecoides
  modified_base (1160)..(1169): a, c, t, g, unknown or other
  modified_base (1936)..(1945): a, c, t, g, unknown or other
atggaccccaacaagatcacgtccaaggtggcggagatggtgaatgcggcccgggacctggccctcgagtcctcccaccagcagataacgccctcccacctggccatagcgatgctggatgacaggcagggcgttcctgcccaggccctggcccgcgtcgggggcgaggaggccgtggcctccgtcctccgggtgctgaagaagggcctggtgcggcagccggctgtcgacccgccccccgacgaggcgtacctcagcaacgacctcaagaaggtgtttgccaccgccaccaagctacaaaaagccaagggcgacggattcctaggcggtggggcaggtgtttgcccgacgtgtcatccaccatcacctcatgccaatccaatcaccccgcgccgccctcactcctcccttccattcacctcactcgctccaggcatcgacgtcgtgttcgaggcactgctgggcaacaaggtcgtggccgccgcgctggccgagtccggcgtgggcaaggcccaggtggagacggcgctggccgactcgcgctgcggcgccaccgtggattcggagacggcggacacccagtttgacgcgctgggaaagtacggcatggacctcaccgcgcgcgccgcggagttggaccccgtgatcgggcgtgacgacgagatccggcgcaccatccgcgtgctgtgccgccgcaccaagaacaacccggtgctgattggggagccgggcgtgggcaagaccgccatcgtggagggcctggcccagcgcatcgtgcgcggcgacatccccgagaccctcaaggtacttattatggggtgggggggtgggggggtgtttggtgggtggggtttggggtttcctggaaaagggggggggcgcacaaatggatgccggcacccatcgcccacacgttcccgccctcagaggtccatacacacaacccttccccctttccaatcctcaccagggcgtgaggctgatctcgctggacatgggctcgctggtggcgggggccaaataccgcggcgagttcgaggagcggctcaaggcggtgctgaaggaggtgcaggacgctgcggggcgcgtcatcctgtttgtcgacgagctgcacaccgtgctgggcgcaggcaagaccgagggcgccatggacgcggccnnnnnnnnnntgccgcggggcgcgtcatcctgtttgttgacgagctgcacaccgtgctgggcgcgggcaagaccgagggcgccatggacgcggccaacctgatgaagccgctgctggcgcgcggcgagctgcgcatgatcggcgccaccacgctggccgagtaccgggagggggtggagaaggacgcggccttcgagcgccgcttccagcaggtcatggtgggcgagccctccgtggccgacaccgtgcagatgctgcgcgggttgaaggagcgctacgccagccaccacggcgtgcagatcgcggaccgcgcgctcgtggccgccgccactctggcggaccgctacatcaccaaccgcttcctgccggacaaggccatcgacctggtggacgaggcctgcagcgacctgcaggtgcagctggagtccaagcccgaggccctggaccgcatggagcgcgcgctgatcgggctgcaggtggaggccaaggcgctggagaaggagaaggacaagcagagcgtggcccgcagcgcggaggtggccgccgagatcgcggccctgcgcgacgagctgcagcccctgcagatgcgctaccagaaggccagcggcggcttgcatggcactggcctatcccctatgccggtggccatttccatcccgaccatcccagcccaccctcattccacctacttccacccaaccaggccaaccccacctctcaccaacaaccccccccaccacacacaccaactcaccaggaaaaggcgcggctggaggnnnnnnnnnnggcgaagtgtgtgtggggaagggtgttctgagtttggagcgttcctgagtgacactggaaaaggcgcggctggaggagatcaaggcgctgcagaagaaaaaggaggagctgagcatccggctggagcaggccgaggcgcgcatggacctggccatggtggccgacatccgctacggcgcgctgcaggaagtgggcgaggccctgcgcgccaagctggaggccgcggcctcgggcgacagcatgttgtcggatgtggttgggcccgagcaggtggccgccgtggtctccaagtggaccggcatccccgtcaccaagctgcaggtgggtgttgtcattggtggtgccttggttttgggacaagcttgctgggcatgcgagcgcaaggcctggcgcaaatcgggcggccaacagcgtcgagcatccatcggtcgatgggcttggcgccgcctctcctcccaacatgctgttggctcgcacgttcttgcccatctcgcagtcctctcacgccgcgcctcgagcccagacgcgcctgctccacctctccaaactcccaactcactcactcactcaccgctcacccccccgcagtccaccgaccgggagcggctgctgaacctggaggcggagctgcacggacgggtggtcggccaggacgaggcggtcaaggcggtggcggcggcggtgctgcgctcgcgcgcgggcctgggcgcgcgcggccgcggctccagcttcctcttcctggggcccaccggcgtgggcaagacggagctggccaaggcgctggcggccgcactcttcgacagcgagcgcgagatggtgcgcctggacatgagcgagtacggcgagcggcacagcgtgtcgcgcttggtcggcgcgccgcccggctacgtgggccacgacgcgggcgggcagctgaccgaggcggtgcggcgccggccttactgcgtggtcctgctggacgaggtggagaaggcccaccccgacgtcatgaacctgctgctccaggtgctggacgacgggcggctgaccgactccaagggccgcaccgtctcctttgccaacacgctgctggtcatgacctccaacctgggcgcggcggcgctgctggccggcggcggcggccccgccgcgcgcgccgcggt

SEQ ID NO: 1857 - DNA, 693 bp, Chlorella protothecoides
atggaagcaaaggggaagcttgcacggctgggaacaaaacctctcgtgcaagtactgctcacgccaggttctctagccgccagggcacggcccccatgcggccgagacatcctggaatgcggtcccgatgagcgcatcatcgtcttctccacctggcgcgacgtgctgcgcctgctggagcacgccttcggccgcaacgccgtcccgcacgcccacccccagacccgcaaggccctggccccggccttcgcggccttccaggtggggcctggcgccggcgcaggctctgccacgccgcgcgtgctcctgctgctggtgaagcagggtgggaacgggctgaacctgaccgccgcccagcacgtgatcctggtggagccgctgcgctcgccggggctggaggctcaggccgtggggcgcgtagatcgcgtgggccagctgcgagagacgcacgtgtacaggtgggacagtggggttgattttacaaagggggaccggagggggaggcggcgagggggaggggccagcctgcctctggcatcgaccggggggaggctggacctgggatgcgatgtgcagcacagcaggctgccagtgagttactttcgtgccgcagactggtcagccatgcgggtgatcaaccctgagttggacatgtgcatggctgtgttgagggccagatggcgacgagcttga

SEQ ID NO: 1858 - DNA, 1410 bp, Chlorella protothecoides
atggccaccggcataggggataggccagtgccatgcaagccgccgctggcctctgcgcatctgcaggggctgcagctcgtcgcgcagggccgcgatctcggcggccacctccgcgctgcgggccacgctctgcttgtccttctccttctccagcgccttggcctccacctgcagcccgatcagcgcgcgctccatgcggtccagggcctcgggcttggactccagctgcacctgcaggtcgctgcaggcctcgtccaccaggtcgatggccttgtccggcaggaagcggttggtgatgtagcggtccgccagagtggcggcggccacgagcgcgcggtccgcgatctgcacgccgtggtggctggcgtagcgctccttcaacccgcgcagcatctgcacggtgtcggccacggagggctcgcccaccatgacctgctggaagcggcgctcgaaggccgcgtccttctccaccccctcccggtactcggccagcgtggtggcgccgatcatgcgcagctcgccgcgcgccagcagcggcttcatcaggttggccgcgtccatggcgccctcggtcttgcccgcgcccagcacggtctcgtcgacaaacaggatgacgcgccccgcagcgtcctgcacctccttcagcaccgccttgagccgctcctcgaactcgccgcggtatttggcccccgccaccagcgagcccatgtccagcgagatcagcctcacgccctgggtctcggggatgtcgccgcgcacgatgcgctgggccaggccctccacgatggcggtcttgcccacgcccggctccccaatcagcaccgggttgttcttggtgcggcggcacagcacgcggatggtgcgccggatctcgtcgtcacgcccgatcacggggtccaactccgcggcgcgcgcggtgaggtccatgccgtactttcccagcgcgtcaaactgggtgtccgccgtctccgaatccacggtggcgccgcagcgcgagtcggccagcgccgtctccacctgggccttgcccacgccggactcggccagcgcggcggccacgaccttgttgcccagcagtgcctcgaacacgaccttggtggcggtggcaaacaccttcttgaggtcgttgctgaggtacgcctcgtcggggggcgggtcgacagccggctgccgcaccaggcccttcttcagcacccggaggacggaggccacggcctcctcgcccccgacgcgggccagggcctgggcaggaacgccctgcctgtcatccagcatcgctatggccaggtgggagggcgttatctgctggtgggaggactcgagggccaggtcccgggccgcattcaccatctccgccaccttggacgtgatcttgttggggtccatgccgtacgtgtgtgtgcgttgtga

SEQ ID NO: 1859 - DNA, 408 bp, Chlorella protothecoides
atgcactcacaggagatgagccgcccggcgagcgacgacgcccccttctccgccctggccttcaagatcatgagtgacccctttgtgggctccctctccttcattcgcatctactccggcaccctggaggtgagagagatggccgggtgggcagctgatgaccaagcgaatgagtctgctggccaggcccttggtgctcccaatctcgcgcctgcagccgcctggggtcctgcacctgctgggctccaccatttgcccgccggcacgtacgtgctcaacgcggcgagggagaagaaggagcgcatcggtcggctcatggagatgcacgccaactcgcgggaggacgtgaagtacgcctacgccggcgacattgtggctgtagcggggctcaaggtgggtgggcgggtg

SEQ ID NO: 1860 - DNA, 765 bp, Chlorella protothecoides
atgccgggcttgttcgaggattcgcatcgccgacggggtcacggtcgcgccgtgtcctggtgtccacccctgacagccagccttggagtcaatgctgccctcgcaatcctcctgatcatcctcgcactgagatcccggggtggtcttggccccgatacgatcgacctcaacaagaggctgctgttggcggaggaggggctggaacgactgcgtgcagggaagccaagccaagccagtgggggggggagatcccggcccccctggctcaccatcggcatccccacggtgcccaggcgccagactggaaccaagtacctccagcgcaccttggagaccctgctggacgagctgcctggcggggaggagggtgaggcggggtctgtgcatgaggtgtcggtgcatgggggtgggcggggagggggaggggcaaagggtactgcaatccgaggagggagccccgtccttgacaggaggcccggcagcgctcagagatcgacagcgcgagcggtttcaacaatgtgtgacaccctcccccacctgtggcgaaacgaggtgtcggtgctggtgatgaataatgcgcctggggagcacgcggagtttgaggagctgcgccgccgggccgccacgggcaccgaccgcttctccctgaaagcgcggcactacgtcacctggctgaacaaccccggcctcgtcgccgaccccacccccgacgccgccgacccggacgacctgcacaaccccgacgaccgcccgggcaggtgctga

SEQ ID NO: 1861 - DNA, 534 bp, Chlorella protothecoides
atggcactggcccaggatccctgcccacgactccctcaccagcgcacaccatcactcgccctgcaggcaggtgaggaagcagacctgcgacctcatcgctctgctgcgccatgccgccccactctcccgctactacttcttcatggaggtgggggttgcagacggaggggctcctccagcgtggggttgtgtgatgcagagggctcgccgcaatgcatttttccggatacaccccgagccttctatgtgggacctctggcctgtgactgctgggtcttggcgtggctgtccagggtcacaccagtgtgcgctgttacacacctcccctccccactcaatccgctcccccaccaggatgacttcgaggtgtgcccctttgcgctgcgggccttgcacacggcggcggtgaaggccaatgcgcagcgggagtccaaggggtgggtggcgctccgggtctcctacggcatgaacggcgtgctgatgcacaacgccgacatccccgacctcatggattacctctggtgcggcgtttga

SEQ ID NO: 1862 - DNA, 477 bp, Chlorella protothecoides
atgatttccaacctgggttgcgaccccctggtcatccagctgcccatcggggaggaggagaactttgcgggtgtgatcgacctcatctccaacaaggcgctcgtctggaacggcgaggagctgggtgcaagctggaatgtcgaggaggtgccggaggacatgaaggagctggcggccgagtaccgcgagaagctggtggaaagggtggtggagctggacgatgacgcaatgatggcatacctggatgtgagggaattggtggtcgtgggaggaagaggggtagaggggccctggactcgcagctgtcctgagcaaagcactggggccgtgccggcactgagtctgctggctgtccaaggcgagctccccgacgaggagaccatccacaagctgatcaggaagggcaccatcgcgaacaaggttgtcccgttgacctgcggctcaggtgcgggtggtgtttggagatcagggcagtag

SEQ ID NO: 1863 - DNA, 306 bp, Chlorella protothecoides
atgtggcctccccttggtgacgcccattccgctgcatgcccacaggtgtcgcgggcgctcctccggcctgcgtccggcatggtggctggccgcgcccgaggcatgtgtgtgtctgctgcagcaggtggcggaaagcgcgcctttcccctggatatgtacaggaacattggcatcatggcacacatcgacgcggggaagaccaccaccactgagcgggtgctgttctacacgggcaagtcttataagattggagaggtgcacgagggcacggcgacgatggactggatggagcaggagcaggtgtga

SEQ ID NO: 1864 - DNA, 2325 bp, Chlorella protothecoides
atgacgtcttctatcagcccgaccaaggcgttcctggggcgcctcggccggggttggcggattggtggccccggcaccccccctgagccgggtccgggctcccctcccgcccaggactctcccccccccgccgctggcaagtcggccagcctggaagccctgagccccgcgtaccagacggaaggctccgacccgctggacgaggagctgtgcgctctgcccctggcctttggccccgccgacctggagaccctggccgaggcccgcaccggcgtactggaggcggtcagcgagaagctgtcggcccacgtgctggccaactacgaccgcttcgtgggcggggtggagggcgtgacgcgcgtggaggtggacgtgcaggccgcctactctgcggcgcgcatggcgcgcgagcggctggccctggcgctggcggccctgggcgccaccatccgcatcgcggaggacacgaggaggaaagggagcctggccgcgctgctgcagaccgcggggcggctgcagcaggtcgccggcctgctggccgccgtcagttgtgggacacacagggcagtgattggagccccagtgcccatgtctctgcatgctccgctgccctcggctgtcttggactgccaggaggagggcgagtacgcggccgcgctggcaacctgcggccgcgcggcggtcgcgctgggggcggtgccggcgcgcgtcgccgtcgcgcgcgcgctggaggcctccctgaacgcggcgtacgaggagacgctggcgcgcatgtccggcgcgctagcctcggtctgcctcgacttccgccccggcacctacgcgcgcgtgctggaggggtacctgtacctgagcgcgggagacggcggcggcgctgacgctgcggaggcgggcgccgacggcgattccagcagcgatctgcgaggtgctctgagcgacggctccggcggagacgggagcacccctggcccccggccctctccgctcccgggcctggcggcggaggtgcagtccgcgctgctggcggcggtgggcagcgtcagcgcgcgcgttgtgcgtggcgtgctgctcacgcgctccggctgcgaggcgcgcgcgcgctccgcgggcgggctccaggaccttgtccgcctcctgcccagcgacctgtttcgcaccgccctggcgcgcctgctccaggtgttgtttgacgtgctggccagccaccaggccatggtcgcatggcacgcagcggcgctgcaggcgcaggaggcgctggaggcggggcggggagaggttgtggagacggcggggcctgcgacggccgcctgtggggcagcagagacggcgggggtgttgaagggggcgatggtggggacccagagtccgacccagggcgagccggctagggccagcgccgccgtgcaccaccgacagacaccaccccgaccgccgcgtggcgggcgccgcagtcccgaaaacaaagcgcggttcagcgtcgcgggcccggcgacgctggcgctccgtcgcggcagctcggcgcgggaggaaaccgaggcccgggcacgcgacgaggcggaacggtgtgccgtcctgcacgccgtgcacgctgggctggtggcggggcgggggctggtgtgggacgaggtggcgcgccacgtggccacgctgctgtccagtcccgccgcctttgagggcgagcacttcctgcaggagagactgggtggaaagatcggagggtctggaacaggttgcccatggatgcctgctcacatgcccatgctccctcccgccacctttttcagttgctctgtccgctgcttccttcaccatcctgcctgccacatgcaaccgcaccccacgcaactcctgatgtccctggtccaccatcctgccattcctcctccaaccccctcccaaacacacactcacacgagcgcaggtgatggactggatgcagcgcttcgtggcggcaggcgaggcgttcagcggggtggaaagccccgcgctgcgctccatgctgcagcgtcaatccggcaacttcttcgccgccttccacgccagcaacctggaggcgctgagcagcatgctggagaaggagagctggacgccgttgcccgtggagctgccgggcctgctgagtgcgctggcccccctgcagctggatggggcgggtggcgtgaggggcggcggcgagggcagcggcgaggaaggggccgctggcgatgccgacgatgtcggcacccgcggcgcgcccggcccccgccccccatccggcacgtccttccaggccctggtcgcggcgggcaacccgtggcggcggcggggcggcggcgccccctcgcc

SEQ ID NO: 1865 - DNA, 465 bp, Chlorella protothecoides
atgcccttcggcatctacccagtccactgcatcgtgcctgcctccctgaacttccatcttcctcgcagctcggctcacaaacttcgcaccgggcttattcctctcagagcggacgtgcagaatctcgacgccatcgtccaagacgcgcagaggcgaaggatggcctccgcccgcggcttgacgggaatgtgggtgaaggacaaagccaacagcgacagcatggacacagtgtgcgagatggcggccctgtcctgggtgctgcgcacggccgtcaagatcatctcccggatggagctgaaggacgatgaggaggcctttgaagtgaccatgaaggcaggcggcatcctggacgtcagggagcggtacccctggtccggggagccagtcgaccatccacgccgtgacaagcgcaggggaaagcacactgcctacgtgaagcggaccgatcaagggccaaccgtctag

SEQ ID NO: 1866 - DNA, 312 bp, Chlorella protothecoides
atgagggatgcagcggcgctgctggtgtggcatgcacggaccgcgccaactcatgcggaggaatggccactcatcccgcccctcactcctgctcctcacttgctgcagctgagggacaaaatcgtgagcgacaccaatggggccaaactcaccatgagcgtgcctcgcaagggcatctggggcactgccggagtgggcggcgacaaccttgcagggtgtgttgcctggactgactgcggtgggatctctctggggggagggggctggtgtggtgcgctgatgaactggtgcacatcagacggccacgggtag

SEQ ID NO: 1867 - DNA, 708 bp, Chlorella protothecoides
  modified_base (162)..(171): a, c, t, g, unknown or other
atggaccgatccatgaagaagcgcttccgagcgagtgtaacggcgagattaagcttcgtcatcttcgtcttccttgccggcgttctgatcggccggcttgggaaaccgctcttgggcgagtccgtgctcgctacaggcgacttccagcagaccccgagctgnnnnnnnnnngttttgaagcctgccgctgcagcccatcccccccatactgcgcagcagaccccgagctgggagaccaaggccctgaacaaggaggcccagggggtggtcaagggcgcccaagaggtggttaagagcgccttctcccgtgcctccctgaccgggacgtcacgcagcatcaagcccggcccggtgcgcaccgtgtgcgagaacacctgccccaccgcccgtgacggcgtgtgccaggatggccgccccagccccggcagcaacgcgacctccttctacgagaccctgcaccccgtggtgtgcgacctgggcacggactgcgcggactgcgggccctgggtgaccaccgccaccccagaggccctggcctgggcgcccgtggcgctgctgcgcacggcggagaccaagctgctggtgcgcagggtggcctcccccgccggctacatcttcgggatcacggatccagagctggacacggatgtgtcacgccacgtcaacggtacagggctttttgagcctgtcctgaccctgctctggtga

SEQ ID NO: 1868 - DNA, 342 bp, Chlorella protothecoides
atgtgccggtgtgtcctgaagagtcccgacctttcctccacccccgccaatccgcacaggcaccagctcctagcaaactgtgtgcagccggatggaagccggaggctggtggtggatgtgggtgccaactttgggtactacaccctcatggcggcttccctggggtgcaggtgggcaggagccgggaagggggtggacgcccttgggctcccagctatcattggtggcgatggattggggcgcgctgggtggtcgccactcttttcctacatgaaaggcaggagcatgccggggcgtgctgcagtagcttgccgcgcacgcattgatggcatcgtttcatga

SEQ ID NO: 1869 - DNA, 282 bp, Chlorella protothecoides
atggcggcctccctggggtgcaggtgggcggagcacagcatgttgtgctcaggcctggcccgagggcacactccaacaatccacgcccatcacccatccagggtcaaggcctgggagccggtcccctcttttgccgccttcacccagtatggcctgctgctgaacaacctgacccatctggtggaggtgggtcttgtcgtgggggcctgtggggtcgagtgcccgacaggcctgtgcttggtgctcgtcggctgtggtgtgcacatgaggcgcccaacatga

SEQ ID NO: 1870 - DNA, 600 bp, Chlorella protothecoides
atgcatccggattactgtgcggaaggggttgacggttacgttgcgctgcctcgtggggagtggctgcccagcccctgttactttaacctcctcccgagtactcccctcccacaccaatgcacgcagttccagggcgaggctcagccccagccgtccatccccatcctgggctcgaaaacgggtgagctcaccccttccagcaccaagcccctggtcccacgcagcgtctgcaccaacacctgccccaccgccagggacggtgtgtgccaggacggcaggcccggccccggcgtcgacgccgaggccttctacgccacggcccgcaacgtcacctgtgacctgggcactgactgcgctgactgcggggcctgggtgacggacgccagttcggaggcgctggcctgggcgcccgtagcgcgcctgcgggacgcgggaaatacgctgctggtgaagcgcgtggcctcgcctgcgggctacctcttcggcatcacggaccccgccctcgacactgacgtctccaggaaggtcgatgccaccggcgtcttcgagcccatcctcaccatgatatggtggggcaaggggggctgcaagggagcgtga

SEQ ID NO: 1871 - DNA, 510 bp, Chlorella protothecoides
atgaggggggcccgcgacctcctgctcaagcgcagcgtggaaaacatcatcatggagtactcccccggagttggcgactggcagcgtgactgggacaagtcgatgtccaaccccatcatgctcaaagcgattcctggggcccagcacgggaggccgcccctcgctcagcgctcgcacccgcagactccctgccccgccgacgcccagcgctggagcgtaggagggtactttgcgtacgacctgccctggtccaaggtgtacacctatccgggattcaacgtctcgatgccagtgttggagcgggtgctcacttacatgctggatctggacatccaggacatgcagcgcgccaagctcggcaagctgggctgcgagctgaagcaggaggtgagggcttggttcaatggggcgggcctagacgggcggtgtttggtgaatgtagctttgggcctcgccaggggggcctgggtgggaggagcgtgcctgagccatgtcgtgtggtcccagtga

SEQ ID NO: 1872 - DNA, 645 bp, Chlorella protothecoides
atgcccctcctctcgcaggagctggtgaccgtctttggactggatgggagtgtgaccaccttccccccgaggccctggccactcgatgaggcaaggcctggtggagggagggcattgtctcttgaggcccggcccccgctcctgagcctgcccctcacggaggagcagggcctgaccatcggctccgtcttcacgatacgcgcctccaacggcgtggactcctgccgccgcctgagcctgctgggcttctgccacagtgtggaccacctgcacgagaaggtggagctggtggtgaggcagcgggggggggcggtcgtgtcgtcagagcgccagctcaccaggtgtggaaagggtggagagtgtggagtctgctgcatgcgaggagggtgcaagaagggtctggcagtttcactgaaacactcctctcaagcgttctcctcctgcgagttgcgaggcatacccccccaacctggctcactgcgctccacgcgcagtgccctggccgagcgactgcacatgtgcatcgccatccccctgctgtttggcgtcccgccggagcatgagcgcctgcgggccggcgtgctggcgggcggcggcatcatcgaccgcgtggtgcagcagtggctggtgggctgcgtcccgtga

SEQ ID NO: 1873 - DNA, 654 bp, Chlorella protothecoides
atggccttgcaaatgctccaggacagcaatacgtctgctcacatagacctggtgctctgcgacgtctacatgccggacatggatggctttgagctcctggagatcgtgggcctcagcctgggcatccccgtgatcagcgacaccgaggtggtgctgaagggcgtgacacacggcgccgtcgacttcctcatcaagcccgtccgcctggaagagctacgcaacgtgtggcagcacgtggtgcggcgccgctcccagcgccgggcggagcccgccccccccccggccgcctctgaggcggcgccggtggcagctagcccccgcgtcggggccccagctgcggtccacaacgcggaggctagcgccgggtcccagagcgggggcggcgaggaaagcgggagcgggggcccccaggcgcccgtcggcacctgggccagccacgagctgcgcggcgacgagcgcggcgacgagcgaggcgactcgctggaccatggcagcgggccggcctccgactcacggcaccgccagccgcgcaagccgcgagtggtgtggacctcagaaatgcaccgccaggtatcagtggtacttttcgtgggggtgggatgtggggtcgagcgaggcaggggccagttgatgccggcagggtgtgtgttgtag

SEQ ID NO: 1874 - DNA, 1017 bp, Chlorella protothecoides
atgggagagcgaatgcgccaagagtttggcaacagcgctcctcacctaagcgagaaggaggccgatctacgggtgagcgatttatgtggggaaaggagggcgctggctggagatattctgatgaagtatgtccatcttcaaggtaaggaagtgtcggccaaaatgctctgtgacaccttgtgttgttccctgcagaataaaaaggcaaacatcgaggcatatctagccaagctctcgcttgcctctcgcaaagctgaatacctcgtcaaggagtttgaaggacagggagcaggctgcttgcccattcttaccaccgccggcaagagattcagctcgtcccggccaagatgctccagcacatgctctccccgttttgcagtgatgggcgacctcgggatgtctttgattaaactggccaactatgaggaggctgaggggacgagggctggaccctacactgactttggagcagacgccagagggattgccaccgagtcaaggaggattggcacggctgcggtccgatgtcggagattggcgcgcttggcagtctcccatctgacggaagctctggttccccttcatgatgagctagcgctggcaccagctgccgttgctgccctcaaggaacgggaagctgctctattgacggagcatctgatccaagaagacaaggagaagaaacagcaagcagctgcagctctagaagaagcaggtgccacgaggttcggaggaaacccttctaaggccaggaagtttgctcagctggagaatgagattgcgtctgcggaagctgcaattgtggccgcccatgccgagtatgagaaggtcaaatcccgaaacgaagaggtaaggagtaatcccaccaatccgatcgtaccctgctgtgccagatcgggtcatgaaccaaatgtgccttacatcgccgcaggagctggtggcatggcaggcggccaagtcagcagattacgcgaggatgtccaccagcgtagccctgatcaacacgcgctgcagtga

SEQ ID NO: 1875 - DNA, 1050 bp, Chlorella protothecoides
  modified_base (988)..(997): a, c, t, g, unknown or other
atgtctgttcaggaccccctgcgctttgggctcgaagatgacgaggtaggcaggctcaaatccctaggtctgactccacgaggtgctcgactcacaccaccgcgtcgccaccacaggatcagctccagcaggatgttcctcttgacgtggacgagcccgatcacaccagcccgcatattatttactatgatgcagtcaaccacacaaggagctgaaggtggttccttccaggagccttcaacttctgctgctgctggggtcacagaaggcaatgtgagggaggggccctcagcccatttcatcagcccaagcagctacagtgggaactcacgtcagggcgcaagctcatcaggcattcaggcagtccgaggccacagcctgaccgacaccaatcgggaggatcttggcctctttggcactgccagcgaagaagtgcttggcgtcaagtccaaacccctgtacaccatcaccgtctctgaccctgtgaagcgcagcgaggaaggtatgatcccaggcctgtcttccagccactatgattacctgatcagcagcagcagcacagagcagcgcactcgtgtggaggttcgccgcaggttcaaagacgttgtggctctcgcgacactgctgtccacaaagtatcgcggctattttctcttccctcggcccgacaagaacacactggaaggacaactgggggccactgacctcgtgaaaagcagggtggctgacatcacacggtatctgaatcatctggcctcccattccattgtcggcaggggcgaggagctggctgtctttttgacggcacctggcaacctcttgaactctctggagtggcagggactgtcccccctccgcaatggaggcctgcttgagggtgttgcaaggctgcccagccagctgctgggaacacagcctaccttgccttccaccacggaggcaaccttgaatgcaagggacaccaacgaccttttgaggaggttccgannnnnnnnnnccagctgctgggaacacagcctaccttgccgtccaccacagaggcaaccttga

SEQ ID NO: 1876 - DNA, 1260 bp, Chlorella protothecoides
atgatgtacagctgcatgagcttggcgagatgtccaacatcattacccccacgggcagggctgctgccaacagtcagggccagggtcctgctctctgcccctcaacagtgcgcacgtcacatctgccacggcaaagcagagaataatgagactgtgaagagtgaagaccagggcggagctttggaagaggtaggggcagaggtggacaggttcacgaagatgacagcctcgacctttgctcctcggccatcaggtcctgctccaaatcctgctccaccgggaagcatcctgtacacagtctttgaggttcaggcctgggcggctttggtggtgggcggacttttgtcatataatgtcctgcttccttctgaccacgctgacatcccacgattgattgggatgtggtctatctggattttcactgtgccttccttgcgggcacggcaatgcagcagtaaggagaaggaggcactcaactacctcttcctggccatccccctcgtcaacattgccatcccttttgttgtcagatccttcccactcgtcttcacttgtgacctcctgctcctcgccgggatgtatgcctggaaaggagtgaaaccactgtcacagcttccttcaagcaagacgggagctaggcaatgtcagagccccaagtctctggcctccacacttccattgacaattactataaggctgagtcaattgacttgccatgctggctcaggtaacaaaaaagggcagctcatgcttacagaccagccaagatgccaacgcacactctatcacacagcgaccagctgctggcccatgaccttctggctgtactccttccatgggatgatgccgcccacgacctcctgcctggcgtctgtgctgggctccacgccagccaggaatttgtccgtggcagccgccgccccacggccctcagcaatggcccaaacctggagggatgattgcatgaggtcagcgatgattaaagcgctcaagcgcttcattgcaccctcctgcccccctcggccccttggccctgccgcctgcacccaccacgagggactggccacgccggcagtcgccagctgcaaacactccatccatggatgtcgcaaactggccatactctgccttgaagttggagcggggatcggtctcgacacccagggcctcggccagggtggcctctggccccaggaaacccattgcgagcaggaccatgtcagcctcgatgatctgggcaggggtgcaaagggaaggtga

SEQ ID NO: 1877 - DNA, 1950 bp, Chlorella protothecoides
  modified_base (1904)..(1913): a, c, t, g, unknown or other
gcgcgcgcgcctgccccggccggcgccgccgccgcggaggccgagctggagtacaagcgcctgctgcgcgatgcggcggagggcgtgcccgttggcggccgcccagcgctgtgggaggcggggcgccccacggtcgtcgacggcctggccgcggtcaagagcggcggggtcaaggcctacgagcgcgcgccgctgcccttccgcgacgtgcaggagcgcatggctgactggggggaggtgcacgcgcacctgcccgccgagcagcacgcgcagctgctcaacacgcagtcggcgcggtgcatggactgcggcacgccctactgcctcaaccgcaccaccggctgccccctgggcaatctcatccccgagtggaacgcgctggtctggcaggggcggtggcgtgaggcactggacaggctgctggagaccaacaacttcccggagttcacgggcagggtgtgccccgcgccgtgcgaggggtcctgcgtcctgggcatcaaccagaacccggtcaccatcaagaccatggaggtctccatcatcgacaaggggctggggccgggcagaacaggttatgacccggagtcaaaatggtgttggggggggggccgaacacaccacgcactgcttgccaaagctatatctcgtcagcaaaggagcaaggggccctttcgagccggcacgtcggccgagcacccagagcaaacccctgacacctcacaacctcttctccccctcccactccaggcatgggaggagggctggatggtgccgcggccgcccgcggtgcggaccggaaagcgtgtgtccatcatcggtggcgggcccgcaggtctggctgccgccgatcagctcaacaaggcagggcacaccgtcaccctgtacgagcgtgccgaccgcatcggcgggctcatgatgtatggcgtgcccaacatgaagaccgacaaggtactcgtgggggatgtgcttggtctagggagcattgtgtctcagccggcagtgccgttcatggtgtcccagctgaacgccagttgcgctcataccagcttgcgtgcccccctcggccagccagccagcatgcaacccctcctcaccggtgcaggagggcatcgtccagcggcgtgtcgacctgatggcggcagagggcgtccagttcgtcacctcggcccacatcggccgcgaggtggacgtgcgcgacatccgcgcctcctccgatgccctcatcctggctgcgggggccaccaagccgcgcgacctccccatcgagggcaggtgagagggcattgtgggaggtggcatgctgatgcgtgggacacccacctgctcctggctttcccctcattcatcccagcgtccctgaagggcgtgcactttgccatggaattcctggccgccaataccaagtcactgctggactctggcctggaggatggcaaggccatctctgccaagggcaagacggtagtggtcatcggcggcggtgacacgggcaccgactgcattggaaccagcgtgcgccacggggcgaccaacgtcatcaacctggagctgatgccgcagccccctgtgacgcgcgccgccagcaacccctggccctactacccgcgcgtgttcaaggtggactacggccacgccgaggccgcggccaagtacggcgccgacccgcgtgtgtatgaggtgctgaccaagcgcttcatcgacgacggccagggcaacctcaagggcctggagattgtcagcgtggagtggcagccggccaccgcgggcggaccgcccaagttcgtggaggtccctgggagcaacaggggtgtccagaaggtcgtggtgccagtccgtgcatgcaaccccacatttgcacatgcacatcactcccgcccgtggaaaatcggcagttcaaatcctcnnnnnnnnnnagtctggggagaaggaggtcggcgctgcattttgtga

SEQ ID NO: 1878 - DNA, 423 bp, Chlorella protothecoides
atggtcctgctcgcaatgggtttcctggggccagaggccaccctggccgaggccctgggtgtcgagaccgatccccgctccaacttcaaggcagagtatggccagtttgcgacatccatggatggagtgtttgcagctggcgactgccggcgtggccagtccctcgtggcggcagggccaaggggccgaggggggcaggagggtgcaatgaagcgcttgagcgctttaatcatcgctgacctcatgcaatcatccctccaggtttgggccattgctgagggccgtggggcggcggctgccacggacaaattcctggctggcgtggagcccagcacagacgccaggcaggaggtcgtgggcggcatcatcccatggaaggagtacagccagaaggtcatgggccagcagctggtcgctgtgtga

SEQ ID NO: 1879 - DNA, 654 bp, Chlorella protothecoides
atgatggacacacgctttccggtccgcaccgcgggcggccgcggcaccatccagccctcctcccatgcctggagtgggagggggagaagaggttgtgaggtgtcaggggtttgctctgggtgctcggccgacgcccagagcgtggctagaagcacccaccttgtcgatgatggagacctccatggtcttgatggtgaccgggttctggttgatgcccaggacgcaggacccctcgcacggcgcggggcacaccctgcccgtgaactccgggaagttgttggtctccagcagcctgtccagtgcctcacgccaccgcccctgccagaccagcgcgttccactcggggatgagattgcccagggggcagccggtggtgcggttgaggcagtagggcgtgccgcagtccatgcaccgcgccgactgcgtgttgagcagctgcgcgtgctgctcggcgggcaggtgcgcgtgcacctccccccagtcagccatgcgctcctgcacgtcgcggaagggcagcggcgcgcgctcgtaggccttgaccccgccgctcttgaccgcggccaggccgtcgacgaccgtggggcgccccgcctcccacagcgctgggcggccgccaacgggcacgccctccgccgcatcgcgcagcaggcgctt

SEQ ID NO: 1880 - DNA, 1746 bp, Chlorella protothecoides
gcgctgctggccgccgcggccgccgccggctccacgcgccacgcctcctacgccgacctggtgggcgccgcgctggggcccggcccccgcgcggcggtggcggcactgcagatcggcatcaacggcctggcctcggtggcctacaccatcgccgcggccgcctgcgcgcgcgcggtgcgaacctcgctcgcctgccacggcgtctccgccggcgccggcgcggccaactgcggcgaccaggccgcgttgtggcgggagatcgcggcgtttggtgccgcgcagctggccgcctcgcagctgccctccctggatgatgcagcctggtcctcggccgtcggtgccgccacgtccctcgtctactccctggccgccctgggcctcagcctgctgcacgccgggcctggggcactttctaaacgcacataccggggccgcatcgcgcttccccctcctgtgatggtgtacccttcgcttcttccctgcagccacggagcggcgggggacgagcacgggcatccccgccgcgacggccgaggagaagacgctgggcgcgctgagcgcgctgggcggcatcgcttttgcgctggccttccccaccgtgctggtggaggtccaggccaccatccgggaggtccccggcggcaggcgggcgggggcggccatgcagcgcgccatcgccggctccctcctggtctccttcctcctctacatgggcgtgggcgtggcagggtgagcgcggttgttaggggggtggatggtgttgatgcagcgcgggactgccttggccagagggagatgcaggtgagaggcagcgcagcgcccccatccggtgccatggcagcggctgtctccgtgccaagctttccacacacccatcacccatcactcgttcctggccctctcagcacccccatccctctcctcgtcattcatccctctcacagctacgcggcgttcggcaacgaagtgccggacaacgtgctggcgatcccccacatcggccccacctgggtgctggtcgtggccaattgcgcggtcatcctgcacctcctctctgcctaccaggtgtacagccagcctgtctttgccgcgctggagcgcgccctgctgccggcacgggatccgctgggggccaccaaggcggggcaggccctcgtcgtttcagagacacaccctgtcgtcacgccagaccacagcgagcccgcctggcccgcccgcctcgtcctgcgcagcgcctacgtcgtgctggcgacggcgctggcggccctgctgccctgcttctcccagatcctgggcctcataggtggggcggtgggaccgatgggctcggtattgtcctggggagggcctgcgggcgagggttggcgggggtcgatgcactgccgggcaggtccagattccactccttgtagcggggtgtacacccattccgtcccctggagcacccacgctgcgctgcgtccccaaccacccaccccccgcgccaacccacccacaataccgtgcgcccgctctcccgcttgcaccaggtgccctcctgttctggccggcaggcgtctacttccccatcacgctctacctgcaagtgacgggccggcgcggctggcagcggtgcgtcctcctgaccctcaccatcctgctcttcttcgtttccctggccgtggcgggagcggcagtacacgggctggtgctggaggtgctgaggaattgagcctggatggctgcccgagcggcactgctccatga

SEQ ID NO: 1881 - DNA, 951 bp, Chlorella protothecoides
atgtccaggaatgttggggaatgtcggcgaggatgcacagcagcaggggtccaaatcgcgaaagctgaatggaacactgcattcggacacaagtccttttctctcctacatattaaggctcacgaaccacgtttgggcgcatatatggtcgacttttacaatatcgcagtgcgcttgagtgtttcagcaagtctcaaacagcagccgccgcgtggatttggtagcacttttgccggagagctgccgggcacatttcaacctctcgttgaaactctgctcgagattttgcggtgcaatgcggcgaacaaactggacgctgcatcgtctgtacggtcttctttgcctcctggcttgcctcctggcgccctgcttcgcggacaggtgtgcttccaagttcctcgccctccccacagcgaggtaggtcgcgatcacgggagtggggtggtagaaaattcggaccctcaatgtgatgaggtggcattgcgtttggagtacaatgggcatcccatctcttgcaccgttgaccgcacttgcaggagtctcgggtactcaggagtgggaagccaactggaggttgagctcagccacctcgtcggcagcaacatgtctgccctgtcccttgcagaccaggaggtgtgtcagcagcccccctgcagagtgcttgccgctgtggagtgcctccctcctggccggtctgcctgcgtggctgacggccaggggaacattgggtcggggaacacgggcctcggcaactttggcaatgacaacagcggcagctacaacattggtgagctggaggaagaggtcgtggtgggggaggcgccaagggcacccggctgtggtatgtatggacgctttgaggctcaggcgcgatgttcaggcgtttcctggctctgcatcctggtgctcctggtcaggcctgtgctgactgacatcgccctgcggcagtga

SEQ ID NO: 1882 - DNA, 1620 bp, Chlorella protothecoides
atggggcatactgcttcaacaaatcaagcacggcagtccagatgcatgctaggcaatgcaaacaatccaaatggaacaccgctagaacgaatcagcaaccagaatttatcatcgccaggctttcgctaccaattaaaagcacctgtgtctcgatgtccttggcggcaaatgataccaggagctcttgctcttgtggcagggaaaacacgaccccgggcactcttcccccctgcaaagacgatacatcgagtggtatattggcattaatcctcacgcaggaaagccttcagctgcgtcagacctgagcacagaatgacacacacacaatactcacccttggcttccaccgcggtgctgtatcgcactgactggcaccatgtactccctgatatcgagcattctgctgcaggagatgagatatatagcgaccaggctcgtcccagcgcccgacgagccatcagtgctggccccggctcgtcacgcggtgctaccgtgactcaagaaggcaaggtccgtgctaattcaccccgcacggcaatcacctcgcgcccagtaccgggtcctcgctggcttgccggtaccacaggccctcgtctgaaagggttgtgtgcagcatgcgcgggatcacgaccctgcacgagcgaggtccggcgggaccctacatatcataaaaaagctacgattgaccagcgtcgcgggttcgatccacctgaatctctggtcacacctgcgcgaccggagacccacgaagcgatctcgacggtgcagtgcatggcgcgggctcgtcgcctcgagccggggccgcgtctggtgctcgcgctgtccctcctcctccttccctcctcggtcatcggcacatgcgagggaggggcatgcgccggggatcacgcagctgccaccgcagctggcctgcttgggagcagcgcccagtcagggctgggcgcatgccagccgaagaagtacccaacctccggctccttgatgcccatcacgctggacacccaaattctggaccttgtgtgggtgaattccactgagggaggccagcctcacgtgtatgcagtcacgcaggacagcgggggcttcctggggggtcccctgtggcggtctgaggagcctggcagggctgaggcctggcgcgacataaccccaatgctgacaggcacgatgggagtggggttgtgtcttagcacgacatctcaatgtctcagcgtgccatccaacctctcccctccctctcaaatagacttggtgccaggcaaggtgtcgccgtactttggcatcacaaatgtgctggtgtcgccggcactcggccagcacattctcctgcagggcagggcccacttccacttcacctccagggacggtggcaagacgttcaaggccatcggcacccctgggaatacgaccggattcgaccaggcaggcgaggttcgtgagcacactcatcttgcctcaggaacagacttcaaactctctatctctcgattcctggccctctcgtgccgcaggagatcctgttccaccccaagcagcctgagtggattctggccaagacacgccgccccagctgctcctggtacatgcggagctccgcctgcggatacgatctatacctga

SEQ ID NO: 1883 - DNA, 822 bp, Chlorella protothecoides
  modified_base (41)..(50): a, c, t, g, unknown or other
  modified_base (125)..(134): a, c, t, g, unknown or other
  modified_base (573)..(582): a, c, t, g, unknown or other
atgccaatacaccactcgatgtatcgtctttgcaggggggnnnnnnnnnntctccagctgctgcgtctgggccggacggggtggggctgccacctctttgacgtggcagtgatgaatggcgatgnnnnnnnnnnccaccagctgctgcgtctgggccggaccgggtggggctgccacatctttgacgtggcagtgatgaatggcgatggcaagaagatgacacactacccagcagtggtgagagggtggcttgggagggccacatgggcaacgagatactcaaccgacacggatgtggtggagaatgtcaccctcgtccactgtcctccggatcggcatgtgaaggtcgcagtacccatccaggtgggagcatgtgtgtggggccggcgcgaatgtgacttgcctcattgccctgctgcgaggaatgcctctcctctttcgctgggctgggctgcttgggctcaggcagcagatggggagcactgcaggtgttatcctgccacccatgtcgcaccctgcattgcgacggctaccattgacctcaggctgcccctgcctctccccagatcttcnnnnnnnnnnattcgctgggctgggctgggtggggtcaggcagcagatggggagcactgcaggtgttatcctgccacacatgccgcaccctgctttgcgacggctaccattgcccccaggctgcccctgcctctccccagatcttcggggaggaggtctgcccggggctgaaggcgggggggcgcatcaaccatatctcgaggaaggtccgagtgctggcgcggggcgactccatcccggaaagctttga

SEQ ID NO: 1884 - DNA, 618 bp, Chlorella protothecoides
atggctgactatcctctccccccatatcaacacaccactccaccaggcaaccagccggaggccgtcaacctctgggtgggcgacgagcggtctgtcacctcgtggcaccgcgatccctacgagaacatgtacgtggtggtgagaggggccaagcgcttccacctcctggcccccgccgacggctggcgcatggccgtgcgacgcgccgaggtgcactgctgggaggcggcgggccccgggccccagaccggcctggagctgcgacccaccggcgagacgacggcgtggtcctcggttaccccgccggggactgggcggggagaagcaggtatcaaagcagtggtgtcgcgagcagcggaggctcccggacccggcgcccctggggcaaattctgatgcccctgggcacttcgccgaccccttcctgccaccgccgctggaggtggaggtggggccgggggagacactgtacctgcccgccgggtggtggcacgcggtggagcagtccccggacaccatcgcggtcaactactggcacgaccggcactggggcgcgggcgtggcggcggccaccgccgtggaaagcctggcggtgctggcgggcctgtcggaggcgtga

SEQ ID NO: 1885 - DNA, 762 bp, Chlorella protothecoides
  modified_base (54)..(63): a, c, t, g, unknown or other
atggagaacactctgtatggcaatttccgtgcaacatccatctctaaggaggannnnnnnnnnacgtccgggatcccgcactccgtgatggaggacactctgtatggcaatgtccgtgcaacatccatctctaaggagttgcttgtgtcggtcttgcgacagctgtccctcgatgctcgtggtgaggcaatgtgtgctgaaggtggtgggtatgcagcgtgctggcctgcatcccttcactctgttctcattggacaggtcacaacggtcctccatgtactatctaccccctcatcttgtgcagagcttgatgtggggagttcagttcccatgctggagcaccctcccagcgccctgcagttttgcagggagtatgtaggccccaatcgccctgtgctggtcaggggggctgtgagtgagtggcctgccttgacgctttggaatgaagagtacctgatcagagcactgggtcccaccccactgaccatctcgaccacccccaatggccgggcggacgccttggtccctggaccagatggcagcgccctggatcctgacacgggcaaccctgtgtttgccctcccgatggagagcaaggtggacattgcgaccttttaccagtgcttgaggaggagggacggcgcctcgcccgtgccatacctgcagtaccagaactcctcgctctcggtcgaggcgccgcagctcctggttgacgtcgccccggagctgggctgggcatccgaagcctttggtgaggcatga

SEQ ID NO: 1886 - DNA, 720 bp, Chlorella protothecoides
atgacggagcctgcatccccagccctgccgtgggcctcaaggtccagactctcgccagctcccagcgatgccattcggctggatgtgggcaccaggatcgaggtgctttggcaaatagactcagaagaggacagtgatcccaagttgaagtggtggccagccacggtggagagtgtaggatctgagatacaacacggcacggctggacctgtgcacaccctcaggcgcggtttgaaggctttgattgatatgaagccagcagcgaggacggattcgatgatgaagatcacgtccagtcctcctgcaatcaacatctttccatcctgtcacctgacacctgctgcagatgcgatggtaagtctgggatcttgcgatccggagtcagggtcgatggacctgatcccagagcatctgacatggcggcgggccggcgagctctggcaactcgctgatgaggaggggaagagcaccggcgaattctcaggcagcaaggaggggcattcgagtacgtacggacgtcttgctgctctcaatgaggacaatgatgcgaatgaaggcgtggtgaggctgcaggagatcgccgcagccataaccgagcgcgagcgcctgtgcggaagctccgtggacgcagagtgcgcagatgctttgagtgctctcccagcctcccagcagcgggactttgctgcagggttcaggcagttcaccgacgcaatcatgtag

SEQ ID NO: 1887 - DNA, 615 bp, Chlorella protothecoides
atgtcatcgacaccgcagccgagcacattcttctctccgtgggagccacccccaccttttgcccaccctccacccgatcccgccctcgctcaacgaatagtcaagctcgtcgaatttgcagtcagaaatggtccaagctttgtggacctggctcgtcagaagcaggctggcaacccagagtacggcttcctgactggtggtgacggagcggcttttttcacctggcgactctttgcggccgtcaaccacctcccggccgatcagccccttgctgccggtcagcatgcagcactggcagctcctgcagcgcctcagcctggcgctgtgggcgctgtatccagcagtcccagccccgccctgcccccggaggtggcatcaggatggacgcaggtcctggctgcgctctccgggtcgcatacctccatccgtgccagccaggagtggttcatggcgtgccggcagcacgcccagggcatggcggagatgatgctgcaggtggggtatggtggggttggggggctgatgattctggagaccccgaccggctcgcgccgagccaagggtatgtatgcagatgcaagggcggttgctggtatgctgggttgcacaaaatga

SEQ ID NO: 1888 - DNA, 453 bp, Chlorella protothecoides
atggctcccatgtactccgctgctggttgttctctacccgacggtccgttgggatgctggtgcagcccacagctgtcttggggttcaacttggttttgtctgggccaccaagccaagaggcactggaaagccttctgcacatcctcgactcgtcatatgctgtgccaggactcttccccccatcggaaccatgcaggcttgatacccaaactggtggaggagagcctgaaggttgacccgccctactccccgctcaccatccgggcggtcagcgaggccggggtgccgccgccgccccaggtggatgtgtacctgtccgcccgcctggacaagttctacgcccagattgcggtgagtacaagagtggtggtcaattatgtggtcgaggcacagggcgcacccgcgccaggctgtaggatggccgtgttgaatcacagacaacctcctggctga

SEQ ID NO: 1889 - DNA, 1341 bp, Chlorella protothecoides
atgtacgccaactgcattccccgacaccccgacgccccaggctgggacaaggacctacactacgtggtcagcctcgacttctttgtcagccccgtggcgcgcatggtcccctgcggcaacctgttcgaggtggtggcctccaaggtcttcctggccgtgccctccgactgcccgctgggcgccgacggcaaggcacgcagcgtgccgtcccgcagcgtggctgggcgcaccgtcacgctctacgtctcggactgggacggcgacgacttcactgaggtctgcctgcccagcaacctggaggacgatggtgaggggcccggggaacggggggacttggggttgcgtgggtgcgtgggtgatgggtttggcaaacggtacaacatggtggagacccacgacagcgcggcggcctttgtgctggcggaccacgccgagccggggagtcggggccccacctccgactcgcccacctccgacgcctacgcgccggcctacaacgcctccatgcacaccctgtccctgcgcaacgtcttccgccgcgacttcctcgccgacttcatgcgcgtggagggcctgccgggcatgttcatcgccaaccgcgtggacccgttgacggtggccaccggcgccgtggccgactacggcgcctacctccagacggtggccacgcgcaacggcggcgcggactggtcccgcctgcccctccccacctccttccgctacgcgcagtgcgacgcctgccccgccggcgcgctgcgcgaccgctgcagcctgcatctgcacgggccgacgtcgtgggcgtcgccggcggggccgcgccccaacctgtacagctccgcggcggcgccgggcctgctgctggccacgggcaacaccggcctgcacctggacaccaagccctcggcggcggcggcctgcacctgggcctcgcgcgacggcgggctgacctggcaggacgtggcggaccggccctacatctacgagatcggcgcggggggggacgcggtggtggcggcggggcacgcctccgacggccccaccgccaaggtgcgcttcaccgccgacgccggcgcctgctggcacgaggtggacctgccggaggccatcctggtgaccaacatccgcgtggacccggcctccgccggcaccgtggcagcgcctgcacgcgcacgactcggcacccggactgcaccttccagggcggcgtgtcgccgccgggcaagctcttcgtcatcgacctggcccggctgctgggagcggacttccgcgcctgcgccgacgccgactacgaggactgggccgcgccggcgccgggcacgtgcctgctgggccgtcggctga

SEQ ID NO: 1890 - DNA, 390 bp, Chlorella protothecoides
atgggcggccgctggtatgctgggttgcgcaaaatgatttgccccgcgctcaacgcctccatgcacgccacaacgagcgcgcaggcatccaaggccacacaggaagctgccaagcagctgcacctcctgtacctcgcgaacgacgtcctgttcaaggcgctgccctcccggcccaccggctccacgcccgaggccgacgccgtcgccgaggccttttgtccccggctgggcaccatgctacggcatgccttcctggcaggcggccagacagacgaggtgggtggtcctccaaccctcgcggggtggggtttgaggtggggtgtcagcgcttgcaaaatcaagagcagcgtgaggtgtgggtggacgcccgctggaatccttggagcgtag

SEQ ID NO: 1891 - DNA, 888 bp, Chlorella protothecoides
  modified_base (250)..(259): a, c, t, g, unknown or other
  modified_base (486)..(495): a, c, t, g, unknown or other
  modified_base (726)..(735): a, c, t, g, unknown or other
atgccagagtacgccaacaagtcggtggaagagctgcgacgggaagattacgaggacggctgcaagggcggcgcgggcgcccctgccgccggcagcggcatgtttggcgcagccccggcttccgcgccctccgtcttcggggcggcgagcgcccccgcgtttggctcccagagcccgtctccgtttggtgagtggcagagggggccgcccggcagctcgcgtgaggggaccaaggcagggagaaggtccnnnnnnnnnngcccgtctccgtttggtgagtggcagagggtggcgctcggcagctcgcgtgaggggatcaaggcagggagaaggtcggggacgccgtgctgcatgctgcaccatcacggatctccagggccggatctcgctcgcgtctgtggcaccctggtcctgggtttcgatgtgccctgtccctactcctcccgctggcatggcagctggtccgctcccaaattacctctcccnnnnnnnnnnaacaccttcctaacccccccccctcccttcccaaaggcggcggcggctttggggtggcctccacacccgcattcggccaggccgcctcttcccccgcctttggctccaccagcgtgtttggcggggcgccgcagcagcagacctcggccttcggggccacgtccacctttggcacgacgcaggcgcccgcctttggcgcagccgcctcggcccccgcattcggcgggttcnnnnnnnnnntggcacgacgcaggcgcccgcctttggcgccgccgcctcggcccccgcattcggcgggtttggcacgcccgcggcctccgcgcccgcctttggcggcttcggcgcgccgcccgcagcctccgcgccggcgttcgggggctttggcgcggccag

SEQ ID NO: 1892 - DNA, 906 bp, Chlorella protothecoides
atggaagctgtgggaggccgggagggcgctctactcctggtgccctttgccaggcttgtggatggcaagatagggtcccaggacagctcaggaaggtcaccgcatgccgggcaccttaaactccgccctacctcccaccatccctgtctcccgcaacgcccccaggtggcatttgacccgctggacggctcctccgtcatccccgccggctgggccgtgggctccatcttcggcgtctggcccgggtcgcagctggttggccgaccggggtcggaccaggtggcggcggcgtacgctctgtacgggccccgaacactcctcgtggtggcggcggcgtatgccctgtatgggccccgaacactcctcgtggtggccaggggcctgggcggctcgtccccggtgtgccaggagttcacgctgggcgagggtggggcgtgggccctggcgagggacggcatcgccatcggggacggggtgcggacctttgcgcctgccaacctgagctgtcggctcactgccccccgcactcctcactgcgcccgagccgcccgcagggcgagcgccgagaacgaggcgtatgggggcctggtgaggcgctggctggaggagcggtacacgctgcggtacagcggcgccctggtgcccgacctgcaccacgtgatcaccaggggcgggggcgtgttctgcaaccccacctctgctggggcgaagcccaagctgcgcctcctgtacgaggtggcgcccctggcatacgtcaccgtggccgcgggcggggcggcgaccgacgaggcggggcccgccctcgacaaggtcatagcagagcatggggccaagggtcctgtatgtctggggggtaaggcagaggtagaggcatgtcaggaggccatgcggtcgtctgtggtgtga

SEQ ID NO: 1893 - DNA, 432 bp, Chlorella protothecoides
atgcgtgccgtccgtgtgctctccctcctcgtgctggccattgtggcacggtgcacctctgcggaccttgagggcacgtgctggagtctggggccagctgaatgcttcctgcgtcccggatgcgagtactgtaacttcttcggtcgcaagaatgtctgtatctgggatgccgtcgccgagtacattcccacgagcattgctaattgcacggtcaccccgggcccaaagaagccggaccatgcgtgcgatgcgtacgcggagcaggagccttgcaacggagcacagggctgcgtctggtgcatcagcgctgcagtaaagccagcatgctatccccaggatgaggcgaagctgctcccccccgcagtcttccagtgcgacgccccgtctctgctggagagcctggtgtcccgccaccgcagggacatcatctga

SEQ ID NO: 1894 - DNA, 600 bp, Chlorella protothecoides
atggcggagagcgtgcgcgggctggagggcaaggggcggcggctgagcgtggtggccgaaactgtgctgaacgacatcaacagcaacttcagtaactcctcgggcgagctgcagcgcctgctgcccatccagcgcaagctgactgaggtgcagcaggacgtgaaggacctgctggaggccctgacctgcatcgtggaggacgacgtgcagctcaagcgcctgtgcctgtcggaccgcgcggcggccctggcgagcgtgccgggggcggcagggcccggggcggtcgccggcaagcggacgcacaagccggggttcaaggagctgaggggggcggagggcgggtacagcaggaagggggacggcgctgggcagcgcagccccgccatgcgtatggcggcggccatcctggagtcctacgagttcaaactcactgccgtgcacgtgagtgatattgtggagtgggtagatcttgtagctggcttgcgacggggcggggggtggcgttcctggagggccttaccacagttacgtaccgctactcgcacagctgcacgaggctgtcgctggacctccccctttcccctttccccacccaactga

SEQ ID NO: 1895 - DNA, 1440 bp, Chlorella protothecoides
  modified_base (227)..(236): a, c, t, g, unknown or other
  modified_base (790)..(799): a, c, t, g, unknown or other
atgcgctgttgccttggccctccagctggtggagtggctgtggtggtgccaggcggctgcggccggtcggccagagtggcaggcaagcacatcagccacttggtagctgggggtgccgcctggctcattgctttacttgcatccatgctggcccatgcgcccactctccagcttgggtttcttccgactccagacgatgaaagggcagccacatggcgctggaaagnnnnnnnnnngtgctggcccatgagcccactctccagcttgggtctcttccgactccagacaatgaaagggcagccacatggcgctggaaagccgcggccaggttccggcccctatccaccaagagtttcagcctcatgggaaggggaaactaacgccacacatcatgttgcattgtactttgtgagcctccttgatccgagcataggtgagaccggggtgcggcacccctgggtgtcgaagcttggagggaggaggactgtgcctggagccagcaggtcatgcaccccggccttcaggacccccccggcgacccctcttccgagagcgccgagtcggagggcgcgaagtccgaaatttgattgcgcagctgatcgcgggtggtcttcaggaagacctgatgggcagggaggcgccacggctggggccccgaagacggtcggctgctacaaatgtgggcaaacaggccactgggcacgagactgccccgggagctcgggcgctgctcgacttcaaggcggggcagcagtggccgatggtcagctgggactcacgcccgggggtnnnnnnnnnntgggtgagaatgtgcctggagtgggccatgtcgggaggagctctcaagagacccaacattgtcagcggagtcactttattctggaccatccaggggttcttaccccaggacacagagggcacgtgccatgtcatgcttccctcctcttcctgcacagatccacccctcccatgacggacgccggcaaccctccgccggcggtggtgaaggagaagcgcaagaaacggaaattgaccctggacctgctcaaggagacacggggtatcccagacgtcttccacaccttccccgacaccttccgaaagcagtgccgggggaagggccatgaggcaggggacctgcgccgcctgctggagatgtacatcagatggcaggtgggagtttgtgaagtgcatcaggggcttctggacttgcttgcctgcatgccaggccgacgaccaggagatcacggggacagcaaaagtcatcctgaggagtatgcagagggagatcacggggacagcaaaagtcaacctgaggagtatgcagagggtgtgtgcagcatgctcttcttgcctgaggctgtagtgaatggaacagcactcactcccttccacccactgtcgaccccaggaccgggtgttcccgggcgtgccctttga

SEQ ID NO: 1896 - DNA, 2472 bp, Chlorella protothecoides
  modified_base (1450)..(1459): a, c, t, g, unknown or other
atgacgctaggcaagcgccaaaggcgcgccaccgaggcagcgcttggcagccatgcatcacctggctacttcatcgccgtacatgcaggtgcaggcttccacagcaagtcgtcacagcctaaagtagcccgcgccctcagggcagcatgcagggctgcaaggaagaccctgcgagaaggtggtactgccctgcaggccgtcaccaacgccatctctgtgctcgaggtgcgagtgagggccagcgcttgtggtcgtggggtgtgggcggggcactgtctgcccggccgtcatctccattctgtgccccacttcccatgccatgcaagcccgtcccatccctccgctcctaccctcaagcaggatgacccttcatgcaatgcgggacgagggtcgaacctcaccttcaatggcagcgtggagtgcgacgcttcggtcatggctggcaccgcctgctatggagcggtggcggccgtgcccgggattcgcaaccccgtgaaggctgccagcctgctcgccggggaaaccctggagccgctgccatgtggcctgatccgacccacggccgccacatgcacggcatgggccattgtgtgttgtgctatgtcccagccccatctcgccatgccccattgcaggatgctggctggcgaaggggcgcgcgtctgggcggcacagcgtgggctggaggctgctgagagccgtgagcaggcagcccagctgcctgtgccaattcccatcctgatgcaagcgaggcccacgactcacagctgcagcctccgccatgttccccacaaacatccaccctgccaccagatgcactcgacgccgcgcgcggtgcgccagtggcagaccttccgagccatcctggccgatgccaccggcgagtactccggggtggtgttgccggactcgcagcagcagcggctcttcgacaccgtgggcgcggtggtggtggacggcaggggccacgtggcctcgggcgtcagcagcggaggcattgcactgaagcaggagggccgggttggcgaggcggcgctctacggcgcggggtgctgggctgaggaggaggagggaggggcaggagaggaggaaggggcaggagaggaggagcagcagcagcgtgagaccaaggagaaaagcgggggaaggaggttgcgcggagagactggggcctccgaagcggcgcctctgggctccaaaaccaatagcatgcacggcgtcgcggtgagcaccaccggggtgggcgagcgagtggccgcctgcctcctctccaagaccgccgctgacgctgtgcgggccgctgcgggcgaccaaggggtgagcggcgcactgcgcagcgccttgagacgctccgttctaaaggtgtggcgtctgggcccgcagtggcaaagaggagttgcagaagggtaccccttacccattgtgtatttccagggccggcaagattctnnnnnnnnnnaggagttgcagaagggtaccccttacccatcgtgtattcccagggccggcaagatgcactccctgcgccggcccgcctcacacacatttctcgcccccgatccctcaacaccgcagacaccgccgccaaacgacgccggggtgatctgcgtcctggcccagaggtctgagcgagcgcacccagatcagggctgcgaggtcagggtggagtttggcgcggcgcactgctcccactccctggcggtggcgcactgcggggcaccccgggcggagcccagcgtgcacttcatgccggcgctggggagcagggacggccttgacccaggggcgacgggctcgcgcccgggccacgtcgtggagctggcccagagctgccgctggaatgtggaggagcgggtccgcctgctctatgcgatggatgatgtgcacggtccagtaccacctgcggggcttcgtggtcccgacattccacccctccaccctggcctccaggcagccgctgcccctacccccggccccccaaactcccgcctcaggccaggcccactagctcctcgtcctccagcgcggccagcatggccagctcgtcctcatcagcgtcggggatggccagctcctcggcctcggtgtcggcgaggtcctcgactgccggcagcgcctgctgcaccagctctgcgcccagcagctccagcaggtcctcgtcatcctcggcgagcgccagcagctccccctcctcgccgggcgggggtggcgaggcgtgcggcgcggcggccgtgtcggccccgtctccgccgccgggcttgcgggcggtggcctgggccatctgggggtgggggagggcgaagcgaggagcgaggaggtgaggaggttgcctggtgtgctttgcgcagaagcccagggaaaatctgggatgcagagcaggacccccaccctgcgttcatggctacttctttcccccagcccgtggggcaaacaggcaaggcaaaagctagcaggtctcaagttctgccatga

SEQ ID NO: 1897 - DNA, 285 bp, Chlorella protothecoides
atgttcatgtttgtggtgaactgctccatgggcaccgggctgctcatgggcgggatggtctatgtgtactacaagttcggtcccaagcggcgctacaaggcccggctcagggacatgcgctcgctcagggatctcctggtgttccacatggacgacatggacgatgtgatccaggagatcaaacaacgcggtcaagtgaccaagaccgaatttgctcagatcgtcagagagtcgatccaggagagacccatgcccaggacatgcaccaaatacatcccttactga

SEQ ID NO: 1898 - DNA, 183 bp, Chlorella protothecoides
atgctggcggtgcgcaaccaggctgtgctgctgaagacggagacctgtcgcgcggtgctgtacgccgaccgcgccgtgctcttccccgcacacaagacgcgggccacgctgaggatcgcacagcaggtcaagagcgccgtcggccagcgctctgtcctgcccttcgagctcaaggcacggtga

SEQ ID NO: 1899 - DNA, 303 bp, Chlorella protothecoides
atgagcgaagccgtgcgagcgtatcgaagtctgctccgagcggtgaagacgcacgtcagctcctccaccggcaacccggccttccagcaatacatcagcacgacattgaagcagcgagcacgggcaggaggcgaccccgagctcgcccgagactatgcattcctcctgaacagcattaccgagcataaggacttgctcttgtcatacaacatcggcatcgacccggagcagcggcaaaaggaccagtacaagaaggccgcgtcgcgtgttggtctgtccctgccagagcaattttcaggctag

SEQ ID NO: 1900 - DNA, 900 bp, Chlorella protothecoides
atggagcgaagggcaagcatcgtcgtcaggtacccacccaaacagagtgccgtctttatgggtgatttctcatgctccatcgctgatgcccccgccgctccccatgcacaggccgcggcactggcccaggagggacccaagcctgtggtggcctggatcaaccacttcatgtacggcacccaagagtggtaccagctgtcctttgcggcctacaagaccgagctggtggaggccgcgggtggccagaacctgaactacaccgacatcctggagattgagggtgtccagcccaccgagttctcgccttccgacctggcctttgcctggggcaccaacgagacctttgccaaccagaccctcgccctggaggccttcctgtcagtcctggccgaggtcgacatcgtgatcgacgagacctttgttgccgacccctccacctaccacctgggcgagttcctgctgcagttctccagcgaaggcgtcttccctaccgccgaggacgtctggttctctgccggaaagatcctgcgcacggacggcctgatctccgccgccgccggcctggactggtacgagggcgccatcccccgccccggcaaggtcctgctggaccttgtgtcaaccacccgccccgaggccctcaccgtgagcggcatcgtgcgagggaggggtgcaacgcacacccccatctggctgcgcaacatcaaggacgaccccgtcgtggtgaccgccgccgactgcaccaccgccgccaacggctgcagtgccagcccctccaccatctgccccttcatctctttctgcggcaacgggtcgcccgtcctcctggagaccaacctgacgacgggggcgctgcccacggggggcaagtgcacttacgccgcctgccccgccgcatga

SEQ ID NO: 1901 - DNA, 813 bp, Chlorella protothecoides
  modified_base (493)..(502): a, c, t, g, unknown or other
atgctgacggccaccatcctggccgacctcgcctccgacaactggctggtggtggccaccgcgctgcaggccgcctgccgcggcgccacgccggagctggtcacagccttcctgccctccgtcaccgctctgctcgcccacccggcccccggcgtggcgcgcaaggcgctgctggccctgcaccgcttcctccagctggacccgggcgcgggggccgacttggagcgcacgctggtggagcgcctgggacaccgcgagccggcgctgatggccgccgcgctggcaggcctgggccagctcatccgcgccgaaccggggcagtacggcgcgctggcgccctacctcaccgccatcctcaagcaggcgtatgaggggaagctgggccgcgcgttcgagctgcaccgcgcccctgcgcccttcttgcaggtgcggtgggttgtatattgttttgggggggaggggacggcgggggggaggggaagcgaggcactcnnnnnnnnnncctgcgcccttcttgcaggtgcgattttggatgccgaggcgcgctccctgcgcacctgctcggaagccaggcgcgcctgtgcaaggcgcggcgacgaccgtgcgctcccgcgaccgcccaccgacaccccgcccggcgcagatggagctgctgcgcctgctgcgcgcgctgggcgaggcctcgccctccgtctccggcgacgtgcgcgcggtggtgggcgaggcgcagcgccgcgccgaggcgctggcctcgccgctgggccgcgcggtggcgctggagtgcctgcgcacgcgcgcggcgctggcgtcccc

SEQ ID NO: 1902 - DNA, 975 bp, Chlorella protothecoides
  modified_base (703)..(712): a, c, t, g, unknown or other
atgccagacctgtatgccatcctgaagtcgacggagaagctagagcgggcgtatgtgcgggacgccatcagcgccagggactatgagcccgcctgccagcgcctcatcgcccattaccgcaccctgtggagcacggtgtcagagagcgtgcccagcctgcagtccttcatggccacctacggcatgcagtgccccatggcggcgcggcgcctggcccagtcgggcatgcccgccaccgtggagcatggccgggccaccagcagcggggaggcagggtacaccgccgccgtggcggatgccgtgggccagttcatcaccaccatggacgccctcaagctgaacatggcggctgtggaccaggtgtttcccctgctctcagatttgacccagtccctgaacaaggtgggcaaggggatggggggccagtatggccatctatgcctctggggcggagaggagtttgcacaccggaagtcatcggtctcactgctcaggcacggcaaggagcgctccatacccttgagggtggcagacgtggaggcctgtggccggatttcgaaaacagtgctgctcctttaccaatcaaggctgctcttgtggtcatgctgtggatcgccctccccactcgtgatcctttgccaccgtgacgaaacgccagcatccccttccttcttcgtgcctccaggtccccacactgccactnnnnnnnnnngatcgccctccccactcgtgatcctttgccgacgtgacgaaacgccagcatccccttcctcctgcgtgcctccaggtccccacactgccaccagacctgcccggccgcctgaagctcaaggcctgggtgagcaagctgcatggcctgcccgccagttacgagctggacgagggcgaggcgcggcagctcctcttcgagctggagggggcatacaacgaattcatggcccacctgccccgatgagggaggcgggcagcccatga

SEQ ID NO: 1903 - DNA, 1815 bp, Chlorella protothecoides
atgcagcaggggctgcgcgcctgcaagaccgacgcgcgcgccgccgccgcgctctggcacgagtactttcgcctggagctcctggtcgcggcgcgcctgagggcgcgccgtgcgctgctgggcatcgacgggcctgctggggcggggggcccggcggaggagcagggaaagacaggagatgccacaacagacggggcagggcgtcccgacgaggcagcggcggcgccagctaccaaagacagcgaggccgaggcggcgctggccgagatcatgcgcggcggcatcgcgcgagtggtcatgcgctccgcgctggcgcaggcgccgcgcgacgcggccttccgctcccgtttcctcgacatcctgcaggagatgggggatgtggcgagcaggggtgggtctcggagacacggttggccccctctcactctgcaatccctcccccggattcccactgctgccgtcgacgccctgctcgtggtcccgcaggaggagatctacgctggtctggcggctgacctgccagagagcccgcaggcgtgggcgctgcgcgcccggcatgctgcaccgagcggcgatgctcgggacgccattgccgccgggcttgaggtatttgagcggggcctggccgccgcgccctcccccggcctctactccgaggcggtggagttcctggtgcaggctctggagggcgacgctcctggcgccgacgagaccctggccacggcgtgcgagctgtgtcgcagggccggcgaggcggggcatggctccgtgcaggtgctgctgacctggagccagctgcgcctgcgcgtcggcgacctggcgggggctgctgaggtggcgaggaccgcggcgggcatgctcccgcaggcgcccgagctctgggagaccagcctgcgcctggccgtggcggtggcggcggcggcgtctgccagccgcgatgccgagcaggccagcggttgccctactacgtcccatggagacagcagtggcgatgacgaggaggccgatgcgccgggaccctcgggccgcgacgacgcgctgatcggcgccaccctggaggcggtgggtgcctgcccgaggagcgagggcctctggctgctggccgttcagtgcctggtggccgccgggcacaatccaggcatgctgcggacccagctcgaggtcgtgctggcccagggcccgcgggggcccaccgaggtgaggaacgaggggggagagcggggcggcatgggagcggtggcggcggcgctgttccgggcggtggcgctcgtgaggtcgccggcggctgcacggaagctttacgcgtccctgaggcacctgccctcccccggcggggagttctggcatgcggtgctcgacatggagcttgaagcggccagggcggggcgcggcgacgagctgccgcggccgcgcatcctggcgctgtttgaggtgggttggggcggcgagggcgctagggtgattatggggctttccttggttgccatatggcccaagttggggcattccctcccaacccctgtgcacaaggagaaccagtcctcgagtgggagcgagcgcgcatgtattcacggctattccccgctagccgctgccaaactcggctccatgctgatcgcatataaacctcgcccatggccacgcaggctgccgtggacgcacatgggcaggaggacgccgacatgtgggtgcggtatatgcgctactccgcccagccggggtccaagggcggcaccgggtccgtttactggaaggccgtcagggctctgcagaggcccgctggattcgtggagcgctgccagctggagcgactag

SEQ ID NO: 1904 - DNA, 858 bp, Chlorella protothecoides
atgtctgtgtttctgcggcgggctggggagaggggcattgggcatcctcctctgggcccaacagcacccaccggcccccacccaagaccgacgctcacgaccgacctgagggaagcgcttgatccaccggatcaccgtgatcgcagcctctccggcatcatacagctccaccaaccgatcagcaggcgcggtgcggtggtgctggaatgcctctctcacgttcctggcgatctttcgctgcaggggtggaggtgtcaaggaggacgcttccctaataattctgcggtacagatgcagggagggagatgcagacatgctttcgccccgtttggggacccaggcgatcactttgtgggcgagttcgtggggcacgggctctggacgaccatcgtaaccaggacctgctggatcgcggggcaggtgcgactggggagggtgaactcccaggatggacacgatgcaatatcgcttgcatctgtgacgaggccgatcacaatcctacaaccaccaggtttgcgtggagtgtcggccgagcaggatggccggttccgcaacaaggagctccggctgatgaagcagatgaagttccctgaggagtataagaccaaggtggacctcagcagggtaaactgggatgtgatgaagccctggattgccaagcgagtgacggagttgctgggcatcgaagacgatgtcctcatcgggtacatctttgggcagttggagggtcagaagaccatcgaccctcgcaagctccaaataaaccttacaggcttcttggagaagaacaccagcctcttttgcaaggtgagcagagttggagagggagtggagtgtgctgtctgtactccagagtaa

SEQ ID NO: 1905 - DNA, 330 bp, Chlorella protothecoides
atggtgcaggccgattttgcggccacgctggcgccgctgctgggcctgcccactccctactgcaacctcggcagggtccatcgcgacctcttccaactcggggcttccaacggcaaggatctggaaattgctgcatgggcaaatgtggagcaggctctggaaatcgccgcatgggcaaacgtggagcaggtggtgagatacctggaggcgtatgcactcgcagcgtactttcccaagcaggtgcttggccgggtgctgcaggagcatgctgatcttctcggtgatcgcgagaccagcaagaagggaagcgaggctgaggccggcaggtga

SEQ ID NO: 1906 - DNA, 1278 bp, Chlorella protothecoides
atgttggctgtccagcgggaggccgcgaggggcctctcgtgcctggcccggcggatgttcgtgtccagcgcggtgtccgcctcggagctcgagggtgccacaaagacctctcagcccgccccagaggtgcagctggccgtggaggccctgcgcaagcgcctggcagagggtatgcaggtggcccgtgggtttctgggagtggatgtccgtccgggatacctgcaccatgaccgtgcatggccctgcgctgcgatccacaccaccctctccctttgctctctcgccgcaggtcccgatctggacaccttcgtgcaggggcccgacctcaccggctactctgtccatgcccccgcaccaaaggagcgcgcgcggaagcccgactggctcaagcgcgaggtccccggcggtgccaagtacacggccatcaaggccaagctgcgcgagctgaagctggccacggtgtgcgaggaggcgcgctgccccaacatcggcgagtgctggggcggggcggacgggcacacggccaccgccaccatcatgctcatgggtgacacctgcacgcgcggctgccgcttctgcgcggtcaagacctcgcgtgcaccgccgccgctggaccccgaggagccggccaacacggcgcgcgcggtggcggcctggggcatcgactacgtggtgctgacctcggtggaccgcgacgacctgcccgacggcgggtcggcccacatcgccgccaccattgccaacctgaagcgggagacggacggccgcctgctggtggaggccctggtccccgacttctccggcgaccaggcctgcgtcgaccgtgtggcggcctccggcctggacgtcttcgcgcacaacgtggagacggtgccccggctgcagcgactggtgcgcgaccgccgcgccaactgggagcagtcgctgcgcgtgctgcgccgcgccaaggagcgcggtgttcgcgtgaccaagacctcaatcatgctgggctgcggcgaggcgccggacgaggtgaccgccgcgctgcgcctgctgcgcgaggcgggcgtggacgtggtcaccctgggtcagtacatgcggcccaccaagcgccacatggcggtggccgagtacgtcaccccccaggccttccaggcctaccaggacatcgcggagggcatgggcttcctgtacgtcgccgccgggcccaaggtcaggtcctcctaccgcgcgggcgagttctacctcaccaagcacctccaggacggcgagaaggccgacgcggcggggcaggcgtga

SEQ ID NO: 1907 - DNA, 1272 bp, Chlorella protothecoides
atgctgggcggggcggggctgctcgcgctcctcctgtctgcacgcctggggctgactcagcactccggctgggggttctggcagaagctgacagtgcacgacaaggagcctgctgctcacctcggcgccaacgtgagctggggagcccagctgcttgcctcgggcacagatcatataacccgattagccggcaagccctccagctgggcaggctgcctgctcgtggctggcttccctgtggcgctgctgggaatggccgtgtgcgcactcagcatgcacgtgcctggagttgaccctgccgcggcaaatatcctggcatccgcgcgcctcgccagactggcagtggcagcatcctttgcagctgcagcggcacggcatgtggtgcagggggctgtggatgccggggtcgcagcctcagatgcccctctgtccgccctcctggcctgggctccaggccgtctcttccagaccgatgggggctacgtacagccagccacccgcctgtttgcgcgagtgtccctttccacctcgggcctggccctcctcagcctggcactcaatcgccgtgtgctcaggagccaccccggcctcctgcctgcgggccttgcagccctggtggccctgctttccccgcccagcaccagtctcgccatgctgtgcatgctgggttggggctgggcggctgcgtacctgcccgccgtccgtctgcgctcgcgcctggcgcagctgcagcttaaccagtctcgtcatgctgtgcatgctgggttggggctgggtggctgcgtacctgcccgccgtccgtcggcgctcgcgcctggcgcagctgcagcttgctctggcagccatgcacgccttctatgcctcggggcacctgtgcgagtttgcgggaggtttgtgacggatgatgatttccatctgtaccgctcgggtgtgctcgtggcactggagacctttgggcccatgctcctcgttaccaccttggcaggcattccctggggcagcacggcctcccaagcaaggctagctggggcagcggagaagacccaggagtcttctaggccggttccatccccgcaacatgctcctgaaggtgcaatagcgatgatgggaacgctccgctgcgctgcggcgctggcggccatgctcagcgcagccgtccagcgtcgccacctctacgcctggtccctctttgccccgcgctttgcgtttgaagcctgcttcctggtcgtcacagacattactgtgctgctgatgaatgtccttttggtgtga

SEQ ID NO: 1908 - DNA, 696 bp, Chlorella protothecoides
atggtgcgcccgctgcagggccacagctgcatgagctggtaccggggggagtttctttgccacggtggaccacacccctcctcactccttcgccccttgccaccccacccaacatcaggcctgctggaggtgctggcggcggccgtggacagccggcgcaccgtgctggtcgaggcggcgctggacgcggtgcagcgcctgatcgcgcatgcctacatccgcggcacggtgaccgtgctgcaccaccgcgcgggggggggcgcgggtcccttggaccacggtgcagggggcgagggagccacagcaggcacgtcgacctccgcctccaaccccccggcggggtccgaggcgcggcgcccgctgccccccgccgctctggcggtggacctgatcgtgcggcgcccgctgccccccgccgcgctggcggtggacctgatcgtgcgctgcgacgacctgggtgacgagggcgtggagctgcgcctgctgtccgcgctgctcacggccgtgaccagcgcggggctggcggtgcacggcgccgcgctgctgctctgcgtgcgggcggggtacaacgtgtacctgctgtcccgcagcgaggtcaacgccgccacggccaaggccacgctcacccaggcactgaacgtctgcttcgcgcgcatggagtcgggcgacgcgcacgaggtgcccccgcccatcatg

SEQ ID NO: 1909 - DNA, 1209 bp, Chlorella protothecoides
atgggcagcccggcagtgttccatctgttgaacgacagggcgacagcgcgtcgcgccctgcagtctcagctcctcctgagacagacgggcaaagaggtttggcgagcccctctgcacacacacacaccctcgcatccacgacaggttggtgaggcctggggcaagaacctgaccgtggtcatcgccgggctgaccaacacctatgccagttacgtcaccacgttcgaggagtaccaggcgcagcggtacgagggcggcttcacgctctttgggccaaacaccctggacgcatacatccaggtgaaactggaaagcgggaaaagggggcccaggggaagtgaggtccggttgggagggtgtcctggcaagtgcctgcggatgaggagtgggcgcgaactgagagcattgcgtgctggctcaaaccctgactcctcagctcagcctccacctggcccctcagcttcaccctcctccccaacgcttgggtcaacctgcgcaggagttcaaaagcctggcaaaggacatggtcgacggcgctccgctgaatacagaggaccagccccggccgcccaacctgctcagagggggcggagaggtggtctctataaagcctcctcaggctcggcgcagaataagcctcctgggcgcgccaaaccgcccagccttcccctggacaatctccagagccccatccccgcccgccctcacccttgcccaagcacaggcagcgactatggcagggcggtggaggacgtggagcctgggcgcagcttcttgccgggtgatgaggtccgggtcgtgttccagtcggcctgcccccgcaataacatccggcgcggtggtactttcttaaccgtggagcgccaggcacgggagggagccggctgggaggtggtggccaccgatgacgactgggagacgcgctttgcctggggcagctgccacacgctcgattctgccgtggggaatggtgctgagtttttatcgcggcagattactctaaagctgatcctcattatccactcgtctgttccaacgacccaccaccccaacattccgtggccaagcatgaagaatacttctcacacatattccctcctcccactgccctccccaacccctgcaggcatcggtcgctatcatccgagtcctttgcgaccatcacctggatcatccccaatggtaccacgccaggacggtaccgcatag

SEQ ID NO: 1910 - DNA, 864 bp, Chlorella protothecoides
atgcacgcacaaagtgcccctcccaggagctgccgcccagcggagcgcggccagcgcagctcccctcactccccacccctccgacccctgctctcggcagggagccgtgcgacgcggtgcactccacctgcaacggccgcgtggccgagtgcatcggccggggccccgcctggccagacaacatcgcctcctgcgccgtcatcgcccggaagcaggccgacgcggctcacgagctcatgcagcgagagggcgagcagggtgtgtgagatcgttgttgtgtgggcggggtttccacgaggggtcttgagcgtgccgcgctgcgctgcgcgcaagtggaggacgccggtgcggtcgcgccatgctttcctggacatgcgcgggctcgtggtggcggccagcccccacacgcgcgcaggggtggcctgcaagccggccatgggcatggcctttgccgccggcaccaccgacggccccggggcctttgacttcaagcagtcggacaccaacggcacggccttctggcgcctggtgcgcaacttcatccagaaacccagcgccgagcagatggcgtgccacgcgcccaagcccatcctcctggacgtgggcgacatgcacttcccctacgactgggcgccggcgatcgtggagatcggcatcctgcgcgccggccagtttgccatcctggccgtgccgggggagttcactaccatgtcgggccggcggctgcgtgccgccgtccgggacacggtgcggttgggagagtgcttcagtgtgtttgtcgggaggtccccgtctggcatggggccccccggtggggtgaatagaaagcagggtcggcgcgggcctggcctcctgctctcgtag

SEQ ID NO: 1911 - DNA, 741 bp, Chlorella protothecoides
atggagggggcctacctcccagcggagcatggggaccctctggccgggggagccatccttctcatgtcaagatcagttgatggtttctgggagggctggcagctacacgctgtgctttcgacctcctttcccccatcttacccacccaaaaagttgcacccacccagccccactcacttttttgctccaggtgcgttcaccaaccagctgcagaagggtttcgaggagccccgcctgctgattgtgaccgacccccgcaccgaccaccaggccatcaaggaggcggcgtacatgaacatccccgtcatcgccttcaccgacaccgactccgacctggccggcatcgacatcgccatccccgccaacaacaagggcaagcactccatcggcgtgctcttctacctgctcacccgtctggtgctgcaggcgcgcggcaccgtgtccgccgcctccccctgggacgtcatggtcgacatgttcttctaccgcgagcctgaggaggccaaggaggaggccgcccccgaggccgaggccgcggccgagtacgtcgccgacgccgccttccccggtgcggaggagggcgccggcttcgacgcctcctacaacaccggcttcccggcggctgcgccggagttcgccaccggctttgacgccgcgccgtcctttgagcccgcagccgcgcccgcggccggcggcgacgccgcgtttgcacaggcccaggactttggcggcggcttctga

SEQ ID NO: 1912 - DNA, 360 bp, Chlorella protothecoides
atggacccggccaactccctccacccacctccccgtcagatcatccgcccaccagacgatgcactcctctcctttctcctgggaaccgccattggagtcatgatgctgctgtcggtggtggagatgtgggtccacaacgcgatggagcatggatgggcctccaccacatccgcggtcctgctgggggcactgttcttcaaagtagcccagcccctccttgcctccatgagcggcacagaccagggaggggccgtggctgatcttgagggcgggaaggactccgggatggctttggtgctggttggggaccccagcggcactgtactctacaacatcatgtgtgcgagtactggagattga

SEQ ID NO: 1913 - DNA, 333 bp, Chlorella protothecoides
atggctgaccaacgcggtaacgatgtggcgctgctgctggccgctcagagccacctgggcaccaagaactgcaccgcgcacatggagcgctatgtgcacaagcgccgcagcgatggcatcttcgtgttcaacctgggccgcacctacgagaagctccagctggccgctcgcgtcatcgtggccatcgagaacccccaggacgtggttgccatctccgcccggccatacggccagcgcggtgtgctgaagttcgccacctacaccggtgcccgcgccaccgtgggtcgccatacacccggtgcgtgtggggcagtattgggacgtggggcgtag

SEQ ID NO: 1914 - DNA, 576 bp, Chlorella protothecoides
atgggcgactcctgctgcaacccccagggcatcggcgcggtgcaggaccgcatccagcgtgccctgcccggcgtgtttgtgcacagcgtggccaccggcgccactgagtcggccgacgtgctttccacctacttcggcgacgcaaacgcgcaggtgcgggccgcctgcgacgcgctacgcgcgctgccccagctggcgggcggctacgtggccgtgggcttcagccagggcggcctgctcctgcgcggcctgctggagcgctgcacggggaaaggcgcgccggccatgcacaccttgatcacgatgggctcgccccaccagggcgtcatggacgtccccggctgctgggacgtgggcggcggggcgggggtcgcctggagctggtgcaagacgcctgcgtttcccctcgccgcagcacaccccgatcccctccttccctgccaccgcacaggccatgcaagcgctgttggggcatggggtgtactactcctggctgcagcacaacctcctccaggcccagtacttcaaggtgagggtgatcagagggagtgggttccagattctgagcagacatga

SEQ ID NO: 1915 - DNA, 846 bp, Chlorella protothecoides
atgcacgattcgcagagacatcactggtactcgtgtatgcaggcaccagagcatgtattgacacccgccgatgccttgagtcctgtgctggggtctggttgccggttgcctccaggagcctgcagaccccgcctccagcgggggatgcgcgggggaacgggcgccgagtcagaagaggccaccgctggagacatcggggaggaagaattgacgccttcttcaggcgatgtagagatggagggggggagcggcactgaggaagaggaggccggggcgtcgggaagtgatgaagcatctgatgacgatgacgaaggggaagaggaggaggaggaagaggaggggccgagcgggagcgaggcctccggctcggactccccaccccctcgccggccaggccgtaagccgcgactggacatgggcggactcaccacacgagagatgccagaccgcaagacgcgagccaatcgctacgcagcgggggaagtcctggcggaggacgaggatggcgaccaggacttctggtgcgcaggaggtttggtgtgttggagagcagagcgtagcgatctgttgcgtctggagactgtcacctggctgctgcccaaagctcaccctcctccctaccacaggggccaggagttctttgcagaggaggcggcagatgaagcgtatgaaaccgagagtgagccggaggacaggttggaccaagactttgacgagccggtgagcgaatggtggcgatggaagctacatggtcgaggagaatgggtcatgaggactgtttatgatacggtgcttggggagcaggaagggggtgcaagggcacgtacagaaggaggggtttgctga

SEQ ID NO: 1916 - DNA, 201 bp, Chlorella protothecoides
atggaggaaaccgcagcgtaccgcgacgaccgcctggggctgcggaccctgaacgagtctgggcgcctgacgctcgccaactgccccggtttccacatgcagttcactctggactggtttgagcagcacgtcctgccacacgtggcggtgcccgtggccgacgcccgggttgccgccacgcagcccagccgcactgcgtga

SEQ ID NO: 1917 - DNA, 909 bp, Chlorella protothecoides
atgggcccgggcgggctggagtactccatccccgacccctctcccgaggtggtcgccctggtgcgcgccctcggggcgccagcacccggtcaggatgctcccctcccaagggcgagccgggcgggctcccccaaaaccggctccccgggcacccccaccccctgccccaccccccccagcacctttgacgcccgcaccgacgccgggtccgcagagctctacttccactactacggccagctgcagcaccagcagaacatgctggcggacgcgctgcgcaccggcacctaccacgcggccatctccgagaacagcgccgactttgcgggcaaggccgtgctggacgtcggcgccgggtcgggcgtgctctcgctcttcgccgcgcgggccggcgcgcgcgtcgtgtacgcggtggaggcctcccccgccgcgcagtatgcacggcgcctggtccaggcgcagccgggcctggcgggcatagtccatgtcatccagggccgggtggaggatgtggagctgccggaaaagaatgtggaagaggtggggcaatgggttgagtccagcggcagcagcggggcccgctctggcgggggcacctgcgctgcacggcagggctgcacagcctgcctgcggcctgcacactccgagaagatgctgaggcaccctaggccaagcacgcacaagccccttccaacccttccctcttccttgggccgccaggttgacgtgctcatctcggagccaatgggcacgctgctcgtgaatgagcgcatgatagagtcgtacctggccgcccgggacaaacacatgaagcccgggggcaagatgttccccgtgagtcggtggcagttgcccgcagtccgggaggagggactgatggggcgctggggtgttgaccagggttgttga

SEQ ID NO: 1918 - DNA, 420 bp, Chlorella protothecoides
atggcgcggtcggccttctggaaggccaccgacttcttcggcctggacctcagctgcctggaggccgaggcgacggccggctactttggccaggtggtggtggacgccatcccctccggcgccctggtctccaacaccgcgcagcgcaccatcgactttgccaccgcggcgcccgaggacctgcgcgagctggccatccctctgagtctgcaggtggcagcgccggggccggtgcatggcctcgcctgctggtttgacgtgctgttcgaggggtcgcaggcgccacggtggctctccaccgcgcccggcctgcccacgacgcactggtgcgcgctgggcttcttgttgagggaagtgcatgccctggcccgaggcacctggaggcgtgtggtacgagtatggcaaggtctaggcccgtga

SEQ ID NO: 1919 - DNA, 843 bp, Chlorella protothecoides
atggacgtgggcagcaagggcgggtactacgccggcaagtcgcccaagctcctgctgcacgagtggtgcctgaaggagaagctccccaagccgcgctacaaggcagtgccggccgccgcgcctgggcggtggcggtgtcgcgtggtcctgccacacccgcgccaggcggaggccgacgccatcatgttcctggcagaggaggcggccgcggagacggaggaggaggcgctgcagcgtggcgcggtggtgggcctgcaccgcctggcaggggacaggtccctgcactccctcctccccgagcaataccgtgggctgtggaaggagctgggccacaaggagatcttgccccgcccaggcccctctccctcctgtacaacactgcaggccgaggagtccaaggcccgcgcggtggccgctgcggcccgcaaggaaagggcggcggccagggagaaggcggccgtggcccgggcggcccgccacgcgccctccgccgtcatcatgacggaccagcaccgccgcgccgtggccgacctcctggccgacctcagcgtgcgggatggcgagggcgggcgcctcggaatcgatgcggggcccgtccctgagggcagctccgtcgcgagtgaggcgaggcggctggggttcagcgaggcggccgtcgccgctgccatgcaggtactggggcccgcggtctcgctgatgcaggccctggactggttatgcctcaacataccggaggaggagctgcccaccagatttgcgcccggtggggagttgctggaatctgttggcatgtgtgggaaggggctggagatgggcttcctggtggcagggcgctgcgtgtga

SEQ ID NO: 1920 - DNA, 612 bp, Chlorella protothecoides
atgtgccggctgtcggcctccatctcctcccccgcgatctcgcaggccttgcccaggcccacaatcagcggcggtaccggacctcagcccccgctcctgcccgccgccggagatctgggcctccaggcgcacgcgcggccggcgccggacatagagcgcgcctacgcccttgggcccgtacagcttgtgccccgagatggacagcaggtcaatcttcatggcgtccacgtccagcggcagcttgcccaccgcctgcgcggcgtcggtgtgaaagaagaccttgcgctgccggcacagcgcgccgatctccgccagaggctgcaccgtgccgatctcgttgttcaccgccatcaccgacacgagcgcggtgtcggggcgcagcgcgtcggccagcgcctgcacagacacgaggcccgaggggcccacggggaggtaggtcacctcaaacccgcggttttgcaggtaccggctcgagtccagcacgcacttgtgctcggtctgggtggtcacgatgtggcgcttcctgtcccggtagaaacccgccacgcccttgatcgccaggttgttggactccgtcgcgcccgaggggccctcccctttgatcactcctga

SEQ ID NO: 1921 - DNA, 297 bp, Chlorella protothecoides
atgagtgccccctccagcatcgctcactggaacgtcagcttggactggtcggaggaggagcagcgggcgctggagacgggcctggcccgcttcccgcccacccagggcagccccctggcgcagtacgtgcgcatcgccctggcgcttccacgaaagtcggtgcgggaggtggcgctgcgtgctcgctggaccaagcaggcggccctgctgaagaagcgacgcacggaggagctggagagcggggagagcgccgcgaagcgccccctcctgcacaaccccctcctggtgggtacatga

SEQ ID NO: 1922 - DNA, 1095 bp, Chlorella protothecoides
  modified_base (613)..(622): a, c, t, g, unknown or other
atgcgactgcccacctccaagcaggaggagttccgcttcaccgacgtgtcccgcatcaccggcgcccagctggcggccccgccgggcggcgacgcggccgccgcgctgggggccgcggcagacctcaccctgacgcgcccggcggcggtcaccgcagtggtcctggacggggtcctgctccggctcgtccccggccccgaggccctgccccccggtgtcttcgtcggggcctcccacgacgcccccgccgacgtcctggccttcagcctgggcatgcagagcggacagcgcggcggcgcctttgccgccctgaatgcggcaagcgccgccggcgtgctggtggtgcacgtgcccgccggggtcacgctggccgcgcccgtccacgtcgtgcacctgtcctcgcccggggggggcgtgggggaccgcgaccccggcgccgtgcccatgtcctccccccgcaccctggtggtgctggaggagggcgcggcggccggcctggtggaggagtttgtcccgctggcgtcgccgtcgggcggggcggccggcaccgccttgcccgccggtgccgccgcgccctactacgtcaatgccgtgctagaggtggagctggatnnnnnnnnnncgccgtcgggcggggcggccggcaccgcctcccccgccggcgcgcccgcgccctactacgtcaatgccgtgctggaggtggagctggacgaccgcgcggcgctgagtcacgcctatgtggcgacggacgtggcaggtgccagccacaccaaggccacctttgtgcaccagggcgctgagagctcctacagcctgacggaggcacgcctgggcggcgcactgacgcggcatgacctcagcatcgtgcagctgggcgcagccacgcagacgcggctggccagcttcctgctggcttcccaggcccagctgcacgacctgcactccaagctcacgctggaccaccccgccggacaggccgaccagctgcacaagtgcgagtgggatggctgtttgacatcgggccgggcgacgccggggctgtccccctcgcgggctgggcgcagagtcggtggacgcccgtcctcaccaaactga

SEQ ID NO: 1923 - DNA, 435 bp, Chlorella protothecoides
atggatcagcagatctcgacggggggcggggtgtggaggctcaggtggcatcccaccgacccccagctcctcctggcggcatgcatgcagcatggcttccaggtcctgcgactcagacccggcagcggcgagtgggcggtggaggagcggtatgcacaccaacagacgctggcctatggcgccgactggcagcggcgaggcggcgaccaggcggggccattcgcggtggcgacggccagcttctacgacaatgccctgcacgatacagcagacacaccaggtcgaatctgcaatggccggggctccaaaacctgtggccgccccgtaggacagggcatggagaaggcgggcaccaggcgggccagaggatgggccgagctgatgggaggccaggcagctggcctggctggccgtgccatcatgttggccgtatag

SEQ ID NO: 1924 - DNA, 525 bp, Chlorella protothecoides
atggctgtttggcatcgggccgggggacgccggggctgtcccccttgcggactgggcgcagagtcggtggacgcctgttctcaccaaactgagcctgtctctgcggccaatgtccagctcctcatctgcttgccctcaaaggcctgtgcaatgtgcatcgtcgccgacgggcgctcccggggcgtcttcgacggcaatgtgcgcgtaaaccgcggcgcgcagcaaaccgacgcggcccagatcagccgcaacctgctgctggcgccgcgggccacggtgaacgtgaagcccaacctgcagatcgtggccgacgacgtcaagtgcacccacggcgccgccatctctgacctggaggaggaccagctgttttacttgagctcgcgcggcatcgacgccacggccgcccggcgaatcctcgtggactcctttgggcgcgaggtcgtgcagcggctgggggacgccgcgttgcaagggcgcatcgacgccgccgtcaagaaggcgttgcaaggcgtgcaggcagtttga

SEQ ID NO: 1925 - DNA, 693 bp, Chlorella protothecoides
atgcgtcgcatcaacatttgcattcccgactgctcttccacggggctggccagggttcaagggccagctcatcggtcccgccacgactctccctgccgccctacctccgatccccggaaccacacgctcgcatccccccttgccatatcgcagcaggtgccccaaccctccatgcccaactggccggggtcgatggggggcctgggcccaatcatgatgccctcccacccgggccctgtgccggcgagcgccgcgcccgccccgcccccggcgcaggaaagggcgacgccggcgccgggtccgggccgtggcgaggcgagcctggggtcgctgctggaggccaacctggccctgctccagcagttcaagggcaacatgactcattttcgggtgcatgacaacaccaggctgctggtccagttccgggacaacatcctggcggtgatcaagcagatggagagcatggacggcgtgatggcccagatgccgcagctacccgtcaggtatgcggctgatgtgtgtgggggtcctgctgtggtggtgctggataggaccagggcggttgcctggctcggtctgcctgtgaggacaccgtacagcatgtggtgcttgatagaggtggctctgagccagagatccgctgctgagggtcgctgtgtccggggtgcctcccagtccttggctggcacataa

SEQ ID NO: 1926 - DNA, 405 bp, Chlorella protothecoides
atggccattcctcacacatcttcacgaggaccccgccagacatcatgcccacgccgtgcggcattcctcatctgcgccagcaaacgcagggacgtggacatgatgcgcttcaccctgggcattccgggttttgatgatgcccagatacccaggatcatagggctggcagggggcagcctcctcatcgccaatcatgtgctcggatcccagcccactcccctggcccagactttggccgaggtgttgggcctggcgctggcaagcctcgccttcgccatcccaaacttggatgcctgggtcaatggggggaagcaggctgctagtgcgaccatcacaggtgctcgcaacgtcttcagcttggcagaggatctcagcgaggatgccaaagtggtgcgtgcccggtga

SEQ ID NO: 1927 - DNA, 843 bp, Chlorella protothecoides
atgcccgcctgcacgctcgccaccgccactctcactgagaacacggacgtggtggcttggtgtccctcgagccgacacaccgacctgctcgcggtcggcacctaccagctggatgagtcatcaggtctccgcgcaggccatgcatacatgtatcgcgtgcgtacagaaggccccgaggtcctgcagctggaggcggaggcacgctgtgccggggtgttcgacttggcctggcacccctcttcctcctccacaccgctcctcgccatggcgctgagcgacggcactctgcgcctgaccgggcaggacctcgtcaccatcgcgtccagcacaccccagccggactccgatgcgctggcatgctgcgtggactggcggcgtgacggccagccccctgacacagcgaggctgctggcctcctactccgacggcgacgctgcacggctccaggcgacgccggccgggctgacgacgttggagcgctggagcgcgcactccctggaggcctgggcggtggccgccgatccgtggcagccagcgctgtgcttcacgggcggcgacgactgcgcgctccgtgcctgggacgaaagagcccccgccagcccggcctgggccgaccggcgagagcacggggcgggggtctgctgcatcctgcccagcacccacacggagcacctggtggccaccggaagctacgatgaagctgctcgcgcctgggacctgcgctggccgggccggcccctgcttctgagcaaggcgaggggccatgtgaagaggactctggcgggggtggcatgggcatatagaggggaggatgtcacgcttaaagcgtacgcgacaccctga

SEQ ID NO: 1928 - DNA, 189 bp, Chlorella protothecoides
atgtacctggacatgcaggccacgacccccgtggaccctcgggtgacggacgccatgatcccctacttcacggagctgtatggcaacccccactctcgcacccacttcctaggatgggaggcagaggacgccgtggagaaggcgcgggcccaggtgcggcggtgtgttgtgggagggatgggaaattga

SEQ ID NO: 1929 - DNA, 651 bp, Chlorella protothecoides
atgtatgttatgcccgttccatcaggatggggagtatcgcctatgatggcatggggaggggggttgcaaagtagcgcaggacctgattctcgcgcgcaaaagaaggtcttggatctcgactttcctacgttccccagagtccctgcacgcccttgcaacgagggaagactcgttgtatctgtttccgcaattgcatgcactgccgaacaccgagaatacagttgccagcacaccaaatatgaccagggtatgacacgtccgaaagctcccaagaccaagaccacacccggacagagccctcccaccagtcccatgcccggcagtaggaagagaggggccgatgccggtagccctgccaaagacaaggcagctgcagaggtcgtagacctggagaagcggcgcctcgctgtggccgaggagctacggcatgtagagcaacagctcatgcctctgcctccttctgaccaagcgcagatttacgacctggagaccaagtacttggagacctccagcccgtttggcaatgctgtcaggggttatgaaggatttctgggcggatcatctgttgcaaaccgtaagatggtgttgaagccggaggagcgcctgttcagctggtcgagcgtgtcaggacagactcttgtcaagcagtag

SEQ ID NO: 1930 - DNA, 1383 bp, Chlorella protothecoides
  modified_base (649)..(658): a, c, t, g, unknown or other
  modified_base (1229)..(1238): a, c, t, g, unknown or other
atggccgagttgagcagggaccaccagggggagacagggtcgcgggatagtacgaaaggttactggctcggagagcctccggtacaccagcggaaatggatggattcaaggcggcgagagtgggtagacaaggtaaaggggggccaccgatgtcggggaccccctcgatgtctgcaggggaggaggggggagaggcgatctcctgaatcaagcagcgcgcatgtgtggaatcagactcaaggttgcactcggtgctcggtgggcatggcggtggtcttcgaggacgtgactgatcagccagaggcgacgcccacgtctacagagtctgagcccccaaagacagactccatcacatactcggatgcgccgattgtgatccctgatccttcaggagatgtccctgaggagtgcgaggcgaacgccgcctccagctccgagcaggttggtggggagtgcctggatcgtgctcagggcagtctctgcctttcggggggcgctcgcacgacgcagcagctgattttgactcacggcgtcgatccacaggatcccatagagcaggcagaagccctgaaggtagagggcaacacttacttcaagactggagatgacgagaaggcctacgtgcgagcgactcagcctgctgatcagnnnnnnnnnngagaaggcctacgtgcgtgcggtgcagggtccctggtgttgttgtggggtgttgttgttgtggggtgtggcatttcaggagcgacccagcctgctgatcactcagctctgtctgccacgctgcaggagctgtacacggcagccttggaggtggcgcctgcggaggcgacgcaacgagccgtgtaccactgcaaccgcgcggcatgctccctccgaatggcgcggcacgccgaggtcgtcacggactgcagccacgcgctggagctagatccaacctatggcaaggcgctgatgcgcagggccgctgcttatgaagccctggacgacctggaacatgccctgctggattttgacaaggtgggctgcatgccagcggttacaagtgtgggccaggatggccaggtagagctagatgcagggaacagcgccgctggtgctgcggcggcgcgcctccgacctgtcgtggaggagaggagggagaagctcaaagacgagatgctgggtgagcctacttcgtcgcttggggtgcttggaccagatgactctgaaagacgtcaacctggcctgactcnnnnnnnnnncttcgtcgcttggggtgcttggaccagatgcaagctcaaggagctgggaaatacagtactcggcaagttcgggatgagtctcgacaacttcaaggcagagaaggacccagccaccggctcttacagcatcaaatttggacagtga

SEQ ID NO: 1931 - DNA, 1602 bp, Chlorella protothecoides
atgccatccctgcacctgccctccgcgctggccctggccttcctcgtcaccgccctcctggccccccgcggcgccctggctgccagtttccgtgtcgagacgaacgccctgcgcatcaaggagccggccagctacgccggaagctacgactccgccattggcgacttcggggtgcccctctacggtggcaccctccagggccggatcgggcacctggccgccaaccccaagggctgctccaacttcacggggtccctgcctgagggcgtggagatcctactggccatccgcggcgactgcttcttcgtggagaaggcctaccatgcccagctggctggcgccaaggccgtcatcgtggccgacaacatccaggagcacctgctgaccatggccatcccggaggatcgcccggacatcgcagccctggtgccaaagatcgccatcccggtggccctggtgcagaagggagctcgccacttgtggtccagccttgccgtgcccctgcgtgcccttatcaatcatgcacagggaggtcccaatgccgttgcataccaggggccggacacctcattaccacctgtgtgccctgaacgacatcattccctccccacccctcaaatcctcccatcccctcgccaggacgccggggaccggatccagagcgccctggccgccgaccagggcgcggtgatcgtggagtttgactggaaagagtccattgtgcaccccgacaaccgcgtggagtgggagctgtggttcagcaccaacaccgcctgcgggcaggcctgctccgccacctcctccttcctggcccagttcaaggacagcgcggtgagcctggagcaggagggcttcaccgcctttaccccccacgtcatgctggggtcctgcagcgtctggacctcggaggagctgtgccaccgcaactgcatccgcggcggcaagtactgctccaccaccgcctcgtccacgggcgcggcgggggagctcaccgggcgtgccgacctgcggcacctctgcgtgcacaaggtgctgaatgagacgaagaaggcgtggcagtggtgggagtacgccgcgcgcttcgcggcgcactgccgccccgaggccggccagttcaccaccgcctgctccgagcagcagctgcgcgacctgggcgtggacaccaacgccgtgggcggatgtgtggggtcgctggactcgggcgaggcgcacccgctgctggacgcgcaggtgcgcgcgcagaacgagcgcggtcccatgggccgtgtcatcatgctgcccacgctggtggtgaacaccaaccagtaccgcgggcggctgaacaacgccggcgtgctgcgcgcgctgtgcgctgggttcgccgagggcactgagccgcccgcatgcctgaacccgggggtcaacgtggacgagtgcacgcagggcgtggacacctgctggaaggagaatggcttcagcgcctgcgtcgacaccttccggggctacgtctgccactgcccggaaggtgccgcaccccttttcctcttttttttgggggggggggatgggggtggaacgagggtgggctggaaagaatcgggagctggtgtgtgtgagctgtga

SEQ ID NO: 1932 - DNA, 576 bp, Chlorella protothecoides
  modified_base (282)..(344): a, c, t, g, unknown or other
cacgatgctggcgccagacgacggcagcgcggaggccgcggcgctgcagcacccggacgccggcggcgcgctgcgccgcttcgcggtggtgggcaacttccgcgccgagcgcgacgagttcggcctgcgcctgcgcatcgcggagcccggcggcggcgcgcgcaccgtggagtttgcgttcgacctgtcgcgggacaccgcggcctccgtggccagcgagatggtggacgacctggcgctgtcgcccgccgacgcggccgacatcgcggccgccatccgcgnnnnnnnnnnnnnnnnnnnnnnnnnnnnnnnnnnnnnnnnnnnnnnnnnnnnnnnnnnnnnnntcgccgcgctgtcctccgacctggaggcggcggtgagcatgaacctggaggccgcgggcgaggcgctgcaggcaggcatcctgcactccgccgcctcggccgccgggaacgaggcctttggcgtgggcgacgaccatggggagggggcagggggtggggacgcgagcgccggggacggggacgcgagcgccggggacggggatgcgagcgccgggggcggggacgcgagcgc

SEQ ID NO: 1933 - DNA, 396 bp, Chlorella protothecoides
atggccgccgccggcgtggcgcccaacgccgtgacgcacgacaccgtgctgtcggcccacgccgcacgcggcgacctggacgccgcgctggcctacgcggcggcggtgcacggagacgcggagtgcgagtacagcctcttcttccagaccaccctgctgcgcgtgatggcgggcggggggcgggtgcgggaggcccagcgcatcttccgcgacctgcgcgccggcggcgcggccgacgacgtcgcctacatgaccttcatcgacggcatgctggacgcgtgggaagggggagggcgcgcagacgaggggctgttggaccaggccctggtgagtgcgcggaatcccctggaatggggcagggggcatggttgcagggagttgagaggagccatctga

SEQ ID NO: 1934 - DNA, 2406 bp, Chlorella protothecoides
  modified_base (1418)..(1427): a, c, t, g, unknown or other
  modified_base (1667)..(1691): a, c, t, g, unknown or other
  modified_base (1996)..(2005): a, c, t, g, unknown or other
atgcattccgcacggggcactgccgcatgggactcaccactgccattcgccgacatccaatccaccgacaaccccggcactccccaggccgtccatcatcatcgcctacctgctggccggcacttcgtgcaccgctgcggcggcctgctatggagagctggcagtggtgaggcggggcggtttggtcttgcctggcgcggcgctacgtcgtcgtcgtccctcacgctcgggccatgctccgggacctgtctcacccatgatgctctctggtttgaggacgcacgagtccttgcgtcatgcccctgccaggacccacggacgcgcagccgccatgtgaccgccctcaggctcagatggccagtgcccccggccctcgcgacatcgcctccttcccatcacccaccccactcccctcaccctcccccaacgcaggagtaccccgtcgccggcggctccttcacgtacatcatgctgacctttggcgagttccccgcctggatcgcggtctccaaccagatgggcatcgaggtgtttggctccgccgcgctggcccgctccttctccgccttcctggcctccatgtgcggccagccccccaccttcttcacgctgtcgggcagccatggcgacgaggaagactggagcatcgacctgatggcagggggggggaccctgctcatcacactggtgctgacgctgtcggggcggctgtctggcatcttcatcaccggcgtcaccctggtcaaactgggcctgatcctgttcatcctggtggtcgccttcaccaaggcggacccctccaacctgcaccccttcttccgcgacggcgacgtggggggcatgctcagcgcggcctccatctttgtctacaccatgaccggcttcgactccatctccaacgctgcggaggagcaggcagcgcccatggggctctggaggctggcctggccacgggagcacgaacttggctctgtcgggcgtgcctgggcacgggtgacagcgccccgcggcagcggcatgcatgcctgtgtgtcccagggcacgcccactcagggcgtgggccgaggggcgctggcacgccctggcacctgcaggcgaccctctgcgcccacctccacacccccccacgcgcaggccaagaacatcgattcgctgccatgggcgatgacgggggtcaccatcatcgccaccgtcctgtacacgctgctggccctggcgctgagcatgctcctgcccgccactgccatcagcgcctcggacggcatgggccacgatttcttgaccatcggtgcaggagaatgggggggagggtctgaggaggtgcagggatatgcatggacggaccttgtcaccagatgtatgtcccccgtgcagtcgccccgcacgctggccatgccaatgtgcacttgcggcacggnnnnnnnnnntgcctcggacggcatgggccacgacttcttgaccatcggtgcgggagagtgggggggagggtctggggaggtgcaggaatacgcatggacggacctggtcaccagatgtatgtcacccgtgcagtcgccccgcacgatggccatgccaatgtgcacttgcggcacggtgcacaggcccctgggcgtgagccattctcgtcggatctgccccggctcccttgcttcccgcttgtttctcgnnnnnnnnnnnnnnnnnnnnnnnnncatggtcaacaccccctcctcaatcaggcctgcactacatgaagtacgtcgtggccgtggccgcggttctaggctccttcacgggcctcctggtgggtctgtacaccgcctcgcgcatcgccatggtggtggcgcgcgactggatgctgccgccctggctggccaagatctccacgcgcaccaacacgccggcgcgcgcccagatcgtcgtgggcgtggtcgtgggggggtgcggctgcctgctgctgggatcgccgctctggcgtggcgaattttgcctgacgctggcaagtccaccatcccannnnnnnnnngcctgttgcggggatggggctggggcctggcgagcagggggtgcggctgcctgccgctggaattgccgctctggcgtggcgaatcttgcctgacgctggcaagtccaccatcccaaggctccaccaccccgtcccaccttggaaactgtagccctcatcgccgccttctcctccggccatttcctggcggacctggtcagcttcggccagctgctgagcatctggtttgtggtgaacgcgcagctgtacaggcggtactacccgggcgtcaagctgcggttcacacggtgggcacagggtggagcgacctgagaaggcaggggaggtgtttcagagcttgcacagggatcatgcagtgcgtgtgtgactggggtctcaatgtttctgtcagatggggatga

SEQ ID NO: 1935 - DNA, 696 bp, Chlorella protothecoides
atgcaatacatcgtcgccacggcggcggtgctgggctgcatcacagggctgatggtgggcctgtatgccatctcccgtctggtcatggtggtggcgagagactggatgctgccccccttcctggcccgcgtgtcaacccgcacccagacccccctggtcgcccagatcgtgctggggctgatcatcggtgaggacgatgggatttggggaggcgggattggtagcgcccaggagaggagggaatgggtaggcggcccatgcctgggcgggggggtggccacctgttggaccggcatcctcggttgggcgactgggcgtgttggggccgctgggcatgtgatgggggctggcaggagggttgtgtgcaggcttcttcccttcccttgtccctgcaccatcgcgttgctggtgcccgccgacttcctgggcgacctcgtctccttcggccagctcttctccatgtggtccgtggtgaatgcccaggttttccgccgctactaccccgagatcaagctacgcttcacgcgcttcggggccgtggagaccgcgaacgccaaggtggagtccatggcgctggggggtaggctgaacctctccgtcgccgcgcggcggcggctggtggccctccacatggcgctcatgacactcttcgcaacgggtgagagggacggagggagggagggaggggtgtcataa

SEQ ID NO: 1936 - DNA, 336 bp, Chlorella protothecoides
atggccgccgaggcggcgggcctggccacggcctcctacggcgacctcatgctggccaccatcggtggggtgtacgcgcagcaggccgagatcgcgctgggcgggatcatcgacggctccgtggccgccctgcgcgccaagggccagaacatcaagagccagggaggagagggaagtacccctcatgagggccaaggcgcgagggcatctcggagagcagaggcctgcgctgctgcgcgagtctggccgcgcctcgcccgcaccctcctcgagcactcacccaacacgcacaaccccccatccacgcccagttcgcggcggccaacctggcgatga

SEQ ID NO: 1937 - DNA, 417 bp, Chlorella protothecoides
atgcggcgcgggctgccgcactctcccctgcaaggcggcgtggaggcaaggaatcggcatgatgggtttgcacccaccttcttccgcgtcgggcgcccgggcagttgtgacttccaggccccttattcagccctgatgggagctgcgcggaagccgcaaccccactcacgcgcacctctccccctcccaaacccaccttcgcaggtgggggccttgatgggcaagggcggcgccaacatcagccaggtgcgctccgtgtcgggggcgcgcgtgcacctgtccccggcgacggagggcgagccgggggccacccgcgcgctggaggtgtcggggtcggtggaggcggtgctggcggcccgcaacatggtcaacgccttcctggcagtgggtggctgcagcgaggcccagcccgtctga

SEQ ID NO: 1938 - DNA, 2301 bp, Chlorella protothecoides
  modified_base (1384)..(1393): a, c, t, g, unknown or other
atgctgttggtcagggggagtggagatgaggccggccgtttcacggagaagaccatcaaagtcatcatcttgacatggaattacatggcgagctgggagggagtgtcgactcttgcacaatggaccacaccccccagtcatcacttggcattgacagccatttgcacaccatttgcactcccgcacgaagcaaacccgatgcgagtcgaagttcacattacagctccaccaccatcccctttcaacatccgcctcattcaagccactctcacaccttttgtcgccaagggcaatctggttaatcccagacagcagaaccttctggtgctcaaacggaactccagtggcgtccaccagcttcagcttaatttcatccttggttgctgtgggctccagatcaatggtgacctcattcccgcaggccaggtggggggtgatgatcttcacctgcagaggcacggcgtgtgcggcttaatgttcaaagaaaagggaagcaagagaggcttccacgactttctgcagcacaggggatgtcaaagtgctgcggtctctgaagcttcccccttccccatttgccagcgcccaggattgcggcagcagcagcagaggcagcgcaccttcacaggcacccccccacgcaggcggctagagaggtgcagcgttgatccgtggctcagagacgagctttctatcgtatggtctccgctcatcaggcgacctccggccaccaggacctgtacctacctggatcctgagctgcaagtccgcgatgctagatgcagagtccacctcgagaacccgggtttgcagactgcaccgacgaagctcggcgaaagtcttgatttgactggtcaatttccaggtttcttcatttgcgcgcctaaacattttgcgcccggaacaaggggttccgatacacgatcggggagcggggttgcactgggaatgagcgatgacgacgagggattcctggactttagtcccctcgtccatgcgcagactggtggccaagctgacgaccagcatccaggccctgctcctcaaaggcaagggcatgggaggagcaccgttaccgtgcatgccctggttgcagatatgttgcacagtaaacagcatcacatgaggctcatggcacctagcatcccaagccccgttgccctccctccacccagagaggagcagctacctcgtgatcgaccatgccctccccttccggagggacaactacattctgagcctgatccggggcgaccctgcctcagcccctctccaggaccgcgccagcaagctccaggactggttccaggtggactcccacctgaccctggtgcccgacagccactccgggcgcatcctggaccaagagtgttgtgttcccagcccnnnnnnnnnngcatcctggaccaagaggtgaggagggtgttaggcggtgggctgtttgggcgccatagagaagtcttttggatgctccatggggcaagcgtacctgaatgtgaccatcttcctgggcaacgttgtgttcccagccttcggcgccaagggaggctgtggcgatggtctatttgcccctcatgccacgacgccatccccacctgcataccccacccctcctctctgcgctcccacctggtgcaggaggccagcacgctgctgagcgcgggagccatcgcggggtcgaacgccgcctgccccctgcccctcttcgtccccgtgcaggacgcgctgcgggacggggcgctgggcgtggaccccggcggcgccgcccattacgagtccgactcgctgcacacctccgccctgccctctgccctgttttaccctggcgagcagctgcgcctgtttgcggcgcgcctggacgcacgtgacgcccccgccgcgcagtcctgccgcgacgccgcggaagcggggcgggacgacgaagacggtgacggcgacggcgtcggcgccccccatggctgcgacctgttgccgcgcgtctcgctccaggcgcgggccagcttcccgctggcttccccgccgtcccacgaccccgccccggccgccgggccccagctgggcgccgtgctggcggccttcttccgcccgccccgcctgccggtgcgcctggacctggacctggtctggcgctacgccgacgccggccgcgccgtggcggcggccacgggcaggttcgatccggcctcggccgcggagtggcacctggcggccctggacccgggcacggagcgcgacgacgggcacaggtggggcttgggcttgttgttgtcgttgagagggtttggtggaatgcgctttcagtga

SEQ ID NO: 1939 - DNA, 1140 bp, Chlorella protothecoides
  modified_base (258)..(267): a, c, t, g, unknown or other
atgccgaatctggggttttgtgaagcacaagcgattgctgtgtatagtgtacctaaaccggttgcctcctatctgcttgcaccatctctaagtgcgtttgggcaacgtaaccaggcaacctaccttataaagccgactcaagatgtcattcaggagtctcacaaaggcttccagcagaagcaaaccctcctcccagcgatgataattgaagtacgccgggttgacaagacagtaggcccgctatggacaggaggcagnnnnnnnnnntatgatatctttaagtatattatctgggaacagataattgaagtacgccgggttgacaggacagtaggcccgctatggacaggaggcaggtcggccacctcttctggcgatgcgcagcacaacttcagcagattaggtcattcaaatccgtgtctagaaaacttgatcccacctcccgaccatttgcgacaggatgtcaatggcctcggagaatctgggtcagtagtccaagtctcggccggatacgcccggaactacctgctcccgcagaaattggcacagcagctagcatttgacacatcgctgagtcgacgggaacgcactcagcaggcagcagctgctctgcagggtgctgatttggccacgagcacaagtcagagccaggctgaggagcctgaggccaagagcacccccaaggacgaagctggtgctgtaatggagaagctgaagactcccctggtgggcatccttacgattctaggagatgcaaggggtcaacactctgccatgcacatcctcaccccaggtgttcaaacggaaggccgaggggctcaagctggcggtccctctcgagcgggaggacgtggtggaggcggtggctcggcagctgcgcatcacccttgtccccgagctgttggacatcgggaacgagaagctgagcgaggtgggggagttcctgctgcccctgaagattgtgacgccggccggacagcgcgcccagctggaggtccacattgcagcgacgtgaagcaccctggaccttgcctgtctgaacgtagcagcacgaaagctggcagcctgggggcgaggcagggatttcctgttcctggctgcttgagggaggcctcgagaggggtctggcatatgaaatga

SEQ ID NO: 1940 - DNA, 2466 bp, Chlorella protothecoides
  modified_base (744)..(753): a, c, t, g, unknown or other
  modified_base (1913)..(1922): a, c, t, g, unknown or other
atggcagctcctctccctcgttccatctcaagcagggcagtgaccagccatgcacagaagcacttcatcaagctgctgcttcggggcgaggccttgcctgaagcagtcgcagcttcgggggccggctacaccttgtcaggtcgtccgctggaccccaactgcgcctctgccagggcatacggtctccgtcccgatgccttccacagtgagcgggttgtgcaggccgctcgctccaagtgtgcaagcatgggtcaatacatgcatgcatggctaggcctctttgtgtgcgtccctggttggtcgctctgcgggccctgcggcggaccacgggcccgcaggaatcatccacacctgcccatcctaacaggggtggcagccgacgggaagctgacagtgggcatccatgtcaccagtctcgagatggaggcagagccggcaggtgttgtcaaacgcttgcccaaaggtatgcccgcggatggatgcccctgggaatcatcggctgcgctgagtgccgccaagcgtggccgcaagaagaggggctcgagtgactcggaggatgagggcaggcccttggcgcctgctttccccgctgcggctgaggtgatggggtggccgaggggaccaccttcccatgccattctctcatgcctgttcacgccccttcccggccttcctcctgcgtctaccagggctcctcccccgcggaacccaccgaatactccaaggcacggccacggcggcagnnnnnnnnnnatgttcaaacccctgatgtgcccgctctgcaggaacccatgccctgcctggcctgccagcaccttcccatgccattctctcatgcctgtttacgccccttcccggcctccctcctgcttccaccaggggtcttcccccgcggaacccactgaatactccaaggcacggccacggcggcagggaggccagcgtgccgtcatgggggacacgagcgaatcccttgacctcacctgccccaaggagtttgtgggccctcccgggtcggccgcccccctcgcacagccctttgcagtggtcacctcgagccaggtggggtgtaagtacggcgtagttgtgttatcgccctcgcccagctgctcgacagcaggcgccttggatcctgcgctggcctcacctcactccgtatgccccctccccgtgatccatctctgcatcgcgcacgctgccttccgccccctctcccccgcaccctcacactcacacggcgaccgccccacccaggcgcggctggtgatggacttccacgcccacctcagcgggtacgaggtaattggcctcctgggcggccggtacgaggctgggcgcagggtgttgcacgtggacgaggcatacccctgccgcagggcgcaaggctccgactccggtgaggccctggatgcggggccagggccgtggtcttggtgagttctgcatttaaggcgtcaagctggccgacagaccctcaatgtgttgtggcagcctaactcctcatcacctcctgtccacaccctcctgcaggcacctcggtggagctggaccccgcgtcgcaggtcgaggcgaccaccgccatgtcagcgagggggcaggccgccgtgggctggtgagcgtggcggcgggtcgacggcgtggggagcgcttgcgttgcagggcctgacgacgcatggtcggacctggaaaccccgggtgcctgcgcccgcctctgcagtcgtcgctggcgagtctcgccgtgccacgcggagctcgctgctgcatgcggtgtgcgggagcctgctggaggctgtacaggcttccgtccgggcgcagcttcgtcctgcccccccacgcgatgcttccccctttactccctcctgcccactgccaggtaccactcccacccggcgccatcgtctccccctacgacnnnnnnnnnnccaggccctctgccacgaccccgaggccgggctggcgccatgggtaggcgccatcgtctccccctacgacgccagcctcccctccacggtgtgtccaggtggtgagggtggatttctgaggggatcaggtggcagggccacgcgggacgccagcaagggccatgctgggatttcacatgtgccaactccagcccgggccgaggtgatcaacctggatgcctacccgtcagagccgcaacatgtggtgggggtgagatcattcacaaaccccacccgtcatttaaatcctaaccccgcaggcatcccagatccgcatgtgggtggtgcggaccagcgccggccgactcacccccttctccatcaggagccaaggggcggaggcagggccggccagcgcccacgacgatactctcagcagtctgcgagcgtgagtggtgttattttcaaggggaggagccaggggtgttggtgggaaagagtacgtggcgtgtgtggtgtcgatcgacgatgggcagtgcatgccaccccgtgtggggcctgttga

SEQ ID NO: 1941 - DNA, 1509 bp, Chlorella protothecoides
  modified_base (672)..(681): a, c, t, g, unknown or other
atggagctggaggtgaccttccaccccgggctggagaccctgggggagcgcctgctggccaggaaaaaggccgccagcggcgatgcggagtcggtgtgggacgcgtacatgcggcggcgggccgagaagcgggcccaggcccggcggctgggaaagagcggcgtggggagcagcgacgaggacagcgacggcgacccggaccccgcctcctccggggacgagggggagatgctggccgccggggtggccgacgaccccttcttccagcgcgacgagggggaggaccccttcgccgaccccttcttcagctcggctccgggggtccctggtgccggcatggcggccaacgctgccacggccaggaagaaggagaaacggtccaagagggcggaggagggggcgacggccgcagagcgcgctgagctggagatgctgctcatggacgaggccgacatgctgcgcaaggcccaggccggaggtgcgagccctcggggggagggtggaaagggcgggacggcggccatggtaatggcgggttgggaagacctgaccctggtgtgtcggtacctggtgtatctgttgcacgagatccagtttggacaccgccaaccccacgccccgttccccaggcacgtccagcaagccggcccccaagctctccaagaaggagcnnnnnnnnnngccctcggggggaggggtggaaagggcgcgacggcgggcatggaaatggcgggttgggaagacctggccctggtgtgttggtacctggtatacctattgcacgacatccagtttggacaccgccaaccccatgccccgttccccaggcacgtccagcgagccggcccccaagctctccaagaaggagcgcctgcgcctgaagaaggcagcgcggcgtgcggagcgcgcccagggctccgacgacgaggagcttgcgctggcaggtgcgtgccgtcggttcacaccggggccgtcagggctcggtacacggctgccagggatactgggcaaaccggtggcaggcgtggaggatccccgcttctcgagcattgtcacctcgtccctgtatgccctggaccccacggacccccgatacaagggcgagagcgcgaccctggccaagcaggtggccaagctgcggaaggagggggcggcggtgccggcggcgtcggagccggtgccgcgggagccggccgcgcccagcatggacgccatcgtgcagtccctgaagcggaaggccaaggagggccggcaggcggggaagaagcccaagcccgcacggctgtaggggatggggctgtacgccccacctgtcatgccgtattcacattcaaacgtgaggtgcagcatctcccgccaccgtcaaccacggtgggacgagtcggcgcatggccgagagtcaagacgacccccgccctgcctgtgtcgtgtgacgtgagaattgtgcgcatctcggcgagctttccaaaacgccgcgtcctccccgagacgacgatgccagattgctag

SEQ ID NO: 1942 - DNA, 1563 bp, Chlorella protothecoides
atggtcacggggggtccccagcctgggtgcagtgcagggcgagtgagatggcaatcgggggcgctgagccccacgcagggcacgcaaggggggccaagggttggaggttcagggggaccgcaggcgcccggggcgacgggctggctgggggaccgcaggcacttggggcgacgggctggctggtcgagggggcgacgggcgcatcccggtgccgaaagcacgcggtcgaggcacgagcgcgcccggggcgccaccctccctctgcgcgggccccgctcagtggctgatctcggggttgagctgcctccaggcctcgatccaggccacgatgccgtcggccagcttttcgaagtaggggtccagagatcagctgagtgggatgtgcatgcggtggaggtgaacgggcccgcgcatgcacacagagcagtgccctacgtcccgccacgtcttcattccgcaccccctggccaggccccccgagcccgccatacgcccagcgcacgtccaaaccctctcggcctccacacccatgctcagacccactccctccccactccccctcacccgctcggcgatgtccagcatggcggcctccacggtggtcacgctggcgtccagcttgatggcctggaagaaggggatgatctcctcctgccagaagatgcccttgtactccttgcgcaggttgacaaaggggttgctggccttggagtgccagatgtagggcagccccgtcttcacgcccaggcccaggtggtcggcgatgaccttgacgcaccaccccgcccacatgtcgtcgtagcggccccagggctggccctcccccatcaggccaaagtacatggcggggccgatggcgtggcggtcaaaggccaggttcatgccgcacatggggaacagcgtgccctgaggggtgagaggggagggggggacttggtttgggggctgcgtcgcgacgagggccgcaagcaccgcagggcaagcaggaagcaagggaaggccagcatggcgcccgagcatgcaccctacagacaagggatgaaagcagcatgttcagacccccctcccccccctaccctccatcaccaaactcaggcacaccttgggaatggtcatgacagcgtccacgtatcgcgtgttgcgctcctgcggcttcaccatctgggtgggcgcgtcgtagtctgggatgttgagccagaggccgtgcgacaccgcggtgggcttgccctcgcgcatggagaatgggtagccgcgcacaaagtcgctgcccgccacgtacgggtcgtacagggtgttgaagaagtcgggggtggagggggacagcaggttcttgatgtgctgctccagggcgttgatgtcctcgccgctgggggtcttggccacgaagcagtcgtcgtcgatagtgtagatgtagcgcttcttgctcaccatgtacccgaagcagctgcgaggatgggcaacagggtggaggggagtgagctggaagaggggaagttggggaggggcagttggacgcgcaccaggcactgcataagaagcctaggcagaattccggccttgtag

SEQ ID NO: 1943 - DNA, 210 bp, Chlorella protothecoides
gccgctcgccgccgcgccttcctcctcgcctttgccggcagccccgtggacgcggtgcaccacctggtggcggcgcaggcgcgcgacctgcgcatcgccgccggcggtgacgcgctggatgtcctgcccccggccgacgtctttgccgagcgctgggtggaggacgcagcgctgcgcgtcatggccgcgcgcggcgccgcggccggctag

SEQ ID NO: 1944 - DNA, 417 bp, Chlorella protothecoides
atggcgccgcctgagaaggctggtgggtctacagggaaggctgacaatcaagaaatggacgaccgcttcgctgccgtgagcacggaccctcgcttccggcgcttccccaagaaggagagcaaagtcaagattgatgaccgcttcgcaggcatgttcaaggatgccgccttccaaggacaaggcgctcgggacaaacgtggccgcaaggtaaagagcggtggaaaaggcgagaaactacgctcctactatcgactggcaggagacgaggaggagcccgccggcaagggcaagcctgttgcgtctgaccctgattcgagttctgaggatgaggcggctgaagccgaggcgcgatgggcaaaaatgaggtgcggcttggcaattggaatggaacgtgcatcactttccctggactcgtag

SEQ ID NO: 1945 - DNA, 609 bp, Chlorella protothecoides
atggacgacgcggtggtgaccccactcattcgcttaacaccacgccgtatcccgcgccagatcccgctggtccccgacgccacaccgcggctggccgtgctcgacctggactgggagcatgtgcgagccgtggacatcctggcggtgctgcgcagcttctgtcccccaaagggcggggtgcagcgggtcactgtctacccctctgactatggtctggagcgcatggcggaggaggccaccgctgggccccagggcatctgggacgccggagccgatgggaagcaggaagaccagggcgggtctgaggaggacggggagggcccgtctgcggggaacgacggccagcacaggcgtgcccatgcacaggtctctcaggagccaggggtccagaagaagacgccgttcctgctgctgtgccatgcaagggcaggtggcgggcgcagcatggccacggtcaacgactcgtttccttggtcccccatcattccatgcagccgaaatagagcggcggcggctccgggcgtacgagctgtccaggctgcggtactactatgcggtcgtcgagtgcgacggcgcggcaaccgcttcgcggctatacgaggagtgtga

SEQ ID NO: 1946 - DNA, 498 bp, Chlorella protothecoides
atgcagatctttctgcgtggcctctcagggcgtacccgggttctcgaggtggactctgcatctagcatcgcggacttgcagctcaggatccaggacgtggagcatgtcagccctgcagaccaggtcctggtggccggaggtcgcctgatgagcggagaccatacgatagaaagctcgtctctgagccacggatcaacgctgcacctctctagccgcctgcgtgggggggtgcctgtgaaggtgaagatcatcaccccccacctggcctgcgggaatgaggtcaccattgatctggagcccacagcaaccaaggatgaaattaagctgaagctggtggacgccactggagttccgtttgagcaccagaaggttctgctgtctgggattaaccagattgcccttggcgacaaaaggtgtgagagtggcttgaatgaggcggatgttgaaaggggatggtggtggagctgtaatgtgaacttcgactcgcctgctcagtga

SEQ ID NO: 1947 - DNA, 330 bp, Chlorella protothecoides
atgaagctcggccaggtagccagggaatacggcctggtggcctccaccctccgcaaggcaacacctggcaaggttttcctgacgcgggcagagtttaccagcgagaaggagctgtttggaaagctgggcatcgtgtcgctaccacacctcgccctcatcccccccagcctgccagtgggcgctgcacaggccgtcggcctcaccaaggaccatgccatgcccctcaacgactacccctggtcggccgagaccatcgcggggtgggtgatggagacggcaggcctgcctgccgtcgagatcaatcggccctcgctgctcaagtccaggtag

SEQ ID NO: 1948 - DNA, 273 bp, Chlorella protothecoides
atgagcagccatgatccagagggtagcaccctcgcgctgcactctgtctgcgtcgctgcaaagcacagacggcagggcctcgccacgagatctgtcctgcaacaagaagccgtggtgcatgccatcactactctgcaggtagctttgtatgagggagcgggctttgggttaattggcccttcctcggtggtccatggccaagatgtgtggctggagatgcgcctggacttcagtgacagtgctgatgggcttgactggtgcgtgggcgcctga

SEQ ID NO: 1949 - DNA, 1209 bp, Chlorella protothecoides
atggcgacagcaccacctcgcccgggggtgaattctgccaaacccgagccacgttcatgcttgggcgtactcttctacaaccagctacgtcatgacctcgggagaccaccggcatgtgctggcattaaacgccgaaaggaagcaggcgctgttctaaatgggtcgccagatgccctcccgagtggcgacttcaagttcatgtgtgtagggtacagtgcatacgacgaggcagctctcagggacgcgggccgaaatagtaaacctggggagcccatcaccatgccagcctgcgagggaatcgaggtagtagctgccgcacatgggcagcacaaccctagactcatgccggagggtccacaggcagacctgcctcccctggcagccacccgagaagcggagggtcggcctgccaagccgcgacctggaataagttatggtgaggaggagactccgggtggtgggttgagattgtggctggggtggaaacatggaacttacaagtcttggtttctgggaccaccatgtctcgtcgcctttacacccttgaagactcattccattgctcacctacctctcgccaggggagcgcaggcactgaggacgggcttcacgtcatggagcaggggcctggctggagtcgagcggcttgcggccctgcgatgggggacccttgctgccacgagtgtgcgtgccatgctggctcccatgcctggccagtggccctgcacgctgcgtgaccctctgcaactttcgtacatagtcgtcaggcacaggccagagcacgctgggtggctcggctgctcagaacgaccacctcgggcgctcttcgctgctcttgctgttcctgacccctctctgtaccaaagagtccgctccatgttgcccttgcatttgatggagcagagcatgccatggtctggtgtgcatgcaccagagagggctccgcccaatccaggaggtgcttcctccaggcccccgcatatgcagtcacgcactctccacgcccgcaaaggccgccacagcctcgcaagtcatggtgtcccacaccgccaccgtccccgccgccccgcccgcggccaccagcatcggcgcgtcggcgcagaagccggcggagaacacggccccgaccttgaggtcctgggtggccagcagggccggctcgccgccgccccgggtgtcccacagcttgacctggtgcaggttttgtga

SEQ ID NO: 1950 - DNA, 1860 bp, Chlorella protothecoides
atgcccccactccccccccgcccgttttcattacacctccaggtgtcggtcggcatccccgcagccacgacccttcctgggcattcgactgcaccggccttccggctggtcccctcctgggcactgggatccggggtggtgttgctggtgctggcctttgaccagctgcggcggcagtggtggaggctggcgcagccccaagggggggtggcggtctcagcacaggctccgcctgctcaagaggtgccgatctccatcgctcaggggccgccgctggcgactgttcaggacgcgccggcttttgccgctcaggagtcgccgcaaaccattgctcgggaggcgctcctgcccgatgccctgggccaggccactgaccgggtgcagccagcccctcccacacccttctcccctgtcgagctggcagcgctccacgactcggcgcaggacagggcctgggcattggagtcggagctggggtccctctatgtcaggctgtgcaggggcctgccccggcacgctaccagcgaactcgaggcgctgggggcgcgaatctcccgcctggaggccgaagcagatcgcgacgtgaggcggcctgggtgtgctgtgttggagtcctggacacgtttgatttgcaatccatgccacctgcatgtcgcacgccatcggcaggcgtgcatcgtgtcatcccaacacctctctcatgtccaccaatcacaacagggcgaggcgcccgaccatctgcaacgctgcgcccagctgtccagggcacagctggatgtcctagaggcggcaggcgcggatgtctccgcgtatgcccccctcctggcctcctactttgatcagcgggccctcgtgagcaaggtggagggcatggtgcgctccctggcagggccacgcgcggctggccaggccggcacggcgaggacacccgaggtagatggcacgtccacatttgagacccaggaaagtgactttcagagcgggagttccctgggtggggctgtccaggaaccccgacaggcagaggaagacgacggcgcgacagtccagccctcccgaggagatgcccagctcgtgggcggcaacgtgcgggagggaatccttgctcctgggatcacaggaccagctcctcttgggccgcaacctgaggcggtcctggttgacgtggcagagaatggaggaacggagggcccaggtcggtctggcgtgcaagggagcgagcaacagcccgccaccagccagtcggcaccgcctgcggtgattccagagccggcgccctggccacaatccgcggtacccgaaggcgcgccggcatcggtccgtgatccacccgaagctggtccgtctgccggacccgaccctgccgggccggccgcccctcccgctccctcagcaccccggcttacggtggtcgggggagctgccatgtttccccaccccgccaagcagaagatgggcggcgaggacgctttcttcctgggcagaagcgcctttggcgtggccgacggggtgagcggctgggccgactacggcatcgacccctccctctacccccgggccctcatggcctcctgcgcccagctggcggacagcggcgacggcgccccgctctccacggcggcgctgctggagagcgggcacgaggccgcgcaggagcccggcagcgccaccgtggtgctcgcgcagctcgaccccgcccgatccacgctggacatggtctgcctgggcgactgcagggcctgggtggtgagggacgggcaggtggtgctcgagacggaggtgagcggggacgaccctgagggcacgggagttgacgacagggtgggggcctgttcaaggcacctgcaagggaggatgtaa

SEQ ID NO: 1951 - DNA, 762 bp, Chlorella protothecoides
ccgccggccgtcgcggccgccgcggcgggcaggccggcgggacccacgcgccacttcgagacggagctggagatcaacgacttcccccagcgcgcgcggtggaaggtttgtgtgtgcggggtcttgagcgttgacgcgggcaattccattgcatggtgcaagccccaatctcacccacacaccatttcacccacacacacaggtcacgcaccgcgacaccatcaacgacatgggggagctgggcgcggcggtggtcatcaagggcaccttctacccgcccggcgccaaggtggccgagggcgaccgcaagatctacctccacatcgagggtgggtgggccagagtctcccctttcttgggggaagggaggggaagagggggcgcttcgccaggggccgccagcacggggctactcgtccagcttcatccaagcccaccctgccgctgaccggagcaaaggccattccctggcctcccacagctcttcaccccaggtctccacccccccccttcacgtcggctgtgcaggaccgacggagcagatcgtgcggcgcgccaagggcgagatcaagcgcatcatcgaggaggagacggagcgggcgatgcggcgcgaggccccggcggcggggaggtactccgtcatgtagccgcggcagcctgcctcgtctcaatccacctccccaggtgcgtgggcggcctgggctggtggcgctgcgtcttgaattcttggtgtgcaagggtctgcaggccgtcggcctgtaa

SEQ ID NO: 1952 - DNA, 273 bp, Chlorella protothecoides
atggcttcttcggcgggggtcgaggacatgcgcactcccgacgagaagggggcggagacctgctggccgtcaggtccgccctacagtacggagcgggaagtggtcggcgatacatcacaaattgggtcagatgccatgcagggtccccatgcacgccgcaagggcaggaagaaggtaccccccgtcgacctggctcgtgttgaggatccggaggagcggaagcggcaacgccgtctcatgaagaaccgcgagacggctgcagcctccaggtaa

SEQ ID NO: 1953 - DNA, 1257 bp, Chlorella protothecoides
  modified_base (114)..(123): a, c, t, g, unknown or other
  modified_base (290)..(299): a, c, t, g, unknown or other
  modified_base (772)..(781): a, c, t, g, unknown or other
atggaagggagtgagcagatcttgcacacagcaccatcaggctgtgccagtgggagagacatggctggcattagacagctgtgctggagctcctcggctctttcgcacagcctnnnnnnnnnncacagcaccatcaggctgtgccagtgggaggaacatggctggcatcggacagctgtcctggagctcctcggctctttcgcacagcccaagttccacgcccttacacccccctgcccatctccaccccctgtccacacaggacgccgaagcactgatggtggggcatnnnnnnnnnngctgcagaagcagctgaactcgggggccatcagccagcaggacgctgaagcgctgatggtggggcacgccgagaagaccctggcagcgctctggaaggtgaacgtgctggacatcgagaagacgctggaggccgtctgtgtcgccgtcctgaacgacgccggtgcggctgggttggcggggagaggggctggatgcaggaagtatacctgcgtgcccaagtctgagctggccgagcgggcgctggccctcaagcgcatcggcaaggtgtaccagtcggtggcggccgccgcagccctggccacggggccgcgccgcgtgctgagccagaccttccccggggtaaagacggagggcgggcagggcccggcgcccgccgcagcggcggcggcagctgcacagccaccggcgggagggtggtccaatcccgcgcaggccggcatgcactctgccgggtttgctgcgggggcggctnnnnnnnnnntgcacagccaccggcgggagggtggtccaaccccgcacaggccggcatgcactctgccgggtttgccgcgggggcggccgcgaccactgccgggccgggcgccgccgccaacagccccaccttccagccgtgagggttgcagtaacctttgccatggtagattaaccattcccggatttgacccatgttattgtgcattgttacagatacagctcagcccagagcatatactgtgcagcgaggggatcacagtgcagtctgacagcgcacgccagcaacccaacctgaactgtcaagggcgatccatttgcttccacatgccgcccttgcggaaacctggagccggagtttcggtcattctacgctccgagataagcgggaccacggcaacagggtacagcgctgcaagcgtgaccccaaggaaggcagtgaccgtggcaatgctcttccagtcgcgcgccattttattggcgtga

SEQ ID NO: 1954 - DNA, 1635 bp, Chlorella protothecoides
  modified_base (75)..(84): a, c, t, g, unknown or other
  modified_base (1596)..(1605): a, c, t, g, unknown or other
atgcctcttcagagtaccagactgcctggcagaggagagaccagcatgccagaggccggcgcgcggcaggagcannnnnnnnnnacggcaccaggtatggcgtctcctcccctcgctgtggagcttcgacccccacagtatgcaggagcggatgtaccgaagaggagagggcgaaaaccccgtgccagcacgccggcgcggcccttcatctccctatcaggcgtgccggcgccagtagagtgttttcgtggccagcagcgggaagctgccgattgcgaggaccctggctctcggcccagcccaggccatgctgcctcccctgagacgagaatatcacgccagtttgacgccctcctcgccccaggggtcctctgggctcagaggcatggcacgcctcgatccacgcccagtcctgcacctcttaggaagaggttgcagggggcggggggcgggcctgcagatgccccgcctcatcactgcgactttatgtcacctgagaagtacctttgcaaagatggtattcctgaatcctcgaccctttggtcagaagtctcaatcaaagtgaaaacaagatataacggagtattgagctgtacggcaaggcaagtcggtgaagcgtcgtcggtaccgagactggagtctgctgcagcccagttactcctttcggagacacccaagcagttcctatctccactgtcgacatcaacacgacttcaagataaactttgcatccactcgctccacaggtgtcacaggatggtgaaggagactgtctactacgatgtgctgcagatttcggtggatgccactcccgaacagatcaagaaggcctactacttgagggcccgcaaggtgcacccagacaagcgcccgaacgaccccaatgccaaccgagagttcgaggccatgctgtgtatgcatcctggtcatctaggacaatcagcactggggatggttacatgcgggtatgacctgccaggccatgcagtgtatgcgttctggtcatctaggacactcagcactgaggtcagactgcttttatcaaagagagcgtctttccccgtcctcgaaccgttcccccttgtcccgttccaggagctgggcaccgcataccaggtgctctccgacccccagaagcgcgagatctacgaccgcctgggcgccggcggcctatccgacacccccctcatggacccctccgttctgtttggggtcctctttggctccgacgcctttgaggagtacgtcggccagctgcagctggccaccgccgcctccatcgcggcggacgccagcggccagcccctcacgcagcagcagctgtcggccaagatggccgaggcgcagcgtcagcgcgtgaaggagctgacggagcacctggccgcccggctgcggacctaccagggggccaccaagcctgcgaccctggagcgggcggggcgggaggccgccgacctggtcaagttcaactttgggcccgagatgctgaccaccatcggtctctgcgtgggatggggcacggcaccaagaccaccgtgcgcagggttgccggtgactcgttgtgttgctgaggctagtagacgtcggaagggaggnnnnnnnnnncaagaccaccgtgcgcagggttgccggtga

SEQ ID NO: 1955 - DNA, 756 bp, Chlorella protothecoides
atgcgacctcgcctcggaaccccccacccccatccccccaaactctcactctcagtcgcccatccttcccacctccagggctgcctgggtacgcggggcatcaacctggaggaggaggcggccaaggcgccctgccaggagtacatcgactacatgcactcctgcaacgaccagccctaccccatccacgtcaccgtgctgtgggccatcgagaaggcctaccatgaggcctggcacgcgcaccagcccccccagcccaatcaggcgccctacgactacgccaccgagcgctgggccagcgagcccttcagcaagtacgtcaaggagctgcaggccgtggcggacgacgccctcgccagcgccacccgtgacgagaggtggggtttggaagggggggaggcgggatgtgaagttaccaggaggtttcagagatgggggaaggatggtggaggtcaagggtcgcttttggaagcattgatgactaatgtccacaccatccctctcccccgccaaccaataccctttcccactcaccacactgcaggacggcggcgcgggcggccttcatcaacgtgtgccgcctggagcgcgacttctgggccatggcctatgagacataaacaaagaaaaccgtgcccccgagcgcgtgatgccgctccgcccggcagaggccgctccgctcagccagtcgtgaaggcgccggcgccaaggggagagatggaaagagcgagatgggcatgttatgcctgcatttga

SEQ ID NO: 1956 - DNA, 1092 bp, Chlorella protothecoides
  modified_base (162)..(171): a, c, t, g, unknown or other
  modified_base (695)..(704): a, c, t, g, unknown or other
atgccgcacggaggtgggtcggtggggtacttggggacctgcacaccggagggaaggtgccatttccggcccgcatacgctgtcagcagtctcccagcccctgccacgctgcaccctgacttgccctttctttctctcatccacctctcccctcacactgcnnnnnnnnnncatacgctgtcagcagtctcccagcccctggcacgctgcaccctggcttgccctttctttctctcctccacctctcccctcacactgccctcacgtgtacgacagcccctgcccctcccaacgcctccctgcacacacagtcccatgtttgtgctgcccatcttcaagggccccaatgcattcgagaccatcatggtccagtgccagctgccgtgcgtcctcctgacgtcgctggaggagtacaagcggcagggccccgtggctgtcccgttcatgaccatgacccactacacggagctgcagtctaccaagtcggtggtgctggtgcgaggggacatcgtggaccccaacgccctcacccgcttcgaggtgaggcgtggtacgtggagtgtgcagggcatacgggcgggaaccatggccaggcaggatccagctggcccttgccctgcgtcgtgggcatggctgcagcaccattcgctggggcccatgtctggtgctggcaggctggcggcggggtccactcnnnnnnnnnnggaccccaacgccctcacccgcttcgaggtaaggtgtggtatgtggagtgtgcagggcgtacgggcgggagccatggccaggcaggatccagctggcccttgccctgcgttgtgggcatggctccagcaccattcgctggggcccatgtctgatgctggcaggctggcggcggggctcactgtcccagcctgcaggcacctgagcatggaggtggacccctccctcgacgatcctgtgttctccagccagccagccttgatccctgccccccccaaccccctgtgccacgcaggccaccagcctcatgaggatggtgcacgaattttacacggagagagccaagcacgtctttgtgcacgccttcaaccacaacccgccctcctttga

SEQ ID NO: 1957 - DNA, 309 bp, Chlorella protothecoides
atgtcaccccggagccagggccccaagtctgcatggaacctgctgcaggcctcccggcgatgctactctctgggtggagtgtccgcaccttccagtcggaatctgtgggacattgttaaacgggcagagtttgagaaccacgatgccaagcacgttcacgacatctggatggaggtgggtaggaggtgcattgccaatactggggtctggctggtggaacgccgttatcctgagcccagcctgccaaccgagcacattctgtaccacagttccacgccgacccactcaagcaccgggtggcagacgtga

SEQ ID NO: 1958 - DNA, 186 bp, Chlorella protothecoides
atgcctgaggttttcgggtgttacctcctgaggtcctgccacgccaaggggaagggcagaacgtacatcgggttcaccgtcaacccctcccgccgcttacgccagcacaatggcgacatcgtcagcggggcggccaagacgaagaggtatgcatctgttgactgcgtgcgtaccttcgtttcgtag

SEQ ID NO: 1959 - DNA, 354 bp, Chlorella protothecoides
atggagtatgggcgagtccctgtgaccaactggatggccaagggggtcctttgtctgctggggagggcctgcagggtgcaagcctgcccccgctcctcgcgcggcacctggcagcggcgctcccagtcgcatgaccgcacgctctcctggaagatgcctctgcaacaccctgtcactcccactcaccccccttgccaaccccccccgcgcaggtacggctacggcctgcccatcagccgcctgtatgcgcggtactttggcggggacctgcagatgatctccatggaaaactacggcacggacgcgtatctgcacttgaatcgccttggcaatgtgcaggagccgttgccgtga

SEQ ID NO: 1960 - DNA, 609 bp, Chlorella protothecoides
atgagccagtgtgacgggcggaggggacacgcacacgaacagcccttacttgacagagggcatgtaccccagcatgccgccctccatgttcgccaggatttctttttcgcgagggaatgcacccgattcatcgcacttaacgtcgccaacgccccgttcaagctcttccccaccctactcggaggcctcaccgccattgacgacgagctccagtggttccaggtgacgattgatgggaagggcaacgcctacatcctctcccagctgatgaaaattctgctgcccttactgtcggcttcctcatactgcccacagggggagcttgaaaagcggaatgtcatcgtcgaggagcacaacccccttcccacctgtgcacagtacattgagtatctcaacaagagcacgggtataccctatgccgttcagctcacaatcctgtgggtggtggagaaggcctaccatgactcatggcgactaaacagtcccatggaggagccgtacggcacgtatgctcagcgctgggccagcgacgcatttgcagagtacatcctagccctggagggccatctggacaccctcatggagacggagggcagcgcagtcaggtga

SEQ ID NO: 1961 - DNA, 930 bp, Chlorella protothecoides
atggtgctcttcgtgcacggcttccccaccgcggtcacagccctgcagttcgagtgggcctggcagcatccggaggtgtcgctggacgtccgcgcggcggcgcagcgcctgggtaaaaagcggctgcagggcgtgcagggcaaggtgcgcctgctgcacgagatgttgaacctggagccctggcgctacttccccctcagcctccacatcctgagctcggcgcacgcccccctgcgggcccagtgcccgcccctgcccgcccacatcgccgtgacctttgctcccctggaggtggggagtgggagcttggtgggggaggcagtgctcggggacattcagggtggggtcgtgccagagagcggggctgggaacgtgtccacccctgctgcggagctggcggggtatgacatcgcagacgaatccacctcccaggcagaggaagaggcggcgcaggcggccctagggtccacaaactctacgacgccggggtccaaagcgtccagcccggcgcccagcctggcgcccagcccccacgcctcgcccagcagggctggggggaagggggcgtgcgggctctgcgccggcgatgccagtcgcacctggtgggcatgcagctcgtgcgactcccgattccacctgggctgcctggcccggcacctcctagagaagtgcgcgacctcacggctcaagacacccctcgacactcgtgcaggaaggcggcaccctcccttcgcagggcagctgcccgacgtgcgaggcacgggtgacgtggcgggaggtgttgcgggacgcccggaacgcggggtgggtgcagcatcaaggggcccgcaccaagtcgtccccggcagccaggaggcgggctgccggcagggcggcggcatcaaaggcgcagaaggcctcacccctggcctcgccggcgtcgcaccctag

SEQ ID NO: 1962 - DNA, 327 bp, Chlorella protothecoides
atgtggcgccagcctccacccctcactcctcagatcctggcgaccaccgacgcggcgctgcggctggtgccgcgcgaggcggcgccctgcggtgcctctctgctgataaactacgacctcccggctccgcaccctcagcgtgggtacgcgacgcgggtgggtcacctgctgggcggcgccgcccaccacccccgaatcgtggtgagcttcgcggccgcgggcgccgccgcggagttcaggacctatgccggcgagcgggacaggcccatcgaggtcatgcccatccgcgtggcagagatattcgagcaggggcctgccaggggctag

SEQ ID NO: 1963 - DNA, 348 bp, Chlorella protothecoides
atgaacgcggtgtccagccgcagccacgcggtcttcatgctgacggtggtcaagcgcaagccggtgggggacggctccgacctgcaccgcgtccgcatcggcaagctcttcatggtggacctggcgggcagcgagcggctgaagaagagcggcagcacaggtggatctgggtgtgtgcgaggaaactgctgctggggaagttggggcctgctggagcaggctctggcacctactgaccggcacaggtttgcccatggctttggcacctccaagacccgtcggtcgggcgagttgtggagcgggccatgctcagtggggacgacccacgcagattcgccagcccgatga

SEQ ID NO: 1964 - DNA, 930 bp, Chlorella protothecoides
  modified_base (868)..(922): a, c, t, g, unknown or other
atggatgcgttggaggcgctgagcggatcctcctccgacagtgaggccgaggccgagccagagccccagcctgcagcaaaaaagagcgctgccaccaagatcagcctggaggacttgcagcaacatggatactctggcggccccagtgtgctctatgtgccgcccccagctgacgcggatcccaactggacatggtgggtcttagggctctggctgggtgagcgatctctggctatgccgtcctcgggggcagatcgcaagggagtcgagcctgtgcaggagtctcgagaggagagggagcgtaacagggaggccgtgacctccggcctggatgaagaggcgcggctggcccgcgccgccgtctcgcatgcccagcagctcaaggctggcaggagggctgaggcccaggcgcagaaagaggcagccaatctgagctggaagcagaaggtaagggcgtgggagcaggggtgctgtggattggcgagcttgttgtctggtggggaacggcattcttgcagttcgcaaacacagcccagtcgaggaggtggttatcttggagcgagagggagcctcctgctaacaggatctgtcatgtgtgttgatgattctcctgccaggacatgcaaagcattgaatggcaaggatcctcccaaggacaacccctcatgggggggattttatgtaaaaggcatttcggccacgccgactctcctcaccgcacccgtatcgggcttgcgccgcttgcacagctacgtccgcaagaatcaggctggcgcagttggttgccacggacggcgaaccgttttttgtgtagagggtgcagggggtgtgggggcagcgaacaagggggcccgccaaaggccgtggnnnnnnnnnnnnnnnnnnnnnnnnnnnnnnnnnnnnnnnnnnnnnnnnnnnnnnnacgcttga

SEQ ID NO: 1965 - DNA, 192 bp, Chlorella protothecoides
atggtgcgccacaacaacgtggtgcccaaccagcacttcaggaagaaatggcagaccaacgtgcggacctggttcaaccagcccgcccgcaagctgcgccggaggcagggtgagcgccctcgggacggggacaggaggccctcgaatgcgctccagctcgcgttctgcgctggagacgggcggggaagctga

SEQ ID NO: 1966 - DNA, 1221 bp, Chlorella protothecoides
atgatgcagtgcatacgtcacattcccatccacccgcctgcctcggccccccactcaccctgtgacaaccgcccagaggcccaagtagccccccaggttggtgaccatgcccaggaggagcaccaggcgggggcccagctggtgccagtcctgcagcgcgtcatacagcaggccggcgaagatggcggccaggcccccgatgttggcggcggcccccaccagctgcagctggccctggtcaaggtggtaggccgccttcagatccgcagaccatatggagaagcagtagactatgccgctgctcagcccaatgggcaagctggcggcgaaggtggaccacttgttgactgggcgcatgctggcttccaggccgtgccagcccccgtctgcggcagaaacccgggtcagacctcttcaagaacccggcatgcgagggtgacaatgcaggggatcgcaccaccgcgggtcggggattctgcagacttgcacgtgcatgagcgcgagcaaatgcggtgtcgtgaaaagaagtctccgacgacggtcctccacctgtgtgaagacgggattcctcaccgaaagccttttgaggtacggaccaagcgtgtcgtccccagtttccccgccagccgagcattcgtccgcaaccatgaatgccatcgtgggccacgctgcgagcccatgcaccctgcttcctggtgcgtcagagatatgttatggctcagtgagtatcattacatgctcgacgagcttaaaaagccacccacaccacccgcagaggcggcatggcgacacggcgcggtgcgatccctctctcgcccggtgggtggggccagcactgttgcatggggggcattgcccctacgccacaaggccacacgagtttttgctgccaagaatgatgagttgctcgccaagcctgtcccgcggaggcccagggaggagcaggctcaacaaaaggcagacgccccatcggcagcggtacagggccccacaccaccttcacctgcctcctcacctgccgagacggagaaggccacttccaggacgcctggcgtgagcctggagcatcagcgctcccaagccaagctcatgctcaagtacttcagggagaagcaggcagcaaagatccagtccagcggaaggacaccacctcagtctatcgaaaccctgctcctcgcccccacagtatttttggctggaacaaaaagaatgagatcctga

SEQ ID NO: 1967 - DNA, 1008 bp, Chlorella protothecoides
atggccgacacggcagtctcctccagccccagggagctggctcaggccccctctgaggaccccctggaccggcccgacttcgacgtcaccgcctatgtaaaccgcctgtttcccacggaggagtccctgtccgggctggaccccctggtggcctccctccagcaccgcatctcccgcgtggacgccggcatcctagccagcgtgcgccagcagagccgcgtgggggggcgcgcgcgcgccgatctggccgccgcccgcgccgacgtggcggccctctgcgcccgcgtcgccgccattcgctcccaggccgcggccagcgaggccctggtgcagcacatctgccgcgacatccggcgcctggacgccgccaaacgccacctcaccgccaccatctcctccctgcgccgcctgggcatgctcatggccgcgctggacgcgctgcaggccgccgtcgagcgcggcgactatgccgaggcggggaacctgctggaggcggtgcaggcgctggccgcgcattttgccgcctacgcccacgtgccccgcgtcgcggagctgcgcgggcggctgggcgcgctggagaccagcgcgcgtggccgcgcactgcgcgacgcgcgcggccgcgcgctgcgcgagtttgaggcgctgggcgaggcgctgcccccgcccgccaccctggagcgactgcgcgcctgctgcggcctggtcgccgccctgggctaccaggtccgggacgagctgatcgacgcggtgtgccggcgcgagaccggggtgtacacccagatcttcggcatcacgggcgagaccgcgcgcctggagcgcaccgtcaaccgctacaagtggctgctcaagcgcctggatgcgaggcgcgaggtgtgggccgtcttccccccggcctggcatgtcacgcagctgctctgcgtcatgttctgcaacattaccaagaccgcgctggccgagatcctggacctcaaggtgaggaagtgcagaaggtgggggggtgggggttga

SEQ ID NO: 1968 - DNA, 708 bp, Chlorella protothecoides
atgcgcccagtcaacaagtggtccaccttcgccgccagcttgcccattgggctgagcagcggcatagtctactgcttctccatatggtctgcggatctgaaggcggcctaccaccttgaccagggccagctgcagctggtgggggccgccgccaacatcgggggcctggccgccatcttcgccggcctgctgtatgacgcgctgcaggactggcaccagctgggcccccgcctggtgctcctcctgggcatggtcaccaacctggggggctacttgggcctctgggcggttgtcacagggcgcatctcgccgccgtactggcaggtctgcgccctggccgcgatcgcctgctccggcaacacctggaccgacacggtggtgctggtgaccaacgtgcgcaacctgccgcagcaccgcggcacggtggtgggcatcatcaagtcctgcgagggcctctccgcctccgtcttcaccgccatctacctcggcgtgtttgcgccgcacgccaagcccttcctcctgttcatggccgtcgcgcccgcagtcatcgacctggtgggcacgctgttcgtgggccacgtgcccttcatccagcacagcgagctgaaacgacgcgggcggcgcaccttcaccaccggtgtgtgcgggggcgggtccaggagttggtacctgtgcggagggtgggagcaatgggtgtgcacatgctga

SEQ ID NO: 1969 - DNA, 1047 bp, Chlorella protothecoides
  modified_base (803)..(812): a, c, t, g, unknown or other
  modified_base (1021)..(1030): a, c, t, g, unknown or other
gccgcggcccctgctgcggcaccggccgcggccccgactactacagcaacacctccagccccagccgccgcgggcgtcatcgggcaggacgcgttcagtagcgccctggcggccgcgatgcgacacagcgcgggcggcgcggcggcggagcgcggaccgaccgacgcagaagctgccgcaggccccgcgcccatcgacgccgccttcctggaggtgcttcccgaaggcctgcgcgccgagatcctgggcgccggcagcgacgccgacatgctgagcgccggtgaggagccagaggaaggggaggaggaggacgaggacgaggaaggggccgcaggaccggccggcggcgcgggcggcgaagcgccgctggagcgggagtccagcacgagcggcatcgaccccgagttcctggctgcgctgccgcccgagctgcaggccgaggtgctggagcaggcgcggcgcgagcggcggctggcgcgggaggcggaggcgcgcgagacggcgcgcgcggcgggcgggggccccgcgcccggcgccgccgacatggactttgcctcgctggtcaccagtttcccgccagaggtccgggccgaggtgttcctcagggaaagctgttgggagggccatggcacacaggtgggggagcaaagaagcactggtcggggctgcccgggggaggagacgccccaaatcatggtgctggaggaacacgtggcagatgactgtgttacgctgatcagtggcacggccgatgcccacacctgcaacgagacgataccagacatcagcagccaggatcgtgnnnnnnnnnntcggggctgcccgggggaggagacgccccagatcatggtgctggaggaacacctggcagatgactgtgttacgctgatcaccggcacggccgatgcccacacctgcgatgagacggtaccagacatcagcagccaggatcgtaactgtgctctgtgtcttgagcacagcaagtgggcacacacatcgctgcacccctccacgttcaaannnnnnnnnntgtgctctgtgtcttga

SEQ ID NO: 1970 - DNA, 1263 bp, Chlorella protothecoides
  modified_base (168)..(237): a, c, t, g, unknown or other
  modified_base (424)..(433): a, c, t, g, unknown or other
  modified_base (759)..(768): a, c, t, g, unknown or other
  modified_base (1046)..(1055): a, c, t, g, unknown or other
gcggcggtggtcgccgcgctgcccctggccctgggcgagggcggcgccggcggcctgccggtgccgccggggctgagcgacgcgcagcgcgccaccctgctggccgagaagcgattcctggaggcgctgctggcgggcccggcggcgcaaagttgtggcggggggggnnnnnnnnnnnnnnnnnnnnnnnnnnnnnnnnnnnnnnnnnnnnnnnnnnnnnnnnnnnnnnnnnnnnnncctgcgaccgtaccagcgcgagggcgtggcgtggctctgcttccttcgcgccacgggcctgcatggcgtgctggccgacgacatggggctggggaagaccgtgcaggccacggcggtgctggccctggcggcggccgaggagcgcgtggcggcgcatggcgagggcagggcgccccgcccctccctnnnnnnnnnntgctctggcggcggccgaggagggcgtggcggcgcgtggcgagggcagggcgccccgcccctccctcgtcctctgccccgccacccttgtcgcgcactggcccttcgagatccggaaggcgctgggaggggggggggggtcgccggtcgtcggcgcgcaggtgggtggcagcggcgacggccaaggagtgcggagctgcgacggccaggcagcggaacctggcgacgccaaagatccgaccacccccgccgccgccccgggcgtcgagcccctcgcggtgctgcagtacgccggcggcgcagcggagcgcgcggcgctgcgccccnnnnnnnnnnacccctggcggcgagcccctcgcggtgctgcagtacgccggtggcgcagcggagcgcgcggcgctgcgccccgccttcctggaccccgacgtggcccgcccgccggacgtggtggtggcctcgtacgagaccctgcgcgccgacgccgcccacctagccgcccgcgactggctctacgtggtggcggacgaggggcacgcgctgggcaacgccgccgggcgcgtggcgcgtgcggcgtgcgctctgcgcgcgcagcaccgcctggtgctgaccgggannnnnnnnnnacacgcgctgggcaacgccgccgggcgcgtcgcgcgtgcggcgtgcgcgctgtgcgcgcagcaccgcctggtgctgaccgggacgcccgtgcagaacggcgtgcgcgagctctgggcgctcttcgacttcctcatgccggggttcctgggcaccagccgcgccttcaacgccaagtacggcagggcgctgcaggtgcgctgtttttga

SEQ ID NO: 1971 - DNA, 1113 bp, Chlorella protothecoides
  modified_base (126)..(135): a, c, t, g, unknown or other
atgaggcctgcagccagcctgccagttcacctctcagaccctgtcaccaatccctggcacctcgaacctcccaaccctcgccccccaccatcatcccttcccccccctttccttgcgcagaggccnnnnnnnnnnatgaggcctgcagccagcctgccagttcacatctcagaccctggcaccaatccctggcccctcgaacctcccaaccctggcccccaccatcatccctcccccccctttccttgcgcagaggctggcgcccacatcaatgcggtggagatggatgtgagcggcaggacggtgttcaccgccgccagcgatggctgtgtgtacgcctgggacctgtcggccgccgccgtcgtgcgcacctaccgcgcctgccgcgaggatcggagcgagggcgtgctctgcctggccctggtcccctccttgagcggcgcagggcgcctggtcacgggcgccgccgacaacagcgcgcgcgtttttgacgccggcagcgggcagaccctggcggcgcactctcggcacaccagctgggtggtggccgtggccgtcctccctgaccaggacctggccatctccgcctccaatgacacgactgccaggacctggccgtctccgcctccaacgacacgactgccaggtgagtgcgtaatgtcttatgatgacctatcagtgggtagcgtgagacgcgcaagggccgatgctactggtatctcctttttctttttctgggtgccccagtctctgctctccattcacaattcacaaccccaggatctggaggctgagcagcggggatacggtacacgtgctggcggggcacacggggcgcatcaacgcgctccgcctggcggagggcggcggccgcgtgctcaccgcgtccgaggatggcaccgctgcggcgtgggacgtagcctccggcgcgcgcctggcggtgtacggcgggcattcggcctgggtgggcgacgtggcgcccggcggacgagcgggcctggttgccaccgcctcgggcgacggcacggcggtggtgcactcggcggccggcagcgtgctgcgcacgctgcgcggccactccggcgcggtgcatgccgcggcgctgacgcggtg

SEQ ID NO: 1972 - DNA, 1173 bp, Chlorella protothecoides
  modified_base (257)..(266): a, c, t, g, unknown or other
ctagcaggacgcaggggtgagcaccctgggtcttggcgtcgacgggcctggcatggcagccagtgcgatgtcaagaccattgcgccgcgccccacaagccgcccttcaagcacctctttccatcctgtgccctcttcctcacaaacaatcccacctaccacaggccgccatgggctctgcggtgcgcgccttccaccgcgccctgctggcttcctacgcgcgcgagggtgtcacactggcctccctccctcgccagnnnnnnnnnncgccctgctggcttcctacgcgcgcgagggcgtcacgctggcttccctccctcgccacgacccctacctctggctgaacgtggggcaccacctgatgggggctgggtacgacgccgagctgcgcggcatcctgctggaccccgcctggctggagggcaagctggaggcggcggggcacaccgcactggtggccgacttccggcgctaccagcaggcccacgctgaccccggggtcaagctggtgctggaggcgctgcagatgtcgctgggcctggtgcaggcccaccccgaggccgccggcctgctgcgctgccagctggcggggcggctgatggtggcggcggggccggggggcgtgctggaggactggcgggcggcgcaggaggcggcgctggcgcaggctcccgcgagttccgtggagggcggcggtgtgcgctgcctgcgcacgctgaccccctccctggaccaggcggggggcctgcagcgactgacgctgcggggccacaccaaggccgtgacgcagctcaagctcacccccacccgcgacgacattgtgtcaggtgggggcccggacagagggaagggggttgaatgtgggggtttgtccgtttcttggaaaccaggttcggcagacgggctggtccatgtctgggaccaggagatcggggactgcgtgctgagcatgcagggccacatcgggcccatcacctccatgtgcctctccgccgacggcagcctgctggtctcagggtcggctgacggcacagcccgagcctacgagatggagcgcgggcagtgcctccgcgtcctggcaatcggtgggttgtgggaggtcctgtgggggactgggcatgaaggttggggtgggggaggagaagtgcatctggggctcgagactcaggtttga

SEQ ID NO: 1973 - DNA, 1137 bp, Chlorella protothecoides
  modified_base (880)..(1006): a, c, t, g, unknown or other
atgcctactttgtgctcaacacccagggcacgacctacatcctgtccaacatcactgcagccaacgccaccgtcaacaactgctgctccgcctgccacgacaacacgtcctgcgatgcctggcagtgcgcctgagttgtgctgcgataaggctcgtgccggacgcggcctgtcctggaatgggacccctttggaaaaaggccgtgatggcagtggcctggcatggggctgcctggtcttgcgcgtctcgcctcgtgccacgaactttcccgcttgtgccatggcagcgcacggtgtcccaatgcagctggcccccccttccatctgccgatcagatacaacctgcgcaaccatgccctggcctcgacccctgctccttctttccacccgccacctgtgcaggtgcacgctacacagcagctgcggggcggggaacacgacctttgccgcggggacctgtctcctgctctccgtccccggtttctcagcctatgagccggacgacatccacatggagaccacggactcggacagcggtctgatcgcgggcgcgcccttcatcatcacctcgcgcgaggtgcccggctacaccctggccatcggcttcgacttcggctcctcccacgacttcgactgcgcgaacacaatcgtccccggcgcctgcgcgctgcgcggcgggctggaggacgtggtggcagcctgcggctacaccagcgcctgcaccggcttcgcctactacccgcgtggcatggactacaccagctgggccatgggcatcctaaaggccgtgccgcagcgcgccgacctgcagcaggaggcgctggtgctcaacccctacagcgcggcctacatggcgggggccgacctgcccatcctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgctgccgccggggtccagctcctcctccgaccacgtggtgctcatcactctgacctccacctttggcggcctggccgccctggccatcttggtcatgctgctgatcatggcgcggcggcggcgccg

SEQ ID NO: 1974 - DNA, 789 bp, Chlorella protothecoides
atgcagccgacgcgccggtgtctccgctttcaagggccgtcactccatagatatcagggagtggtacgaggtgagccaggctgtcatgtcaggagggcgacacttgtgatggcattccgagcagggtggccccctggatcagtgatgccccccaaaacgccgtcaaatacccaccggcgcccgagctgcctggattcggtgcagaaggatggccaggagcgccctggtgccaaagggctcagcctatcccaagagcagtggggtatcttcgtggcagcattgcctgccctacaggccgccatagcactggatgggcatgaagtgccgaggcgtgagtgctccggcaacgccatgggttgcagcaagggtccgatcctcaggcgagacctcaatcctatcaacgagcgagcacgaggaaaagccttcaattccagcaactgctcagcgctcgtttcagcgcgtgcacgcggccagcacctcccgcagggcaatggcccagtccatgcactcctccacggaagccgtgcggaaggtgcgcgcgcgcgtgcggggcgccaggaacaggctcctggccaggctaccggccgcaatctccaccagcctgaacacgggggcctcgcctgcaagggtagcgaggaagagatgggagacagggtgcaccctttaccgcccatgttgacatgtgctgcacccgcagcaggggtggcagagagctgcccctcacgtgaccagacagcatgtgcccgcctccccccgcctccacccttgtatgcaattgccaccccttga

SEQ ID NO: 1975 - DNA, 837 bp, Chlorella protothecoides
atgaaattccaagcaagtgacatcgcgacatggcgccgaaagcttgccatgggtcgtgatctcgtctgtctggcgagggtcattgagtggcgcgcacgtatgcgaaaagaagcgatcaggactgctctctttgagtacctggaaggggccgatttagaggcggcaacacaacgcactgtgcaacaagagctcgaagacagactgggggagcccctcaatgaatacaaggagtatatcagggctcagactgacgccttcttggccggctgcacggcgagagggaacgatgaggtggatgatgaagactttcaacagcctcgcaagcgagtgaagggtgggtttgttaaacagtttgggggaggagcagtatgggagtgcttgctggacccacagggtgcgggtgcagagcaacatggcaaaaatgatgctgccaatggccatcccctttctggtgacgtgtatgcagctgtgagggactggcatgggcgtgtgggcgtcgatatccgccagtattatacagacaaggaggggcagctgaagcctggcttcaagggcctggctctgtcaccgcaaggctggggcctgctcagccaagctctgccggtgggtttgtggttggcatgctgtgcggggcgcctgcatcggggggtggttttagatcctacagtcttgttggtcctgatgcaccaggcttgcactgcaactcaccctccgcagaatctctgcaagcgactggatgccaggacaagcggagatgccgtcgagttggataagaaccagcgagcatctgtgtccgagttcaaaggcgtgcctgggtgggattgggctgggcggtag

SEQ ID NO: 1976 - DNA, 519 bp, Chlorella protothecoides
atgccagagcttccggaggtggagagcgcgcggaggctgctgcacagactgggcgtggggaggaccattgtcagagccgtcgtggccgatgacgacagtgagtcgtggatctatcgagggatcagaggttgtcaagggcatctctcccaagaagctgcaggctgcactacagggttcacagatcctgtccacagatcggcgcggcaaacacatgtgggcggtgctcggcccgagcaagcactccctcatgctgcactacggcatgacgggcatgcttgcagccaagggctgctggaagaggtggcagacatcttcacagggaggcacacgaaccctgctgagccgcagcctcccactggttacctttgccggtccgcctccagggtgaaggtgcggcaaactaccggggggagaatgtggacgccgcctcctggccccccaggttctggaagatccactttcagctggacgacggcgccgagatcgcgttctgtgactcgagacgctttgccagggtga

SEQ ID NO: 1977 - DNA, 261 bp, Chlorella protothecoides
atgtcacaagctccctccaagtcccacccaccccaacagaaggatggccagctccttccgggaaagcgcggcatcgcattggcggctgaccaggtgctggccctgctaacagccgcgccccagctcacggcaggactggagcgccgggatgacagctgccgcgcccagctctcagcgaggtgggtcggcataggggtggggcgcgagactgggtcatggtgtgggatgggtatacagatccagctggagacggtgctgtaa

SEQ ID NO: 1978 - DNA, 735 bp, Chlorella protothecoides
atgtacttccctccctccccccctcacctcccacacagggagagcctggcctgcgtcgagcgtgccgcgccgcgcctggaggccctgctggaaagcgcgaacatggacgccgacctggccgccttctgcgacacggcggcgcacagcgtggcggcgggcgaagccctggccgcccgccaggccggtctgctggccggcgtccgccgcgagctggccgccagccccgaggtcctgcgtgcgggggccatggaggcctgggacgctgcgcgcggtgtctgggtgcccgaccgatttgtgctgacgcgcgccgggttcctgcaccgccttgcgcgcagcccgggaggggacccggaggttagcatggtgcaggggccgcccacgcccgtcctggcggagagcgtggccctggcccgctgcacctttgagcagggtgatgggttcaaggggtggcaattgcatacaagggtggaggcggggggaggcgggcacatgctgtctggtcacgtgaggggcagctctctgccacccctgctgcgggtgcagcacatgtcaacatgggcggtaaagggcgaggcccccgtgttcaggctggtggagattgcggccggtagcctggccaggagcctgttcctggcgccccgcacgcgcgcgcgcaccttccgcacggcttccgtggaggagtgcatggactgggccattgccctgcgggaggtgctggccgcgtgcacgcgctga

SEQ ID NO: 1979 - DNA, 1011 bp, Chlorella protothecoides
  modified_base (73)..(82): a, c, t, g, unknown or other
  modified_base (782)..(791): a, c, t, g, unknown or other
  modified_base (965)..(974): a, c, t, g, unknown or other
atggggggcgcccagacgcacctttgctgccccctgcgccgtccaccgaacccctcccccaacgtaccccctnnnnnnnnnncgtacaggaatgcaggcacatggatgcgagcggaggcagggagggaggcgaatggtggaaatcatgcatcgaaggccccctcacatgcacagccaccccatccacatcagcctttgccacaatggggggcgcccagacgcacccttgctgccccctgcgccgtccaccgaaccctcccccaatgtaccccccatgacaaaaccacgcagatccacctctggatcttcctcatcgccatcttccacgtcgtctgcgccgtgatcatgctcctgctggccgagtggcggctgcggcagtggcgcggctggcagacaggcgacctgctgcgcagcgcagccctgcgtcgccagcagagtctggcctccttccggagggaggtggcggggctgggggtgccacatgccgtcgcagacacccgtgtcgccgatcaaccgcctgcagagggcgaggcggggcttggtggagtcccgacggcccgcccctcctccagctccgccagccaggccggctctgagaacgtgctggagctgcagctggggaatggcacgcccagggaagagggtttacagacggcagcagacgtcgaggggcagcctgggggcccgccgctgttgtcgttccggcacgccgacacggcgccgggcacggcaccgggcacggcgccgccaggcaccgcaccgagtgcatcgccatcgagcgnnnnnnnnnngctgcagctggggaatggcacgcccagggacaagggtttgcgaacggcagcagacgtcgaggggcagcctgtgggcccgccgctgtcgtcgttccggcacgccgacacggcgccgggcacggcgccgggcacagcgccgccaggcactgcaccgagtgcatcgccatcgagcannnnnnnnnngcaatggaggcgcaggtcggtggcagggggtttctaa

SEQ ID NO: 1980 - DNA, 711 bp, Chlorella protothecoides
atggtcgggcaggtgcaggaccgccacggcaagctggacatcctggtaaacaacgccggcatccagttcgtgtcctcggtccaggactttcccgaggacaagtgggacgccatcgtccaggtggtcatgaacgcccccttccacgcctccaaggctgcgctgccggccatgctggagcagggctggggccgcattgttaacaccggtatgttccaatcatgtgccggcgtggggcagcttggatgttgtattcgtgcccccacctgcatcagaagactacaccaacccgccgactcagacacctcccttgttacaaaatatccacaccacccacccaccacccacccaggctccatgcacgccacggtggccagccccttcaagagtgcgtacaacgccgccaagcacggcgtggcggggttcaccaagaccctggccctggaggtggccacctccggcgtcacggtcaacgcggtctgccccgggtacgtcatgacggagctgatcgagaagcagctggccaaccaggccgcgacgcggggcatccccgtggagaaggtcatctccgatgtcctgcttgttgaccagcccatcaaacgctttgtccgcgcggaggagattggcgccatggtgcgccacctctgcaccgacgacgcgggggccatcacgggggcctgcctggccgtggacgggggctggacagcgcgctga

SEQ ID NO: 1981 - DNA, 264 bp, Chlorella protothecoides
atggcgaggcagctgggcgccggctcggatggctttgtgcggctgcccctcagctcagcctccctggcgctgcctgacctggcggtgaccgggtcttcagaggccctgctcaaagggcagaagccgccgcttatcctagcagcccgggcggtggacgctgcggggaagatcgcggagcacattctccctgtcttctcggagggatttgtggtgcgttgtgtggagggtccaatccgggtggggggacctgaggcttctcgatga

SEQ ID NO: 1982 - DNA, 288 bp, Chlorella protothecoides
atgctcgcagtggggaatgcgacgcagaccaagctgaaggacctggcccgggctgccgcagatgcggggatcggcagctttgcgttccctttccacagcgtgaacaaggtccgggagctccaggctctcatggtgtgggcggaggagagcttggagcgctgtgacgccaccaagaagatcctgaagctgacaaaaggctgggaggaggctcgggagcatgtgttcaaggtgaaggctccgagtttgcggccgggagggcattgggatgtatttggccttggactgtag

SEQ ID NO: 1983 - DNA, 1197 bp, Chlorella protothecoides
atggtgcaatatgcgcctaccaccaaggaggtgactgccagtgggctggcagacatgtttctgaatcgcatctcctgcccacacggccttcccactatcgtcgtcagcgaccgggacacgcgcttcacggcacacttttggaaggagctctttggggcgctgcgcacggagctgtgcttcagcgccgtgtactgccccgagacagatggacagaccgaacgtgccaaccgcacgctggaggagatcctgcgcgccatggtggacccgtacgagacggactgggacaagcacctggccatcgcggagttcgccgccaactcggccgtcagcgccgccaccggcgccagccccttccagaccgtgtacggtttcgacccaccgtccccgacccagctcatctcccaccagcctgcggaccccggcatcaccgtcgaatcggagcgcgccgcgcagctgcagcagaccctcgagcgcatgcgggccaccatggccaagtacaacgcccgcatggccacacaggccaaccggacgcgccaggcccacgccttcaaggctggtgatcgcgttttactgagcagcgcgcacctcaaacttgtggcgcccaacggccgcaagctggcggccccctttgtggggcccttcaccatcaccgccatgcgcggcactggggcggcgacgttggcgcttcctcagtcgatggggatggatccctcggtcgacgagagttacccgaaaccctaccaccgcgacagcaaccatcgcccaatccctgtcttcatcaatgacagcggcgcgcccgcctaccttgtggaggccatcctccggcacaagcgcgtcggccgcggctaccagtacctggtgaagtggcagggctaccctgatgaccaggccaccagggagccccgcgccaacctggcgcatctcgacgcctacaaagcctacagggcagtgcagactgtgggtaggcctacagtacagactggggagggtgttgtgggggttccccttgtgttgtgggggcttccccttgtgttgtggggggttccccttgtgttgcggggggtccccttgtgctgtggggggttccccttgtgttgcggggggttccccttgtgttgtggggggtccccttgtgctgtgggaggctccccttgtgttgtggggggtttcacttgtgctgtggggggttctccttga

SEQ ID NO: 1984 - DNA, 1548 bp, Chlorella protothecoides
  modified_base (393)..(420): a, c, t, g, unknown or other
  modified_base (1412)..(1421): a, c, t, g, unknown or other
atgctggcgaatgtcatgaggactcaacgctggtgcgctcatcccaacgcgagacacggctgtcacataatcgatgtctgcatggaggtgggctcactctacatgcgcaatgcccatcctgattcgtcgaggtcgggagccccggcccctggggtatgccactggaaaatatccagacagccagcaactgaggcaggaacggtacaattggcagatcagtcgaaagggaggtctgagtgtatcgtgaacatagattacagagtggccgaccctcctgtgtgtatatacaacatgcgatgttcgtatccgaaggaggttgtggcctcaatgccacattatagagtggccgaccctcctgtgtttatatacaacatgcgatgttcgtatccgaannnnnnnnnnnnnnnnnnnnnnnnnnnnctgcgtaacatcgagttcctgggtgtgcctgggtcctcggctgtggcctgcatgctggccaggcccagccttcgactccatcatgccgtccatgcaggctccctgcgaggctcattggggttgacatctctggccgcacctggaccttgtttccaccatcatgggatctccctggaagcctccgcctctcagccaatccctatggcacggagcaagcttcggctacatgccatgagttcctccctagctcaaaacagcgtcccagcatcgcagcctcgtcagctacctccccatacatccatccccccgccctctctgccaccggggattgctgcctgggaaagtgccgtcgtgctgatcgacaagcctcaaggatggacgtcttttgatgtgtgcgccaagctccgcttcgccctgtccagaacactggacaagaaggcacggaccatcaaggtggggcatgctggcaccctggatcccatggccacaggcctgctggttgtgtgtgttggccgggccacaaagctggtggagagcctgatggccgcgagcaagcggtacagcggtacgatgaggctgggtgagggcacccccagcctggatgccgagacccctgtgcacgagacaaagccctggcagcacgtcacagaggccagtctggaggcggcagccgaggctttcctgggggagcaggagcagataccgcccatgtactctgccatctccgtcgacgggcagcggctgtatgactctgctcgcaaggggctggaggtggagaggaagtccaggcgcatcacagaggtctgccgaagacccgcagggcgtggactttgtcgtgagctgcagcaagggaacctacgtcaggagcctggccgccgatctggcggcacacatgggcacggtggcacacctcaccgccctaaggagactgagcagtggggagcacgatgtggcagctgcttggcagctgcccgacctcatctcccagcttnnnnnnnnnnagtggcacacctcaccgctctgaggagactgagcagcggggagcacgatgtggcagctgcgtggcagctgcccgacctcatctcccagcttggcgatctcaagaaggaggatgcagcccaggcctga

SEQ ID NO: 1985 - DNA, 900 bp, Chlorella protothecoides
atgctcaccagcctgcgcgccccctgtcctcgcggtgcctgcttccaacccagcaagaggcccctcacccacctcaaatgtcgacagagctgcgtcgccccgctctgcgcagccccaggtcgccccggcccggctaacaccgcccgcaccctggtggacctgacctcccacggcaccttggccaccctgctcccggacggcacccccctgggcaccgccacgagctacgttctggacggcacgggacagcccatcctgcgtctgagggcccacgccgtgcacaccgacaacctccgggccaaccctgccaccagcctcttcgtgcacccagccaacccccccgcccgcgccctggcccgactcaccctcctgggccacgccgaggccgtgcccgagaatctccttcccgccgtggccgaggtgcacgccaccctggcggcgggcgggcagggcgtggacgcacccagcccctccgacgtctacatgcgccttcatgtcacctcctgcttcctggtggaccagctgggaggggggtccgccgcgcagcgcctcaccagggaggagtacctgggcggggtgccagacgccctgcgtggccctgccgccggcctggtgacctacatgaatgcctccaggaccgaggacctgctcaacctcggggctgatgcgatgggctgcagccccgatgatcttgccacggtggagctcgtctggctggacagcctggggttctacattcggactgtacccctgctgccccccaacgagcctcagaccctgcgcctcaccttcctgaggcctgtgtcggatgagagggaggccaggtcggcgctgacgatgatggcacaggagtcgtgggagaggaggcggccatacaaccccgtcatggttaccacctga

SEQ ID NO: 1986 - DNA, 516 bp, Chlorella protothecoides
atggcccccgcctcagtgcctctggtccctgccctttgcaggcgcttcggtgtggccgccaaggtcccgcaccggcccaggccctccaccgcccacctgccggccttcaggccggaccccttggcgctggccgccgcgctggccgccgcccacgcctcgaacgtggtggtgctggacgtggcggggcgctgcgccgtggccgacgccatggtggtggccacgggccgatcccccgcccagctgcggggccaggccgaggccgtggtggactggctggagaggggggcgcggggggcggggtgtgcgccgccggggtgccgggtggagggcggccacggcgccgagtggctgctggtggacggcgggcgggtgatcgtgcacctcatgctggagggcgcgcggcgcgcctacgacctggaggcactgtggggcgaggaggggcgcagcgtgcacagcgtggaggcagcgccgggcgtgcagaccctggacggtcttatgccgggggccggggcctga

SEQ ID NO: 1987 - DNA, 1395 bp, Chlorella protothecoides
  modified_base (491)..(500): a, c, t, g, unknown or other
  modified_base (1196)..(1205): a, c, t, g, unknown or other
tcggcggccggcagcgcgggcgacggtgtggcgcggcaggatggcgcgccgacgaccccggcgacagacgcctccagcccggcggcgacgacaagcgcagcgtcctcgggctggggctggtacgagggcgcgggcgtggcggcgctgcgcgcctggctggcggcaggcggcatgcggcgcgaggcgggcctgctggccaccctggccgacgcgccctggcccaccgaccagctcaggccgggtgagggtggtgtgctgtgtgcgcgtgtgtcgccatgcgatgcggcggtggggtccgtgatgcccctctctggcgcccatggacgccggcgagggtccctccatcttcagccaacgcccagccacgctccggacccttcctccacaccatgctcccgctcacgtgtgcactccccctctcctcgccaacaaaccccatgcaggtcgccccgcgtcggcggtggagctgagctcgctgcgcgcggacgggnnnnnnnnnncagcccagccacgctccggacccttccttcacaccatgctcccgctcacatgtgtactccccctctcctcgccaacaacccccacgcaggccgccccgcgtcggcagtggagctgagctcgctgcgcgcggacgggtaccgcgggctggtggccccgctgctgcgcggcgactggcagtgcgcgcgcggaggcgtgtacgccagtgcagaggcgcggctggcgggcgcgctggacgcgctgctgggcgcggtcccgctctggttccggggcgaggtgttgcagcgccagcacctggccatcggcgaggcgctggcaggcggcgtggggccgcgcgaggccggcatcgccgtggccgagaccgagcgcctgctggcgctggagggcgtgctgggcggcgagtggcgcgacgtgtggcaggtggtctggcgccgcgggctcagcctcatctccgacgtgcgcgaggcagccatgtacgccgccgcgctgcagcgccacgccttctccccggacgtcgtgcctcgccccgtcttcgagcgcctgatggccgaggccaactgtcacctggtcctgcccttcccgggggacagcgtggtcatcctgcgctccggcgccctcatgcacatcgataggcgcgtgcagcagatcctggcggctgtcttgagacccatggccgggtggatgcagccatcccaggnnnnnnnnnnttgcgctccggcgccctcatgcacatcgacaggtgcagcagagcatgggggctatcttgagaaccatggccgggtggatgcagccatcccaggctgctgtcggaggaggggacgcatgggtgaatacatcgagcccatgagtgggcgggggtccagccttcctcgcaacccgatcccattcctactctag

SEQ ID NO: 1988 - DNA, 1392 bp, Chlorella protothecoides
atggtaccctacaggcaagacctcgccgatccggttgcgttcgcaagcaacgtcgcctgcgcccaggccgccgctgcggccggcctgtgggatggcgccttcgccgcctttgccagcgtcacggccgtgggtggctttcccgctcagctgcaggtggcatcggtcggcttgcccgacccgccctccggcgacgtggcggtgacgctgggcacgccgcccctggcgacacctgtgcgcctcggcatcgaggtcgagcgggcggtcacgcgcctcagcgtggcgctgagcctaccggggcaggcggcggtcgccagggtgctggtggccgccgccgtcgatggcgccaccaacgccagcggcggcgaggagccgagccgcgctaccttcgtggtcgtcgccgccgcggcgccggcccgcctggccgaggcccaggccttgctgcagccgagtggcccgggaagcgcggcgtcgagcgcgccgagcccgcaggtggccgacctcacgctcaccgtgcgcgcgcgccacacccaccccgatggcagcgccacccctggtcgacacgccgtggaccgtgcgcgccgacagcacgccgccggccctcggcgcctgctttgtcgaggccagcgccacccaggtggggaccggtgccacggtggacccaccgtgcggctgcgcgacccgtcggggacggcgacgacggcccacgtcgacgccacctgggaggcgacgggcggcgggggcgcgcgcatcgcggcgcctttgtgcgccgagaccgcgcccgaggtggtgctcgccgtcttccccgaggtgcgcatcgtgctcaccagcgacgtcgccgcggtgtgccccggcaacctggtgcacctcagcgccaagatcgaccagctcgccggcggcagcctgggcgacctgcgcttcagcctgcgccccggcgccggcgtcaagagcctgtggccgctccgcagcgtcgccgccggggtgcaggtcgatgcggtgcccgacggcttcgccctccccagcgccagcgactcggcgggagcgctgggctgggttctcatggccggtggcggcctgggctacggcagcctggcggggaccttggaggcggcgcgcggcagcgccagggtggcgccctccgtgctgcagatccccggggcgtgtgaacccgacttcgtcgaggccaccctcgccggccgggcgttcgtggacgaaaacggcgatgggttcgctggcccagacgaggccggccttgcgggggccatggtggccctgtcagccggggtggacgcccgcaccgacgccatgggccactaccacatcacctgccttgcgccgggccgccacgccatcaagctggacccaccgcccacgcaccctgcatgcagcctcgga

SEQ ID NO: 1989 - DNA, 1632 bp, Chlorella protothecoides
atgacgagtctccgagccgctgctgctcccccctcctcccctgccatccgttccagaagcggcctgagctccacagctcaggttcggtgtcgcgctggcgatacgttcgcctctgaggccgtggcgccgatcgtcggacgccgccctagagattttcactggcgacacggactgggcaacttgaagaacttgatgttcttcccgacctggcactacacacacgataccgtcaatcagttctgcgccctgcagaccgtcgcgcggggcccgcaggcgcacacctgggccacggcgcccgccgacctctcgcatgtcgcctggccgcaggatgccagcctcgagacgttcctcgcccagcagcaggtcgatggcttcgccctggtgcaccaaggggccctggtgcacgagagctacctatcaggcacccggccgtcgacgcgccatagtcttgcgtccatcacccgcagcctcaccggcatgaccgccggcatcctggtggaccgggggatgctggacctcacctcacccttggagacctggatgccgcaggtatgcggctccgggtatgaaggggtgaccgtccgtcagctgctggacatgcgctcaggcgtcaactccagcgcgattggcgcgctgcagtccatgcacctcatcgctgcattgccgtggcagacccgccacgacgggctgcatgcctggtcgcacagcctcaagcgcgccgagggctgcgaggggcctggtccctggcccttcgagtaccggaccggcgactccgagatcttgggacagctgtgcgagcacgtgaccgccaccagcatggccacgctctggtcgacgctgctctggcagcccctgggggctgcgcacgacgccagcgtgatggtagacggccataaccatgccctgtttggtggtggcctcgcgatgaccctgcgagacaccgcgctgttggcgcgcatgatcttgcgcggcggcacggcgcacgacggcggccccgccatccttcccagggcgtacatcgacgatatgtttcacggcgacgcggacacccgcgcggcctttcccggcaccatgttagacctgccgctgccaggcggcatgtaccgcaaccagagctggagcctgcagtccgccccccccatcacgctgctcctgggcgccggcggccagctggtgtacctggacccctcagctgactttgctgccatcgttacctcgcactggggcaaacccatcgctgtcagcgccacgcctccaccgtcttgccctgggccgcctggcggcccattgaaaacagggagtgttgcggggtactactttcacggccggttccctctttccatccccacgtctccgtgcctcgtcaacaacgaggcacatcaacctgtatcagctgtcccccagaggagaccggggacagttgtaagaaccctatttcaggtagtacgacatctgttcccgttgcggaggcatatagcctgccccgcaacaaccgaggctggtggctggtgtgccacaggcgcgggggcgggcgccgggtccgtgctatcaggcatagcagcgttggcggaacacttgcggtcgcgtgtgtccacaaccttgtggcgagggctcggagccccgggtgactag

SEQ ID NO: 1990 - DNA, 1167 bp, Chlorella protothecoides
atggtgaaactgggccccgccttctgtgacatcacctggggagctgggggctccactgctgatgtcaccctggaggttgcaggggccatgcagcaggaggtgagtacttggaggcttgcatccgtttcccggggctgggtcggcccctgtgctgatcggcatgaacaccatgatgcacctgacctgcaccaacatgtcgatcgagaagctgcacgagagtctggagaaggtgtgattggtacacatgggtccagctgcccgctgtgttctagcgaggaggggtgtcgagccgctggcatgccctgctcccatcttctggtctcgcttctcatgtatctgagcccaatgcagatccaccagtgcctgattccaggcagtcacccacccagccatgccactcctggtctcctcctgcaggccaagtctatgggcattcgcaacatcctggccctgcgaggcgacccgcccaagggcgagacgagcttcactgctgtggatggcggttttgcatgtgccctcgacctcgtcaagtacatcaggtgcggagcaggggagtgctctgtgttgtgcagacatgcattttgtccagacacacaatctgcatcttgctccctggtgtcgcttggtctggcccctgcggtccatgccccggcctgcacccgcgcaccaaacgcgctgcgcttgcacccccccggtccaccctgccctcgtcagacccacctctcactcctccacaggcaggagtatggcgattactttggcatctgcgtgagcggttaccccgagacccaccccgacctcatcgtggacgatcccgtggccatggaggccaactaccggagcgacctggcctacctcaaggccaaggtggaggccggcgccgacttcatcatcacccagctcttctatgatgtcgactgcttcctcgccttcgtgcgtgactgccgcgtcgagggcatcgccgtgcccatcctgcctggcctcatgccgctcatgacctatggcggcttcaagcgcatgaccgccttctgcaagacgcgggtgcccgcccacatcgcggccaccgtggaggcgctgaaggacaacgacgaggcgatcaaggtgggtgggcgggtggagcgagctgcagtgaggaatgtggagtcgtgtttgagggaggggctctaa

SEQ ID NO: 1991 - DNA, 1290 bp, Chlorella protothecoides
  modified_base (936)..(945): a, c, t, g, unknown or other
atgactactgaagaacctttctttggaattattgtgatgatttccggttcgccatgtcggatgcatctcccagactccgaagggatcttctctccatcgcaagatcctgcagcacttcggattctcgcagcagtccctcgtgacggaatgcaatacctcggtggtgtgattcctccttcgaccctgggtatctctcgcgcgcgacaagggattcagtccacgagacacgggtacccgaacgataaaacacgattaagctcccgggacagttgtagcggatgggattaccattgccttctcaaaaatcctgtcaataagtggatgcaggagatggatggctcaccactacgggaatctgctgtggcccaggcaactgcacccaccactgctgccaacgaatctcagagactggccgtagatgcagaggctccgacccaaagatacatttcccaatctcagcaagaacctagcggcgtaaagagggaagccgtcgaggcccgaagtccggacgagcaagcatcctcaccgacacccggggagaccaatgctcccccttgcgtgtccgatgctcagccaccgcagccctcgaatacgccggtgaagccaccgcagccctcgagtacgccggtgaaggtgcctgagccacacgtggaatgctcctcggagcctttggagtcccctgcagatgcttctggcgcaccagacgagcctggcagcatgccgaaagcctctcaggatggggggggcacgcaggtggatgtccccccgtcccagctccccacagacgaggagatcacataccgcctccaggaactgctgactgaggtggacttgcagtccaccacaggtgggccagtccttgcgaacgagacgcttgagcgtgggggtgcaccgtcatcactggcatggccggggcgctcaccgcactccttcatnnnnnnnnnncgtgggggtgcaccgtcatcactggcatggtcggggcgctcaccgctttcctttagcatcccctttgcagaaaagatgctgcggcgaagactcgagcaggaattttcgacggacctctctagcaaaaaggccctcctgcgtgcagaagtgggtggtggcaggaaccctggcactgcgggagcccatgcgctgcgagaggctggctgggtgctgcgcgtgggaatccagcggaagcctgctgaccatataatcccaccccctgactcatcgcaggtggaggcgtacctgtcatcacagccggcccccccggggagcgaagcggacgaggagcccactgcccggtga

SEQ ID NO: 1992 - DNA, 345 bp, Chlorella protothecoides
atgacgacgacgacgacgcaggagcgggttcgtcgaaggcaacgccgcggcgcgtcagggcgcggccgcacggcgacgccgggcgagaagcgggtcaacggcttcaccaagcccctgcgcctgtcccccgccatggcggcctgggtgggcgccggcaccgcctcgcgcccggccatcgccaagcacatgtgggcctacgtgaaggagcacggcctgcaggaccccgccaacaagcagtttgtggtgtccgacgccacgctgcgcgcgctgacggggcaggaccgcttcaaggcctttgggttttcagccctggtcaagcagcacatcctgggctacgacgactga

SEQ ID NO: 1993 - DNA, 1740 bp, Chlorella protothecoides
  modified_base (351)..(360): a, c, t, g, unknown or other
  modified_base (903)..(912): a, c, t, g, unknown or other
  modified_base (1555)..(1564): a, c, t, g, unknown or other
atgtcgctgcggttgctcctcccaccggtgggaacccggctcgactcccaccccggccaggcagtactcccccatctcacccggacacagagccgctgggagccggggagattacaccgtgatgtaaatttcatgcatgcagcgcatgggtcaagaggggcctggggatggcgtcgacgttcctcggtgctcacaccgcatgccgctcctatggaggatgacccgcagctggagcggaaggtgtggtatgagcgatgcaggagcgccattctctggcgggggccatacccgttgcttaaatcagttgcatgggacggtgtctcccctgagccggcagatggacgcaagctnnnnnnnnnnggagcgccattctctggcgggggccatacctgttgctttaatcagttgaatggcacggtgtctcccctgagccagcagatggatacaagcatgaagtcacgcaggctggatgcccaggattctctggcctcagggcccgccctgtgctctttgatgcacccttccaacatagacaacccggacccctcgcacccaacaacgcaggagcgcatctggaccctgcctaccgccctgacgctggcccgcgtggcggccatccccgccttcgttgccctgtggtactctcccgcgccctgggcaccggcggccgccacctggctcctgctggccgcctccgtcaccgacttcctggatggctacctggcccgcaagttggtgcgaggagcaggggttggagttggccgggcgtgcctgtgcgtggctgcttgggcgccggcatcgggtagctgcacacgccggcgcctgctgcggggacggcaccggctgcatggcaaggtgacactcctccccgaccgccaaccctccacccttccccccaaaatnnnnnnnnnngtgcgtggctgcttgggcgccggcatcgggcagctgcacacgccggcgcctgctgtgggaatggcaccagctgcatggcaaggtgacactcctcccaaaccgccaaccctccactcttccccccaaaacacacaaacagaacgtggcctccgagttcggggccttcctggatcccgtggcggacaagctcatggtctccacggccctggtcctgctcagcaccgcgcccattgtcgccgggcgcctggccggcgacgcgctgctgtgcccgctggccgccgccgccatcgtggggcgcgaaatcgccatgtcagcgctgcgggagtgggcggcgggcgcggggcccgcggcgcgtggcgccgtggtcgtcagcaccgccgggaagctgaagaccagcgtgcagctcgcagcgctggtcgcgctgtgcgcggcgcggacgcgcgccgcgcccgccaccctggccgacgcgggtgcggcgctgctggcgcttgcagcgttcctcaccctctggtccctggcccagtactttgcggcgctctggccctacatggccggccggcgcagctgccggtgagcgtgcgcatgggctgcggaaatcctgcccatgggtctgcccagcgtcgcggcggcgggtggcggatgnnnnnnnnnnggaaatcctgcccatgggtctgcccagcgttgcggcggcgggcggcggatgagaggctggtggggcccggctggcgtcgtagcgatgagtggcagagaagaggctggaggggcccggctggcatcgtagcgatgagtggcagagaagaggctggaggggcccggctggcgtcgtag

SEQ ID NO: 1994 - DNA, 534 bp, Chlorella protothecoides
atgagtatggatgccgaggcaaacctgtgcactcagccaaggttgtaccacactcccttgagcagtgcttgctccctgcgctccagcatttcccacgaatcacatcccacttccacccgccccacttcaccctatcatcccgctcctcgatcaggcgtgcgcatctgccgcaccatcggcacgggccacctccgcaacctggaccccttcctcatgctggatgagctgaagatgccggcgcatgaggcaagcgccgggttccccgaccacccccaccgtggctttgagacctgctccatcatgctgtctgggaagatggagcaccgcgattcctatggaaaccacggcgtcatcggccctgggggggtgcagtggatgaccgccgggcgtggcatcgtgcactccgagatgccaaaggtcaccgagggcatgctgcacggacaacagggaggaagagttggtgtgcagagtgtcgcatcgtgcattccgaaacgccctgcaactagctactcctcatacaattcggcggcatga

SEQ ID NO: 1995 - DNA, 2856 bp, Chlorella protothecoides
  modified_base (2458)..(2467): a, c, t, g, unknown or other
  modified_base (2680)..(2689): a, c, t, g, unknown or other
atggccttgccggtgctgcgcaccaccgaacccagggacttgagccaccccgccatgctctacggaagcctccaggcacagaaatcagggggtcaccctgccggcgtcacgcacagccaggcaggcactgccgcgagcgacgcacaccaccgacagggacaggggtgcggaggacaggcccttcttcccagctcgaatgtacaccagtacaaagcagaatgggtctgtgacaatatggattggtgtcaagagacgccttgccctggtgcaggcagggtttacaggcccctgcaggaagcaagggctccccccacccttgtaaacggtcttgaaagactgtcgatccctccctcggagcagtctggtgcagcaggcctcttagggatacaaaggtatccggcacctgccggtgctggagagccacagggcccccgcgatcccgatcacatcggaattgcgttgaattcgtgtcgccgaagcacggcaactacactttgggagagcgagaggtctgagccggtggccgggcactgccaaactgctggatcgccatggactccctgggcgcgatatattttatcagcggcaggggggacgtgctcatccagcgaacctaccgggatgacattgagtgagtggagggaagcgacggagtgcttagcctgcgtagtacacacaaccacttctccccacctcccacccctccagcaagaacatccccgccgccttccgcaccaatgtcatcaactccaagtccctggactctgccagcacggcccccgtgcgccagttcatcggctcctcctttatccacctccgggcggggagcgtgtacttgctggcaatcacgcggaccaactccaacgccatgatgatcctgcagttcctcagcaaggtggtggacctcatcaagtcctactgccatggcgacttcaacgaggaggtcatcaaggccaactttgtgctcatctacgagctgctggacgagatcctggactttggctacccccaaatctcagagcccgcagtcctgaagtccctcatcttccaaaaggtgctgtggtttgggtggatcagagggtgggagggggggcccgccgcagcggggaaatggggggagaagtgcagctttgtccatccttgagacgctggggcggtcgtgaaggttctaggatcactgtgtggggatttgtgctggagagcacgaagaagaagagggaggcggcggcacagaatgcgacccttcaggtgacgggcgcggttggctggcgccaggatagcataaaatacaagaagaatgaggtcttcctggacgccatcgagactgtgaacatgcttatgagcgctcagggcaggtgggctggtggcaacttgtttgacaagatgagttccagcatgaatttcaacagaacacgttccctctttcctcgcagcgtgctgcggtgcgacgtccagggcagggtggtcatgaagtgcttcctgtcgggcatgccagacgtcaagctggggctgaatgacaagctggaggaccattcccagtctaagtttggtgcaggcattgaagctgccgtccagcactcttctcttctcctccaatccctacatgcaccatttaaaaatttggacgtcaccttccacccctgcgtcaaccttgggcgcttccaggccgagcaagtggtgtctttcgtgcctccagacggcgaattcgagctcatgaagtaccgatgcacaggcgaggaaccctggccatggcctgggcgtcaggtgcatgcccaggccatggtttgtggcatgtctcatgcccctgcccaccaaactggggcgcaaaccctgtgcacgcacacacctcctcacctcgcctcctcacctccccctctggacagagggcatcaacccgcccttcaaagctgtggtcctggtcacagaaaagggccggacgcggctggaggtcagcgtgaagctgaagagcagcttcccctccaacctttttgccaccaacgtcatcgtcctcatccccatgccggagcagacagcgcgtgctaccttccagctcagcacaggcaaggcaaagtacgaccccaaacgcggctcgctggtttggaagatcaagcgttttgcgggggatgcagagcagtcgctgagcgcaagcgtcgagcagatcgccacgacgcgcgagaagaaggcgtggagccggccgcccatgagcatgtcattccaggtgggtgggtgggcgatagggttttgtacagagaatgggatggggcagcactggttgggaatcccgatgcactctgccagcggcgtgcgggtgcagtacctcaaggtgtgggagaagtcgagctacaaggtggacaagtgggtgcgcaagctgtgcaagtcaggagactaccacaccaggttctgagcctggaggcaactgtgacggggatggagcaggctgaagacaaggtcagaatannnnnnnnnnctctcgctgtaatcgagaggcgtgcaatttgggagaggggttttggtagagtcgtgaaattgggcaggacaaggtcagaatttgctccagcccaggtcgtggttgttgacacaaacgggagacaggcaagattggtggcccccactgatttccttgagaacaataagggtattgaatccttgcacacagttgcagatctttacatgttttcannnnnnnnnntccttgagaacaataagggtattgaatcctcgcacgcagttgcagatctttacatgttctcgtcatggccgtgcccactgaactgggaagctgcctcgagtggtttacagttgcccacaacacttgccagctactctggcacggatgcctcagccaggtcccagtag

SEQ ID NO: 1996 - DNA, 2703 bp, Chlorella protothecoides
  modified_base (82)..(91): a, c, t, g, unknown or other
  modified_base (180)..(189): a, c, t, g, unknown or other
  modified_base (1753)..(1762): a, c, t, g, unknown or other
  modified_base (1843)..(1899): a, c, t, g, unknown or other
atggcacatgcatattgcgagggctggctgaatagccccgcgacgacccacaccacccttgccctgcagtgtcaaaggcccnnnnnnnnnnattggggcgtaggggggtgctggcggcaggatgtcctgcaagcggctcactgccaactcactcaacatcacccctcctcatacaacacnnnnnnnnnncacggcaaccttgatggcacatgcatattgcgaggactggctgaacagccccgcgacgacccataccacccttgccctgcagtgtcaaaggcccagacggtgctcccatacgctggcgccaagccggctatcgcggacagcgtgttcatcgccccttccgccagcgtcatcggcaatgtcaccctcggcagcggcagctccgtgtggtacggcaccgtgctccgaggtgagctggtgttggggggtgatggaaggacatggggcgttgggggaatgctggcggcagggtgtcctgcaagcggctcactgccaacgcactcaacatcacccctcctcatacaacaccctcacacacacacacgcaccatcccaggcgacgtgaacagcatcagcgtgggtgagaagaccaacatccaggacaacgtgttggtgcatgtggccaagcacaacgctgcgcaccaggagctgcccacccgcatcgggtccagcgtgacagtgggccacggcgcggtgatccacgccgccacgctgggcgaccgcgtggtcatcggcatgggcgcggtggtcatggacggcgcggtggtggagcccgagtccatcgtggccgccggcgcgctggtcaccccaggcactgtggtcccctcgggccaggtctgggcggggagccccgcccgcttcctgcgcgacctggcccccggcgaggccgagttcatcgccgccgccgcggaggactacgcccgcctggccgccgtgcacgcggcggagaatgccaagggcttcaacgcggtggagctggacaaggcgcggcgcgaggaccgcgcggcgcgcgaccccgagcacgacgcggcgcagggcatcgcgcgcgacccggagacgcgcgccgtcccgtggcccggtgtcaggagcggcggccaagagagtgctgagtcggggcaggcggacgttcctcagcatgcgccggcgcactggctctgcactgcactgctcgaatcctgtagacagcagcgaagagaagagcctggcattgtctggaggcagtcgcaggaacagatccggtgtcgcaagaacagatccggtggtgcatgccaagcagtgcagttgccgacgtcatggagcactgcagcagagcaggaaactcatcgatgccttcagcgcctgcgggactttttggaggggtccgccctgccattgccgtcatcaccccgcttccgccccgcgcgcctggccgcctccgactccgattccgacccgctgctgctgctgtcggagccagatgacgatgatgaggaggaggaggacgacgaggagtcgctggaagaggagccgcctgacgacgaggagtcgtctgaggatgatgagccgccagatgatgcagatgacgaatcgtccgaggacgaggaggcgtcgttcttggccgcctctgctgcagcccgctgcgcggcgatgagcgccggcaggttcttcagcgtctcgcgcatgcggtccgtcagtcctgcggggtcggtgttgggtgcggggggttgttgcagctcgactcccatccaagacaaaagcacacaccctnnnnnnnnnntcgaggagtcgtctgaggatgatgagccgccggatgatgaagatgacgagtcgtccgaggacgaggaggcgtcgttcttgnnnnnnnnnnnnnnnnnnnnnnnnnnnnnnnnnnnnnnnnnnnnnnnnnnnnnnnnnatccgtcagccctgtgggatcggtgttgggtgcgggggtttgggattttggggggccgaagctctactcccatccaagacaaaagcacacaccctagcgccccgctttccatcccacaacccacggacctcccagcccgatggaggtgaagaagttgatggagaagcgcatgttgcgcgggctgtcggtggggaagatgccggtgtaccacgcggcacagcttgggtcctgcagcctcttgttgaggcccagcaggcccagctgctccaccagctcctggaacaggatcttgacaaagatgcgggaggaggaggtggtgtcctcctccgtcagccgcaccacctccagcacggaccaggggatggcgtcgctggccagcaggtgggcgaagagcttggccacgttgcgcagcttgttggtctccaggcggtggatgagcgagtactggcgcacgaagcactcggagaagcagtcgcagtactcgcgcttgagcttggagaagcgctcccccagcagcgcgtagtacctgtgctgcctgatgcacctcggcactgccagtgcatggcagcccttgctgcagggcgcctgcatggcaggtctcctgtaatgcacgctgcaggcttcgagcaacatcacagacaatctacaagtgggtacgccagctcactttatgaaggtcttctcctgggagcagcactcgatgatcatggtgcacagctccatctccaggccggcaggtatgccctgcaagtggggaggagggttgtggggaagcatgaggcacaggaggctcctttcacttga

SEQ ID NO: 1997 - DNA, 1107 bp, Chlorella protothecoides
  modified_base (73)..(133): a, c, t, g, unknown or other
ggcgccggcaaagcccagagcaacggtgccggcgccgcggcaggtaccgtgccgcccgcggtcgagcgcgccnnnnnnnnnnnnnnnnnnnnnnnnnnnnnnnnnnnnnnnnnnnnnnnnnnnnnnnnnnnnngcggggccggcggggggcgtgtaccttccccccttcaagctggcggccatgctggcggaggcgcaggacaccaccagcgtgcagtaccagcgcatgacctgggacgcgctgcgcaagtccctcaacgggctgatcaacaaggtgaacgccgccaacatcaagcacatcctgccagagttcttctccgaggtactgtagtgggtggcgggtgcttgtggacggtgagggggcgggggtgctcatcttcaggttgggtggcagggtgcttagggaacggcactgtgccttggcctccagatcactcaggggcatgtcagcaggaccacaccctccgcgtgccgcctttccccgagaatagccagatggcgtccccctccttcacccccgtctacgccgcgctggtggcggtgttcaacaccaagttcccggagctgggcgagctgctgctgcaccgtgtggtcacccagttccgccgcgcctacaagcgtaacgacaagcctgtctgcctggcggccatcaagttcctggcccacctggccaaccagcaggtggcgcacgaggtgctggccctggaggtgctcatgctcctgctggagacgccctccgacgacggcgtggaggtggccgccgggtttgtcaccgaggtgggggccctgctccaggacctggcgccccaggggctcaattccgtctttgaccgattcaggtgggagggattgggtggggtggggacggcttggagttgcctgccatgcctgggtgcaaaaggtctttccatcgagcagactatatgcagcatcaaacgcctcgaactccactgccccagctcacgtttccgagctgtatttgaccccgggctccaacccctcactcacagggccatcctgcatgagggcagcattgacaagaggactcagttcatcatagaaaacctgtttgccgtgcgcaaggccggcttcgagcagcaggggtga

SEQ ID NO: 1998 - DNA, 465 bp, Chlorella protothecoides
atgatcgcacatcacaaacatccacaaaacacgatcacctcatggcagagggagtatggcgagggagcagcgcgccagctggcagcacgcaaggccgccgaggcggcggccgcggcggccgacccttcagacccgaacctggtccctctgggcgagcgccccccccgggaggcctcgcccgccccggctccggtgcccgctgtggagtggtgggacgcgcggctgctgacggacaagaccagctacggcgcggccgcagagggcgagccgtccatccgcgaggagcggatcacgcacctgatcgagcacccggtgctgatcgacccgcccggcgaggccccattgccgccgccccagcccctcatgctcaccaagaaggggtatgaggagggttgggagtcagtggcagtctggggatctggacccaatgcctcacccaattgcatcagcaacggttgggcgtga

SEQ ID NO: 1999 - DNA, 855 bp, Chlorella protothecoides
atgtcaacaggtctggatgttgagcggttgcatatcgtttggcgcctcagcgccacacttcttgccaaggctcgccattttcaagatcctgaggccacagaccccgtcctcctgggccccccaaacaaaccgtcgcctgcgcaggagaagaagaagatgcggacgcagaaccggcaggcgcgcgagaaggagaagcaggagctgatccgtcagggcctgctggagccgccgccgcccaaggtgaagatcagcaacctgtcgcgcgtgctgggggaggaggcggcggccgaccccaccgccatcgagacggaggtgcgacgccagatgggcgagcgcgccgccgcgcacgaggaccgcaacctggcgcggaagctgacgccggcggaggcgcgggagaagaagctgcgcaagctgctgggagacccggaggccgaccccaccacctccgtctcgctctacaaggtgggcagcctggcccggccccagctgaagttcaaggtcagcctgaacgcgcaggagaaccacatgacgggcgtgggtctggctgtggagggcgagttcacgctggtggtcgtggaggggccgcccaaggcgcagcgaaggtatgagaagctgatgctgcgccgaatacagtggaacgcagaggaggaggacgagcaggagggcatggaggaggcggaggcgccaaaggccccaaactactgccggctcgtgtggcagggcaccgtgctgaagccgtcctttcggaagttcagggttgagacgctgcggaatgctgctgcagcaaaggccttcctggggcagtacaacctctcacactactgggacctggctgaggcatccgtgccagagtag

SEQ ID NO: 2000 - DNA, 993 bp, Chlorella protothecoides
atgatgctggacgtgttccaggaggaccccgactttgcccagcatgaggccgagtaccaggcgatcaggcgtgagatcctgggtgaggaaagcggggacgaggaggaggaggagtcggggagctcctctggcgaggaggaggaggaggacggggaggagggcgggcacgccgctgggccgtcgggcgtcgggggccccatctccgaccagacgcagacggacctgatcaacctgcggcgaaccatctacctcaccatcatgtctgccctggactttgaagaggcgggacacaagctcctgaagatggtggggcatacctgccggcctggagatggagctgtgcaccatgatcatcgagtgctgctcccaggagaagaccttcataaagagacctgccatgcaggcgccctgcagcaagggctgccatgcactggcagtgccgaggtgcatcaggcagctcaagcacataatgaccgacatctcggcatgaactcccgcctgaccatggtcctcacaagccataccctcccaacctcccccccttcaaaaatgcaccacaggtactacgcgctgctgggggagcgcttctccaagctcaagcgcgagtactgcgactgcttctccgagtgcttcgtgcgccagtactcgctcatccaccgcctggagaccaacaagctgcgcaacgtggccaagctcttcgcccacctgctggccagcgacgccatcccctggtccgtgctggaggtggtgcggctgacggaggaggacaccacctcctcctcccgcatctttgtcaagatcctgttccaggagctggtggagcagctgggcctgctgggcctcaacaagaggctgcaggacccaagctgtgccgcgtggtacaccggcatcttccccaccgacagcccgcgcaacatgcgcttctccatcaacttcttcacctccatcgggctgggaggtccgtgggttgtgggatggaaagcggggcgctag

SEQ ID NO: 2001 - DNA, 1359 bp, Chlorella protothecoides
  modified_base (299)..(368): a, c, t, g, unknown or other
  modified_base (894)..(903): a, c, t, g, unknown or other
atggccggggtcccagcttggaaggaggtagggtggcgagggcatgaccagcgccaggagggccatgttcctgggcggactggtccccatcgtgggtggtggcgggcctacactccccctccgtcggctgcggtagcgccgaatagcatgccgcgactggtgcaggacatgccgcccagaagacgggctgcaaggtccggcaccggcgcagcataccggtgcacacccaagtcgacgggccaaagggccctgtacaggaaatcttccgggatcagaatctcatattcctctcgtgatgnnnnnnnnnnnnnnnnnnnnnnnnnnnnnnnnnnnnnnnnnnnnnnnnnnnnnnnnnnnnnnnnnnnnnntttcacaacgatccggaaccctggcagggtgcgatgggagaattccgaagcggacgataatgttgcatcaggtagggcgctgggggttccttgtagacaacttgtgtcaaaaaggtctgcaggacccactacagctccccctagagtgggccctcactccttcctgagatcgcacaaaagggttcatgctgcgcgtgctgtcatgactccgcaaatccgatcgcgcggaggtcggtcgaggctgagcggctcgtgctgcctctgctcagctacattgcctcctatttgtactgctttcatggctgagatcatattcgtccaattgctcagtgggtggggcgatgatcatggccatcgcagcctcttcgtcatgcctcgagcgcagctcctccggttcggagatgggcacatacgctcgatccaccgatgtacaaggctcccgagagccaatacaggcagccagccaggacctgcaaatcaccttttcatttccagtcgaggtgtgtttctccaaacttgcggatcnnnnnnnnnntcatgctgcgcgtgctgtcatgactccgcagatccgatcgcgcggaggtcggtcgaggctaagcggctccggaacccggacggcatggccactcttgctcccggaaccctgctgggcaacggccgttacagggtcctcaaggaggtcaacaggggcggcacagctgttgtatacgagtgtgagaccctgcctagcggcgagcatgtcgccctcaaggtgaggcttccgtacgggaagggcccgcagctgcacccacgaagggctccgggatcttgtcatgaccgtgaaggatgggcgtgccaccatgccgatcaagggcgtcaagcgcgaggtgtgtgtcggtggagttgcgatgaggggttgatgaagggtgtctttgtgaagccccctccatcggacttcatcacgcctcaagcctggaatttgcagcatgctatgcaagtacatgccaaatga

SEQ ID NO: 2002 - DNA, 1914 bp, Chlorella protothecoides
  modified_base (690)..(699): a, c, t, g, unknown or other
  modified_base (758)..(767): a, c, t, g, unknown or other
  modified_base (1121)..(1130): a, c, t, g, unknown or other
  modified_base (1429)..(1438): a, c, t, g, unknown or other
atggagaaggcatgccagctcaatggatccggtaagcaggatccgcactgcgcatggcccaacccttctctggtatcgttgggagtttctgcgcatgttcgttttacacatggcactcatatgcgctttctgtggacccagccatcgggacacggtagtctgcccctgccattggatgtccagctggtaacacccgccaatctcctcctgcacagagctcatggggcgacagctgggaatcgacgccgccgccaccggccccagggccggaaccgggaagcccgtggagggctgctggttctgcctctccaacgccaatgcagacatagacctggtggtcagcgttggctgtgcggatgcctctttctgtgccctgcggccacatatgagaaaacgtcaaacatccacccttttcaaggagaggagtcctacgtggccgtcgacaagggcgccatcaccgacgagcatgtcctcgtcgtcagcgtggagcacttccccagcagccagtcgctcagcatcgactgctatgccgagatcaggaggtgggcttcatgggttcttggtcgcctggtcttgggacatagcgtgactttgctccatcgctccgaggaggacccactgcaccacaacaaaccccactccgccctcccaggtactggggcgcgctcgacaggtgtgcagcggcaggtnnnnnnnnnncgaggccgcggccagggctcgccaggtgcgcggggatggggggcgcgcttgtgcgggcnnnnnnnnnnggaggacccactgcaccacaacaaaccccatcccgccctcccaggaagagcgggggcaaccactgccacatcaacgccctggccgtcagcgccgaggccgcggccagggctcgccaggtgcgtgggggttgggggcgcggttgtgcgggacacagggaggtgtgcaggaggctgggtggtgattgggcgccccggcactcctctgtcggacggggtctgtgcgaggggtgcgagtccaccgctctccctgagtcgcagcatccgcggggcagcgtgcacttctcgagtgatgccgcctcaagtcgagctcccatgtggcacctgcagcaacagctcgaggccacgtcacccgcnnnnnnnnnngctctccctgagtcgcagcatccgcggggcggcgtgcacttctcgagtgatgccgcctcgactcgagctcccatgtggcacctgcagcgacagctcgaggccacgtcacccggcccctccccccataccctcacaccaacaccgccaggtcttcgaggaccgggcaaaggctgcggggttcagcctcacccacgtccccgctgccgccggcgaggctgcacgagccgcgctgcgagacgtggtgggggatggcgagtacttccaggctttcctccccgatggctcctccctcgtgcatnnnnnnnnnngcaaaggctgcggggttcagcctcacccacatccccgctgccgcgggcgaggctgcccgagccgcgctgcgggacgtggtgggggatggcgagtactttcaggctttcctccccgatggctcctacctcgtgcaccccatagcctttggcgagcgccaccccctgaactatgggcgggaggtcctggccgagctggcgggggtgcccgatcgggccgagtggaaggcgtgcgccgtccctgtggaggaggagcggcggcggtcggaggccttcaaggccctcttcaagccgcacgacatcatgggcgtgcaggagtgaggcctgcggcgagtggccctggccgcctgtactgctgtgcgtctacgctggcagacagcatgcagggccgcttgttctgcttgacacgagttcatgtgcacagacagcatcatggggacacgggaagcacctgcctgctatgtctttattcacgatga

SEQ ID NO: 2003 - DNA, 582 bp, Chlorella protothecoides
  modified_base (521)..(530): a, c, t, g, unknown or other
atggtggaggcggtaccgcagctgatctcatggcttgagtccaggggcgggcgtctccgtgacatcgaggccggggaggtggcccaaggtggtcgaggcatcgtggccacccgggacattgctcccggggcctgcgtcctggaggtccccttcccctgcctcatgacatgctccagtgcactggcctgccccacggtcagcgcagtggtgaacgctgggccactccccttgaccccctttcaagtgggtgcatgggttgaaatggggcgttcctgtgtgttgaactgcattcctcgctgggatgggggactgtcggaggtgaactccggaatgtttgcttgcaggggtaggggttggatgccatggatgaggtcatcaccctcccgaccccgtcgctgggaccacccaggtgcttgcacggctggctgcacggccctaggactcccttatcccgctgcctcccacaaccctcacacccaggtgctgaccatacatgtgttgttggagacgtccaagaagannnnnnnnnnaccccctttcaagtgggtgcatgggttgaagtggggcgttcctgtgttgtaa

SEQ ID NO: 2004 - DNA, 636 bp, Chlorella protothecoides
atgctgacccatgctattcgacgtgccagccatatgttggtcacggcgagggcgcccgcgagcgctagcctgcgaaacctcgctatcacggcaaccccaggggacgaccagcagatgcgagcggatgtgaaccggctactctacaggagtcgccagagaggctggttggagctggatctgctcatggtgagtggtcatggagccatagaggccacaggcatgcaattttatgggaccaggtgtctcgcatcctccacaacattgacaaacacccacaaacacccccccaccctccaacaccagggcatgtgggctgagcagaatgtccccaccatgactgcaaagcaactagaggactacaatgttgtgctggatgaggagaacccagacctgttcaagtggctgacgaaccaactccccacgcctgagcatctacggaataattcggcataccaggcaagtgtacatggattgcttgcgctggcggggacggttgagaagatggattggggcatcctcagctttactagttctttttgccgtcctgttagttcagcctctactcttattcgtttcccgccctgcagctattacacgctagcgtgcaacagtccatggacaagcacagcgtcgtga

SEQ ID NO: 2005 - DNA, 795 bp, Chlorella protothecoides
  modified_base (269)..(278): a, c, t, g, unknown or other
  modified_base (460)..(469): a, c, t, g, unknown or other
atgggtgatgggggagccactgtgatccccccttcccgacggcccgacggcacgctgcgcaaggaggtccgggtcagggctgggtacgtcccccaggacgagcagcctgcctatgttccgcgccaagcaagacaaaatgtccccaagtgcccaggtcttgacgagactagtcagggtgcgtgggcgaatgatgtgtcaaccaactgggactgcacgattctggcgagctcacgggcgttgatgctgatcggttcccactcctgctgcannnnnnnnnngacgagactagtcagggcgtcgatgctgatcggttcccactcctgctgcctcgcagttgcaggcgccccaaagccgaagagcaaggcagcaaccaaaaatgccaagcggaaggagaagaaggtagacggcggcaagcccgcaggagtgacggaggcccccggcaaggcggctgccaagtcannnnnnnnnnaagcggaaggagaagaaggtagacggcggccagcccgcaggagtgacgcaggctcccggcaaggcggctgccaagttggagcaggggaagacccctgcagcaaacccctcagacgtggcgcagcagctggcagcctgcacgctggagccgggtgccaagccagatggcccggtcccaacctcagcccttcgtgccctgaagaagaaagtgaggcaagcggaggagctggagaaggcgcaggcagctggttccgtcctttccccggaacagctccagaagctcgggcatctagaagcatggtatggaccgaggacgcctgcctttga

SEQ ID NO: 2006 - DNA, 1005 bp, Chlorella protothecoides
  modified_base (63)..(72): a, c, t, g, unknown or other
atgcggtcgactccctgcccagtcaaaatccttgcgcgaatgcataagaaaactggtatgctnnnnnnnnnncctgaccacgggacggcgatccgcctaaacagcatgcggtcgactccctgcccagtcaacatccttacgcgaatgcataagaaaactggtatgccgaagaaaccccagggaatctgcaaacaggtcagccgctggctctcaaggtggggaatggtatcatgggccagttcaagcccccgtactgggctggtacagggtggtgtctctgtggcgactggggctgcctacactctgtgctccactcccccgctcactcgacctcgtttcacacacaccctacagtactacttctaccatgccctatcgtggccacagctcctgtatgtggctgaggactacgatggcaccatcgtgggctacgtcctagccaaaattgaggaggaggcgtcagagacgcacggccacatcacctctctagccgtggccaggagccaccgcaagctgggtcttgccaccaagctcatgacagctgcactgcacttgaatctggatgtcactccaccctctgccattcatgctaccccttgcgaaaccggccaactcatccccatcgcttgcgcagatgccgggatggaggacacatttgcggcccactatgcatcgctccatgtgcgagcctccaaccgtggcgccctgcatctttacatggacaccctgggatacgagtacgtggcgtggtgtcttccgcggggacagattgttgctgggggtgcttgggagatcgattgctgtgtcaccccagggtcatgcctatggcgaaaaggggcacaaggcctcaggtggcatgcagtgaggcgctgcacaggccaaatgcaggctgcgccttgctcatcgccccatccttcctcccgggacctttctccagcctctgtgaccgggaggcgcagtactatgcagacggcgaggacgcgtttgacatgcggaagccgctag

SEQ ID NO: 2007 - DNA, 720 bp, Chlorella protothecoides
  modified_base (397)..(406): a, c, t, g, unknown or other
gtcgccgccgagggcgcggacgcggcccgtggcgacgcgctgcactgggtgggcgtggaggtgctgctgccgggtggcgaggcgcggggtgcggtgcacgaggtggatgccgcggggctgctcgcgcgcgtcgcgccggggcgccagggcgacggcggcgcctggggttacgagggcgcggaggcgagcgtggaggtgccggtgagggacttgcaggccgtgaccccggcgcggacagacaccgtcaaggtgggtggagcagggtgtggggagggccgagtggtggagcccagcggggtggtggagactcgggaattgcaagggcttggctgctgttcaggcagcgctccgcgcggccgtgcacctagtgccccccgggtgcgactgcctggcgccnnnnnnnnnngagtggtggagcccagcggggtggtggagattcgggaaatgcaagggcttggctgctgttcgggcagcgctccgcgcggccgtgcactcagtgcccctcgggtgcgactgcctggcgcaccgccgcccaccacacctcgccgatgcaccctcacccctgccctccacacgacgcagctgctgcgcggcgacctggccggccgtgtgggcgagctggtggggacagacggcggcgacggcatcgtgaagctgggccccgagatcaagatctgggagctggcgcatgtggggcgcgtcgtcctccccgcggcctga

SEQ ID NO: 2008 - DNA, 474 bp, Chlorella protothecoides
atgtcacgcgcttcatcggactggcccaggtgtctggtggtggtggctgtggctcttggaggcttgtcctcggggtcaggccggcgaggggtggaaagaggagggttggaagagcgttcttcccaggctcccactgcccatgcctgcctcgctcccgcccaggtcggcaatggggccaagcagaagtggctgcacgccctggccttgacccccgcagcggagatgaccccggaggccctccaggtgcaaccccccgggtcgacggggaaccctttccaggcagctgcggccaagcgcctgaagagggccgcgggggatgcggggcccggcaccgacctcgggtcccaggactggaggtggcaggagcagaagaaggcgcggcagatcatggcagcacccagtctaggcgagtgggggtggcggcatgcaaacgaacagcactgctccttgagccagctcagggctctggcatga

SEQ ID NO: 2009 - DNA, 345 bp, Chlorella protothecoides
atgttgggaagcaggctgtggctcacgagtgaagcccaggccgggtcgaggacagaatcgacgccctctgtcgaaacgcgctgggcccaccccgcatccatccgccaaggagtgcctcacatcaatcctgtgcctcaaatcaacaggagggcgccgcgcaagtcgcggcgcactcacttcccccgccggccgccggcaggctggaacctggtggtcaagcccctgggtcaatctgacgaggagccctacgtcgccgaggcgaccggcgggcgccgggagcccaacgccgacgaggcgttgctgctcaagcgccagacgccccggccgcggcgtcgcatcctttga

SEQ ID NO: 2010 - DNA, 609 bp, Chlorella protothecoides
atgccggccgtcagagccctcttcgccggtgcctgcaacggcagcatcgatgccctgttcaagcgtgcgagcgctgtaaatgcctccaatggtcccttcgacctgctgatctgcgtgggccagttcttcggtgctgcaggcccccattcaccttcgagccgcgccctcccacccccctcgcctactcccctgccaggtccagatgacggagagtaccagggtccgctgctggagtatctgacgggaggcaaggcagcgcccctgcccacctacttcatgggtggctggggcgggggggcggtctccgtcctggaggccatctcggccgtgccggagagcaacatccactacctcggccgcgccggggtcaaggaggtgaagggcctcaccctggcctatctggatgggacacacaatgcggctgccttccgagaggtgccagacaactccggatctgctcggtactacaccgaggctgacatcaagctcctccagcacagcctgagtttgcagggtgacatcgacgtcctgctgaccaatgaatggccagagggcctggctgaggggctgccagagggtgtggcgcccccagactcgcacggtaggtga

SEQ ID NO: 2011 - DNA, 228 bp, Chlorella protothecoides
atgtttgccctgctggaggatgagaacgtgcccattgctgagaacctgtccgacctggatctggcaggcctggaggccctgcgggcgtcattgaatgagcgctactcgggtccgaatgagatggtggtgaacactgcccctccaggccagctcccatgggagatcctgggcgtggacgagtccagagggggtgagcccggcgcagggcaggctgtttcagggatgtga

SEQ ID NO: 2012 - DNA, 522 bp, Chlorella protothecoides
atgctgcgccggtgccggaccttgcagcccgtcttctgggcggcatgtcctgcaccagtcgcggcatgctattcggcgctaccgcagccgacggagggggagtgtaggcccgccaccacccacgatggggaccagtccgcccaggaacatggccctcctggcgctggtcatgccctcgccaccctacctccttccaagctgggaccccggccatccgcaaaggaggcccgcgaggagctaaggcgctttgcggggtcgccccgcccctcgcccgaatggcgggagctggtgcgactgtcccacgccgcacttcaacctcctggccaggcgaatcccgccatgctcaccgacagcttcggccgggtgcacagctacctccgcatctccctgacagagcgctgcaacctgcgctgcctgtactgcatgcccgacgagggcgtggagctcgcgccggcctcgcacctgctcagcagcgaggagatcctgcgcctggtgtgtggtggggatcattcggccgggtga

SEQ ID NO: 2013 - DNA, 867 bp, Chlorella protothecoides
atgccctttgatggcaatgtctggtctgacaagaagatggtgacgtacagggagatgcggggggccgttgaggcggagttcgggccgctggagcccatcctctccccggcgggcgaggtggctcgcaattttcggtgccaggatttcacaggctcggtgtctttcatcacttccatgaccaaggcattttgcagcgactgcaaccgactgcgcctgatggcggacgggaacctcaaggtctgcctctttggcgccaatgaggtctcccttagggatgctatgcgggagggtgcgtcagaggaggacctggcggccgtcatctctgctgcggtgtacaggaagaaggctgcgcacgcgggcatgttcgagctggccgccacagccaatcgggccatgacgcacagcagtacaggcggccagggccactcgccgcaggcctcactcctgcacgcccatgatgtcgtgcggcttgaagagggccttgaaggcctccgaccgccgccgctcctcctccacagggacggcgcacgccttccactcggcccgatcgggcacccccgccagctcggccaggacctcccgcccatagttcagggggtggcgctcgccaaaggctatggggtgcacgaggtaggagccatcggggaggaaagcctgaaagtactcgccatcccccaccacgtcccgcagcgcggctcgggcagcctcgcccgcggcagcggggatgaaagcctggaagtactcgccatcccccaccacgtctcgcagcgcggctcgtgcagcctcgccggcggcagcggggacgtgggtgaggctgaaccccgcagcctttgcccggtcctcgaagacctggcggtgttggtgtga

SEQ ID NO: 2014 - DNA, 417 bp, Chlorella protothecoides
atgcacatgcacacgtgcacacgcgtcgcacctccattccgcaatcaggcgcggctcttcgtgtccgccggcgtggacaagatccggctgacgggcggggagccgacgctgcgcaaggacctggtgcggctcgtggcctcgctctctgccctgcccgggctggcctccatcggcatcaccaccaacggcctcacgctgggccgccagctggcggcactgcgctccgcgggcctgacccacctcaacatctcgctggacaccctgcggccagacaggtttgtgaccctgacgaggcggcagggccatgcgcgggtcctggcatccatccaggaggccatcgcacaggggtatgacccaggcttggaagttgtgtcccacgttttgcagcccatcgcggctgagcctgagctggcttga

SEQ ID NO: 2015 - DNA, 2493 bp, Chlorella protothecoides
  modified_base (982)..(991): a, c, t, g, unknown or other
  modified_base (1636)..(1645): a, c, t, g, unknown or other
  modified_base (2021)..(2030): a, c, t, g, unknown or other
  modified_base (2475)..(2484): a, c, t, g, unknown or other
tgccgcgccctgcgccccgggcccctctccacgctggcgcgatggcggctggtgggcggcgtgctgctgggccgcgacccgcgcggctcggcgctgggcctaggcgcggtggcgggcgtggtggcgctgcgcacgctgctccaggaccgcatcgccaacctgaacggcgaggcggtgcaccacgtgctgcgccaggatgtgcgcagcttcctctggctcctgggcgtcagcgcggcgcagggctgcgcctcggccgtgctggcgcccagcctgcgccacatcgccgacctgctggcgctgagctggcgcgcgcgcctgacgcgcgcggcctctgaccgctacctcgcccctggggcgacggggtacaccgcggtgcagctggcggggctgggcgatgtggaccagcgcctgacgcgcgatgtggagcggctgagccgcgacctggccgccctcatccccaccctggtcaagcccgtgctggacatcacctggttctccgcccgcctctgggccatgacggggcgccgcggcgcggccatcctgtacctctacgccgcgctggggtacggcacgctgcgcctactgactccggactttggcgcgctgctccgccgcgagtacgagctggagggcgggttccgaggcgcgcactcgcgcctgcgcacacacgccgagagtgtggccttctttggcggtggcgcgcgcgagggcggcgccgtcgtggcgcgcttcgacgccatgaccgcccacctgcgcgggctgatcgcgcagcgctgggcctacggcaccgccgacgagttcttctccaagcagctgccgcacaatgtcacctgggtgctcaccctcctctacagcctggaccagcaaggtgggttcatttgtgtggggggggtgggggtggagggcggtgggcactcaaagggagtgagatgtggtgaagtgtgcaccgtagcatgcatcactgtggggcggcgggctccgnnnnnnnnnnatggaccaacaagtgtgcaccgtggcatgcatcactgtggggcggcgggctccggctcctcgaaagaaggacgcgcgactctagggcttcatcacaggctggcaagggccgtatctaccacccctacatcccaccccccaaactccgttgctcctgcaggcgacctcagcgacgatatggtgcagggacacctggtgcaccaaatcaggtacctggcctccgtggtcacctcctccttttccgcctttggcgacctgttggccatgcccaggaagtttgctgagatctccggcggcatcgcgcgtgtcagcgagatgttccaggtgctggacgctgcctcgcgcttcgacagccgcgccgcgctggccgagctggagggcgcactgccggacagcatcgagttccggaacgccgacatcctcacgccgggcgggcggatgctggcgcgggacctctccttccgtgtgaccccgggccacccgctcctggtcacagggccaaacggcgtgggtaagaccagcctgttccgcatcctgagcgggctctggccgctggctgcaggggccatgcaccggccgggggctgcgggggcgggcctggactcctccgcattcgaacgtgccatgcccaccggctgtcaatggnnnnnnnnnngaatggggggtggggcatgcacgaagggacgctgtttgagcttccgtttcacgcaaatcagtctgtttcctgaaccccaccacccccctacaaaccctctgctcctccaggacatctactacgtgccgcagcggccatacaccaccatcggcacgctccgcgaccagatcatctacccgctaaccgcccgccaggcgtaccagaggtattccatcaccgacagctcggaggatgccgcgcagcagctggatgctgagctggatgacctgatgggggtggtgcacctcaagtacctcgtcagccgcgagggtggatgggacgcttcccgggagtggggcgagaccctctctctaggcgagcagcagcgggtgggcannnnnnnnnncacgcctgcgactcacgtcgatcgcgacccaactccattgcaaccccactccatcgtactttccccaaacaggcgagcagcagcgggtgggcatggcccgcctgttcttccacaagccgcgcttcggcatcctggacgagtgcaccaacgccacgagtgtggacgtggaggagtcgctgtaccagcacgccaccagcctgggcatcaccctcatcaccatctcccagcgcacggcgctggtgaagtaccacgagcacgagctgcggctcctggacggccagggcggctgggagctgcgcaagctcagggcctgatgcgtgccgggcgctctgttgtccttatcaaggcctatctcaacatcagaagtaggagccagaggtctgtggctgcatgttctgcaggtcttgaggatcaactcctcgaggagttagcctctggagtcccnnnnnnnnnngggagctag

SEQ ID NO: 2016 - DNA, 2169 bp, Chlorella protothecoides
  modified_base (2054)..(2063): a, c, t, g, unknown or other
atggtcggcgatggcgtgaacgacgcgcctgcgctggcgaccgccgacgtcggcatggccatggcggggggcaccgacgccgcggcgggcgccgcgggcgtggtgctggtcggcgaggggctggaccaggtgtgctccgcgctggacgcgggccgcgccgcgctgcgcaccatccgccagaacctgggctgggcggtgggctacaacgcggtgggcgtgcccctcgctgccggggcggcgctgcccagcctgggcctcgccatctcgccctccctcgccgcgggcttcatggccttcagctccatcgccgtggtggggaacagcctgcgcctgcgcgagaggatcgcaggcaggccggcgactgccccggcgctgatacccctggcgcctactacctttccgtccgcctgtcgcatggcaagccttgtactcctcactgtgcaccctgccatggatccctgtgatccagcgcccaccaaagcaaatccatctaatatttgctgcacccttcctgctctgaacaacctcttggctgcctcttcaagcttctctccttgttcacatgctgtcaagacattaaaaaagaaatcggcactgccaacacccgtagcatgcatgcctgcatgcctggccttggccggaacgggtctgtctgatggcttcttgggcccacccgacttgctgtccttgccatcacccgacgagggcaggggagcggttggagtgcagacttgggagataccaaagcaggacacaaccgatgtgcacacacccaacacctggccgcatttcctgccgttcggtgatgttggatttgcactcccggcactgcacatcgttctgcttgcggttcccgggcaccgtcaggatgtccccaaagtagatgctgggcagagccacggcccaggtcaggatgatgccccagggcgcgggcagctccagcagcccggtcagcttgaagccggtgaggtcgtccaggagaaaaacgctaaccagcacggccagggtggcgggcacgttgagggccagcatgcggccgtaggccacctccgcgtcgctgtacatggcctggctgcgcaggctgcagcgtgggccctgggcggtcaccaggctggcgttgcggcgcaggcggccgcgcagcgcgtcgaactcatcgtccgacaggaggggcttgcccgagcggtacgccttctgggcctcgatgaagcggatctcgtcggagctgcatggcggaatgagagagaggcgataaggatgcgttgcgggcgtgagaggagtgctgacgaagggcaggaaccctcgcgcgcactcgaacaccctgccggtgttcgacatagggaggagctcctccttcagcagatcaaactcctggtcgctgagcttgggcttgccctcaaatcacggagcatcatgcatggaagcaaaccccaagtaaagctgatgtctcaccgacagggcctccaggaacatttgctccttctctccaagactgagctgtgtcagtcggcgggccccagtctcgtctatactgcagaacgcatttacccccgacgctggggatgcgaagctgctcaggggcccatggccagccttcggtcgaccaacgtaccatcatccactgaattatccctagtggcattcctttggacattgagacgaggcgcgcctgctgcacggggcgccgcggctctgaatgccagagggcacgcacggagcctcgtgcacccaaacgccgctggacgcctcgccaagatgtctgtcgccagactgttgagtaccttcatctcgaaatcaacatccacagggcaagagacgggttgtgaccttcggtgcggtgcatggagtgttctagcgaggcctgctgcagagaatcgccccggatggggcgtggaaaagaggaatggtctcgaaaatctcgcccttggggaccatcgctccagtctgaatagcgccaaacctgctcataagactgtcaacacggcgtccatcgttccatcaacgcccgagctccctttttatcagcacaggacgttcgacgaagagctggcattgcnnnnnnnnnngtcaacacggcgtccatcgttccatcaacgaccgagctcccttttcatcatcacaggacgttcgacgaagagctggcattgtagcgaccacggagaagttctttga

SEQ ID NO: 2017 - DNA, 747 bp, Chlorella protothecoides
atgtcgaacaccggcagggtgttcgagtgcgcgcgagggttcctgcccttcgtcagcactcctctcacgcccgcaacgcatccttatcgcctctctctcattccgccatgcagctccgacgagatccgcttcatcgaggcccagaaggcgtaccgctcgggcaagcccctcctgtcggacgatgagttcgacgcgctgcgcggccgcctgcgccgcaacgccagcctggtgaccgcccagggcccacgctgcagcctgcgcagccaggccatgtacagcgacgcggaggtggcctacggccgcatgctggccctcaacgtgcccgccaccctggccgtgctggttagcgtttttctcctggacgacctcaccggcttcaagctgaccgggctgctggagctgcccgcgccctggggcatcatcctgacctgggccgtggctctgcccagcatctacctggtggtggacaagatcaccagcatcgccttcaaggacgcgctagtgctagtcgcaccttgccccaactgcggcaccacgaccaccacctactttggggacatcctgacggtgcccgggaaccgcaagcagaacgatgtgcagtgccgggagtgcaaatccaacatcaccttcaacgctgagaagagacaggcggtggtgacaaacctgccctcgtcgggtgatggcaaggacagcaagtcgggtgggcccaagaagccatcagacagacccgttccggccaaggcctga

SEQ ID NO: 2018 - DNA, 1251 bp, Chlorella protothecoides
  modified_base (89)..(98): a, c, t, g, unknown or other
atgccactggctactttgcccgttctaggcacgactgccgccgcccagcgggccgttccgtctcgcgctccatgcctccgacgcctctnnnnnnnnnnccgccgcccagcgggccgttccgtctcgcgttccatgcctccgacggttcgccattacggctggggccggcagggtcccagactcggcaccctcccgcgggccaccctcctcctccgacctccgccagctccggggcgtgggtcgcacctacgaagccctactctccgcgcatgccatcgacagcatcgctgcgctgcaggacctctaccataccagcctgggcgccagcaaggacgagctccagcgcttcctcgccgtgagtcgtgggcgcgtgggtctcctgggtgctctgcctgtggcgtgtggggacgggaaggcccggtgcgtggccatgtgctggcttgggtgtgcggaatatgtgatgtgtatcaatccgttcgtggtgtggctgcgtcaccctcagccgatgatctgtggcccattcctcggatgctgtttgtgcgcatttccaggcctcgggccgagattcaacacgcgcgcacacacaaaccacaggaggtggtgggcatccgcaactcgcaccaccgccgcactgtggcggagcacgtgagcgcgctgacctggcaggcggaggcggagcgcgcgcagcgcgtgaccctggccgtggagggcaacatcggcgcgggcaagtccaccttcctcaacatcatggcggaccaggcgctggagctgcaggacatcatcgaggtggtgcctgagcccgtggaggagtggcagtcggtggctggagcagagggcggggagggccccgtcaacctgctggaccgcttctacaaggacccccagcgctacgcctacaccttccagcactacgtcctgctcactcgcatgcaaaaggagcgggactccaggagcgggctcaagccgctacgggtgctggagcggtccatcttcagcgaccgcatggtctttgtgagggccatgcacgagagcgggttcctgcaagacatggaggtctccatctacgactcctggtgcgcaggcagttctgacatggtctggccaggagcctggggtggggatctgggaggaggaatgtgggcacctatgcatgcaagagtttgggtttctgctgtctggtggggcagattctgccgagctaggtccagggagcagcgtgatcttcacaggaaggccgcatggccgccctga

SEQ ID NO: 2019 - DNA, 249 bp, Chlorella protothecoides
atggagatcgggaacgacaagctgctgacgcccaacggcttcatctacctgaaggccagccccgatacctgcatccagcgcctacggcaccgggcccgggccgaggaggtgggggtgagcgaggaataccttggctccctgcatgacaagcacgaggactggctgcacttcggggcgcgcacgctgtcagaggtggtggaggcccagaggcacatgctggagaccgtgacacgtgagccagggagttga

SEQ ID NO: 2020 - DNA, 753 bp, Chlorella protothecoides
  modified_base (266)..(275): a, c, t, g, unknown or other
atggcacaagggtgggctgcaccatgccctgcacccgaatccatcacaccgcgtccccatcacaccgcgtccccatcgtatccctcccagttattctcgttcctgaagctagggtccaagacagccacgaagcccaagtacgagacggtcatccctgagacgagctacgccattcctgctgtactcctaggcgaggacatggggtgggggcgacgggtgtttctcagttgggaaacgtgcacactcaatgtcaacatgccgcttcnnnnnnnnnnaaggaaatggggtgggggcgacgggtgttttccaattggaatcgtgcacactcaatgtcaacatgccgcttcccatgatattcctccagcattttcttcttcatacccaggtggagcggggttgacccaggtcacgacatccaacacggctctggcggcaggtttgggcctcctgggtgccttcctggccgtgcaagcctctcgcgtcaagtttgtctttgacgaagacgccctggaggtgctcaccgggaaggatgaggaagaatcagagaatgcgtttgtgggtggacgtaaccgctggagctacgacagcatcatcaactgggagttttggtttccgtccttccccatcctggtttacttcaaggaagaccagacgcgtccagagggacagatccacttcttccccgtcctcttcaacggcaagcagctgtttgaggtgatgagcgagcgcttcaacaagcccgagtctgactga

SEQ ID NO: 2021 - DNA, 966 bp, Chlorella protothecoides
atgaccagtcctcatacactggcacacattgcaggatcaaggaggagtctgagctcattgagggagaggtggtggagattgagattgaccggcctgccaccggttctgccagcaagacggtgtggcatggtgttacgggtgggggaccagggcaagcagcaaccgtggccaggaatgcacgcggcgtgccagagtcaaatccatttgcatctgagtggcaccctcggggctgcagtcgggtacactggcgggcagagtagtcatgctgtggagcccttttcaccgcacgtcacagggcaagctcacgatgaagacgacggagatggagaccatctacgatctcggcgcgaagatgatagaggcgatacagaaggagaaggtcactgctggcgacgtgattgccatcgacaagtccagcggcaagatcatggagtgccacccgtctatggggcatgtgagctgccttgcatgcccatggcggtgtaccttctcccgcacccacctccgcctccacattttcaggtcaccaagcttggtcgatcctttgcgaggtcccgggattttgacgccatgggaggcccagcatcatcgccaggctatccctgtgcacatctgttcacccactgtcactgcccagcaccaacctcctgtctcacctcttccgctgccccaccctcaggccccgccaccaagttcgtggtgtgcccctccggggagctgcagcggcggcgtgaggtgacacacgtggtgaccctgcacgagatcgacgtgatcaactcgcggcagcagggcttcctggcgctgttcgccggggacacgggcgagatccggagcgaggtgcgcgaccagatcgactccaaggtcgcaacctggcgcgaggagggcaaggccgacatcattcccggcgtcctcttcatcgacgaggtgggtctggcgcgcgggctgggatgcttgtgtgggtgttga

SEQ ID NO: 2022 - DNA, 435 bp, Chlorella protothecoides
atggcagacctacgggtcaatgcggaggaaaaagatctcacacgcatcgaacggattggcgcccactctcacatccgaggccttggcttggatgactctctggaggctcgcgccgtctcccaaggcctggtgggccaggcatcagcgcgcaaggctgctggtgtaatcactcagatgataaaggatggccgtatcgctggtcgggctgtgctcctggccggccagcctgggaccggcaagaccgccattgccatgggaatggcaaagtcactaggggacgagaccccctttgccatgattgcggcctccgagatattctccatggagatgtcaaagaccgaggccctgacacaagcgttccgcaaggccattggcgtgaggtgggtgctggcgagggccggtgggtgcggtgtattctcctgcacagaggattag

SEQ ID NO: 2023 - DNA, 432 bp, Chlorella protothecoides
atggctcccaagaaggctgacaagtcgccgaccaaggccaaggccgcgaagggaggagtcgagaagccagcgaagaaggtcaagaaggagccgaagggggaggtgtccgttggaaggccgacagctcctggcaataccgggtattgtatgctggggcttccgtctgtccatctagtcgctttgcgtgtgctcgatccgtctagtcatcgcacctccttgaacttttccactacgcagaggccactgtcggccttcttcttctactcgaatgacattcgtgagcaagctcacaatgcctgcacgatcgtccttcctgcagtgaaaagcgacaaccccggcattgcgtttggcgagatcggcaagaaggttggagctctgtgggctgccctctccgagaaggacaaggtgagcgtgtgggagctttgggtgtga

SEQ ID NO: 2024 - DNA, 2247 bp, Chlorella protothecoides
  modified_base (353)..(362): a, c, t, g, unknown or other
  modified_base (1524)..(1533): a, c, t, g, unknown or other
  modified_base (1834)..(1843): a, c, t, g, unknown or other
  modified_base (2046)..(2055): a, c, t, g, unknown or other
  modified_base (2149)..(2158): a, c, t, g, unknown or other
atgggcaccaggggccctggtcttcaaccaggtgctggcaggcctccctcacccgctgtccctgcaccactcccgctgcagatgaaggtggacacgacgcgcgacgagctgctgcacatacacttcaacatcaccttccctgcgctgccctgctcctctctgacaatggacacgggcgacgtcagcggcacctaccactcggagctgggggttgccgtggccagagatcattgccctcgcacaatatgggcatgtgcttggccactccgtccattcctacttcctgcccccgctccaggaacggggagctgcacaagtggcggctggatgctgagggccggcgcagcgatcgnnnnnnnnnncccgccacggataaacgcacacgagtccgcctttgccatgtccttcaatctgggctcggccaacctggagaacattgattttgaaaagcaggcgtgtcgacacctgggactgggtcctagccctgggttacccctcgccccagtgctcgaacgattcagtgcgccgcccaagcctgatgttctgccatcccaagccaacccacttttcacactttctaggaggaaggcgatgctggcgcacgagggctgcctcatccacggctgggtggcagtgcagaaggtggcgggcaacctccacttctcggtccgccccgaggccctcttcatgtccatgaacgaggcggagatcatcggcgccctcctcacaaggcacatgcacctgaatgtggagggcaatgtctcgcggccggcaacaacatgcactgcttggcgaagagtgtcttcgcctgccttacaccacccctctttccccacaccctttcccccatcaacatacacacgcaatgcagcacacacccgacgcctcggccctgaacgccagccacgtcatccacacactgaggtttggggagaagggctaccccgggcaggcctacccgctggagggcgtgcgccgcatcgaccgcaaggccaccggcatcgacaagtactttgtcaaggtagtgcccacgcgctaccgccgcggcgcctggcgcggcgacgtgcgcacgcaccagtactctgtcaccgagtactatgcgccggtggacaccaaggccagcaacctgctgccgggcatcttcttcctctacgacacctcccccatcgccatggacgtcgagttccgacggccgggtctcctgcacctcctcgtacgcgccgcggcggtggtgggcggcacctttgccctcacgggcttctggtgagcttggtgtgggtgaggggtgggtgggagggggtcaagggaccgcggagcaagtatggcgtgtgctgcacatgccatccctgcgccactcgacggagacgaggcctggtgagcggccaacgcccccatgtgcgtcctgcatggcagggcagcgggccatacacaaccgtcaacactccccggcccccctcctttgatgcagggatcgcgtcgtgcacatgctggtgctgcgatttgggccgccgcaaggtgggccannnnnnnnnngtcctgcatggcagggcagcgggccatacagagccgtcaacgctccccgcccccccccctttgacgcagggaccgcgtcgtgcacatgctggtgctgcgattcgggccgccgcaaggtgggccggggccctctcccgtcacgcggcagagggtgtgaaggggaacctctggcactggcaccctggggtaacaggacaccggcaccctacgccttggtgtaggctgccttctccttttcataccgggccttgtcggcctcggccttcttctcgtatggtgcctgttgagggaaaggaagcannnnnnnnnnggcttctggtgagcttggtgtgggtgagggttgggtgggaggggggtaagggaccgcggagcaagtatggtgtgtgctgcacatgccatccctgcgccaatcgacgaagacgaggcctggtcgttacacattgtcagaaggtcgtggtcggggtcatgcatcccagcatgagtccttgcatggggctggggcactgtcgtcgnnnnnnnnnncaccggtcaggtcgttacacattgtcagaaaggttgtggttgggtcatgcatcccagcatgagttcttgcgtggggctggggcactgtcgtcannnnnnnnnnccgggccttgtcggcctcggccttcttctcatacggtgcctgttgagggaaaagaagcgtggctacttcagacagagagtagggattga

SEQ ID NO: 2025 - DNA, 363 bp, Chlorella protothecoides
atgctggacattgagtgcttctcttacctgaaccgcgcgctggagtcagagctggcccccatcctggtggtggcttccaatcgcggcatcacgcgcatccggggcaccgcctactcggcgccccacggcatcccgctggacctcctggaccgcctgctcatcatctccacctcgcccccgggggaggaggacctggcgcgcatcatccagatccgggcggaggaggaggatgtggagctggcaggggatgcgcatgccctgctcaccaagataggcctggagaccagcctcaggcgagtgggtgggcttgcaaactatgcatggctcccccctcacatcaaaggctgcacggttggacattga

SEQ ID NO: 2026 - DNA, 231 bp, Chlorella protothecoides
atgctcgccgcaggcaagctggatgccatccagccgctactggacgcaggagccagggtgacccagaactgcgaaggctccccacccctcactatggccgtgtgcatgggtagccaccccagctacgagcggtttgcgctcgcggcctccagcctgctgctcgacgcaggcgcggtccccttcgagaggcgagccggcgtgtgctttttgggggtggggtgggtattgtga

SEQ ID NO: 2027 - DNA, 339 bp, Chlorella protothecoides
atggacaccatcgacccagaggtgagggccgacgtcgagtacgcggcccggctcctccagacagccgcccagagcgacgggccggcggatgatcaggacacggcgagccaaggtgatgggcagcacccgctggccgccagccccgccagccccgacagggagctgcagaccccgaacgccgcaccgcagcgacggtccgcgcttggccccgtctccctggagcttttctgcgtgctgatggaggaagtgctggcgcagaccaagggtgagccacgccgggcggcgaggggttgtgtgaggatgggggggtgggatgtccggcccggaccagcagcatga

SEQ ID NO: 2028 - DNA, 600 bp, Chlorella protothecoides
atggccgagctgaggcgcgccaaggccgcctcggaggtcaaggagtgcacctttgcgccgaccctgaacaggaggtctcaaaacctgacctcccatagatcctcggcactcaagtactacgacaggctgtacctggaggcggagcgccggcggcacaagctggaggccgcggccttagagcttcccgcccaagtcacctttgctcccaagatcctgaggagcagcgtcgtgctgcgccggctgaactcagggcgtgcggacgccgaactggcggccacctgcctgggccggccgccgcgcgtggaggcccgcctgctggagcgcggcgagcgctacgccgcgcgcgccgaggcctcccgcgccgcggcgcgctcggccctggaccccgccacggggcgccggctgttcgtgccggagacgtgccgcccgccgcgaggcggcctgggcggtgtgcgcggcagcagcatcggggagcacctctacggcgtcgcggcgcagcatgcaaagcgcgccgcggcccaggccgaggcagagcgccgccgcgccgagcgcgacgccgccagcacctttgtgaacgcctcctcccaggtgcgtgtgtga

SEQ ID NO: 2029 - DNA, 723 bp, Chlorella protothecoides
atggaatccgaggagaccaagagcctcgaagacccccgccccgttctcctcgtcacgacggtggacattggggacggtgtgacaggcagggtcgaggtccggctcggtgacgaccccgaggacgcagctcgagctttctgcgccaccaacggcctccccgagtccgttgtgctgccattggctgcccatctacagtcgaacctggatctgggcccgcccagcgagcaggatgccgcgacagggagcgtcgcccccgcccaggccatctcctgggcggacggggacgtgccggcgcagaccccgcgcgaccccctttcccagcaggatctgcactgggcccgccctcccgggcagggctccccccccccgcaccccgacgccggcgcctcgcggggcaccggcggggttaccccggcgtggggccccggcagcagcgcgccgccgcagggaaccacctcctgcgtgcatgagcggctgtaccacgagcacttccggcagcagctgaagctggaggaggcgaggcggctgcgggacctggagctccagctgcgcatggcccaggtgcacctcgaccccgtgagccagagcctgtcggccgcacgcacgcctgacggctacaccaactacggcgagaggctgtacgtggagggccgccttgaggcgctgaagagggagcaggcggtgcgttgctcgggggctactgttgggagggggccgttctag

SEQ ID NO: 2030 - DNA, 345 bp, Chlorella protothecoides
atgtccttccttccctccaattccgcggcatttgggagccaaaatccgagaggggatgtagaacagctgttcgccgcggagcctcctgtggccactgcatccacatcggctccaggatccgggtatcaagccccctccagcccgggagcttccgcctcgcccgtcgggtatggacccaccagcaacaccctggacgagcccatcggggacaccatcaagcgcgacctcaaacgcatctataagaacctggtcatggtggtcttccccttcaaggatcggagccagcagactgcggccctgcgcaactgggacctgtggggtcccatggtgcgagctacggaatga

SEQ ID NO: 2031 - DNA, 327 bp, Chlorella protothecoides
atgggggagggaggtcaacaccatccctgcggacctcaagtacgccagtcacatccccttctcagcccgtcctccggctgccgactcgttcggaaccctcttccttccatccctcttcatccccccctttcctcccttgcacgcgcgtacagggatgactggggccgcaccgcgctgcactgggctgctttcctgggcctgacggacgtggcgcagctgctcttgctccgcggccagcagtgggcggagcgcgaggccgctcaggacagcgacgcgcccgccatcccgtcgctgcaggagttccaggcgcggtgtgggtgtgtttga

SEQ ID NO: 2032 - DNA, 657 bp, Chlorella protothecoides
  modified_base (288)..(297): a, c, t, g, unknown or other
  modified_base (561)..(570): a, c, t, g, unknown or other
atggacccgacgcaaggcttcgtcacggagtttgcggggttcgtggacgacctcaccaccccggagaaacgtaacatcgtggctctcacggagatcgcgcgagaggcgatgcacaaccagccccaggctgtgccaggcttggcgcaagtcatcatcaacagggtgctccatgtgagcggcgtccagggggagacacaagcgacggtgcagtgcttgcgatggccgaccaacccctcaagctgcctgccctgtacctcttggattccatctccaagcttgtgggtgagnnnnnnnnnntgtgcaccgatcatcatgacccaaccccctacatcacaggccgaccaacccctgaagctgcctgccctgtacctcttggactccatctccaagcttgtgggtgaaccctacaagacgtacttcagcgcagccctcccagaggtgtgtgatatctgggtggagttgtttggtgctgcaagaggagagcagaagcagtcaaggggtggaagcctggaagaacagatgtttggctcgcaccatgctgtctgtcaagacctgttcttnnnnnnnnnntcaaggggtggaagcctggaagaacagatgaatggctcgtaccatgctgtctgtcaagacatgtcctctagctcaaggatcccatag

SEQ ID NO: 2033 - DNA, 2697 bp, Chlorella protothecoides
  modified_base (791)..(951): a, c, t, g, unknown or other
  modified_base (1008)..(1017): a, c, t, g, unknown or other
  modified_base (1590)..(1599): a, c, t, g, unknown or other
  modified_base (2195)..(2204): a, c, t, g, unknown or other
atgtgcctggctcccgatggccctctgctgggcccaaattgccttggccttgatcctcatcttgcctggctctcctcccacaatctgacggccctctgcctagcccgccctgcctcgaagcattctccacagcccgcaccttacaccccccccctctcaggcctcttcttcatcggctacctggcgcagctgccggccaacgtggcctgcctgacctttggcgtgcgtcgctggctgtcctgcatcctgctggtctggggcgtcgtggcggggctgggcgccgccatccgcacccgcgcccacttcctcgtgctgcgcttcctcctgggcctggccgaggcgggcaccttccccgccatctacttccagctggcccggttctacgacgcagacgggctgggcctggcctacacctggtgggtggacatgaggggggggtctgccgtgcctgcaccacatcaggcccggccgacctcacatttgtctgcggccggcctcaaaccataccgtgcctctgcccccacctcccggcagggtggcgacggctaccgcggtggcgggcctgaccggcgccccgctggcggccggcctgctggccctggacggccgcggcgggctgcgcggctggcagtggctcttcctgttagaagcggtccccgcctgcctcctctcagtcgcggtggccctggccctgccctcccccgccgacgctggctggctgtcggcaggggagcggtccgcgctccgaacgcgggtgcgctgggcacaggcagggcagggcgcactggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagggcgctgaggtgggcggcgtcggcgacgaaaacggcagtcgggcgggcacgnnnnnnnnnngccgcgctccggacgcgggtgcaatgggcacaggcagggcagggcgcactggagctggtgccacgcgaggctgccgtcgccggggcggggccacacgacggcgaggccccggcgtccgaggaccgcgccgacgatctgcccctgctggcgtcggacgggggaccccggcgtggttctgcgccgtcgggcgggcacggcggccgcgctgcgcgccgcactgcgcgacgcgaggctgtggtggctggggggcatcctgctcctggtggacgccgccatgaacgcggtcaacttctggctgccccagatcatccgcgcctcgctcagggccggcatagtgaatggggacgagggaggcgaggcgggcgccgaagcgacctcccggcagcagcggctcgacgtcaaggcatcgctcctggcggggctgcccttcgcggtggctggcgtgggcatggtgctgaatgcgcagcatgcaaagcggcgccacgagcggcggctgcacaccgccgtccccctcgtcgcggcggcgggcgccctggggtggtgaacaactggcaatgggcaatcgcggaaccnnnnnnnnnntgggatgcggggttttgggggggagggggtgaacggaaagtaggtgtgttcatgcttgcgtggggggttgtgggtggaggaacagctgcgtggctagattgtgtggcgaccttggtctggtgccagggatccattgccaccgcacgcccaagttctggcaagagtctcattgatcgcaaaacccagcaatgttcccccccctctgcctgtttcctgcccttctcccccccgaaaaaccctcctttcccacctcgacaggctactcccgctgacagccctcctgctgggcacggctggcaccgtggccgccctcacggccggggccgccggcatctgggcggtccatggccccttctactcctggccgtctgccttcctggacgcgcagaccgcgtccctgggctttgcgctggtcaagtcgctgggcgctctgggcggcttctgcgggccgctggtcgtgggcgtactggcggatgccgagggcggcgatttcgcaggcggtgccttcttcctggccgccgtcgcgctgcttggagcgggcatgactctgggaagccccctcacacccatgcttgcccctccacagcattccgagnnnnnnnnnntacacccgtgaatggattctcctggtctcatgccacccttcgctccctcctaggaagccccctcactcccatgcttgcccctccacagcattccaagggtctcagagcgaggcagagccattgttgcgattgccatcctggctgcgttggcgtcaaagtaatactgtggagcacatatcctcagtacccttctgataatcacacccggccgtgctgcttgacctaccctcttgcacatcgcaccagcccatgtaactggactggtgtgcatctgtcagaggcatggtggggattgcaagtaatggtacacagacttgcagcccggctgactcagcacagctgcccgtacggcctgaccggggtcaagctgaggccgcgggcgctcgctccaggcgacatgccctcaggacctcctcagcctgctgctgatcgggcaccgaccggaaatcgggctcgatgccctcccggtcgatgtctaccccggcaggtgtaa

SEQ ID NO: 2034 - DNA, 711 bp, Chlorella protothecoides
atgacaagcgagcctagccttccgggaagctaccccatcaaggtacggcgggctgcctcgcgctgcccggccgggggtgaggaccgacgaatctcggagggtcccggaccctggagtcgatccccagccccgccctctacctacaggcacggaaggcgtacaccatcaccaggccacgcgagaggtggacggatgaggagcatgatcgcttcgtggacggtgtgcgcctctacggccggcagtggcagaagatacagggtgaggctcagggctgggggggaggggcatgtgggcaccaagtctgcaatccagatccgatcccatgcacaaaagttcttcgccaaggtggcaaaaaggggaggggactccctgtcgtcctcctgcagccaaggtgtgggaagggtccggcttggggcggggcctccatgtgcctggggcatcgttgtgcacatgcctgcagaaagcgttctggtgatgggcagtgttcggtcatggatcgaactggaagctgaatccccaccttgtcaatctgtgcagattggctgcccgaggacttcaaggtccctcccgccaagaccaggcgtcggggcagtgactcctcgatgcaggatgtcgaggaccacgctggcgatggggcgcgctccgtgttgccggtgcccacgaacagcgaggtcagaaagtccgcccagagcgctgcgccaccccagatga

SEQ ID NO: 2035 - DNA, 1941 bp, Chlorella protothecoides
  modified_base (1625)..(1634): a, c, t, g, unknown or other
atgtgctgcagaagctcacggcatcgagccaggccgcggtggggatgcccctccaggctcggtcactggacagtctccaggtgtgtagagggtcaatggcagggacatcctgatgcttgttgtgcatgcagtgcatggggggccgtgcaagcgcccatgcatgcccatcgcattgaaattattggcgagggggagtgcacaagcatggaagaatggggcgcatctcgaggcggacagcctcgcctggtccagccacggccagcctgccctcgcccggctcggcctctctcccactgcgtcgtgcatgccatgctgcccaatcaatcctccaaccttgtctctggcctcccccttcctccagctgcgtgctttgatagtggctctggaggatacactggaggaggagcagggattgtaccatctcgccgcacatgccgtcttcaggaatgttctcaccgggctgcaggtgagaaggggctgctggtccgactgatgacttgggctagcctgacagccactgacccattggagaaagtgctgttttctgcttggtcccggaggcctgtatatgccaccgctcccgagattgtgctctgtccagcggctccctccaagacgatcaccttgaagccgacgtatggggctcctgatgtagcagacatgagtgtgccgtctgggcgatgtgaactctcccccttaggccagagcaatactgccgtcactcctgcagattgctctcggtgtgggagcagacatgtggcgacggcatacaggagtcagaggttccagcggcggcagatcctgcctggaagtgcatggtcgaggtgcacatcgtcagtaactcccggggcagggcgcgcgcgcgatggtgatgctgacgggtggggaataagcttgtacgaaatctacaatgtggtgtcagtcaatacttcttttgccctttttaaagttcacctccagcgacctgcgcttctggccgagctctcgcacacgcccatgtcgaacccggcggggtccccaccggcccctggacttgacgaagaaaacagtgtgataaacgagttgaacaacctagcattgaaagatgtgagtgttcggtcgtggggtgctgtgaaagcacctatactcttaattgcacagtggggaccacagcgtgatcccctctccaacaccaatgtgcaggatcccgtctcaaaacctgaaattgatcagccaggctcttcccagggtgcctgtgactgggaggacgactgggaggccgccgtccccccccccgctgcgcagccctctccgcccaccacctcgggcgcaccagaccccgccctgctggcgcaagacgagcggggccgtggtgcaggacctccgccacttgatcctcgctccacggcggccggcccctctgcagcggccggcactccccctttctcaagcgcgcactgccttgagctcaccggcctgtcgcctgccatccggcagcgcgacgtggaggagtgggcggagcggctgaagcccgccgtcccgccctacgttcgatgggtggacgagacggcagccgtgctcgtgttcttcgacccgcccgccgccagggcggcgcagcgggcagcggcggcgtcgtcagggcccannnnnnnnnncccgcccgccgccagggcggcgcagcgggcggcggcggcggcgtcggggcccgcgctgggcacgctgcgtggctgggaggaggcctccgccggcgccagggccctgccgccggcggagctcgcgccgccccgaccccggcccgcggccagtgcagccgtggctcggcgactgataggcgccgcgctgtccatgaacctgcgggacaaggggaaggaggaggcgctgcgggacgcggggcgcgcgaagcgcgaggcacgcgtggcggagcaggcgcggcgggctgccctggacgccgcctgggagtga

SEQ ID NO: 2036 - DNA, 1263 bp, Chlorella protothecoides
atgggtcggctcaagtggcaccagactgggcaatggaataccctccagggctcgaaaacaattcatccctgcagagatttcgatcgtgatgatgaactcctggaactggctgacgtaagaagttgtgagacactccgtgccccgacgcaaaaccctgatccggctgttcgcccgaaagccatttgtgttggtgtcctgtgcgggacacggctctctgcgtccatcatggatgtatcatgcctcgaagatggcgactgggacatactgggagcggctccgtccgggaaccaggcctggtggacttctgaactggagggggacagccgctttcccctcctcgacctgagtaccgatgctggaggaagtgcctccacatccctttgcacgcccaccctagaacttgacttttccgacggcgctcccgtcatagcaatgactgccggcctgggtcccgtggacaaggcccctccccctgtaccagccacgggcacctcaggggcctcctcaaactccgatcaccagacctcccgccccaagtacactgccgaggagaggctggagcgtcagcgtgcgcgcaaccgactggctcagatacgctaccgtgcccgcaagaaggcggccgccggcgcggtcgtgggccacgtcagcgctgtggcggcctccctgcaggccgcgcgcgccgaggctgccgtcctggcgtcccagcactccctcctgtctggcctgatgagcgtgagggacgagctcatcgacgcgctggagagggcttacatgagccagggtggcgggggtgcgccggcgcccggggcgcccagggcgcggcccccgcccggcgccggctgcccgcgaccagcggcgagtcacttcaccccggggcagctggcggggtggcacgggggctgcacgctcgccagcatggacagactcatggccctgccgcccgagcaggcacgcgccttctcgcaggtgcccaccgaggtggtggcccggcggtggggcgatgcactttcctccatgaagcagctcatcgtggacctggaggagcggggcgggaagtgcaagcccctggaggaccagctgcgcaggaaaatgctggagggggtgagcttgtctgtgggggtgggcctgcgggctggagggtgttgggtctgggagggagagattgttgggagggggttgccatggaggtctgcatgcctggctcaggtggcccagggtgcttgtttggtggagccctgcagggagactggaaacaggaaataa

SEQ ID NO: 2037 - DNA, 582 bp, Chlorella protothecoides
atggccccgcacggtcgacctgtgacagggccaccacgacatggcctccccacctcccagccgcgactgtcggcatggtcggtggatatagggaagaaagcacttcagggcttgcgtaggagcccggagcgaacatatgcagggcctgattcgccctctcaggatgctgggaggggtgtggccccttggtgggcaggcccacttcgaggtgttgcggccctcttcatcacctcgacgctgagcctggggggagtgcgcgtgtgccatgccgcgaactggagctcgctgctcgaggaccggctggtggaatctgctcagggcctggaggcggcggtggggggggtgacctcccgcttcagggcctccctggtcaccaagaatgcccgggaggctcaggcagcacagaccttcctggacgaggtctgggaggtggtggggaccaacttcgaggacgttcgcagccgcggtttccgcagggaggactggcaggcgcagagggcggcgcacgccggcatcgctgacctcgaggaggcacacaggttgactgggcagtgcctggtgcagtgcgctgcgtcgctgtga

SEQ ID NO: 2038 - DNA, 1539 bp, Chlorella protothecoides
atgacctcatacccaccgcgcccccaggtgttcgccgtggcctggcgggggggcgagacggcacgccctgcgctgcagaagctgctgggaacctggcggggggtgttcgccgaccacgtgctggcgatggcgcaggcagaaatgcagtaccaggaccatgtgcagtaccacagaccgcagggcgcgcagaccgcgccgcactacccggcctgggcggctccgcagcaaccacagggcgcgcagaccgcgccgcagtacccggcctgggcggctccgcagcactacgagggcgcacacggcgcggcccagtacgccgcgccgctgccggcggctgcggcaccgcagtacccccccgtcacccagccccggtacagccaccagcctgcgcctgcggcgcagcaccagcattatgccgcgcccgcccccctggtcccgaggtacaagacgccgccgccggggatgtgccacccgacgccgcggcccggcagcggtcccactgtccccatcccggacctcctctcctccctgctggcagcgggggtgctgggcggagcaaaggctgcaggcgtggccgaggcccgcgagccatccctggagtttagttcggagataatcaaggtagcgtgtgcttctagtggctgcctgacggagtggaggcggggggatctgtgtgctgcttgtgtgcgacccgtggaaccctgcagacgcgcagtgcccctggcacgggaagaattccaaggagatcaccaggagacggacagggcgtggctgccagggggcgcgcacttgggccgggagctggggggatgtgttgggtgggtgcagcagaaacaccagggcagggggtcggtccagagggtgggggcacagtggcaagggactggctggtcgaagtcttggcaggaggtttgtgaggtgccacacttcatcacacgccagccaacaggcagctcgagatccaccagccagcctgcttgcctctgcccggggccacatctgcttgcaaacaatcaaacctgtgacacaaccctcgccccgccgaacacgcgtctcccttcctcccacccccggcccacaccgcagggcgacgcttcgcacgccgtgcatcgcctgctcgcccgcacggccgagaccaagtctgccttcctggacgtgcagttcctgcgccgcgcgcggcgcggcggcggcgccctccgtgcctcccgcctctggtatgtggacctggacgtctggttggccagcgccgccggggcggggcagggggcggcggccggggagggccagccgccgcagcgaggcgaccggcagcccgacgccagggtggcgtcggccgcggcacagcagcggcacagcgtgcccgtggacgaggaccagccggcgtgtgcgctgtcgggcgaggccttcgagcaggtgtgggacgaggagcaccaggagtggcggtacgagggggcagtacggctcacgggcgaccaggcgctcaggtgcgtgatgtacgatgattctgggtcggtgggacaagcccagggggagccaggatga

SEQ ID NO: 2039 - DNA, 306 bp, Chlorella protothecoides
atgctcaagtacgatgtgagcggcgtggggctgaacctggtgaccggcgaggagtacctggagcggaccaacgctgccaggctggaggacggccggcggccgagcgcgggggtgtgggtgctgggcgtcatccagggctccctcgccgagcaggccggggtgcgcctggtgagcaaaggaggcgcctgcacagtgcatggccctactggatctgtttggaacgaaggaggcgcctgcacagtgcatggccctgctggatctgtttggcagtgggtttgcgggaggcggaccttgtgggggcggtga

SEQ ID NO: 2040 - DNA, 2781 bp, Chlorella protothecoides
  modified_base (1452)..(1461): a, c, t, g, unknown or other
  modified_base (2060)..(2069): a, c, t, g, unknown or other
atgcgaaacggtgcaatacagatactccggagtaggagacgcagctcgggacaagccacatcctgctggatgcttgccttgggagtcggtggagtgctcgccctcctggctgccctgtcctggcagcgctctcgggcagcagcagacgccgcagcttcggacaccgaggagtgtaaagtggatggaaggacctcacggattgcgtctgacaacacggtcgaccctggcgccctgacccctccccacgcccgcctggctcgcgcaatcagccagcacctgtcccctagcaagagccggcacaggcctctgctgggccaggaactctgggacgggggctcggagggcgccagcgaccccgacatgagcgcccacctcgactctgtcctcctggatgagtcggccagcgagttgcacctgacctccgtggaccccctccagcgcgtcggccgaggcgccagcgggccgggccgttgtcccaggtgccgagaccctgcccgtgcacgccgccacctcccagcacacacacgtactacgtgcagatctgtgtacaaggccagctggcacggggcccccgtcgcagtcaagtacatcccctgccgcgccgacgacgcccgaggcctgagggccgctgtgcgcgaggtggcggggacccagtccaggctccgtcccagagcagcgcatggtgcgagtgccgtgtgccacccgagtctcagccttccgatcaagcattccctcccctttgctccctcgcaggtgcagtgctacgattgggctgtcctccccgtccccacgccctcccggccgacgcctgacagatgcgaccccgcctcctcctcgccgccagacacccctccaggagactgccctgacccttcctgcaccccccgctccccaaaggtgagcccggccgaggccgacgccggtggccagccagcggcgctgacgctgcggagagggcctggcaggccgcgcccggccacgccctccagcccctcgccctgcctgcccgccacgcccgggccggacggtttgtccccgggcagcgcgccctccagccccgccatcccagccctgcacggcgccgcgctgcgggtggcgacgccgacgtggagggcgatgctgcagccgcacgaccgggggtcgcccctcgcgacccagccctcctgcagctccttctcgggtgtgcatgcgtgggcggggccggggggccttgcttcagcagaactgaggtgcccgtcggggcgggcgtgggcagggccgggggcccctgcttcagcaggactgaggtgcccgtcggggcgggtgcttcaccgtgagcagcgccacgatgccgcggagagcgcctgggggaggaccctccccagcatccccacactgcccctcccggcacgccctcacccaccctccccaaaccatcatggacccctcaccgcagatgccactggccccagnnnnnnnnnnccctcacccaccctccccaaaccatcatggtcccctcgccgcagacgccacgggccccaccggcctgctgctggaccgtctgcgctcggcctcgacggcgggggcgcggaagctgggcaccccgtcgcccctgcacctgggacgcaagggcgcggcccccaccgcccaggacgtgcggccgcggctggcctcccactcctcgggccgggagcaggcctgcggcgccctaggggaggaggcttggtggaggggcggggcggcgctagcagcggctgcagtggagggggtgtcgccgcggcgcgcggggtcccccactgccgagcaggcaggccccgcctccttgccattgggggagcaggcaggccccgccggctccgcctccttgccatcgggggagcaggtggacgccgccggtctgccgggccatggccccccgcgccagcctgtctccccggccgagtcattcaacagcgacgcggggtttggctcccccctgaaacacaaatcacccgctgctgctgctcgagggtattggcggcaggcacgctggcgcatgttggcacgatcgagccactgccctccccaggcgccccacctgnnnnnnnnnngctcgagggtattggcggcaggcacgctggtgcatgttggcatgatcgagccactgccctccccaggcaccccacctcaccccttcccctcccctcacccccccgccgcaccccggcagtggcggcgcggagtgtggcccagcacccccgccagcccatcttcgagctggagggctgggagctgggcccccacgacgccgtgctggcagtcgtgatggagttctgcgacgtgggcagcctgggccgggcgctgagcaagggcgcctacctgcccagtgccaagtggagcgccgacgtcacacacgtgagcggggcgcatagttgctgttttattcgagggcggggagatgggggaggagattttgcctcgagggcggggagatgggggaggagatttcgcctcgaggtgtgtggaccaggagggcagacgcgaccacgccaccgactggctgtctgtgcttcaccgcaaggccgccaggccgctgcgatgccagagcgatcccacccacacacacacacacacacacacacacacacacttgcagagagcactgctgcggacggcgcaggaggtcgccaagggcatggcctacattcacagccacgacatcgtccacgggtgcgggcctgggtagggaggggtgatgaagaggagggaggcaggggactgatcttccttgggcagtcccaggggttgcgagcttgggaatga

SEQ ID NO: 2041 - DNA, 1389 bp, Chlorella protothecoides
gtcgccggaccccggggcggcctccgaccccggccgcctggcgcgcgctgcggccgagttcgcggccacgtggatgcccctctcccccgcccagcaccgcggcaaggccgccggcgcggcgccggcctcccgccgcctcgagctggaccggctggcggtgccgggaaagggcggggttcatcaggggcgggggctgggtcctgtcacgccgcagcaggcgcagcgggaggtggcggcgcggcccgcctcgcccgggcccagcccagcatcgcccggcctccggatcgcggcgcacaggccgcaggggctgcgcctggcgcccaccatcgcctcgcccatcgcaaggcgggagccccggcccgcaggcgagtggtgtgtatgttcacagggagcggcgtcggggcggggaagcggtttgcatgtcgctgctgcgtgcagcagccatgctcacgcctgctctgccaggcccatggcatcatgtgcaggcagggctcatccaaactgggcccccaccaccacctcccaggcttggccccagcgagctcatcaggctcgaacccagtctccaccaagatccccagatcgttcccgcctgctggcaagaaggccggggacagtacatcgttccccgctgtggctccaaaaaccaggatcccacgccctgggagcactcagcagcttcctcagcagcccctgccacgggtccaatctgaagttttccccagcgatcgacgggcctcatgcgaggaagtagcgccttgcggtgattcgtggcccctcagccctttcagtttcagcttgtggggcgatctgtgtgccactccctttccctgcacaccgagtgcggtgtgcattgccatgccaggatggtcagtcccttgggatcaaaggcttcctgtcttgcatgcaggagcacctgcgaccatcctccaagagggtcaaggaagcacacctcgtctcaagaccgagacacgtgcatctgttccctcagtacagcttttgtccaataaagttattctgcgacaaggacaggagcttgttgccacgtccatggcactccccccactccctctagcactgctcactctggtcggagcgtgtctgtccctcgcgactaacgatgcagcgctggtgacctgcgggagcttgatcaagctgcaacacgtggccacgtcatgccgactgcactcccatgatataccctacggctacggaagagggtctgggcagcaatcagtgacatgctatcccgacagcgacagtggggagagctactggcgtgtggcgtgtgaggtgcgatgtttgatatggtctagggagctgacagagccggctgcttgggggcccccagtatgtccacagacaccagagctcccgacgtgcatttaa

SEQ ID NO: 2042 - DNA, 321 bp, Chlorella protothecoides
atggcgagcggcggccggcactcgggcctcgcgcggcaccgccacgtgtacatgcgctggaaggagcgcttcttcgtggagggctgcgagtgccggctcaccatcgccgggttctactacctgtgcctcgacaggtgcggccatgtctgggagggccagggagggtgtggtggtgctgtgatgagctacaacaggataacgggagccatagagggtctgtactttgacccgtccagcacccccgaccagcagctcacgctggagccccagcaagctgcgggggatgaggggctggcattcgggcatgtcgacatcgcgtga

SEQ ID NO: 2043 - DNA, 360 bp, Chlorella protothecoides
atgtgtcgacactcgaacgtacgcctcccggaaccaggggcccttggtctttgtgcatcctccccaaggcctggcccagcccacacccagctgttctccgtccccacccccagtgttaggctggtgtccctggcggcacagaggttcatcgcctccctcctggacgaggccatcaacgtgcacaagcgacggaagctggcgccggcctcgcagctgaaggcagatgggcacaacgtcagggacaagcgtgcggtgctgacaacggaggagctcgtggaggccctcaaggagtgcggcgtgaatgccaaggtggcgccctactacgcagaccagcccaagccggtgtctgggtccgcgtga

SEQ ID NO: 2044 - DNA, 300 bp, Chlorella protothecoides
atgcttgatgtgctgctgaccgtcgtggtggcatcagtggtcgggcacattctgacgatggtgttttggaaggcatcgtgtccggtcagggaccaacatgttttcatcaccggaggcagcaaggggataggattggcggttgccgaggaggtcctgcggcggggcgcgcgagttacgatcgcggcgcgtaacagagatgatctgagcaaggcaagggccagcctcgccgctgcatgcccagcctcacggggcaagatccacaccgtcgccgcagacaccacctcggttgaccaggtataa

SEQ ID NO: 2045 - DNA, 249 bp, Chlorella protothecoides
atgggccgcctgtgtgggacgctggaggcgtacaacatcccggactcggaacgccctgtcaccaccttcttcgagggtgagatcgtggacaacgtcaaccacaccttcttcacctcggagtacggagcgtgcatagagtcagacctgcggcactggtctcgcttcaagaccttccaggcgctaagacgagtgcggcgcagggccgggagggagcgcgagggggcaagtggatccatggactcaatctga

SEQ ID NO: 2046 - DNA, 1509 bp, Chlorella protothecoides
atgtctcctgggcgccatgtgggcttcccagggcgaggaccccacccgcatcctctaagaggcgatgcgcggcctctgggagtggagaccgcgcagcaccctcgaccgccgtcgcgcggtgatgcgacgggctcggagccggccccaggcgccgggcgcctggatggagagagcgcgccactcccccgccccctggcccccaggcgagggggccgaggggccgaaccccgcgcggccgccgccaggggccgctgccccggccgccggcacgcgcccgcaccaggccaggcagaggacgagcgcaacagcgccccctcccacgccccgccgccggcgtactcgcccgtcgtgccggccgacgcgccccctccccccgactgcatcgtgtgctacgaaccctgcgtggaggtggcggtgggtgcgtgcggccacgccacggtggcggtgggcgcgtgcggccacgccacggtctgcgcggactgcacgctgcgtgtgcgcctgtgcttccgccagctggcgtgcccgctgtgcaagacggagctggcgtctgtggcgctgacgcagtggcgcgccggtctggccggtctggccggcgacgccgcgcaggcctcgcgggggctggtgccgctcagccgccaggctccggacatcctcgtggacaggggggcaatggggaggaggagggaagggacaagggggggaggagggaggggacaagggggggaggagggagggaacaagggggggaggagggagggatcatgggatccaaaccccgccaccgtgcccccttgcccctccaagccatgtctgtctacactccacccccactcgccagccccgctgggcctcgacccacacccaccccacaccccaaaccacgcactcctcaggctggcctttggcggcgccgccgccccagcaccctcccccttccacctctccctcctgcaccgcacctccatcggttgcccggcctgcggcgcggcctgcccgacgcactcggccctgctccagcacgcccggcgcgtgcacgcccccgcccgcctctgcgccatgtgcctgcaaggcgggcgcgcctggccgcgccagctggcgctgcatggcgacgaggcggcgctggccgcccacatggcggcccaccatcccgcctgcgacttctgccgccgctcctacatcgacgacgacgcgctgtgggcccacatgcgcgacacccacgtcagctgccacgtgtgccccgcccccggcccgcggccggcctacttccgcaactttgccgcgctgagtcagcacgtgcacgcggcgcaccacgtctgccccgagcccgactgcgcgcgccagctcaccgccttcgccacgcccgccgagctggcgcggcacgcgcacgagcgccactccagtcacatgccgcgctgggacccggggcgcgcgcggccgctgaccctggacgtcgcggggatcgtggtgggcggcggccaggcgacgcgcccggcggcggcgacgcgctga

SEQ ID NO: 2047 - DNA, 342 bp, Chlorella protothecoides
atggtgcagctccacgccgcagcccagtctgcagaaggcgccctgggacccgtggacgtggtcatctgcaatgctgggctatccttgccaggtagcctcagcatccatggatggtctcggggtcaagcctacgcgtccctgtgtaccatacgagcccgggcgaccgcccaactcgctgcagggctctttcccgactccagtctggagaacttccagaggcaggtggatgtcaactacctgggcaccgtgaagacaataaaggcgttccttcctggcatgctggagcgaagacaaggccacatctgcatcatctcctctgccctggccatctgtggtgggtag

SEQ ID NO: 2048 - DNA, 195 bp, Chlorella protothecoides
atgccctaccgtctgagcgaggagacggggctcatcgactacgacgccctggagcgcacagccgagctgtacaggtgcggcgcaggttgtgggggctggtgtcgtcgcatggcagcccccgtgcctgacgcccatgcgcagtcgtgccaggcccctgggcgctgggcttgtgagcctggagtgtgtatggtgtga

SEQ ID NO: 2049 - DNA, 369 bp, Chlorella protothecoides
atggtgagtgccggcttctgccacctcctgggcgacgcgctggagcagatgccggccatggacttccccctggcccccttcctctgcggcgtaggcttccttctcaccctcctctgcgacgcggccgtggtgcacgcctcctccggcccggtccccggctgccatggcgccgggctggtcggcggggcggcggctcggagcgatggcgatctggggctggacccggaggcgcaggtggaccccgcgcggcggcgacggcagcagcggcaggggccggcgtcggagggcacggcggacggggtgcagccccccacaccgcgggcgcacccggccctctcgcagcgggggccccacgccaagccgggcggc

SEQ ID NO: 2050 - DNA, 411 bp, Chlorella protothecoides
atgaccaacaagtacagcgagggctaccccggcgcgcggtactacggcggcaacgagttcattgaccaggctgagtccctgtgccaggtgcgaggggatgataggaagcgtgccctggccgccttccgccttgaccccgcggagtggggcgtgaacgtgcagtccctgtcgggctcgccagccaatttccaggcaggttcctgttctgtggccgggagggcaggcactgtgctgggcctggcccggcaggcatgggtccagtgtgggccgagccgccgcatgcaccggcccttgcactcgccaagactcttcctctggctgacgccgtgcattctcaaccttcacgcaggtgtacacggcgctgctgaagccacacgaccgcatcctgtctctggacctcccccatggtga

SEQ ID NO: 2051 - DNA, 345 bp, Chlorella protothecoides
atgacaactgtcctggctccgctccagaacgggggtctggagcagccgggtctggatccccgtgtgctccagtgcggcttcgcccgcctcctgggcaaggacgtggactacattgtgcggaagtatgagatcgtgctgggcagacgcagcaaggcctccaccctggacgtgatcctgggtgacttcatgtccgtgtcccggcagcacgcccgcatcctgtacagcttcccttcaggtgtgccgcacatcgcacaatggcctggcgtgtatgttcagcgggcaggcgcctgtctgacaaagcagcgcctggagatggggcatggctggtgttgcaccttggtctga

SEQ ID NO: 2052 - DNA, 1866 bp, Chlorella protothecoides
  modified_base (793)..(802): a, c, t, g, unknown or other
atgcctgtgcctcacacgctggttccctccccttcgtccactgccttgcgtgcccccctcacagcccgttgggagctgcaggtcctgggcaagaacggggtggcagttgacggcgtcacctacctcccaggcggggacccggtgcccttggcctcccgggcgctgctccagatagggcaggatgtgtccttccacttcctgctccccagcagcactcgccgcaggcacgtctcagtgatcagggtgtccggtcctgatcccattgaggtctggtgccccctggcaaggggcagtgttgagtctcatgtgcccttggtggtcctgacgcccgacggcggtggtcatcaggggacccggcaccgtctggatgatcgtgggatcatgcgatgtcctgggtgccgattgctccgctcgaaatcacttaaacccgcgtgccccacgcctgaacgcaggtccctgacaccctccgccccgcacgccactgcgcccgctgccccggctgaggaggggcctggcagcgcaccggtgccgcccgctccggccgccgctgcggccgccgctcagccggcacccgcccccgaccagccgtcgacgcaggctcacacccaggaccttggtcctgctggcgcgccgccggccgcctcgccagcctcgactcccgtggaggaggagcggccgcacgtgccgtctgcctcgcctgccgcttggttttctggggagcaagggccggcgcagggcaccgcctcgccccgtgcgcaggccccccacccccagccgtcgcctgccgcccggnnnnnnnnnntgcctgccgcttggctttctggggagcaagggccggcgcaggccaccgcctcgccccatgcgcaggctccccacccccagccgtcgcctgccgcccgggaggccgcggagtggggccgtggcggcgtgcaggcgcagcaggcgcagcaggcggccccgcagcaaccggggccccaggcgctgctggccgcgctttccggccacccaggcgtccagcaggccctcgcctccaaccccggcattttgcaggccctgctgggaaacccggcgctcctgcaagccctgctgggcaacccaggcattttacaagctcttctcggcaacccggggctcctgcaagcacttctcggcaacccggggctcctgcaagctcttcttggcaacccggggctcctgcaagctcttctcggcaacccggggctcctgcaagctcttctcagcaacccagggctcctgcaagctcttctcagcaacccaggactgctgcagcagggaggtggcgcgacccctggcgtactgcagggcctgctggcaatggcagggcagcaggctcagcagctgagcgcgcagcaggcccagcagctgagtgcgcagcaggcccagcagcgggcgatgcagcaggctcagcagcgggcgatgcagcagagggccgccgtgcagtccctccaggggcaggcgctggagcaggaacaggcggagctgacaccggcgcagcaccagcagctgctgcaggcttggcaggcgcagcagtatgggaacccgcaccagtacgggcggccagggtcatgctgggtcaagggcgagggagtcatggcggggtctatagaggggggcgcgatttgggatgaaccggagtggggcgggatgtgcctggggcgctggacggcacggctcccctcactccatgggtgcatccatgtccatgtccatggccgccgtgctttccttgaccgcgtcccactcgatgggaaacttggtcacacggggcttgtcggcgaggatgctccgcatcagcctgggcagggtttgagggcggcctggagttttaagtattgcattgtgtga

SEQ ID NO: 2053 - DNA, 279 bp, Chlorella protothecoides
atggcatgcacacgcagccagtccacacaccctgcacatgtgcaggagtttattcgggtagggtactacgtgaacacagagtacgaggaggagacgctacgggaggagcctcccgagactccacagcttgacaggtgggaggctcttctgctgctgagttcctgctgggtggttgctgcagggagatgggactgtatgcatgccatgcaagttgcgactctcttcttgagcggcagcgtcacttgtccgccactagtagtcacaccatgcaatacttaa

SEQ ID NO: 2054 - DNA, 531 bp, Chlorella protothecoides
atgcaagcagctgtgggtgtggatacagacaccagattgccacacccggcacctcaccttgagcaggcgccggccgcgatggccgagaaacccgagaagcaaaaccttacatgggcgcagctcacaaagtccctatgtgctggaggaatcgctggggctgtgagccggacctcggtggcccctctagagcggctgaagattctcatgcaggtccaaggcactgagaaggtgtacaccggcatcttccaggtgggcagggactctgtgtgtgtatgcctgtggtgggatgtgggttatcgatgtcgtgtgctgtctgcgctcatatgccagaattgggctcttgttgcttcctgggccccacgaagaggctacaaaatcactgcttgtgcattgcagggcctgcatgcatgcgcggcttgtattgtaatgcctcgcactggggccctggcttggtttgggagtggggtttggatgctggacgcgccgcacgtctggcaacccccgccccctctcgcgtctcatctggggtga

SEQ ID NO: 2055 - DNA, 579 bp, Chlorella protothecoides
  modified_base (93)..(177): a, c, t, g, unknown or other
atgggaatcgcgagcctctggaagctgctcacggaggaaggtgttgtccgcaagctcagtggctccgacccgtcgcagcaccacaccttgctnnnnnnnnnnnnnnnnnnnnnnnnnnnnnnnnnnnnnnnnnnnnnnnnnnnnnnnnnnnnnnnnnnnnnnnnnnnnnnnnnnnnntggatcatgcaggccgatcagcagctggccctgctcccacactttggcaggacggagcgatgcatgaaggttgccctcgagaggaactgggtgaaggcgataaactctgtcttctggcatccttgcccatcgcagagcatccagtggctgcggcatggctgccttccggtgattgtggtggagggccgtgcgcctgcagagaaattggcggcggtgcaggcccggtacgccgcccgcaacggcgtcgacggcggcggccgcggctcttcctccttcatagcactgggcaagtcggtgggcgtcatgcttcagcagctggtgggtgctgaactggagcgtagtggagctgcatgccgtgagccgggtggtacggagtgcaagactcgaggccggagggggtga

SEQ ID NO: 2056 - DNA, 666 bp, Chlorella protothecoides
atgtgtcgccccggacgcctgccgctccccttctgccgagccccacccctccgtactgcatcccccctcgtgtacaggacgacgtgcttcctatcctacgcggcctggcagcaggaccggctcgcccggcgcgccgaggaaatcgctgagcagtggaaggctgcggccccggcccagctggccaaggagggcgtcgctgcggatgcagcgacgggcgcctacgccatgccctgcccctgctgccgcgccgtggtggccccggcgcagcttccccccggcttcgcggcgcgggcgcgcggcgcccctgcgccggccgcggcggcggccgagccgcccgcggcactggcgtccctcctggacggtccgacactgcaggccctgcgtcggctgcagcgcacgcagcgcgcgacgctggaggcccagcgccgggcggggggcctggtggggacgcgcgtggccgtgaccctggcggagctggaggcgtccaggcaggccgcgagggacaccgcctcggctgcagtagcagagccccgagaggggtcggggcctccggcacggctgcagggagcgacagaccgagacgtgcgcccagccgcctgccggcgggcgcggcggccatgcgcggagggcggccccctcgccggcaagccaaggacgagcagctag

SEQ ID NO: 2057 - DNA, 765 bp, Chlorella protothecoides
atgtgggtcagcgacggcatccgcggcctgtttaagggcaacgggctgaactgcattcgcatcatccccaaccaggccatcaagttcatgacctacgagcagctgtcgcgcaagatcagccacgccctgatcgaccgcggcggcgacgggcagctgacgccgggcctgcgcctcgcggcgggcgccggcgcgggcattgtgggcatgtcggccacctacccgctggacatgatccgggggcgcatcacggtgcagcactcctcccacgcgcagtaccgtggcatgtggcacgccgccagcagcatcgtggcgcaggaggggctggtggcactgtggcgcggttggctgccctccgtcatcggcgtcgtgccctacgtcggcctcaactttgcggtgtacgagacgctgaaggacctgatcgtgaaggcctacggctgccgcgatgagcgggacctggccatcgccacgcgcctcgcctgcggcgccacggcgggcacgctgggccagactgtggcctacccctttgacgtcgtgcgccggcggctgcagatgtcgggctgggcgggggcgcagagcctgcacgccgccgagggcgcggcggtgcgctacagtggcatgaccgactgcttcgtgcgcaccatccgtgaggagggcgtcacggtgaggcctgggatcgtgcgtgaggggtgggggggaggaggggagggtggttgtgggaggggcgagagccatagccgtgctgtgggactgccatgtgtgggatga

SEQ ID NO: 2058 - DNA, 414 bp, Chlorella protothecoides
atgcgccgcccttcactccacccctcccactgctccgctccccctccccctcccctgccccaaacattcctgcttgccagcaagtggtggccccagctggcataccatggccgcggactgggccaggcctggtggatgctgcacgtccgccccaacaaggtgaagcagctgtgcgactacctgggcatgcgactgcgggcgctgccgcccacccccggcatggccgtagacgaggatggcctgcgcctggtggagttctgggtgccgcgtaagacggtgcgcgcctggaacccgcgcacgggaaagcgcggcacgcgcacgctggcctgggcggagggcctgcaaatcctggtgcgcctggacctggacgaggaggcggtgacggccatcacacgcaccaccaagattacgtaa

SEQ ID NO: 2059 - DNA, 1338 bp, Chlorella protothecoides
  modified_base (1049)..(1058): a, c, t, g, unknown or other
atggtttttttttgggggggggtgtggggggcagacaaccttgccagggagtatccagatgaaggcatgcctgcctgtggcccacctcccgttcgatgtggatcctcctgcgcatgcctgagcagggatggatgcggtggtgaactgcaacgtgcacagcgagggccggtatgcctttgtggagctgcggaccaccgagatggccaccgccgcgctgcagctcaacggcgtggtcagcttgatgggcgccacgctgagcatcgggcggcccagcggctacgtcgacccgacccacgccgccgccgcggcgcgctcggccgcgcaggcgctggcgcgcttccacgccgagacggagggcgcggcgcgggagggcgaggcgccgctgccctccgcctttgtggccgtgtggggcgccatcgcgccgggcgcggacgaggcagcgcgcgccaaggtgcgctgggtcgagtccagggagtggggtgggtggggccttgcttgggcgggaggtgtgggtttggcgtcgggtggatgggacgtgaaggagtgcgaggggacgtatgggagcagtggcatgggaggaagcttgatggggagcttgcccgtccggcggcgcgatggtgcggcatcgtttcaatctctccatgcccacgcaaccacatctctcccccccaacacacacaaaaaaaggcgctcgggttggtgcgtggagtgtgcgagggtgccggcacggtgctgcaggtcgtccctgggcccactgcgcagaccgccacggccggagaggagtgtgcggagggtggcgtgtcggagcaggggctggaggccagcatgccaccggcaggcggggccgtcgccgccgaggattctgctggcggagatgcacccaccgagcagcccaccggtggcgagtcggcaccccaggagcctctcagtgagacacgaaatgcggcggaacccgctgacggctcatccgcgccggcggagggcccggagggagcagggggagagcctgccgggtttgtggcgcgggagcaacggagatcagtggcccnnnnnnnnnnacccgctgacggctcatccgcgccggcggacggcccggaggaagagtctgccagggtggccggttctccgagtgacgagggcgatccccccgccgccgagccagaggcggccgtgccggcggggccagacctgacggacgccgtgctggtgcagttcctggagcacctggcggccgagaggggcatgcaggccctggaggcggctggcggcggcgggctgcgcgtcgctcgcatcaccgcccgggactgggtggcggcggcggtggatgcgtcgacctga

SEQ ID NO: 2060 - DNA, 441 bp, Chlorella protothecoides
  modified_base (288)..(297): a, c, t, g, unknown or other
  modified_base (377)..(386): a, c, t, g, unknown or other
atgatcgcggtgaagagggagagcccccctactccaactgcctctggctgtgtggatgtgccccaggatgggttccccccgggcctgcggggcttgcagaaccttgggaacacatgtttcatgaatagtgtgcttcaggcactgctacactcgcccttcctggtgccgttccatctcatgggccgacacaatggggacacctgcttcatctcagatgacgactctccctgcctcgtttgtgccttggtgagtcaggggtgttggctcaagacggcccatacagtgacnnnnnnnnnntgcatatatggagactgccagacggggaccttcactgctggccatttcactgtgagtttcacgcctgctcgccatcctgnnnnnnnnnntgcatatatggagactgccagacggggaccgtcactgctggccattccactgtga

SEQ ID NO: 2061 - DNA, 393 bp, Chlorella protothecoides
atgattgtgacgaccccggatgagtgggttgccctatacaacgccatcaaggaggagagctcctgcagcgaggagaaacatgtcttcatctacgcctcggccgcagatgccgactccgttgccgccctacgcatcctggaggtgtcaaggggggagatgggcatggtgttctgtgtgcagggttgggaagttatgtgctgcatgatacacacaccaggccccccctttgaccctgccactccaccacagaggctattcaagaatgacatgataccgcatgggtggttgcccgtcagtcgttacaaggagattgaggaggactttgatgcctgctaccaacctgatgaggaggtaggggacctgagctatggatgtgatggggatgcatggtaa

SEQ ID NO: 2062 - DNA, 621 bp, Chlorella protothecoides
atggccgagctgaagctgagcggcaaccacctgaaagggagccgccccgtgctttctttcgacgccacgtttgaccaagagccgcacctccaggtgctcaaggagatgctgacgcagacctttgccgtgccgcgtcggcaccacaaggtgaagcccttcttcgaccatgtgatgagttttacggtggcagatggccgcatctggatcaggaactaccaggtgcttcccaaccccgagaagaagaaggcggcgcccggagatgtcacgttggtggaggtgggacccagggcctgccttaaccccatcaagatgtttgcggggagttttggtggacctgtgatttatgagaacccttcctttgtatctcccaatgcggtgagtcaggctgtggggccatatttggcccatcacccgcccctggggctgctgttggcattccttgctcatccccagcagcacctcttgcactcccacccactgcccctcctgccgctttaccaaacagatccgagcggcactaaagaagcagcagtctgggaagtatggtgccaaggtggatgcaagggagcaccgcaagcagcacgtcgctgccaacccacttccgcggagcgagctggctga

SEQ ID NO: 2063 - DNA, 741 bp, Chlorella protothecoides
  modified_base (247)..(256): a, c, t, g, unknown or other
  modified_base (717)..(726): a, c, t, g, unknown or other
atggggcggaagaagaagagggacgacatctttggaggcatcaagatgcaaagcatccagcctggcaaggcgcagtacgactttaccgatatcgctggaattgactcgggagttgaccccagtgattggggtgcggaaggggatctgtgcatgcatcgtcaaacatcctccaaagaagggaagatagtgcagcgtgagctccttgatttcaacctgatcactccactccccccgtcctacagcctgnnnnnnnnnnggtgcattcaggaggcagtgctcgcattccatgacacggagtgtcagccatcgattgcaagcccactgggcactcggatcaaggaggaaatccgggaggtggtagagttccttaagaaccctgcccgctttctcaaaatgggagcgcgttctcctgctggtgttctgctcgttggacccccaggcacgggaaagacgttgctggcaaagtcagttgccggtgaggcgcaggtcccattcttctccgtgtcaggaacaggtgagaaaggtgaaatgagaccatggagggccgatgtgtctcctgcagcctgcacgagcttccttattcccattcacaatgatagagttcatggagatgtatgctggaatcggtgcgtcgagggtgagggacatgttccaacaggctcgagcagcggtgagatggtggtcattgagatggtgaaagagggagggggaggggannnnnnnnnnacccattcccaataa

SEQ ID NO: 2064 - DNA, 1584 bp, Chlorella protothecoides
  modified_base (298)..(336): a, c, t, g, unknown or other
atgcgaatcctttctcgccctgcacaggtatcggtgtgccccaatggcacagcgacgggctccacctacttccttcccctggaggagcaactggagacgaggatcatcgagaggggatatctggaatctaaaatggtagggtcttgggtgcgtgtgcgctgggttgtccctgacggtgttgggtgtgtgtgcgctgggttgtccctgacgtgcttgagggctgttagccaccctgaagtgaacgcctgcatctcgtggactccaagtccgcggcattctctcggccaggctggggggnnnnnnnnnnnnnnnnnnnnnnnnnnnnnnnnnnnnnnnctgctcggcatcgaatcagcaccggctcgcaccccgtcatccagaaggcccccccccatccacctcaggtggtggcactggcgggtgcggtgtgcggagatgctggtcctgggggaggccaactacacctcgtctgctggcgaagacctgaccctggtatgcgacttgcgtgtgtcgcggattcgtgggctttaccagtttttatcagtgcttttgtggaccctgcctttttggctggctgacggcgtcatcatggccaactacatcgcgcgtgagatggtctaccactccggctttggcgcccgcatgggcccagtggctctgcaggacgacgatgagaacttcctgatgcgcgagaagggtcgccatgctgggtccagacgacgtgccgctgagggaaggggctctgagtcatcaaagctcatcccatgcccccctttccaccctgtccaggtcggagccggtgtccaacatctccacggagctgtccctggtggcctaccaggacgtgaaggacatcctggccgcagccgaggccaaggcctactacggcatcgtcaagaactacgcggccttcgaggccctggtccagaatctgaccgtgcgcgagacgctgaccgggacggagatcagcgacatcctggacaaattcctgcgggtgtgtaccgcgtgcagaggctgggccgccgttggatgcgaacccgctccctcagcgacccttgctcaagtccttcatcgtgtcggcatgctcggacaccggtgtctgcccccgctcagccagaaactccatgtccctggacacccgcagcgctggagcggtaccctcggtccaccctgtcgggcttctactgggaggaggatgggagcgtgggctacccgggcaagccaaaggttggtttgagttggtgctggctggggccgggtctcaggctggtcaaagtgtcttgcaaggggcgcgtgtacctcccccccgacccaacatacaccctcccttacctcctcatcctcgccctcccaacccccaagacgcacgaggggcggctggtgaaggtgggcgtcacccgcaacggcgtggagatcggcgcagacacgggcaacggcgccgcgcccgccaacggcgcggagggcaccaacggcagcggcaagggcaagggcaaggagcggtacgtgcccgagtggtgggcgcccggcaacccgtacgccgtgcgcagcaacatgggccggctgctcctccgcgaagggatgtag

SEQ ID NO: 2065 - DNA, 1326 bp, Chlorella protothecoides
atgcggccctgtgctcaagtctttgagcatctgccaggccctgaggcggcatctggtgagcaggcgtgtgcgcatcttgcccctttccatgcacgtgcctgggggcatgctcctgcacaagcgatcgctgcacacttggctcggcacagttcgccggccgatggaatatcatctgggggccggcccaagagcgccccccctccaggcccaggcccccccacttcctccacaccacaccgctggtggcgccacgcacgccacgccgagcgctcagtcctcctgcttgggcgcggtgagccaggacatgcggtccacgcctcgcagctgcatgcccagtccctccttgtagatgtgggccgccagcacgtcctggcccgggaaatcggcggccttggccgcctcgatggccgcgtccacctccttctttgcctccttctccagcgccttcagctcggccacctccgccagcccggcgtccagcagcagcttgcgcacgtgctcgatggggtcgcggtgctggcggatgttgctcacctcgtcgcgcgtgcggtaggtgctgccggggtccgacatggagtgcccgtggtagcggtacgtgtccatctccagcacgatgggcccctctgccagcgcgtgctgcttggcaaaggccacggcggcgcgcaccgccagcacgtccatgccgtccaccttcaggcccggcatgtagtcgccgcgggagaagtaggcgggggacttggcgctgcgccactccgccgtgcccatgccgtagtggttgttctcgcagatgaagatcgcgggcaggttccacaggctggccatgttgaaggcctcaaagatctggccctggttggctgcgccgtcgccgtagatggccacgcccaccgacccgtcgtccaggtactggtggcccagcgccaggcccgcgcccagggggacctgcgcgcccacgatcccctgcccgccgtagaagttgtgctcgcgcttgtacatgtgcatggacccgcccttgccctggttgggtggagggggatggacaggggctgggtgcggttggggtctgaaagggcgacagcaatgtgcatcgagaggtgtagggcccggagccatgtgcacgaggccgtcacagagccgccgcaccctcctgcaacccctgcagcccaacctccccgccagccctgcacccagccgcccacggatctcccctccaccctcctccgcctctcaccatggaggcgccggtgcgccggcccatcagctcggcaatcacctcggcaaccgtgcccccgcggccgacgtgggtggcgtggtcgcggtagctggtga

SEQ ID NO: 2066 - DNA, 1332 bp, Chlorella protothecoides
  modified_base (1119)..(1128): a, c, t, g, unknown or other
atgtatggcacagatgtgtacaagtactccaagacctccgagtgtggctctgggtttgggcttgcatgcagtggggtttgcgcctgcatcacacgggatggctcccgccaaaagctgcacatgatctgccccgcacgtcccctccatgatatcggggttcgggttccctgccttgactccactccccagccagaaactggagcaccgccctctaaaccgacatctgcgacgcgatgtccctggccactgcaaccatgtcgaccaccgggtccttgcaggcaccccacgccaggtcctgctcctggctcaagacctccgcccggatccaccactccgccgctttccgtcaagccgtgcatgcctctcgccccaggcccagccttcgcgtgttcgccagcgaggccgtggctgcgcaaggtgggcgcatcctcaaggattccgtgtccttttcccactccccgatgcgcatggccatgccctgtgctagggggcccgggtgggcccgggccacccacgacgtatgcacacaccgttttgccccttcgaccaggtgcaggggtggtaaatgacgagacgtgggaggagctggtgctgaagtcgcccgttcccgtgctggtagacttctgggccccatggtgcggaccctgccgcatgatcgcccccctggtggacgagctggcggaggagtacggggacaggttaaggacacttaagctgaacacggatgagagccccaccgtggccaccgactatggcatccgcagcatccccaccgtcatgatcttcaaggatggtgaggaccctgggtgggggtgcggcagcttgggcatcggctccggtcgggttggtctttggggctcagagctgactcttctccaccctcttccatcccgccacaggcaccaagctggatgccgtgattggagccgtgcccaaggcgacgctcaagcaagccatcgacaagtacctcgaataagcttgaggggactttcatgtacacgttgtaaggcgtactctaaggacaaggggggagtgctggggaatgatgacagtgcagatggcaagggttggggccatctatgtctatcttggcaggggccactcatcttctggccatcnnnnnnnnnnaggtactggggaacgatgacagtgcagatggcaagggttgggaccagcaatgtctattttggcaggggccactcatcttctggccatcgattgattgcatcccccaagatcattccgcctggtcggtgctgcgccctcggggacgatgggccttggcgctgggcccctcctcgcgcgcctgggagacaaacacgcccaccatga

SEQ ID NO: 2067 - DNA, 1680 bp, Chlorella protothecoides
  modified_base (580)..(589): a, c, t, g, unknown or other
  modified_base (683)..(692): a, c, t, g, unknown or other
  modified_base (786)..(795): a, c, t, g, unknown or other
  modified_base (914)..(943): a, c, t, g, unknown or other
  modified_base (1597)..(1606): a, c, t, g, unknown or other
atgagagtggccattgacaaggtgcgacacagggtgctgcctgcctcgtgcccaaaaagcattgcagggtccatgttggtatggaccttcaccctggccactgggccgcttgcgatctcggttctggggctgcgtgacatcgtccgtcttgtcgcgccctctcactcacagtgccaccagggcaatacctcccaggatccagcgggtgctccaggggggcgagaaggggctctgcccttgcttgcgggcttggaaggtccagacacatacgagcaggcgggaagccggacacggacgagtacagatcacttgtttgacagacccgccggggcccaatcacgctcaagactgacgagggcacgatacagtactcttactaagccatcttcgacgctcaccacccagctgtgccttagattccagcaagggggtgcaagatacacagtgccctgtacttctccctccagcgcgaggggtccttccacttccaaaaagcatggtgcgcgatgggtcctcgggagggacctggttccctctttaatactgatctgcatatcaggtagccaacctcagccccctnnnnnnnnnngcccaagcaatcgcttcgtagagcaactcgcagcttggatgctcagcatcttgatgctgccctctcaatcgctccatgccgggttttcgttccnnnnnnnnnngcccaagcaatcgcttcgtagagcaactcgtagcttggatgctcagcatcttgatgctcccctctcaatcgctccataccgggtttttgttcannnnnnnnnnagcatggtaccacaccttcgaggacgcatcagacctgtttgctgctgctccctacccctcccccaagcctctcgcggtgaggactcgcaaaggtgtctgccttctgttgctgatgtccnnnnnnnnnnnnnnnnnnnnnnnnnnnnnnaggtggacctcaatggcgatggcaagcctgaagtgctcgtggctgctcccaatggccaggtccagctgctcgccccagcacggcccggggatgggtttgcacgcgttcggcatggcactccgagggtacgctcttccgctgctcctcccaaccatgtgtcacctgcacccctcccaggtcctctccgcggcggaggtcgagcccgacaacaacatgccgctgctggcgcttgcgacggggtacctgacccccgagcccaaggagttggtgagggccccacgcaagcaggtggtggtcctgctgaccagcagcctcacgctgcactgcctggaccacaacctgcgcccgctgtggagccagcggctggcgcccagcttcccggcgcgcgccacgcacggcgaggtggccctgcacgtctcccaccactccgtgtccaagggggaccggggcctggtcgtgctgggggcgggcgtcacccatgccgctgctgcggggcgcaagctccgagcggtggtatttgggtgcagggcgggttgcaactgacagggagcgaggtgataccgcccactcggttctttgacgactgttgccccttacaaacaatccatctagatggcgcactggaggaggtattgctcggggaggggctggaannnnnnnnnntgacagggagcgaggtgataccgcccactcagttctttgacgactgttgcccctcacggacacgatccatctag

SEQ ID NO: 2068 - DNA, 762 bp, Chlorella protothecoides
atgtattcggacttttgtgttgcgactcaaccagtgattggcagctttcggggagggtgtccccacccctgccggatctcggcgccccccacgtcagcgccatgccgaggcacctttcgaatccaaaaagctgggtctgtgccgtacccttctaggaatccagctgacatctggagacggacattcgaacctcaattaccattgcctttattgctgtgtcctctacagacgagcagaggggttggctcccgcgcaacccggagggatgtccctcccacaagggcgtcaacgagccacgaatcatcctctgcagagttaccccctaagtgggtcggcgctgccgcggcccaagccattagcaaatcgcaggttgcagctgtagtggccgctggtctaatctgtggaaatttcgcggtaagaggtcgtgagttagctggtagacccctgctcagccagtattgcatgcgccacactcccctgccacacacaatgttgcaggtcaaggggtatgcactcttcttgcggggagagcttgggcccatagttcgaccctggctccctcaagaatgccacaccccatggctggcggcttttgcagcagttctagtgttgggaggcctcctcctgctcgcactgcggcctcggagcatctacctgctggattttgtgtgctaccgtccccccgacgagctcaaggtcacttatgaccgcttcatgcagggctctgtcgactcaggggtgagtcgttgtgaggcgcggtga

SEQ ID NO: 2069 - DNA, 1452 bp, Chlorella protothecoides
  modified_base (401)..(410): a, c, t, g, unknown or other
  modified_base (738)..(747): a, c, t, g, unknown or other
atgctggcgacccctcgcccggactcccagccccgtcagaaacagggaggagataagaagaagggtcggccgcacaagggccccagtcagaagccggtggacgatgcagaggacgcagctgcagggcctgggtacagggatagggccctggagcgtaggcaggggctcggacctgagctgacgggggtgccgcaggacctcgtcagcctcatcaacaacgacggggtgggatgcgtctgttttgagggcctggtctgtagcagaggagtgcccttgcaggtcgccccagtgtctgggggattcacgcccggccttgtcagcgcagttgcagccctggggtgccatcacccgtcagtcccagcctccagaccctcctctctgaccccttctccctcccctgnnnnnnnnnngtcgcctgtcattcccagcctccagagcctcctctctgaccccttctccctcccctgggccaggagaccgccctgcacgaaggtgcgggccgaggagcagcgcgaggccgaggaggaggaggacagcgaccgggaggacagcggcgacgaggcccccggaccccaacaggctgctgcagggcggcgggcggcgccctttgtgccgcgccacatcgccccgccggcctcggccccaaaggccaggaccgcgatggcggctgccctgcatgagtacctcttcgcccccaagcccaaagcgctgggaatcactgcccgcaaagcacatcannnnnnnnnnctgaggactgttcgcacaccagaccacttcatgtcattctgtgatgcccttcccggccagctgcccgcaaagcacatcaccatgaggtgtcccgccttctgctcctctgcagccgcggccgagatgttccagccccgccgcacctccttcctgtacgaggcggaggggggcgggctggagaacctgcccaccactctgcatcgcgccaaggaagactgccccaaagtgagacgtggggtgaggatggggacgatgcctgcctgggatgccggagtgaaggacagacagcgactggacgctgctggtcttggtggagcagagggagcgctggaggcaggtgcaccccttcacaggagcacgcctgggcccatgaaaaccctgcccactcatgcatcagcagccgtgaagaagaaagtcaagaagaagcagcacctacagggcaccgttttgccaggcggcgtggctctggccgggtcccttcgtcccgacagggatgctgcggcgctcaaagacggtgccggccctgacgcggagggcgctgggcagccaggtgtgtctgctcttcggaaagcgcacagcctctttgcaacgaggaatggggatgtgcctggtggcatgcgggccagagtgatcttgttgaagctctcagcactgcctctgcacggatctcagcattggccggtcggctcgctgatcaccgcatga

SEQ ID NO: 2070 - DNA, 1458 bp, Chlorella protothecoides
  modified_base (273)..(282): a, c, t, g, unknown or other
  modified_base (385)..(394): a, c, t, g, unknown or other
  modified_base (1205)..(1214): a, c, t, g, unknown or other
atgcccctgcccgcttgcactgcaggatcaccaagccatcgcccagcccccgtggatgatgacgagaacatctttgacgacgatggcgaggagtacaagccggagaggagggcgcctggcgcagcaccagtacccccgttgccaggaccggcgggcaggggagcctactttggcggcgcagaggagggccaattggtcagtcctacacaaggcggattcttgccggaatctagcttgattgcgcttggacgtggcagaggaaatagccccctnnnnnnnnnnatcagtcccacacaaggcggactcttgccggaatctagcctagttgtgcttggacgtggcagaggaaatagcccccttaactcgtttggggtggtccttctgnnnnnnnnnnggatcacggactgcgtgaactattgcccccacattgtcaatcctgatgcaggtgtgggtctggcaggtccttctggagcaacagagtgtgccccaccacccccgcctctacagcctctcgggcacgaggaggaggaggaggaaggcgcctacccggacacatctgctcagtacccggacacatctgctcagtacccggacacgtctgcgcagtacccagatacgtctgcgcaatatccagacacatctgcgcagtatccagacacgtccgcgcaatatcctgtggcacagacgagtgcaccggcagagactggcgttgctttctatctagaggacgataaagcttctgatcagatggctgcagaggacaagcctccagctaagaagccccagaagttggtcctgcaggacgcagatgatgggtacgcagagtgctaccccaactactttgatgctgctgggactgtggtggacagcgagggagaggacgagaaggccggggtgcgtccccgcgcagagccttctcctcctgtttaccccagcatcacgatcccatctgtgcaggaggtcatcctcagccggctagactttgactcacaggccgagtgggaggcttacagcgcaagtctcaagccccaggtagccggcaaaggcgccaacccccgcaaggcacaggtgagatgggagtccctgcatgcccgggcatggacacgagcgcatggggagctcgccagggtgcgctggttgcgctgtagggaccacccaccccttggacgagggaccttgccgacgggcagtgctgaccttccctnnnnnnnnnntgtgcctgtgtttgaaattaggaagcgcagagccttcgcctcctgttcaccccagcatcacgaccccatctgtgcaggagggtgtgctggttgcgctgtagggacccacccaccccttggacgaggggccttgccgacgggcagtgctgaccttccctctcgatcgcacagcgggagcgcaacaaggaggccatcaaaaacaagaacaagatggaagcccagctgggtcagattcgcgatctga

SEQ ID NO: 2071 - DNA, 1443 bp, Chlorella protothecoides
  modified_base (346)..(355): a, c, t, g, unknown or other
atgttagcccgatcaggagcgccttctcaagcaggcacagaatccactggtgtgcaggctgagtcttgtaggctgagtcctgtaggtgggaacagtcttccacagtctcctgctctcgacacaaaccatgagagatatcgacatgcatgcgatcttgcaggctgcaaatttccatccatcctcgagatcgtgttggaaacgggctctagcctgcgcgccgcgctagggacgggcaagggaggcttaggggttgactcctacttcattcagccagggaattctgtggagaacatagtgatttgggtgcaccgagccagtgacagtcatcgtgcagctccttcccttnnnnnnnnnnatactggccttcctgaacctgctttctgccctggatggtcaggctgcggtgtcggtccgctccgtgagcgaccatggcaggtggactgtcacgacacttgctgcttgcatatcccccctcaccaatccctcccctccgccaccccgccccagcacgctgctgtacgagtcctggaaagcgggcacggcgcagggcgccgccgcggcggttcacgccgcgctcctggccctggccgagcgggaggagggcgcggatgcagccaggcccacgcggcgtgtgctgcagctgtcggccgccctctcccacgtcctgtgccacgtcaaccgcttgcggcgcggcggcgacacgcccgcccgcgtgctctgcgtcctggcctcctccgagccatccacgcagtacattcccctgatgaacgccgtctttgcggcccaggtgaggcggggatggcggggctgcctgtggagaggacccctggcgcggcagccgggaggggcagggcacgggaaccgcgtgcttcttctctgctcaggcgtacgagtggcgtcgccgagagctgcaccgattccccaatccttcccttatccccacccttccctccctctgaccagcgggacggcgtcgtcatggactgctgcaagctggggagcggggaggccaggtttgcgcagcacgcctcccagctgacggggggcgtgtacctgaagcccagcgagcctcaggcactcctgcagaacctcctggtgcgcgtcgtggaggaggggtaccaggcaaggccccatgcctctgcagatggtctttgcggcggggccgggcgcccgagcccagctcattctgcccaccagcgctggcgtggacgggggcgccacctgcatgtgccaccgcaggcccctgacgatgggacacgtgtgcagcgtctgcctgagcgtcttctgcgagcccctgcccgtctgtctgacctgcggctccgagtttgtgacaggctgatggagggtagagaacatcaggcaatggggggtgtcaagagcaagcgcagacaacctgtcagggcagaagaaagcccgggtgacaggaacaccagtcttggatag

SEQ ID NO: 2072 - DNA, 1896 bp, Chlorella protothecoides
atgccattccttcgggcccccccaccgacagttgtgtacctggatgctgacaccattgccctgcgtaacctggatgccctcttcctctgcgacggtctctgtggtgtcatgcggcactcggagcggctgaactccggggtcatggtcctgcagccccaggcccagctattcagcgacatgatgtcgcgcatcgagcagacccccagctacaccggcggcgaccagggcttcctgaacgcctacttctctggatttgcagcctcccccctgtttgaccctggcaggggccggctgctgagcgagagctgggcccggccgcctcccggcaatgccaccggaggcgcggcggcccgtgtgaggatgggcaggcttcccacagagtacaatgcagacctgggcctgtatgtgctcaacagcaaccgatggatggtgcccgaggtggactcgcagggcatcgtgggggctgggtgggtatctcctcagcaacaccgagccagggacctgaatggaggatgtgtttccaagcgcagatgggtcagcgagtcactgcccccgtgtgcgagactgcgcctgagactgccttacatacctggggctgtagatgtgcaacatccacatcccaagccacctcgaacactcagggcacccctcacacccctcctttcattcctcccaacaccacatcaggatgagctgtttgtccttcacttcacgctctccagcttcaagccctggaattggtggtccagctggatcatatcagggaacatggagcggtggcaggcgctgcggcggcgcctgcccggcccagacacagggcccagccgcctgctggtcagcacactggccgccggcccttggttgctgttcgccctcttcatgcgccggacccccagcctgagtccctgcctccggaacctctcttttagacgtggcgcgcccggcatgtctggagccctggcactggaaagggtggcgtgcatgccttgggtcatcctgctggccgcactgacttctctgtgcctggccgtcggctttgccgtctgcttggtcccaacccaggtgggcggagggttgtgggcttgggagtggtgctgtggccgttcgcttcctgatgtgtgtagaggaggagtctttagatatgcccccccccgccgccccctcctcggagcggtagaggaggttgtcattcattggctccaccagagcaaaggaggtttccatgatcccacttcgtctccaaggtcctgcatccccctgctgccccgtacgcacagtctaccagtggggcttcgggctgcgccaggcgggcaacaacatttcggacgggcggctcttcctggccgccagcgcagggaacctgtggcagcagacggcgctggcatttggcgtcacgctgggcctgctgggcatcctgccctggtggagcgacgtgctggggtgggtgattggcccgggcatcggtgtgggtcttgcatgatcgctccctgctggggtcctagctcccatggtaactcacaatgcccgagggccgcggcatgcccttcccaaagcctctcccctcctgctcctgagcctgcctgtgccatcgccctcccgccgcagcctcaagtccttcacgggccgcttgttctccatgggcgctgccatcgcgcccacgacgctcgtggtgggccacctgctgagctcgctggccttgtcgtggttccacgccgggctcagcatggcctcgcccgcctcgcccaagctgaagcaccccgtgtgaggggagccccaaatggggcgacggatggatgcggcaggggacgcgaggcgtccactctagcccacgcaggccgtctctttgcaatactagccggcacaatgtttctgcagaatgtttccttacctccttaa

SEQ ID NO: 2073 - DNA, 1104 bp, Chlorella protothecoides
  modified_base (116)..(125): a, c, t, g, unknown or other
atgatcgacgatgcaagagggaaagcatgggtccgaccatcgaggttccccggtacgagacggccccgctgccctgagatttccacccgagtgatggctgtgtacggatgtgcctnnnnnnnnnnaagcatgggtccgaccatcgaggttccccgatacgagacggccccgctgccctggaatttccacccaagtggtggctgtgtacggatgtgccatcatcctgacacaggctcagcaccgattccagtttcttcgagatgtgcagtattaccatctccttgtaattcgcccatcacggaagctcaacttggctttagttcagcgcgcatatcgcgccatgatcaaaattacgtgatcggggtggcgcgaggtcttcatgcgcacggcaacgtaatttttgcgcaaacaggttctcaagcccccacgatgctcaaagacccactccaaactagatctaacttcgacttcctggtgaagactcccgctctggacgtcgcgtgggggattacaggctcccgctcaggacgtcgcgtgggggattattggtgtcccgaggtcacccacccgaccgtgacaatctgcagtcttccgggaggtcatcctctgcgccctgtccatgcagttcaagtccttggtgatgggaagccggaggccgggacgaaacataagcaggcttacgtctccctcatgtatggggatgacttcctactgggaatgcgtgtgctcggccagtcactgcgggagtctcaaaccaccagggatttggtggccgtcgtggttggatctcacgtctcagacctctcgaagaacgtgttgaggaaggatggctggatcgtacacgaggtgcgcggcgtcggagagcgaatcaatatctgtcggggactggttgcgtgtcgcgtccatgcgagggtcgatgcagttcagaatcctggactgtggacaggaacggcctctgggtcgtttccaccccgtttctgggcagtttacaccaagctgctggtattcaatctcactcagtatgaacgaggtaccggcctgagggatgagcatgcgttgtcatgggccatggaaggcttgcacgccttcaaggagcacggctga

SEQ ID NO: 2074 - DNA, 822 bp, Chlorella protothecoides
atgcttgcaagcacagtacggcacccggcctgcacgtctgtattgtcaatcagcacagggcagtgggcttgccagtttcgaacattggtggataggaccaaagcgcagagataccatgctgaagagtgcctcgcctggaaggctgagccccagcagtactgcagtgtccgatgggtgctatatcattgctgtggcatcggagacatgcctgaccgtgattgttgcgcgacttgtagaggcatggtccgggatcaggagcacagttgcaatggtaccagcttcgaggcgacactttcccctattgaacaaggctggatacaggcctatccaccacaggagccaaggagaaggcgcgtatcgtcaagctctaagtcggcggcgccggcagggttccgggagagcgagtcgaccacgaacgagcacgagacggccttcgagacctataacggtccctacgagtgggtggccttgccgtttaagctaacaaacgaccctgacacgattcaaaaccttatgaacaccctattcagcgcgttgcaaagcaaatttgttgccgtggacctcgacgacgtcctgttccttgattgcgtccttgactttggaggggccggtgaagatgccgcgcgagtcgaggacattctcatggaacttgagacgagcgcgggtgaactttcatatggcgggctcggcatggagatgggtggagtcaaaggtctgaaggacatggcggaggtgaagatgatggtcgtcaagagtttggctgtgtgccaagacgccgttgaggtgcactacagcaaacctgttcagcaatgcactgaatag

SEQ ID NO: 2075 - DNA, 699 bp, Chlorella protothecoides
cccccctccatgcagcctggattgatcccggtgcccgctgcgctcttccacggcagcctcctgctgtccaccctgggcaacctgggattgacccaggaggccctcgcgcagcccacgctgtacgtctccccgctcttcgtcgccggctgggcgggcattgtaaacaccgcactgaacgccctgcctgtgggctgcctggacggcggccggaccaccttggtgagctcttgggggctgttgactggcatgttgctgccggagctcggcagcaaactttgctcctcttgtcggagggccggcgagggacaagcctgctgcctcgctgagctcaaggcagcagctgggccaaacgtcgcgcacgccacgagtctcgcacgccattgttcacgttcccccatcaccatcacccaggcggcttttggcaagggcgcgctcgccttctccagcctggtggtgtatgctttgctgggctttggcgccctgggagggcccctggccctcccctttggcctctacgtcctggtgtgccagcgaaagtcggagggctggatccaggacgaggtgtcgggggtgagcgggacgcggcaggccctggccctcggcatcaccctcctcgcgctgaccgtgctgctgccggagagcgcgggagtgctgctgggtggcgtgggggcggggggacccgcccccgacctcttctga

SEQ ID NO: 2076 - DNA, 570 bp, Chlorella protothecoides
atgcacctcgctcaggatgcccatgagttcctggtatgtttcctggacgccctggtcagcatgaaggacgcaggtgggcggggcctggatgtggggctgcagacccaactgctgccgggcctcgccaccctcaatggctggcctgcgggcgccgctgcctctcgtcaaccccagctcctcgaaaaaggtgttccaggccgccaggaatatggcagccagggcacttggctaaatcacaacacaccctctgcagggcatcccgtggcgcaggccttctcaggcgccctgcagtcagaggtgacgtgctgggcgtgcgcccacgcctccacgactcgtgacggcttcatgcatttgtccctggacatcccccccgcctcccacctcatcgcgccggccattgccctcgacccggccgacccaccgcctgcgccccgggcggccaacgggaggcgggtggcgccccccgtccggggtcgcggccgcggtgccaaggtgggcaggcgcctgggtgtgctggggtgttgttgttggtcaaggatcattgggatagttggcggcaacgcagagtga

SEQ ID NO: 2077 - DNA, 459 bp, Chlorella protothecoides
atgccacctctcgggccgcagcatgagtgtcacttgttgaccgggcccgtggcgctcgccgctcaaggcctcctcgccctgttggcggggtcgacagggtggagtttccagtgcctgcgggatgctgggccactggctggggtcagcgcgactgaagccgcccctccaaccccgacaggtgttgccgcagcgatcctcatcgcgcacacccccaacggccatgcttcctccgagtgctcctggtacttctttgcgtttcttgccgacacaaccctgggcatggccttgtccctgggactgcacatgctcatcatgcgagtggcctccggggaggcagggcagggcgctgtggacaccaaaacgacccttctcggggccctcaaggtcctggtgccctgtggcgactatggtgagtgccgagaggttgtcggatgcagcggctatgtttgtaggcactga

SEQ ID NO: 2078 - DNA, 1083 bp, Chlorella protothecoides
atggcggacatggggagcaggtcgtacgaccctgccgccataggggctggccggcggctgcccaccgcctccggcatccccggcaccaccctgggcctcatccgcctacccgtcttctcctcgggcggttgcctggtcgacacccccggcgtccacctgcaccaccggctgccacacgcgctcaggccggagcaccacgccgccctggcgccccgcggccggctaagggggcgtggggtggcagtgccacctggcggcgcggtgctgtggtggggtggctgcgtccgcctgcatgtggcgccccaccgcggccagcacgtgtccctcaccttcttcggccccaagtccctgcacgtggccgaggcaggcggcggcgaggaggccgctggaggtctggctcgcggcgcccctggtgccggtggtgtggacgcctgcggcgatcgacccccgcccccgcccgccggcggggcctggttccaggggggcagcgcggcgctgctggagcggggcctgtcgcgcccccgccgcctgaccaagcccctggcgcccggccagcccagggccatcgccgacctggccgtctcgggcctgcccggctgggtgagcgtgcacggcagcggggcgggcgagctggcgctggaggtctgcgtcccggccggcgtggaggtgttctggaggccacccctgcccaaagtagctggtgcgccggcgcgtccccatggtacaccaccactcgctatacgctgcgacctttcaggggcggccgccttcgtcccagggcgacggcgccaccatgagcatctggatctcgctcccctggctgctcctcccactaccgggcggcggcgacggctcggggacggcgccgctgggctgcgcgcgccagcgcagcactgcgtcctgcaccagcacctgggcaatgttgacagccagggggcacacgatcatgaccgccgccagctccagggaggggcggcccgcgaaggcggcgtccagcctggcagccagccgctgcagcagtggggcgcacgcaaagatctgcccagaggggtggaggaaaggcagtgtgagacacttggatga

SEQ ID NO: 2079 - DNA, 729 bp, Chlorella protothecoides
atgcacatgtacaagcgcgagcacaacttctacggcgggcaggggatcgtgggcgcgcaggtccccctgggcgcgggcctggcgctgggccaccagtacctggacgacgggtcggtgggcgtggccatctacggcgacggcgcagccaaccagggccagatctttgaggccttcaacatggccagcctgtggaacctgcccgcgatcttcatctgcgagaacaaccactacggcatgggcacggcggagtggcgcagcgccaagtcccccgcctacttctcccgcggcgactacatgccgggcctgaaggtggacggcatggacgtgctggcggtgcgcgccgccgtggcctttgccaagcagcacgcgctggcagaggggcccatcgtgctggagatggacacgtaccgctaccacgggcactccatgtcggaccccggcagcacctaccgcacgcgcgacgaggtgagcaacatccgccagcaccgcgaccccatcgagcacgtgcgcaagctgctgctggacgccgggctggcggaggtggccgagctgaaggcgctggagaaggaggcaaagaaggaggtggacgcggccatcgaggcggccaaggccgccgatttcccgggccaggacgtgctggcggcccacatctacaaggagggactgggcatgcagctgcgaggcgtggaccgcatgtcctggctcaccgcgcccaagcaggaggactga

SEQ ID NO: 2080 - DNA, 285 bp, Chlorella protothecoides
atggacggtcgggtgctcgccagcatggtcctgccatcggtgccggcgcagcccctgctcgtggccgactggaacttcgatgggctgaatgacatcatgctgctgggccaccacggcgtcttcggctgggcccaggtgcggaggccaggcgcactgtcctttgcgacgctggtggcggccctcatcgttatcatggtgggcgtgtttgtctcccaggcgcgcgaggaggggcccagcgccaaggcccatcgtccccgagggcgcagcaccgaccaggcggaatga

SEQ ID NO: 2081 - DNA, 426 bp, Chlorella protothecoides
atgctcatccccaacaccatcttccgcctgggcgccgcggccgtgctgctcaccagcagcgcctccgagcggcggcgctgcaagtacaggctggagcgcctggtgcgcgtgcacctgggcgccgacgacgccgcctaccgctgcattttccaggcgcccgacgccgcggggagcatgggcgtggccctgtccaaggacatcgtcaaggtggccgcgcgcgccatgaccgccaacctcacgcgcctgggtgagggggttgggagtgggacccggctgggccggggcccgaccggtgggaggtacacgacgtgtcttggaggagggggtgcgcagggcaatgggcgtgctcagacggggatcaggggccagggcccaggcatggctgggcttggcgattggggttggaagtgtgagggtggcatgtga

SEQ ID NO: 2082 - DNA, 717 bp, Chlorella protothecoides
atggctctctcggccctgctccagaaacccgtcagcgtgcaggacattgtgggagaggcgccgcagcaggcagcatggagcatcgacctggcacacctcctggcggggcgcggcctgaaggtggtgctgtgcaccaggatgcctggcgtggacaccagccatgcacgcctatccttctacgcagcccagatggaggaagatgcgcccagagtggaccgactcttccaggcaggttcccaagtacagagtgtttgtggttgcaatggagccttgttcggggaccatcctgtcagtggatgctctggagagagccgagtactgtgcctggtctctgctgttgttcccaagcttggcctagtacaggtagacagaccaaggcttgcgcgctttcctgtcccgacttccacgcaggaagcagctgcagttgggatccgtgtactatgcgccagcctcaccgaccaggaactgctcgagcgactcagcggtagccttgccatcctgctcgtcgacaagacttgctcaatgctgggagtcccaggaggggagtatcatggtcactttatcctggtctgtgggtttgacccgagaaccgaacggtttgccgtcatggacccctccgaggagggggccgcgcctttgtggttgccagcagcccgtctaaatgctgcgcggcttgtacccggcacagacgaggacatcctcttcctatccaagtga

SEQ ID NO: 2083 - DNA, 714 bp, Chlorella protothecoides
atgctcacaccaggcgtcggacttcaagcgagatctgggtgccctgcaggacggactgtccgacaggttctccttccacgtcacggcagagcaggtgggccgggtgctccgttccagcagcagacagctctgtgggccctgtttcggttgcgccctgccatcttgctacaatggattgggcaggtcacgtgttatccattggtcgtgccatgtcgaactgcacgccttgctcaccctccttgccaggcagcggcacgagagtatggcgaggagtcgtgccgcgctttccggacctctgttctggaagccctcccacacagctggcagggcagctgggacacggcgctgcacctggctcacttccagaggcagaagcgggggaagggggagcagagggctgacccggcgcgcctcgcccgcgaggacggcggggccggaagctccccggcccagcggaccggcctcaagctgggtgggtcgccgcccaacgccctggccggggtgagttgggcggggggagctggcgagggtcgcacaggagcctctgtgccagccgttgtgtttcgtgtcttcggtgtggcgggcctcgcgatccaagcacctgtggaacaccgagcggtgcgctctcccaacccccccctgcagctcctgcgtgggaggaaggctggggaggaggtgtcccccaatgttctcgtcgcccacctcagtgagtag

SEQ ID NO: 2084 - DNA, 360 bp, Chlorella protothecoides
atgcacaagccggaaaccccctgccaactccgtgcaggcaacgcctggatggcgggacgagcggccgtcaggcacgcaggatggaggcacgcagggagcgacagcagcgagagcagtttcgggaagtgtactatgaacaggtacgagcgggactgtgttgcggggtcaattggtatggattgcctgactggattgaccggagctgccatctctcgtcaggcgttctgtttggtgtcctcacaccagctgaaccttctgccgctcctcgtccagggtgtatcgtatggcaagcctgcagcatgcatgatctttgacctggcggccctgctgggacaggagacgagtcacatgctctggtga

SEQ ID NO: 2085 - DNA, 447 bp, Chlorella protothecoides
atggctgccttctttcaagaccagcacttccaccacaccaatcggcggaagcctgtcgtcctgatcgggccggcggacgcctccctgcggtgcctcgccgtcggctacgaggctacaggccgtatgcaggtgggagcggagcacggcgacccagggtggggtgccgcagaaaagggattagaggcgcagggccaggcacagtcccactcaacccccatgtcgcccgtggtacatgacattcttcgccaaaacaccacctctgacacaaagccatggccttcttcctcccagggcaacaagctgggccatgcatttgcggcggccactgaggcagtcaaggcggaggcctggcacgacctctttgacacgacggtcatccagatctcaaagcacgacgtcgacaggttcaagtcggagcttctgagactggccacagatctcctgtga

SEQ ID NO: 2086 - DNA, 378 bp, Chlorella protothecoides
atgtttgcgttcaactgggtggccaggcaggtctgccagccgggcaccgtcgcgccctatgtcccagacttcacgcgggccttcgatcacttctgcctccacgccggcctgggtgaaaggaaggggcgatgtggtgtgatacacagaggcgtgggcctgccccgtcgccctgccatcctggcacgctgctgcaaggctcatgctgccgcccactgccgctcgctgacccacccatgcaggcgggaggggcgtcgtggaggggctgagcgcgcagctggggctcagcccgacgcagatggcacccagcgccaacaccctgtattggtgagtgagaattcacaggccggagctggtggcctggccggactctccgcttga

SEQ ID NO: 2087 - DNA, 231 bp, Chlorella protothecoides
atggcgcagcatcatggaatgccaacgcacatgttcctgaccttggtcacatccccgcaccacatacccttcccacagttgggggacagtggagtggagtacgatctcacggagatccctcagtctgtgcgatccagcatcgccgtttacgaggccgctcgcgccctcgtgggctacatcactcccgactttgatgaagtgcagcgggtatgtgttgagggagacctctag

SEQ ID NO: 2088 - DNA, 237 bp, Chlorella protothecoides
atggaggcagcgctgacctacaaggactccatcatcaccagctaccgcgaccacgccacccacgtcggccgcgggggcacggttgccgaggtgattgccgagctgatgggccggcgcaccggcgcctccatggtgagaggcggaggagggtggaggggagatccgtgggcggctgggtgcagggctggcggggaggttgggctgcaggggttgcaggagggtgcggcggctctgtga

SEQ ID NO: 2089 - DNA, 474 bp, Chlorella protothecoides
atgcgctcctctcctgatgacagctgcatgcatcgcgctctgaacgcctctagggagccggtgactgtggggctcatcaggggccacatcgccgccgccacgactgtcggcggcctgctgctgtccgaggcctcccccgccctggctcaggacgcgggtcccgccgcgagcgtcgccgccggcgccgcccccgccctccccgccatcgaccccgcccagctctcctccggcgtggacaccgcggtggggacgctggtggacctcctgcgcgccgccggctccggcatcaagtccggcctgggcggcgcccaggacggcctggaggctgccgagtcggcctactcccgcatcgcgccctacgtcgaccgcgccgtggacgcggtgcgccccggcgtggaggccggcgtggccaaggccggcgccgcggcgggcccggccctggagcgcgcgctgccggcggcgcaggacgcgctg

SEQ ID NO: 2090 - DNA, 483 bp, Chlorella protothecoides
atggggccaacgggcggcctgggatccgttccttcctcccgtctcccaccctttccacccggcgcccaccgcaatcacgcaggctatgggaagagcgggcgggaggacagccccgacgccgccgagaacaggttcaatgccctgtccctggaagagcggcgcaagttcgaggcggagacgctggtcaacgtcggcgggcgcaagcgccagtcctcgctgaacaggtaccgcacctcgtggggagctgagtcctcggggcccaacgagctcatcgtggtcaccatcctggccgcggtggcggccccgctgaagctgccgcgcgtgaccagccgcgaggagctgctggaggccctgtccaagctgggtggggtgaggagcgaggacgtgctggcggtggaggtgctgtggacgccggaggaggagggcgacaccttcacgcaggaggacctgttcaccgactacccgcaactgaacaacctctag

SEQ ID NO: 2091 - DNA, 774 bp, Chlorella protothecoides
atggccatggcagccctgaccgccagcgccgccctgctcttctgctcctgcgaccctgctttcgcggcaggaagcgggggacgcatgggtggcagcgccttctccagctcgaggtgtggtgacactgtggttgagcagcgctaccatgtacggacagatccagcggcgctttgccatgttcaatttccccaagaggagcgtcagggtgtgaactccaggtccatggacaaaggaagatgcaacccgtcgtccggatttcaagacagcggcagctcctttccattgggccggggcgccgactcctcgttcctgcagcagcagcgttcccagggcgcccgctccctctcctcgccggcggctcgctcctcgggcggtcaccacctcagtgtgacgggccggagcgcgctggcccccgcctacatgacccccctgggcggcggcggcggcggcttcggcctcacctccctccttttctggggcgtgtttgccttcatcatggtcaaggcggcgcagggcgtgctgggcggcggcggcggctcccgcgccctgcgtgagggcgacgacccggtcagcgtggcgaaactgcaggtggccctcctcggctccgcacggggcctgcagcgggacctggagcgcatcgccagccgggccgataccagcggccccgcgggcctccacttcatcctccaaggtgtggtgccgcgggaatcgccaggtgtgcatgcaggtggtgcaccaggcccatccagcaagtgggaggaagcccagctctga

SEQ ID NO: 2092 - DNA, 894 bp, Chlorella protothecoides
  modified_base (390)..(399): a, c, t, g, unknown or other
  modified_base (801)..(810): a, c, t, g, unknown or other
  modified_base (865)..(874): a, c, t, g, unknown or other
atgcacatatgcaagctggtgctcatcctgcatcaagctgctgcgcctcagtctcccgattccctcctttacacaacccgcagtcaagcttggccagcatgtggcgatgctggaccacctggtcccagcagagtacgtgcagaccatgcgcaagcacatgctcaaccgctgccccatcagctcctgggaggaggtggccggcattgtgcgcgaggacttgggcgcgccgcccgagaagctgtttgccagcttctcgccggctcccctggcgtccgccagcctggcacaggcctgcctcaacgttgcatgcctacaatgcctcctgtgcatcttgtaccctcccccccaacacacacacacaccggcactcactgtagatgccgccattgnnnnnnnnnncaggggtcggaggaatacgccggcatgctcggtagcaatgctttgcgtgaggcaggattgaaggctgccggggctctcccagagacgcaggtccttgaggttcagcatcaggtgcagcaccggggcttgagagagtccagctctgcagacctcgccacgctggcaggtctcattaccatcgtcaagtggctcgccccggaatttgactacggctggctgattgaggaggcgcgcaagaacgtccccaagggtgcgtgcgggtggcaggcgagtgtgcacggcgcctgcaccctggcagagagcggggcacagcgcatggggggaggaatcttcaacagagccttttatggctgttggcctcactccccaccccacccctcccaaccccccaccccacccctnnnnnnnnnnatccggaaccaactatgcccttcagatgcatgcacagtcaaggatagactgcatnnnnnnnnnnatggcgtcaaggcacaataa

SEQ ID NO: 2093 - DNA, 642 bp, Chlorella protothecoides
atgtcccatttggatcaccagggtctagccaccgtctcgagggtgtgcaagtcctggcatgaggctgccacggccgatgcactgtggcaggccctctgcgaccgccaaagctgggcggtggacgcctcccatggggaagctgaggctggggcctccccagcgcgacacacgtttcgttccaagtactcttccagctgctatgactgcttgcaaccgtgtgatcactgtaccctgggatttgcaacattagtgctcagccctgcaccaccatccattacctctcctgcacagactgtgctcggcctgtgccggagcctacgcggaccccaacccctcccagcgcctcgtcaccaagacacatgcgcagtacctgtaccgcatgaggccagcggacctggcagcgctgccacacgccgtggcctccaatcccatcaacccagccttcctgcccatgcacctcttccgaaaggcagatgtcgaggaggctgcatgggagaagaagaggacgagcacaaaatcagtgcggaggtgtggctgagcgtgccggcgtggacagccccttcatgctgtgtagctgggaccggcgatgataatctggaggagacaaccacgacgcctcctcctgaaacccaccaaccataa

SEQ ID NO: 2094 - DNA, 3261 bp, Chlorella protothecoides
  modified_base (2029)..(2110): a, c, t, g, unknown or other
  modified_base (2406)..(2415): a, c, t, g, unknown or other
  modified_base (2751)..(2760): a, c, t, g, unknown or other
  modified_base (3043)..(3052): a, c, t, g, unknown or other
atgactctcctcaggtgcagggcgcatgaacaccacagccagccccaggtctgctggaaagtattcaaagcaatactccatcccttcatcatggggcgggggtacggaagaggtcgcggcaaggtgcgccttgggtgttgggtgtccctaactaggctgaagcgcgtgctgcggcgcgacttcaaggatgggaagaccgacgagtggcaggagaagcgccagcggagggacgacgggtggcaggagcagcccacccacaacgatgccttcaacgagtactacaagggccagaacatctgcccgcccgaggtaactttggttccagtggagggaactggcttgtcacaggcgggcttgtacgcatggaggggaaccctgcgtgctgcccgtggccaccaggcctgcatgcctgggcacagctcctgcccgacctggtccccttcaaatgcacggggcgctgtcaccacacggccacacattcactttgtggcattgtctcagcccacgcttcccactgggatcacgtctgccccatcctgcgcacgactctcgtgccatcccccacttgcaggagtgggacgcgttcctggacgccctgcgccgcccgctgcccatcaccttccgcatcaacggctctggcaagtttgcgcacagcctgcgcgaccggctgcaggccgacttcctggcccccttctccggcgcggcggctgtcggccccgagagcgcgggcctgcagccgccggcggcgctggcctggtacccggacggcctggcctggagcttctcctgctcccgcggcgagcttcgcaagctgcccgccctggaggccctgcacgagttcatgaagcgcgagacggcggtgggcgccatctcgcgccaggaggcggtgtccatggtcccgcccctcttcctgggcgtggcgccggggcaccgcgtgctggacatgtgcgcggcgccggggtcaaagaccttccagctgctggaggcgctgcactccggcggcgcgggggaggagcccgcgggcgtcgtggtggccaacgacgccgacgccaagcgctgcaacctgctcacccaccagaccaccgcgcggtccaatgggcgcgtgatctggtgggggcccccggcggggaggcggctggggacgtcaaggggcctggtgctcctgaggaggcggtggatgcacggaaccccctgcccccgccaccccaggccccgcgcgtgctcttcgaccgcatcctggcggacgtgccgtgctccggggacggcaccatccgcaaggcgcctgacatctggaagcgctggaccccgggcaacggcaacggtctgcacctgctgcagctgcgcatcgcgctgcgaggcgcggagctgctggccgtgggcgggcgcctggtgtactccacctgcaccttcaacccggtggaggacgaggcggtcgtggcggagctgctgcgccggacgcgcggcgcgctgcgcctcctggacgtctccggcgaggtgcccgcgctgcggcgcctcccagggctggccgcctggcgcgtgcacgacggccagcgctggcacgatgcctgggcgggggatggcgagcgcgggcgcaagctgctgccctccatgttcccgggcgtgggggaggggggcctgcacctggagcgctgcatgcgcttcctgcctcaccaccaggacacgggcggcttcttcgtggcggtgctggagaaggtcgcgccgctggagggcaggctggagtaccccagcgcgccaccgcgcgacagggcgggcgcagcgctggcacgggaggccgggaagggcgagggcgccggcgcgggcgaggcggggggggcggtggtggctgacgccgtcgaggaagctgggatcgagcagggcgagcagcctgctgccggcgtcgaggccgccgaggccgtgggcgcggccccgcccgctgcgctgcatgaggctgacggagctggggaggaggccggcgctgcagcagcggccgggacgcccggggggggatccgccacccgcgagccggggnnnnnnnnnnnnnnnnnnnnnnnnnnnnnnnnnnnnnnnnnnnnnnnnnnnnnnnnnnnnnnnnnnnnnnnnnnnnnnnnnnccggagcgggagggcatccaagaagcgccgagcggggcggcggcggcgccgggtgcggcggccgcaggcgaggcggacccggcgccctcgctggtctggggcgcggcgcgcggcgggggcgggcgcaaccgccccggcgggcgctggcacggcatcgaccccatcgtgcccttcaccgacccggcgcagctggagctcatgcgcgacttctatggcatgcaccccgcgtgccccgtgccctgctccctggtggcgcgttcggaggacccccgacccaagcgcctgagctacgtgtnnnnnnnnnnctgccccgtgccctgctccctggtggcgcgctcggaggacccacgacccaagcgcctgagctacgtgtcggccggggtcaaggagctgctgctcatggacgtgaaagaggcgatgaagatcaccgccgccggggtcaaggaaggaagggggggtgccaggcttggcttgtgggtggggtcgggacggcgggccggagtgcgtgccctgcgtcccttcgcggtgggtgcagggcgccggcaccaggcgcacgccatgctcaggctgtgcgagtccctgaggggccctggggtgggcgtgctgtaccacgcagcctgccccgcggccaccacacacannnnnnnnnngccctgcgtcccttcacggtgggtgcagggcgtcggcaccaggcgcacaccatgctcaggctgtgcgagtctctgaggggccctggggtgggcgggctgtactacgcagcctgccccgcggccaccacacacaagggcgctcgttcatcgctccggtggcaagcgccgcgcgggagcgggaccctgcgacactgcgccggcacgatgtctgtggcccgccagatccccctctcgacgcccacccccccaccccgtgtgcctcgtgcgcgtcgcaggacggccnnnnnnnnnncccgcgcgggagtgggaccctgcgacactgcgccgacgcaatgtctgtggcccgccagatccccccctcgacgcccacccccccacctcgtgtgcctcgtgcgcgtcgcaggacggcctggtgagctgcatctaccgcgtggcgcaggagggcctgcccagcctgatgccgtacctgacgcggcagaccatcgcgctgcccctgaatga

SEQ ID NO: 2095 - DNA, 1404 bp, Chlorella protothecoides
  modified_base (494)..(503): a, c, t, g, unknown or other
atgtcagtacagccattggatccttccagtgcatgccagacgcatcatatgcgagagattatgctcttgatgatagggtggctgtggcctcatggtgactcgatggcacttttaaaacaagcaccccacacgtgcctagacaccacacccgtaaggcaagcaacaagctccagcttgaccctcggccatgatgtatggcttggcaacccttgtctcagttccggacagatcatctccggacctccctcaaatgcgtacccgagcaagcgcgcctcaatttctccaaagactgaagctccaggcgaggttttcaacgaaaagagaggggaacgcagggaatggttccgggagggcgagctgaagcggagtgaagttgtgtccttctctcttgcatgtgacattcctggctccctctcatgcctcccgattttctttctacatatcaaggggtactgtagctcagtggcaacgcttgtaagaaggagggaggatgnnnnnnnnnncggctccctctcatgcctcccgattctctttctacagatcaaggggtactgtagctcaatggcaacgcttgtaagaaggagggaggatgccgtgcagaatgccggatgctgtgcaagcaaagcttctgtcacgtgtcggcgcagccagaccgactgcacgaatcggacggcccaagggctggccgaacaggtccctgggtctaccccactctcatgcatcagccgctgcggggaggggcgtctgataggggagaatctcatggaagtggagccatcttccactcatcgacgtgttgtgaacaaggaattccaacccaaaatggtgtctgcgcgcgcctttgttctggtggttgccatcagcctgtgggcaggtgtacacgccgatgaggtcgactccctgctgagcaccaagaaggaatgggtcgatgaggccctctcatcgtgggagaaggttctggcgccggtgcccaaggtcgagaccccacccgccaaggtaccaaagtacgtatggccggtccctgtccccaaggaggagcccgaggtgcccagcaagaaggacctcgaatccgagctgtttgccaagtttgatctgaagccggccacaccctcccccaagcccaagcccgaggtcaagctgcccgccgtcaccctgccccccaagcccgaggtggaggtgaagtctgtcgtcctgccccctgtccctgagatcaagctgcccgcggtcactctgccccccatccctgagatcaagctgcccgccgtcacgttgccccccgtccccgagattacgctgcccgcagtcactctgccccccgttccagagttcacactgccagccatcactctgccccccctgccagagttcacgctgcccaccttcaccccctcccccaaggcctga

SEQ ID NO: 2096 - DNA, 504 bp, Chlorella protothecoides
atggccacccagtccctgccgctcccatccctgcccgcagtcaaggacgcgatgtatgcctacggcaagcacctgggccttgctttccagatcgtcgacgacatcctggactacacgcagaacgccgagaccctgggcaagccgcaggggcaggacctggcctctgggaacctcacggccccagcctactacgccttgcaggccgctgctgaccttgctcctggtgccaccctgccaggatccgagcaccagcaaggagctgagccgcctcatcacctcacgattcgtggaggaggggtccacagcgcgagcgctggcgctggtcaccgcagggggcggcattgcaaggtgggagggtgtggcaaggctgcgatcgctggagctggcaagggaacagggtcaagccgcgctcgcagccctgagctgcttgccgccctcggcctccaagcggtccctggaggggctggtggagtatgtgctgcagcgcctattttgaggggctga

SEQ ID NO: 2097 - DNA, 441 bp, Chlorella protothecoides
atggcctctaatctcctccaaccccaggcacatgcggtattcgtcccattcgtgagcgcgcgaggagcatgccacggcctgcggccggcccgccggaccctgccaccccaggccgggacccagccccgcccccgctcggcctgcgtcgacgcggctgcccaggccgccccgggccatgccactcacaccagctccaccgcagcctcgtccttccccgccatggcccccatgccagcgaccgtgagtcacgaggtgctgcgggcccctgtggcctcagacatggagacctgccgccagaacctgctggatgtcgtcggccagcggcaccccatgctcctggctgccgccaaccaaatcttttctgcggggggaaagcgactgaggcctctcatcgtgctgctggtcgccagggccacgcttcctatcaccggcatgccgtga

SEQ ID NO: 2098 - DNA, 381 bp, Chlorella protothecoides
atgcagatctcgctcccaatatccctttcccttccctcccaccgagcaggcgtcgacctgactgtgtccagtctcatcaaagacaaggaacttctgtccgcgatcgtggacttccatgtggcccccaactatgccctacgccccgcacagctgaccaacaacctccagatccccaccctcgccaccgaccaactcatcacggtattcgtcccgctgggctccccggtggccttcgggggtgcacaagggtatgctatcgcctctacattagagaccctgaccctctgtgacgtcgtggcgtacgtgctggactctgtgctcatatcaagtgctgcggacgcaatcctcgtttctcagggcaaggttgccgcctccggttag

SEQ ID NO: 2099 - DNA, 474 bp, Chlorella protothecoides
atggcagcgctggttcacacccgggcagctaacatgaaaggcttgactgtcgggctgtttgatgtaccttttgaggaacagcactggcaccgagctgtgattgggcctcgcaggtggcgtctgttgtggtgtgatgggggaggtgttgagggtcccctgtcccattttcctgccccacaggatgccgctgagaaggagctggcagacgcccgtgcggcagcacaaaaggagatcgcagcggccaaggcagagctgaacaaggagcgtgatgctcgcctgggagcggagaagaagaagatcgacgccgcgctggagaaggatctggctgccctggctgccgagaaggagaagacctttagcaacctggactcccaggtgcgttggaggggtgcattgcaggagggggaggggcatgcgttggagggtggccggggtcctcccagggcaagggcgtggcagctgagtcggccctga

SEQ ID NO: 2100 - DNA, 423 bp, Chlorella protothecoides
atgatgctcacgctccagcatgtgcggccgttccaggcggtgggaacgcccagggcgggcaggacagcggggcgagtggccaccgtggtgagggctgcgaagtcgggcaacagcaaccagcagaggccggtttccagcgcccctcgatcactgggaaagcttgcgaccaccttgctaccggcgctgtcccccctcctcatctccctgccggctcacgcggagccagggaagatcttcgacttcaatgccaccatgccggtcatggcagcccagttcctcctcctcatggtggcactcgacaagttctggtttgggcctgtgggacgccacctggatgcgcgcgacaaggagctccgggacaagctggccagcgtcaaggacaacagtgcggaggtctcaaagctccaggtggtgcttggctga

SEQ ID NO: 2101 - DNA, 309 bp, Chlorella protothecoides
  modified_base (266)..(275): a, c, t, g, unknown or other
atggagtacttccaggtgctgccaactaaagagtttggcgcggccaagatcatgagcagccagccccaattcctgcgcgacaccgccaccggactgagcaccacccgcttcaggcgtgttggggtcttggtagcggcgtggcaatgcttcactggcatgcctgggagggaaggcggctgcggtttagagaagtccaagctgttccgtctatcccaaccaactccaccctgttgctctcgacacggcccatcaccccgttattttannnnnnnnnnggcgtgcctgggagggaaggcggctgcggtatag

SEQ ID NO: 2102 - DNA, 633 bp, Chlorella protothecoides
  modified_base (593)..(602): a, c, t, g, unknown or other
atgaggggaccccgaccacaccgaccaggagtgcccgtgctggccaggcggggcacgctgctggcagggggcctagtatgtacagcagtggtgctcttggtgctcagactatcggtacgtccagcccatggacgcgtagttcagccaccacatccaagtgaatctgtggcaggctcagcacgggatccccctccttgctgccctctgcagcccctgggccttgacttgtcctcatccggggagggcctggagcgagcctacaggagccaacgattgggcaacgttcccatgcagcggttctgccggcttggggtccaggcaccccagaacaccacggagcacaccctggctgtgctcattccataccgagatcggcaggagcacctgcagaagctcatgcctgccctcagaacccacttggacgaacaaaaactgacgtatggcatcttcatagtggaacaggtgcaacgtggggatgacacgagggtgtgcagggtgacgtgctggtgctgggcaccgagaccgactatgtcaaatccagctttgatgagtgttctccggatcctggcaaacttggatgccagcagctgccnnnnnnnnnncccacttggacgaacaaaaactgacgtatga

SEQ ID NO: 2103 - DNA, 1164 bp, Chlorella protothecoides
atgtggccgtctgtagagcagtgctatattgactcacaggagctccgagttgctacaggagctgtgcacaacattacccctccccctccctccgcctcctcaaaggagtatggcgtggatgcagagggcgtgctggagggcgatcctctcacagacggcgagaatgtggaatgggacgcagaggcctctcggccccagctggtcactcgcatggcatggggaagctgccgagaggctgccctcctgtggatgacgcttgctgactcccttccgctgccaggcgccgcggaccccggcctgcaggccgccggcgtagcgcttctgctggacgtcggggcgcgtctggtgcagcagctcaccctcctgaagcacaatggtgccatcgaaaagtgctcccaggcgctctcggctgtgtgcacgaggtttggtggcaggctctgggcctttggagtccttcatgctgggctggaggtcactgggcctcacactcacaccatgcaggccccgggtccaccactcaggggttggggcagagaatgcggccttgtgttactcacatcctcatcgccctccaggcacccacaatgcccccctccccatggtctgtccagggtgctggcctctggggtgaaggagctggacgtggctcccctggcctggctggatgccttcctcgctttcctctcgcggccggggcagggccgctccgacattgtgcgccgctctgcagggctgccggccggcatcctggcagtcctcgctgctggcagcagcggcacatggcgggaggtcctcatttctcacaccctgccccgcctgattgctctggcacaccccgagaccgaatcgacggccgactgggcgcctcgcgtgcatgccctcaacacgctacgcatgctgttctccgcctcggagctggcagacggcacggcgcgcctcctgccccagggagtgggcgcctgcctggcagggctgtctgcctcccgatgggagatccgcaacgccgccaccctggcctattcagccctgcttactcgtgtcctaggatttaggaacgacgcagtccaggagcgtctgtacctgcgtgcggggccagggaacaggaagggacggtggtacggtggatcccctgcgggacgcatgggagtcatgagcacacattaa

SEQ ID NO: 2104 - DNA, 747 bp, Chlorella protothecoides
atgaacttcggctgggccattgcagactgggccgccgatctggccgccgcgggcgtgcccatgccgccgcgcgtccccaacgccgccgacctgcgcctctacgccatcaccgaccctggcctcgacgaacgcgcggcgcggagcctcgtagacgccgtgcggctggccatcgacggcggggccacgctggtccaggtgcgcgacaaggactcgcccgcccgcgcctttgccgccgccgccgccgaagccctggagcacgcgcgcgcgcgcggcgtgccgctcgtgataaacgaccggctggacgtggcgctggccatcggcgccgacggcgtgcacctggggcaggacgacctgcccgccgccgccgcgcgacgtttgctgggacccgaccgcatcctgggcgtgtcggtgaagacgccggagcaggccgcgcgcgcggcggccgacggcgccgactacgtcggctgtggcggcttcgcgcccaccaacaccaaggcgggcaacctgaccgtcgggccggagggcgtggccgcagtcgtgcgcgcgcgcgtgctccctgtcgtcgccattggcggcatcggcgagggcaacgcctcggccgccctggcgaccggcgccgacggcgtcgccgtcatctccgccatcttcggcgcgccggacgtcgtgcgcgccaccaagcgcctgcgcgcggtcgtggacgcagcgctcaccgcgcgcggcctctcggaggggggggaggaggcctga

SEQ ID NO: 2105 - DNA, 672 bp, Chlorella protothecoides
atgctggcgcgccaggtggaggtggtcatggccgacgtcggcgcggccgcggtcaagaccggcatgctccccgacgcagccagcgtggtggcgctggccgccgccctgcgcgcctgccccgccccggccccggccctggtcctggaccctgtcctgctctcaaccacgggggacagcctggcgcagccgggggtggaggccatgctgcgcgagcacctcttccccctggccacgctcatcacgcccaacctgccagaggccgctgcgctgctgggcgacggccgcgcgatcgtcgacctggagggcatgcgcgccgcggcgcgcgagctgcacgccctggggccctcctgggtcctggtcaaaggcgggcacctgcccgccgaggcgcggcgcgaggcggcggggcgcggcgcggccgcggcgtcatccggaccggagcagccgtcgcggcagcagaccgtgaccgacgtgctgttcgacgggcgcacgatgctggagctgagcgagccgctggtggtgtcggacaacgtgcacggcacggggtgctgcctggctacggccatcgcatgcgagctggcgcgcgggcacagcgtgctggccgcggtgcgccgcgccaagcgctacctcgctcgcgcggcctgccccttggcgacggcccgcagcgcaccatga

SEQ ID NO: 2106 - DNA, 552 bp, Chlorella protothecoides
atgcgccaggtggccaaggaagcgcatgccacatttgcggtgctgctggacatactggagctgcagtcggcgagggaggggactgtcgtaggtgccgggcacaaggggaggtacgcccccctggccgccatcgccccccgcctcggctaccaccgcatcctggcgttgcgcccccccctggtcctcgaatccctggcccagctgggcaacaaccggctgtgcacctccgtctgcggcctgctgagggcattgtggactgcagcgtcccacgatccagaggcatcctgggtgccggggacggtgcaggacacttctacagcactcatcgacggcccagacgccctgcgggcaaacctggcagcccatgtcctccctctgctcttcggcatccatcccggggcctgcgccgccctgctggctgccctggactcgcagggggcaggggcccccgcgaccccagacctccagtcggcgcgcatggccgtgctcgccgccggccacgccagcgggcttgttacctgggagaaggccgcatcgggcgggcccccgtga

SEQ ID NO: 2107 - DNA, 393 bp, Chlorella protothecoides
atgctgctcttgcaaggctccgcctacgactacttcatcttccaggatgtcgacaccatccccaggccgggcagcggaatacggtatgcatttccatcgggcccagttccgctgcatctcaccccttttggcatccaccccaaggccaactttgaggatttctttggaggcatcctgagcatcagccagcagcagatcagccgtgtcgacggctttggcacagacttctgggggtggggcagggaggatgacaacctgaagctgcggttgcagaaccatgggttgtggcctccccagtaccctgacgtgcccaggggcactcaacatggcccttacttcatccaccagcgccacaaacaggcggcagaggtgagtggtgattgtcatcgctga

SEQ ID NO: 2108 - DNA, 1269 bp, Chlorella protothecoides
atgaacaggaaagctgccaagcgtgccgagaaggagaagcggcgggcggagcgcgaacgcgaacgcgaggccaagtccaaagccaaggcagcaaagaaggccgccaagcagaccatcaaggatgccaagaaggctgcagaagaggcagaggcagcacgcctggtacgtggctggtgtggactcggcgtgggaagctggggcacagggagcgtgcatggcgagcagagaatgcaggccgccagggtcgtgccggcggcctgcgtgccacttccacctccctctcaccagggaggccaagtcccaaactacacacccattgcgcaggctgaggagaagcggtggaagtctgagggatactacaccagggacgtggaggcaaccgacaggtacaacccccagcccccccttccgctggaggaccggccagaggcctccaactcgccgtccagagaggcccggcggggaggggccgaggtggggaacaggggagctttggatgcagggggcaaggacgcaggcgtgcgggcgagggacgactctcccagccgggcacccaagcgagggcgttcgagggggctcgccgacgctccggcccgcgagcggcgagcgggggctagcccggcggcacgccggcatcctagcgcatcgccgccgcggggacgggcgaggacggaggcggccgacgtggaggatgcgaggggccctcggcgccttccagcgcggcaagattccccgccgaggcgaagggacagtgtcgccgactcgccgcccaggaggcgaggcgccagggaggcctcgccgcagcccgggtctcgctcacgtgcgccggcagcaagcaaggcacggaggtctgccagtcccaccccgccggcccggggtcgccgttccctgagcccgcgctcacccgggagacggagagggagcccgtcgccgccgcgtcgtcgccaggaggcaggccgtgcgctggcgtccaagggaagggagcacagcccctcaccggggccggagcccctccagctcctcgtcctccggcaggagcagcagcagctcgagcggctccagcagccggtccagtgggtcgaacagcagctggtccagcagcagctcggggaggtcgagctccagcagcccgcctcgccggcggcggcgggcgtcgccaagccccagcccacggaggcggcgctgaccctcttggcaatgcacgcatgctgttgctttccgagttctcagcgacccagcatctggggcgcagcttgccctgggcagtag

SEQ ID NO: 2109 - DNA, 336 bp, Chlorella protothecoides
atggccgtgctcgccgccggccacgccagcaggcttgttacctgggagggggccgcagcgggcgtgaccccggaacaactgcacgcccacgtcttcgccgccctgcaaaccaggaacggagagcagaggctggctgcggcgagcctggtgtgcacccatcccaaggcgctggcccccttcacccctcgggagctgggcctggtccagctctgggcggagctggagatggtctgcgactccacgccgcaccgcgagaaggtgctgcgcctgctctccaaggcaggcgccagggtgcggggtctcgcggccgccgcgcgccagaggggaggtgcgtag

SEQ ID NO: 2110 - DNA, 231 bp, Chlorella protothecoides
atggatggttggcaggaccaagccaagaagcccttattgaacttcctggctgttacaagcaagggagggcgcttcatcaagagcgtggacaccgctggcaaatgcaaaactgcagattaccttgtggagcaattggaagctgtcatcaaggagattggggtcgagaatgtgcaagttgtcatcacagacaatgctgctaactgcaagagagccggggaaattattcatgaa

SEQ ID NO: 2111 - DNA, 642 bp, Chlorella protothecoides
aaccttcccctccccaagctgcgcaacttcggtgggaagctgggggactcgctggcggcgctgggctgtgccaccgccggcgacgtcctggcgctggcgcccgaggtgctcgagcgccgctttggacctgagcgcgcggccttcatctccgcggcggtgggccagtggggggtgtggaatggggcctgcggcaggctggcatttgggcagggtaggctctgggagacaccgagtcgtttgctggggtgcacgctgcatgccaggtcaccctggaacccctcatgcccctgcctcgcgcaggtgcagggcatatccatggagcccgtcaaggccagggaggtcacaaagtccatgctggcggcaaagacgttttacaacaccaggggtgggtttggatgtttggggggtattcttccggccgagcagttgccaggccctgcacctgtcactggggtgctagaaggtgggctcatgccgcccgcatgcctgtggcgcagagttcagcaagggctcgtgcggcatctgcacagcgatggctggtcctggtggaccagttcacctgggacactggccctgcccaacctgccgacctctgcggcggccaacctcctaccccaccccctcccgcagatctggatgtga

SEQ ID NO: 2112 - DNA, 354 bp, Chlorella protothecoides
cggcgacgtcctcctcggcaggcgccgccgcggggccgcagctgacggggtcgacactggaggggtggaaggctttcaagcgggtgttccaggagggcgtggagctgttcaacgccaagcccgccaagggcgtggccttcatgcaggagcaggggctggtggggccggaccccgacgacgtcgcccagttcctggccaagaccctgagcctgagcaaggcgcaggtgggggactacctgggggagcgcgaccccttcaacctcaaagtcatgcacgcctacgtggatgcgctggactttgccggcctggaatttgacatggccatcaggtgggagtggagcgcggggatgtctt

SEQ ID NO: 2113 - DNA, 384 bp, Chlorella protothecoides
atgtcccccataccttctcccctcaaaccccgcccccccacaaaaactacccgcaggaagttcctggacgggttccggctgcccggcgaggcgcagaagatcgaccgcctgatggagaagtttgcggaacggtacgtgctgtgcaaccccgactccttccgctccgcggacgtggcctacgtgctggcctactcggtgatcatgctgaacaccgacgcacacaacccgggggtcaaggtgaagatgacgcgcgccgacttcctgcgcaacaaccgtggcatcaacgacggcggcgacctgcccgaggccttcatgtcgggcctgtacgatgccatcgtgacgcgcgagatccggctcaaggacgaggtgggcgcggggaccggg

SEQ ID NO: 2114 - DNA, 181 bp, Chlorella protothecoides
atgctgggcatcgcctttgccccggagcagtcggcggagcagctcggcgtgcgcggcgtgctggtgctagacgcgcgcaagggcagccccgcggatgaggcggggatcaagggcacctcgcgcgacgagtatggcaggtgggtgggcgtgggtgtgggtgtgggcgaggcgagagcgggag

SEQ ID NO: 2115 - DNA, 378 bp, Chlorella protothecoides
atgcgcgcccgcgcccgggatgacgaggacggggacgaggacgccgacgaggcggggaccgggcagcggcgccgcgcgctggcgggcccgctgcccgccagctacccctcgccgccccgcgcgcccgacggccccttccgcctgtccggcgtgtatcttgggtgcatggagaacaaggcggggttccaccccatccgcgaccccgcctccaagtggtatgtgtcggaggagcagctgcccaacagcgccgtgcccttcggcgtcaagtacctggcggggtgggggtacgtcctctcccgcgacctcttcacgcgcatcgtgcacaagaccaacctgtgggctgcggaccccgagtcggcgcccgcctggtacacgtga

SEQ ID NO: 2116 - DNA, 612 bp, Chlorella protothecoides
atggcagaagcggcgttgtcgaagagcctggacgagatcatcgcggagcagaggcagaaggagacgacgaagagagagaagcagaccagcaagcgtggaagcaaggcccagcaggccccagctacccggaaagggtcaagaggcggtcagaatagctcgcgcccgccagccagaggagcccccgggcgcgtcatcactgtgacaatcaaccgcagcagtggcgtcgtgaagagggtaggctggggtgggggtcaccagggacttgcatgtcacgttgcgtggggatggcagcctggagggtacatgaagtgtccctatcaaacccgtggcttcatattcgatgcacaggcaggcgatgggcaccggggaagacccgtcagtctcgaggatcctgagccgagaaacaccgaggcccgcatccaggccctcgagggcgccggaaaatggggccacgacatgtttgcgcgagcggagggcaagggcgccgctggaccacgttccgcatccgctctgggaaccaagctaggtggcctccctggccatgccatgcacatccctttgctagagcctgccctgtacgggaggacgctgctgcccacgcgtcaagcttga

SEQ ID NO: 2117 - DNA, 459 bp, Chlorella protothecoides
atgccgtcgagtcccccccttcacgtcgcccaacgcactctcctctgcagcacgagcggcacccgcgccaggcccagcaccctggtccgctccaacaagaagaccgacatcgccaagcagggtctgaacgggatcgagaatgaggtggtgaagaacaacctgatgggccgctcccgcttccagaacaagaaggactgggtggatgcctccggacgcaagggcaagggctacggcgtgtaccgcttcgagaacaagtatggcgcgaatgtggacgggtactcccccatctacacgcccgacctctggtctgagtccggcgactcctacaagctgggccgcaacgggctcattgcctgggcgggcttcttcgtcatcttcctgggcgtggcggggctgggtccctctcaaggggctggtcagcatggaatgcccggcatggcttttgttgaggggtcctag

SEQ ID NO: 2118 - DNA, 1599 bp, Chlorella protothecoides
  modified_base (1280)..(1312): a, c, t, g, unknown or other
  modified_base (1405)..(1434): a, c, t, g, unknown or other
atgcacggttggaagggctgggacgtcaagctattcccattcccctggtgccccccaagaaggatcgtacctgcgcccatcatttccatccccaagccagtgatcgaccgtgaaatccacgagccccgccacagctgcttcccattctcctcccaccttaccttcccccccctatgtggcaacacgcagcgcgagtccatggccctgacagccctggtccacaccgggtccatccagccagactcacccgacggcgcggccctggcggagatggcggcgcacggcgacgcgggctacttcctggaccgggtggtctcgcccatctttgccttcctggccgttcatgtggacaggatggggacggacggggtggaaatcgcccaccgcatcgcctacgatgacgtgaacgagagtctgtgccgcagggacatcgtcgcccagagtgtagggcaatgcggcgtggcagaggcatgtacattcctcctgtggagtggctgccctgcacaagcccatcttcatctcgtcatgcccagcccactcaccagctccctacaccccccaacccccactctcctccctctaaccccatcaggccctgctgcgcctgggcgtcagggttgggccgggcgggagcatcgccatgtcccgcgacccctacgatgccctgctgggcatcggcagggtccagatcagcgtggaggggcagcccatcgccaagctggcggcggggcggctggacacggagggcacggggggcgtgggctggaacgtggaggtcgcgcgcgactgagcagggaggtgggtgtgggtgcgagtcatgccgccatcccacgccaactcgatgcacaagggttgatcctccccgcctgcgcagaacattctaccgcgtctgggccttcatcctcctggagttccacctcatggccgtcctcacctggggccgcgacaactagggcgcgccatgcacgtcatgccgccgcccatgccctcccgcagctacgcgatctcctccctggccatgagccacgccctgctgagcttcctggagcaggtcgccgccttctggacgcagcgcgcctcagcgcgatcgggaaatgcccctccgccctggccgatgacatggcaccagcccccccgcccccccgctcctccttccctgcgcccagttgggggcccccgcgtggcgggcggggccatctctgggcgtgccgccctgggcgtgctccagtggctggccatcctgtgcgtcatggccctgctcatggccgcccaggtgatcnnnnnnnnnnnnnnnnnnnnnnnnnnnnnnnnngctggtgggtgttcggcaagtaccacatctggtggtgggctgcggcagggtacggcggcctggttgtggcccacgcactgctgtctacccgcnnnnnnnnnnnnnnnnnnnnnnnnnnnnnngcggtgtcgctgacgcactcggcggcggccctggcgcgccgcgcccgcgcccgctcctggtgcttcggctggggctgggcctgcgtcgcatggggcttcgagctgctgggtgcctcctcggcgcggccgccgcctgtggaccacgtcgcgccctacgacatgcgg

SEQ ID NO: 2119 - DNA, 546 bp, Chlorella protothecoides
atgctgtgggcgcactgtgaacgaggtgtcacctgtggtcagatccgtgcatgtgggcacatttccccggagcagaggcatggttctttagtgggcgtacgccttcgagacgcagtgccgacattgcaccttgacatgcacgacttttgtctcaccctcccctacgcactgctcgtcgcggtgcgggagctcattcggtggctggcgtcccctagcactgctcacatagggggtagccacgacagaagagagcacacaccttatgcaggccagggattgggcagtgccgccgcactgggcttcctgggttacaccagcctaaaagcgtacaaacagggcaggagagcgcatgtgactgcagtcctctcccttggtcagtcaggggcatgtgtgctggcagcggcattgctctcccgcaccctcacagcaagcgggctaggttccttggctggagcgctaagtattctttcggatggaggaatggccgccttctatgtgtggaaccttactctgttccatcccaagctaccactcccgaaagagtaa

SEQ ID NO: 2120 - DNA, 858 bp, Chlorella protothecoides
  modified_base (357)..(399): a, c, t, g, unknown or other
atgggaaggccaacgttctcctcgtcgctcctcccaggtggtcctccggaagaaggctcccacagcgtccaccgcacatcagaggttggagtcctcactcctcccctccggcactatcccgcaggcgctgccgtgagcaccgtcaagaagcacgatgcggggtccaacaaggcgagagcaggcaaccccaatgctgtgaagctggacgcagaaaccgaggatttccatcacgagcaagtgagctcggagctcaagaagcagatccagcaggcccgcctggccaagaagctcagccaagcacaggagagcactgagtggcatagcatgtggtgtgctcccaacttgactgacaccgannnnnnnnnnnnnnnnnnnnnnnnnnnnnnnnnnnnnnnnnnncccccccccccccccccacacaccttgcagctagctcaaatgatcaatgaaaagccccaggtgatcaacgagtatgaggcagggaaggccattcccaatccccaggtgggaggacacagatggctgtgcatggggctctgtacctggcttgagtcgggtccaagctgttgccgcactgctccggtcctggttgtcagcctgcatgctggcagcgtctcttgcctggacacagcaattcctacagcgtccacttccaaccacccctctctcccttcctccacagattttaggaaagctgtcgcgtgccctaggggtgaccctgcggaaaaatcctggcaagaagtagatgaccagatagacgccatgcagtgctttgccatccacgatgtgggcgcgtgctctggcgggccatggcaccgaaagatacaggcctccaggatgcttcaattcaatctataa

SEQ ID NO: 2121 - DNA, 552 bp, Chlorella protothecoides
atgtcaaatacttcgttggagatggccacgaccaccacccaatttcagatcacatactccggcaagagcctgcaggtgacgctaccccaccaagcctctgtgttggacctgggcaggcatgcgccggctgggcagtgcagggcaccaatgtcgttgggtgtactcacagagatctcacatccgtccgaaatcgtccacaggtgtgacatcgggggccacatatcgagtgctggggagcagcgctgcagcagttggcgccgtcatgtcagccaaggcaacaccactctcaacccaccagatgagccgcgcatcgcggggtttgatcacgagctgcgtagggaggccgccaggcgtgcgggagtcgcccacccccgtgcccccccggcaggaccgtataccttcaagaacttcagggcctggcagacccctggactgacaccatccccagcagaggccctcgccttcctccataggtgccgctgggagggtcacagtgcagtttgcacacgtattggaggtggggccaagcttgcaacacgcgcctcaacctga

SEQ ID NO: 2122 - DNA, 696 bp, Chlorella protothecoides
atgggcaaggtggagtggggtggtggggaggggggtggtgggacaggtgctggtctgccaggggcaccctggcctcaacgatctgatgacaaggggtctgctccaaaccgtatatgccgcgcccctgccacccccgcctcctgcgcagtgtacgaggggctgctctctgccaacaaggtcccggacctgtactcctccgcgctcagcccggagcaggagaagcggcgggtggtgctgaagaaggccaacctcgacaactcgggcatccgcaccaacttcctgaaagcaggtggccggcggggtgacccgccgcagggcttcccactttgtcctctggcccgccagtgctggtctgcacggcgagactgggcaggtggagagctacatgaacctccgcatctcgcgccacccaacggtgcgtgccggcgtggtgtgtgcgagtgccgagaccctccctgcgcacgctccccgccgagcgcctcacccccccttccccatgcttgctcgcgcggccaggtggcgcgccgcgtcgcgcgctacctgggccaattcgaggtggccggggccagcggcgcattcacccgggggacgcagtggctggtgtggcgctttgagtcggacgccaccctggcagatgccatggccggcctcctggatggcgggatggaggtgtggcgcgagagggcgggaggctga

SEQ ID NO: 2123 - DNA, 630 bp, Chlorella protothecoides
atggctggcacgttcaccgtgcaccttggttgggaggaagtacctactgagactgcagggtgtagtggagtagccatcaacatttttgacccctgcaaggaacgacctatgcgtcccaactccgctcgctgcgcagcacctgagcagctggttctgccaaaggccgtcccaagggtgccagcaccctttattgcggtgctcctggccccattcctgtggaggctgggaaggccagacctctttgactcgtacgctgccggcatcatcctcctccaggtgggcaagggactggagaagaatagaggccacacgaccggccgggaagctgatcatggcgagtggcactctgtcttcatgctggcttgggacgcatgcggaactgcggtgaagccttcaactccgccatggcccccctcactccccacaacccatgtgcagatgtcgatccctcagctgcgctccgcaggctccctcaaggccttcaacaaggaactcgcagccgccgattacgaccttgatttgtggaggaggcggtccatgcgagtacaggcatgtgactttgaggtgctggacgcaaataaccaagcaggtgagaggacgactggcatgcatgcatcggtgtgctcctga

SEQ ID NO: 2124 - DNA, 798 bp, Chlorella protothecoides
atgccgcctgagggcaaggtgggtgtctctcccgcctgcatcctcggcgtcaacatcaatgcaggccaggagatatcccttcggctgcgcacagacgatctgagaggcttccggaggtacgacaggatctgtgagaccctcatgcatgagcttgcccacatggtgcactcagagcacgacaatgctttcaagaccctcaactccgagcgacacgcaagcacctctggagaatggaccagtgaagccgcgagtctggactttgcgaaatcatctctgcccagcggggcacatcctgtcaagggagaaaggctaggaggcacatctgagaggagcaggcttcatcagttcacgggaagtggagatgctgccagaaatgctatcgctgcggtgaccagcagtgccggagccagagaggatgggtctggcgcaaggacacctgacccaaacggcgtgggagctgcagcaaggcagttcaggaagaacgatgcagtactctatactcagagagatggcagtcaagtgccagccaaggtgaggcaggccagggctgggtcggaacatgctctcatgctgactggagagcgtacagcattgaactatcaactggagtccgtgagacagaagggcatcgcttggaaccggcccgacctgaggagtacacctccgctgaccctcttacagccgacaaggaagccgcagcccgtgcgctcggagaatgaccatcatgagtacacatttgatatgttcatgtatcaagacgggttctcaaggctcttcatgatcgatatgggcctgtag

SEQ ID NO: 2125 - DNA, 369 bp, Chlorella protothecoides
atggatcgatttgcacgcgccgtgcatcgcctgcacgccgccattttccagggctaccgcgactggtgctcacatgtgggactgcccctccgcataccggagctcaagctggccaagatccacaggccgcacactatacaggcaaggtggaagattttgcacagggtgacggagtgggagtatgggctggaggagctggccatgtacttcctggtgtactcggaggcagccaacctgcggcacaccccggagtgcctttggtttgtctactggatatgccgcaactccttccacaggtggaatggtgcctcctgcccaaacccgatgcacccctcctcgcccatctttgcatgtgagtggcgtttgtag

SEQ ID NO: 2126 - DNA, 276 bp, Chlorella protothecoides
atgccggaccagaagcgccatctggcactgaccaaggccgtcatgcggaagctgctgaaaggagcatggcggcctgacgccggcactgccacggccctggcctggtcgttcatggcactctgtggctgcccagagcatgtccttcatcctgtgtccgacttccatctttccccaacggccccagcactgcaacggctgcactctctgggtatcgtgcatcgagacgtgaagccggacaacgtccttgtgaccagcaagggagacgtacggcgatga

SEQ ID NO: 2127 - DNA, 2523 bp, Chlorella protothecoides
  modified_base (192)..(233): a, c, t, g, unknown or other
  modified_base (1302)..(1311): a, c, t, g, unknown or other
  modified_base (1662)..(1671): a, c, t, g, unknown or other
atgccccagtcccccgccctggtggcggcctggtccgaggccgggagcgtgggcgtgtgggacctgggcgcgccgctggcagaggcgcgcgccgagccctcgcccgacgcgtcgcggtcggagcgcctggcgcgcatcgcgccgcgcagcgtgcacggcacgggcgccgaggggtacgcgctggattggtcnnnnnnnnnnnnnnnnnnnnnnnnnnnnnnnnnnnnnnnnnntggactggtcgcgcctggcggcggggcgcctggccgcgggcgaccgccgcgctgccatccacgtctgggagcccgcgccggcggggaagtgggcggtgggcgcggcgtaccgagggcaccagggaccggtggaggacctgcagtggtcgcccaccgaggacaccgtgtttgccagcgcgggggcggaccagacgctgcgtatctgggacacgcgggagaaggtacttttggaagggggggccccttgagagtggggaatggaggaatgggaggggccctggggcaaggtgggtgtgggctggtacctggagggaacccctccacccccccctcccacccattgctccacccacaaacactgcacacagacgaagccgatgctgacggtggcggcgcacgaggcggaggtcaacgtcgccgcgtggagtgccagcacggcctacatgctggcctcgggcggcgacgacggcctgctgcgcgtctgggacctgcgcgcctttgcctcggggcagtacgtcgcgtccctgaagtaccacaggtgagggggaagggcgcggggacgtgcagcagaggtgttgagagcggggtttgcaggcggtgcagagcagcactgtcagcctgcaggccctctctcttccaagcaagccctggtccacctctcccccctcgcaacctcactctccggccccctgtacagcgcgcccatcacatccctggagtggtcgccgcacgagtcctccatgctgctctccaccggcgaggacggccagaccgcggtgtgggatctggccctggagcgggacccggaggaggaggcggcgctggcaccggagacgaacgccgcggtgcccgacgagctgccaccgcagctgctcttcgtgcatgccgggcagcgagacgtgaaggaggggcactggcacgcccagatcccgggcctcatggtcaccacggccgccgatggcttcaacctgttcaagcccgccaatgtgtgaggcactggcaggcggcgccgaatgcagccggcacgttcgctgctgccccaccacaatgctgcgtggagccgtctgcnnnnnnnnnncactggcgggcgccgccgaatgcagccggcacctttgctgctgccccaccacaatgccgcgtggagccgaaccagaatcccggaaacagtgtctcgtcgtcgaggtgccaagctgctggcacggcggcgcactcaggcggggggcagagtgtcaagaaggcccttgatccgctggactccggcatgcagggcggagctcgcctggtcgatgctgatgtagtctgggatgtcgctggggtccgaggtcggcgggtctgcttgggtggggtggggcagcctcttgcgttatattccccgcaaacaagaaagggccacaatcagtgtattcctgttggaggtccaagcgtgcannnnnnnnnnctggggtccgaggtcggcgggtctgcttggttggggtggggcagcctcttgcgttatactccccgcaaacaagatagggccacaatcagtgtgttcctgttggaggtccaagcgtgcgggcatgcatcacaaccaggccgcgccataccgatcgactgctgcccacctgaggagggcttggcggtggagaaagccatgaggaggtccagcaggctgctcgcattgctggcgagcgcgtgcagcgaaagggctctgcccccggcccgagcaccgaagaagcgctccagtgacttcacctcggcctcaagtgctcgcgggatgatgtgcctgggcggtgcggacagggagcatggggtggcgatgggatggccgcacaacatcccgtggaggctggagctgcagggtagcccacattgccgggtactgaacggtatcaacaagcccccccctttcacttcgcagctctcgacgtgggcctacgcaccagtaggtcgacctgtgggaggaaaggatgcgcagggtgctgctggcatcccagggcggccgatcctcctccttcagtgtctccagccacaggtcgcccacatcctgaaggggtttggtgacaacgttagtcattgctggagaggtgaggggagaggtgtggcagcacctgctcatccggcgtcaaggcacgtgtctgatgctgtggcattcgccaaatctaagctggcaccaaacccactccgcaacccccatgcccggcaccccatcgtcccaccagctggcgatagtgctggacggcaggctggaggttctcaaccaccgccgcctccatctcgcagaccatgtcggccagggactcggatctga

SEQ ID NO: 2128 - DNA, 2025 bp, Chlorella protothecoides
  modified_base (418)..(427): a, c, t, g, unknown or other
  modified_base (990)..(999): a, c, t, g, unknown or other
  modified_base (1064)..(1073): a, c, t, g, unknown or other
atggcggcagatccaaagcggtacctgacaacaagaggacggcggggtgggggatcaatcacaggactcggcagtctgcaccacaatgcaggacagcttggtcacacaagacagcccctccaatgcctctgctggttggaaagaggggcacaccacaatctcacaggctcaggatggccaacccatccgggttccagtccaccagtccgaaaagcggcaggcgggggaacgacttgctcacgtgcgacaagaaggctctgtcggaggggcaaggtgagggccagtggcccgctgcagctgatcacagagcctcagagcctggcagacatgcatggccatatgcagggtggaggctcaggcacagagctcccgtgcaggaatgctggaggcaccaggcatctcgtgacagactgggatnnnnnnnnnnggctcaggcacagagctcccgtgcaggaatcctggatgcaccaggcatctcgtgacaggctggaaccgggtggaggactctgtgcatccccgcatacaccatggtcgtcctcagatccccacagcccccgagcacctggtggcaaggtccggcatccctctcgcagtgaccaggatgcatggacactcttcccacagctgagctcgggtgagggcctgcacggggatggaggggaggaactcgacagtcctaagcgacgttcaaggacaggggagagtgatgctcccggacaccaggcccttgccgctggacagcacgcccagggcgtcgcggggcacattcagcagactgacgcagtccagcaagctacaggacacatctcgctggcagcgaaccaattcctgtgctttgagcctgtagtacacttcccgctgattgacgggtacccctgcagcaaggggtgtggatggctgagggacagcttcggcagtacatgtgcaatgcagattaccatgtcgagcaaaaccagcgacacaggatcacagcccttggatccgcccagnnnnnnnnnntgctgcatgcatgaaggagctcgtgggaggcaatcttctccaaaatccatcggaggagaccattnnnnnnnnnnaatgcagattaccatgtcgagcaaaaccagtgacacaggatcacagcccttggatacgcccatggcacaaccatctcaccctggacaagcgccgctttgcattcccgcagcacagcgaaaatgcgagcaaagtgctctgcactctccgggtggctcccaattagcgagcgccgagtcaaggtcttggaggatgtgtgctgcatgcatgaagtatctcggtcatgaaggtgcacatggccagttaacaacgcgccaagtctcgggcgatgcgattcatgaacaaattctcccaccgcttcctgcgcaccacatttatgtcagggagctggtgggaggcaatcttctccaacatccatcggaggagaccatccaccctctgcaccacctccgcggcatcgacatgaagatccagcgtgcagccatggacgttcatctcggccacacaagatctagatccccactgtcaaacatgtcactcgcgctcgttccccagcacggttacgtgctcggcacgttggtcggcggtgtcctcgtgcagaatgtgtggatggcgatccaggtgggcatggcacgccgcaagtacaaggtgtgctaccccaccatgtatgccaaggaggacactcccgacgccaagaccttcaactgtgtccaggtgtgcgctgggttaggcaattcgaggctccgggttggcctttgttcaagagaaggctcctggttcttgcccctgcatagtagacctcctggcgccctcacctcgccaatgctccactcactcatctcgcagagggcacaccagaacacgctggagatgatctccaccttcaacaccctgctcatcgtggctggcgccagggtgagtggtggcagcaacctgatcccaaggtcgaggggaaacgtcctctgtcgttcagcagtgcatgctgttgctccttggcccgttgtccacctgtag

SEQ ID NO: 2129 - DNA, 336 bp, Chlorella protothecoides
atggcgctcgaatccccccgcttcacgctccccgggctgcgctgggccggtgtacacgccagctggttgcagacagatgggcagcacatgcaggactgtggccggcttcagagaccagtggctcacaagcttgtcaccccttcccacttgccccaggcgctgacgcagcgcgaccttcgggtggcccaggggctgagggagcggctgaggggtcccgctcctcactgggccgccgagctggacgccatgctggccgcggggcgcaaggccgacattgaggcgctgcccggtgccctggcgccaacgctgctggaggcgctccggtgcgccatgtag

SEQ ID NO: 2130 - DNA, 723 bp, Chlorella protothecoides
atggactgggagtccatggccgccgagctgaagaaggagcgttcggcgggcgtgctgagcgccgccccggacgccggccgcctgctgcccgacttcccggagctggccgccgcggccgccggccccgagcccatggagctggaggaggccctgcccgtcacgctcgcggctggcggcggcgccaccgcccgcgcgctgatcgtggtggacaccaacgtgctcatctcacaccccgccaccctggagcgcctgctgcacgcgctggccgccgccgccgacccgccctcggctgcccgcgagtcgcggtcgctggaggtgcaggccctggtgccctggatcgtgctgaacgagctggaccggctcaagtccagccccgacgggggcaaggccgcggcggcggcacacgcgctgcagcgcctgcgcctgctgctcatgacccgggacgccggcatccggggccagacggcggccgagcacgccgccgtgagtgatgaggaggggtgggaggaggatgtcgtgcctgaaattgggagggtgctggtcgatggggccagagagggtgcgggggggcaaggcgtggcaggtgctgcggaagtggcagcacagcatgctcgcaaaaggtacacgagcagacaactggcgctcgcagtcacagcaaagcactgtatgccctcacacatgccaaccggcgatcccagcgccttcagcatccccacctcctga

SEQ ID NO: 2131 - DNA, 501 bp, Chlorella protothecoides
atgaggacgaagaagtccagtaaaaaggggaagaagaagtctgcatccgccaaggtggatggaggcgggggcccttcatgcatgccatggtgtgcagcgtgccctgccagcgttcatcgccctgctccccgccccacgcaggcctcggccggtcccgccgtccccacaaagcccgaggtatggatgcccggcgtgcccggcgccgagcctgacgaggaggggctggactacgaccccaccgcctacacctgcctgaccacgctgagcctgggctggccctgcctcagcttcgacatgcttcccgacgcgctgggcgaccagcgcaccgccttcccccacacgctgtcctttgtggcggggagccaggcgccctccgcccgcctgaacagcctgtcagtgtgctgcgtgaccaacctcaccgccctgcgccacggcaaggtgcgctgcgctggaccccgagggcggccggccggccgccttgctcatccgtgggccgcctga

SEQ ID NO: 2132 - DNA, 1287 bp, Chlorella protothecoides
cagcgcagcgcagcgcgcgaggtgggcgcgccggccggcgaccccggggccgggcgcgaccccgccgacgacctgggcgagcgcggcaggttcgagcactgcgcggctaagccgctggcggccgacgccgtgctggtggacgaggcctccatgctcagtctgcccctggccgcggcgctgatgcaggcgctgccgcccacctgccagctggtgctggtgggcgacgtcgaccagctgcccagcataggtcccggcacggtgctcaactgcatcctcacctcgggcctggtccccgtgaccgacctgcgccaggtcttccgccaggccgccacctcggccatcgtgggcgcggcgctggcggtccaggccggcgtggcgccgcgcctgccggcgctggcgcggccgggggacgtgatcgccgccgctggtggctccgctgccctgctcctgcccgtgccgcgggcgggggacctggtggcggctgcgcgcgacgtcgtggcggcgctgacgcggcgcggcgccgaccgctccgagccggcctgggcgtcgggcgacgtgcaggtcatcagtcccatgcgtgcggggccggtcggcacgggggcgctcaaccccgtgctgcagggcctgctgaatccggggggtcccgatgctgtcggcggcaggagcggggcagcacagagccacggcctgcgcccgggggaccgggtcatgcagctggtcaacgactatgaccgggaggtcttcaacggcgaccagggcaaggtgagggggatttggttgttgtgctgggggagggaaggggatgcaaggggcttcgtgacaaagcgtgcctgtcccaggacccttgctgccgacccatgcgctggcgcgcggcaccacggccccttgcgccgactcacgcatgccatgccctccacgaaggtggtgtcctgggaccccgccggcaaggtggtcaaggtgcagtttcctcacctggtggaggcggcggccgccgagagggcggaagcaccggcgtcgtttgccgctcgagcaggtgccaaccccgcccccgacggcgtctgctcgtaccagggctccgaggcgggcgcgctgggcctggcctacgccatcacggtgcacaaagctcagggtggggaggcgccctgcgtggtgctggtgctggcgccagggcacggccgcatgctggaccgccggctggtgtacacgggtgcgatcggggggtggggggggctggggagtgggtgcgggtcgatggtggagggttgctgggcgtcggtagagcgagcg

SEQ ID NO: 2133 - DNA, 1110 bp, Chlorella protothecoides
  modified_base (643)..(652): a, c, t, g, unknown or other
atgccaggtctccctcatggcttgggcgggtgtgttcttcaagaagggtttccaggcgtctgggaccatggacgagctcaagtggaaggtcaagcatggcgcagactacctgctcaattccctcgtcagtcaggacccctgcatctttgccggcgccaacggcaattccacacagtacgtccatacaggcagcagcggcatgactgccctgccgtggggagccggtggccacatggcacccaccaggccattgatctttctatcatgccattcatatcagcccccatatccctcacaacctgtctctcttatgataccaccagggattttgacaacttctcacccctggagtactacgagcagtatgtggggccccgccccaccggctacttcaccgctggcgatccgggcagtgaggccactgggggcgccgccgccgccctggcagctgccgcctacctgctcaagagcgacatgccagagtggtacagcgtgagtggcagagtggggaagagagaggagggaccccggcgacatccttttacatgtgttgtggctcatcatgtgcgactggataggatgccctggtccatcccgatgctgtgcgccagatcccacaccctttcctccccaccgccacccnnnnnnnnnncccgccagtcgaccatagcgaaggccactgccctgtatgagtttgcctccaccaaccccaagtctttcaagacgtcctccgacccagtcatcaagaatatgaaggagagaggagcattagatcgcataggattcacttgtgtgatttctgacgagcaatgcatttgcgtcaccgtgtttgatcccgtcaatcttctcaaaccatcccatcctccctccttcctctgcacgcagctcatgcaagccctgtatgcgacagacggtgactaccatgacgagctgacgtgggccgctgcctggctgtacaaggcaaccgggaagaagaagttcctgagtgaggccgagaagtggtgggcgcagtccaccttccacaacacgctggaggtatgctgggaggacttgggtggcgtgggctgtgggactgcaggattctttgagggagatcaggttgagggttga

SEQ ID NO: 2134 - DNA, 1230 bp, Chlorella protothecoides
  modified_base (56)..(65): a, c, t, g, unknown or other
  modified_base (244)..(253): a, c, t, g, unknown or other
  modified_base (366)..(375): a, c, t, g, unknown or other
  modified_base (551)..(560): a, c, t, g, unknown or other
  modified_base (691)..(700): a, c, t, g, unknown or other
  modified_base (754)..(763): a, c, t, g, unknown or other
  modified_base (822)..(831): a, c, t, g, unknown or other
  modified_base (890)..(899): a, c, t, g, unknown or other
atggccgaacctgcagcaaggagggaaactgcaccgacttcttctgggagtccacnnnnnnnnnnttcccatgagcctctccccacttcccactcatcccctcctcgtccaggtatgtacggcgagtcggaggtgcggcaggtcgagtttgccagcggcagggtgctgaggtcccgggcgctgccctcccaggactttgcggagggcatcaccaagttgggcaacaggtgcggggcggcgtgtnnnnnnnnnnaggtgggtgggtggtgggtgggtgctggagtgttgatgtgtgttgggaggtggctgaggcggcctggcaggcaagtgggggcaggggccaaggccccagcacagagcaggggnnnnnnnnnngggcaagtgggggaaggggccaaggccccagcacagagcaggggctccctcggatcaccgtcctatgaacctccccccacttcccactcggcccctcctcgtccaggcatgtatggcgagtcggaggtgcggcaggtcgagtttcccagcggcagggtgctgaggtcccgggcgcnnnnnnnnnnggatcggagcgcacccggactgtggggttttgctgttcgcgcagtggcagggtgcgctcacagccggccgcccggcacctgccccaccccctttcccccaccgcagcctgtaccagctgacgtggcgctcnnnnnnnnnnaggccgcccggcacctggtctttgccaggcctgtaccagctgacgtggcgctcnnnnnnnnnntgatcggggcgcacttggaccgtggagctttgctgttcgcgcagtggcagggtgcgctnnnnnnnnnncctgcaccagcgctccgtgcaggacgccggccgcgccgtgcccttcctcaacgagctgnnnnnnnnnncccccgcgcctgggtctatgccgcggaggacctgggcgcagcgcgcctggcctccacccccctcctcgacggctggggcatcaccaacgacggcacgcacctgatcctgggcgactcctcccccacgctcacctgggtcgaccccgggaccatggcccggctacaccagcgctccgtgcatgacgctggccgcgccgtgcccttcctcaacgagctggagtgggtggatggggccatcctcgccaacatctggggccgggagtgcctcgtgcgcgtcagccccaccgacggccgcgtcctggcctgggtggacctgcgggtgggtgggtga

SEQ ID NO: 2135 - DNA, 246 bp, Chlorella protothecoides
atggcgccagaggcatccagggacgccgcgtggatgccgtttgggggcgggccccgcctctgcctgggcaacctcctctccatggcggagctcaagatcttcctggccctgctgacacgaaggtacgacgtcgagttcttggaccatgcggaggcatggcactacatccccctggcccggcccctgcggggaatgccaatccgcctcagacccaggcacctcactggcaaagcgcccagcgcctaa

SEQ ID NO: 2136 - DNA, 576 bp, Chlorella protothecoides
atggagcctgccccggggcacaagtcacagtccctccgtgcggaggcggtgcagagcaacaacgaggtctatgacaaggtcatcgaggtgtttgcggacaagaaaccaagcgcttggcggaagctgatcgcctacagcaagcagtggcgggggatggccgacggcatcctgaagaggtgggagccagggatagtatccggggcaacctggcctgctgacatccaagagggcaggcaggaattcggcggcggtgtggatggcggcgcagcaacgccctcctggggtgcatggttgggggcacgtggaagacgggatccggggtggccatgcggcggccgctcgacgctcgacatgcgcgccgacgccgcctcggcgcgcgacgcggtggaggaggcagcgacgctgcgcaagctctcccgccgtctgcgcgctgtgcacgaggagctggagcagtacgtgagcctggcggaggccttccggaaacagccgccgggcgagtgggagagcatggtaaccacgcatcggcccacgctgaccatggagttcttctcgcacctggagctgatgtacatgtga

SEQ ID NO: 2137 - DNA, 579 bp, Chlorella protothecoides
atgatgctccctgccttcacccctcgggcggtgcaaggctactaccccttcatctccagcgccacctcggcggccttggaggcctggtgcggctcggcagaccctgtcctagcctataaagcggtgaactcgctggccctgaagatcgccattggcgtgatcgcggggaccggtgggccctggatgcaggccgaggcgttccctgccttccagcgcctcgtgacgacgtggctggagggcctgtttgcctggcgcatagacctgtcttggacacgcttcgggaaggcccgcaaggcacgagccgcccttgatcagatggtgctcgaaagcatcgaggcatcacgcagcgggacagagttctgtgccatcagggtgatgctggacgccagggatgaaaggggggtgccctactcgaccctggagctcctggacaacgtgatgaccctgctctttgccgggcatgacaccagcgccactgccatgctgtgcctgctggaggagatgcggaagcacccagagggtgtgcaagccctgcgtgcagaacaggcaggctggtcgaggggggaagctcctgtgtag

SEQ ID NO: 2138 - DNA, 273 bp, Chlorella protothecoides
atgcccctggcagaaggctgggtgaaagaaagcatgcgcaggaccccggtggtgcccatcgtgccgcgcaccgccatccagggttttgaggtgggcggattctgggtccgacccggccagccggtggtggctggcctgcgctccaccatgcagctggatccaaggtgggcggctgttgaaagttgctcgaagggagaaactgtttgggaggcagtgacggggatggggtgggcggagctgagggtaggactggaatgcgctgtgcgtggatag

SEQ ID NO: 2139 - DNA, 1146 bp, Chlorella protothecoides
  modified_base (620)..(629): a, c, t, g, unknown or other
  modified_base (787)..(796): a, c, t, g, unknown or other
ggagggtggagcgcggaagggaggcacccaaccgtggcggccccccccccgccctgccatcagataccttcacggatcacctccatgttgccaactgcagacagtggcaaggcccgggcgctggtggattgcttcgcggacctgatggacctgaggcgggacaggagccgcttgcacgcctacttcagggccgccaaggagagtgtactgagcagagtgtgtggcggcgagcgccacagcgctggccacacgcgagagggagggttgctcctgaaggcggaggaggcggagtgcaaagaggtggaggaagaggggtgcgaagaggcggaggaggcggagtgcaaagagactgaggaagaggagggcggagcggcggcttgccaggcagcagacatccgagtgcaggtagcgcatcagagtttccatggagccggagcacatgctcagggttgcgcgcctggttgcgcgactgtgagggccgaggaacttgcgccagcgagcctccacctcatcaaggttgaacacattgcgctgtcaacctccacgatcaccaagggtgaggaagccgaaccgtcaaccccccacgtcgtcaagagggagcaacccaagtcacctacctnnnnnnnnnnaatcaccaagggtgaggaagccaaaccgtcaaccccccacaccatcaagagggagcaacccaagtcacctaccttccatctcgtcaagggagaaacccctgcgccatcgagccccatggctgttgaccctggagggtcgcagtccgccacagactggnnnnnnnnnntagaaacccctgcgccatcaagccccatggctgctgagcctggagggtcgcagtccgccacagactgggaggatggctcgcctggcggccacacaccttgctcaaagatgtcgacgaagccccctgcttgtgtggatctcgccaacattgacgtcggggagcaggcacgcattctggcggacatcctggcgcagagggcgggtactgggaagaggaaggcagccgccgctgcctccctggtccagggcagcctgaagaggctgtggggaggcggaaagggtgtgaatctcgaagtcagcccggctgcgaccccctgcatgcgcgtcggggccgacctgcaggccacatga

SEQ ID NO: 2140 - DNA, 1434 bp, Chlorella protothecoides
  modified_base (658)..(667): a, c, t, g, unknown or other
atgctcctcgtgtacacaaatccctggacagcggtggccgccttcacgctggcagccatggctcgctccaatggtgagcctcctggcgtgggagcaaggggagggggtggggcctggggaccagacctgtgtctttgccacagtgattgctcctcagctcctgtgccaggcagtcaccctgactccctggccacttgccatggctcagcctgtgcctcacccgtcctccaccccctggaacatgctgcaggcatcctcgggtgctggttcttgatgcacgcgctactttctagcaccttccggaccggcagggtgtcgtggaccggcgtcctgcgatgttggatcgggtgcctcaccatctgcgcgccctacgccctcatgcaaggcatgacgcggaggagttggggctggggctggcttgcagttgccaggccagccggcatggagccgcttctggatgcagcactccagcccccgccctggtgtcagagcacattgccaagcctgtatggctatgtccagcggcagtactgggacgtgggtttcctgcgcttctactccaagctggatcgggtgaggcaccggcgagaggcaggcggcggcctgtccttgcgtggcagtgagacgccccctcagtgcctcaacccttccgtgctcnnnnnnnnnnggcaccggcgagaggcaggcggcggcctgtgcttgcgtggcagtgagacgcccctcagtgcctcaaccctttcgtgcttgctcctacccctgtacctcagcagggcaccagtactaaacctacccagccattccctgtccgccttctctcttctgcatctttcttcacgcatgcaacccccgcctgccttcctcccttcaaagccctaccaacacccccccgtcccaacccccctcatgaacacaccacagtggcccaaggtactccagtccatccccgtcgccgcactttccttcgccggctgctggacctgggcctgcgcggactgggcctgcgcgctatcgctgggcatggcgtgccgcgccccggccaggccgctcagtccgctggctcggacggggtcgggggcggggccgctgcggcgccccgcgcgctgggcccccggcccgccgccctcccgccgcggcggtgtgggcgcggccttccacacgctgggtgcgggcgtggcgcagccctgcgcctggccgccagaggcccccgccctggccccctacatctaccactgggcgctgatgacggccgtggccgccaccgccatgcacgtgaacgtggcgacgcgcttcctctccagctgcccgcccctgtactggtacgcggccgcctggatcaaacagggcaggcgccccgcgcttgtgctctggggctgggcgctggccttcaccgtgctgggcaccctcctcctccccaatttttatccctggacatga

SEQ ID NO: 2141 - DNA, 552 bp, Chlorella protothecoides
atgcagcaccccctctcctgcaagcacattggtgtccttcctcatcacacaggcagtgcccacacaaccatctttgatgatgtgtcggcctgggactcggtgttctttgtccgggtggcaaagtgtggttatgaaaccgacatgatcaatgctttctttccgctgctgcccttggtcatgcgattgggtagtgccttcctctgtgagtggtgggaaggggacggggtgtgccggggggtggtcagtgtgtgggggtttgtggtggggagttgtgaaagcaaagctcagggattccacgaaggggcaatgagccctggctacagcccatcatgttacttacaattgatctccaccatcaacgtagtacccctgcacggcctcatgccgttggaatctctcctgacactggctggcctgctgatcaacatcgccgccttctccgcggccgcccttgccctgtggaggtgtgtgcatgcgcagagagcggggcgggggaaggagacaaagtcatcagagtccatagcaatgtgtggtggatgtgctcaccggtga

SEQ ID NO: 2142 - DNA, 789 bp, Chlorella protothecoides
atgctcagctggcgcacgctgcacccgggctgggacatccgcttctacgacgaccaggtggggaatcgagcaaggaggagtaccccttcacatccttctccacaaaaccccccacaggactgcctggactttgttcggcgcgagttccccgagtacctggccgcctaccggagtctagagcgcgacgtccagcgctccgacttcttccgctacatggtggtgctgcgcctgggcggcgtctacgctgacatcgacaccgaggcgcggcagcccctggacggcctgctcgcctcctccgacactctggtggtgggctgggagagcgacttccccgacgcccaggccaccgtggacgcgtggtacgtgcgcccgcgtcaggtgctgcagtgggtgtttgccgcggcccctggccacccagcgctgcgcgccgcctgcgaccgcatcgcggcgggggtcgccacccgccactccctctcccctgccatcgacacgctggagcgcaccggccccggcctcttcaccgacgtggtgctggaggcggccgcgggctcgccctgggccggcgcggcgcgcgacccctggaccgtgcgcatcctgccgcgcgtggcctttggcgcacccaaggcccccgcccacgggctgacgccgctcgaccccggcgtggtggtcctgcaccacttcatgggcagctggcgctcgcgccgacgctggccctggcaggtgtcggcgggggaggtggcgcgtgccctggcccgccgcttcctggcccgccccggcgacgcggagtga

SEQ ID NO: 2143 - DNA, 2871 bp, Chlorella protothecoides
  modified_base (851)..(860): a, c, t, g, unknown or other
  modified_base (2002)..(2011): a, c, t, g, unknown or other
  modified_base (2414)..(2423): a, c, t, g, unknown or other
  modified_base (2540)..(2549): a, c, t, g, unknown or other
atgctcgccggtgggggggtgcgaaacaaacggggtcctggtctgggtggcgcgtctgtccaacagaccccgacaaaaggcagtggccggcttgtgcgtggtcgtggcagtcgtggccggcttgtgcggggtcggggcagtcggtgcgtcaatgggccccccaccacactgccctgtcatcgccatcctttcctatcctctgtccctcgctggtcccccctccaaatcaccccccccgctccaacaaccactcctagagctgcagaggtgaggaagctggaggctgcagaccgcggcgccgagcagctgtaccccacctcgctcaccttcgacccgccctacgtggccctggccccgcgcggcggcctgggcgagtctcagtccggcgccgacgtggctgctgcgctggccgcgcacgggtcctggcagcccagcgtgcagcccctgcgcggacccacgctggccgaggtgctggtgggcagcctgggcggcgttggccagcgccgcggcacgctggttgacgtcggcgcaggctacggcgtggtcgcgctggcggccgccgcgcgcgggcacgcggtgcacgcctttgaggccgggccgcgcagcgccgccgcgctccgcgcctcgctggcctacaacggctttggcgaccgcgtcgcgctgcacgagaccgaggtgctgggcgccgtcgtgcaatccgcgcggctgtgcctggatgtcccggcggcggggggcgaggctggcggtgctaccggtgcgccgccgctgggcgaggcggcggtggagctggcgcgcgggtacggcccgcccgaggcttacagagcgcgggaggagccgggtgagtgccgccnnnnnnnnnnatgctaccggttcgtcgccgctgggcgaggcagcggtgcagctggcgcgcgggtgggggaaacatgtgctgagctcgaaggaactgccggaggccactgtggaggtccagccggccagcccctggtccagctgggctcgcttatacgcacatgcaaccccctccctccctgtcatttcccccacccccccaaaaaacatgcagccaacggctgggaggcgcacatcctggagggcttcgcgccgctcctggccgcggcaccggcccccgtcatcgcgctggagtggaacccagccgcgctgcgccgcgcgggcacgcccgaccccgtcgccgccatcctgcgcccgctgcacgacgcgggttacacagaggcttcgcacagtggctacgtctgtgacgagcgctggtacgcggccacctacggcgtgcggcgccgcggcggggtcacgcccgaggagctggccgcgctgaggcagcccacctggtgccgcctgcacgtggaggactggggcgcgctgctggagcgcgcctcgccgcgcagccccgagacgctgctcttcgtcaatcgcgaggccggcgcagccaggcggcgcatgggaggcggcgctggtgatgcagcggcgagggctgggcacgcagaggcgacggggggtgacgagggggccaacgacgccgagccgggtgccctggcgcgcgctgccctcggcgcagccgcggcgaatgccggcggcgccgaggcggtggctgccgccggacacggcagccgcgcggcggtggagagtgtcggtggcgacactgctgcaaatgccgatgctgcagcagcgacggggaccgcccacgatgcccaggctacaatggaaactgccgacggtgccaaggcggcagcctccccctcgcctgcgggccaggtccgatctgccaccggcgcgaccaacagcctcggaggcgccgctgagctggaaaacatggatgcagccgtgcatgccacggcggcggccgtggccgacctcgcggatgcgcaggtggccttgcacagcggcggcgatgccacacgtccaccttacgttccttcagcccacacaaaatgccccaaccatggcccactggtttccctccaaacctgccgggctcgccttttgccgnnnnnnnnnngcgctccttcagcccacacaaaatgccccaaccacggcccactggtttctctccaaacctgccgggctcgccttttgccgccttccaacccctcggcagagtccgcaaactggcaggggcctgatcgttgcatcaccgccgggcatcacccccatgtgtgccgccgagcgacacacaggctactggaagaccaatctgtaccttgcagctctttaggacacccttgcattcctcactcgcagccagcctgctttcatttggcagccgtgcacataattcccttttcaaaccgcctatacactcatagaggagcagggcttacatccatgcgcagccaagggaaggtgaaagacgggcgcagggcggggagaatcgcgacgctgcaaagaatgggagggtcagnnnnnnnnnngaacgtgagacaggcgcagggcggggagattcgcgacgctgcaaagaatgggaggtgtacacgagctggtgaggcttctttggaagtcccacgctgggtgggccgcggcgacagtcnnnnnnnnnntagagtacacgagctggcgaggcttctttggaaatcccacgctgggtgggccgcggcgacagtctttaacacgtccaggatttcagtggtccacaacgaaggcccccgcggcgtggttgtcggccctctgtgcgccgagcttggggcccatgagccaggagaagggtttgctcagtgcgccggcccaggaggaaaggctgaagtccatctccacacacagcagctgccggtcggtctcaggctccctcacgctcaccaacatcgaatagtgaccctgcgtgcatgcaaggggatgttgagcatgtgtgaaattcagacttga

SEQ ID NO: 2144 - DNA, 606 bp, Chlorella protothecoides
  modified_base (385)..(394): a, c, t, g, unknown or other
  modified_base (464)..(473): a, c, t, g, unknown or other
atgtcaatcccctcctcgagcttgcttaagaggaataccccgacactctacccgcaccaacgccgtactattctcgtcctctgcctgacagcactgctcgccttcacaactccaatgacgaaagctcaggagcagagatggagaaactgctccgacgctcccacgcctctcacggtcgtggaggccctcgtcgagccttcgccggtgcaggccggcaaggaagctgctttcatgataaagtacgagagcggcatggaggtcagtgcaggcattctcgatgtcaccgtcaagtacctcggcattcatgtggcgaatgcgagccctggggttcatgccagccctaaatgctcgacccatgtgcatacatgcacttgtcactccgagnnnnnnnnnnggagtggtgcgcagttttattatgtgtggcggtctcgctccgctgtgtatagggcgaatgcgaggcctannnnnnnnnnggactgccccttgccagctgggagtggcagctttgtcctgaaagaaaagatgcctgccatcgcgcctccgtgtgcccgtcaggctgagactgcccttcagacaatgaccaatttcctggtttcccgtgattaa

SEQ ID NO: 2145 - DNA, 693 bp, Chlorella protothecoides
atggctacattcccaggtctcaagctccgccacgcatacccctgtgcactattcttgtcaccagcagccccctccccactgcgcgtcctgcaggcctgggaggacggcgaccacgtgctggtgggcaccaagtgcaaccagctgctgcgcctcgacacgctcaccgggcgcagccgggccatcccgctcccccccgccccgccgcgcgcgcgcgagaccttcgaccacgagtggggccactgcggcatccactccattgcgctgtcccccgcgcgccgcctggtggccaccggcggcgacaaccccgcggacgccgtggtcctggaccgcgccacctggcgccccgtggccacgctggtgggccacctggactgggtcttcggcctggcctggctctccgacgcgcacctcgtcaccgccagccgcgacgccagcgtggggctgtggaccctgcccgaggaggccgtgctgggcgacggcgccgggcaggacgaggccgatgcggcggccgacagggaggaggaggcgcgggcgggcggtgactacggccggcacggcgactttcgcaagtcctttggcgggaaggtgcgcggcgtggagtacgacgccgccacccggaccctggccacgctttccttggagggcgcggtgcgcctgcacgacccgggcgacaacctgcgcctcatacgcagg

SEQ ID NO: 2146 - DNA, 1158 bp, Chlorella protothecoides
atggccaggacaatcggtcggccccgtctttcatccccagctcccggccgcaaggcccaccggctcaaccgtactccatgtccctcgctccgacaggtgcccttcacgctgcacgtggtgcacattgacgagcgggccgctcactccgagaatgttgaggaaagcgggcccggcccctcggcgcatgcagcggcggtgggcggctactgcaccgacgccggggtcgccttccacgccgtccccctgcatgcagtgctgttggacggcggctcacacagcgggaccgaacccaacacggcggccggcgcaggacgcctccgcgcactgctggactcggtggccgacgcgacggcgcgcgacgacacgctgcgcgcgctgcgcacgcggctgctcctccgcaccgcgcgcgcgctgggggcgcgcagcctggccctgggctgcagcagcacgcgcctggcggcccacgcgctggctgaggcctgcaagggccgaggccacggcgtcgcggccggcgcgcgcctcgtcgacgcacgccacgggcccgcgctgccctttttcttccgccccttccgcgacacgtccacgcgggagctggcggcctgcgcgcacctcctggccctccccgtccccgcccgcgccccccagcgctacttggccggccggcgtggcgcgcgcagcatcaacctgctggccgaggactttgcgctggcgctgctggccgccaacccgtcggccgccagcaacgtgatgagcgtgctggaccgcctgcaggccttcgactggagcgaggctgggcgggcaggcggcgtggacgcacagacgggtcgggcgcaggaccggggcgccacgctgtgcccgctgtgcctcaacccgtgcgggccgcgcgacgggcccggtcgcgacggggtggtgcctgaagcttcgcgcctccccgtccccgccgccgaggccctggcgcagacctgcgccgcctgccgcgtcggggtgctggggcttggactcgggaggaaccacgatccggacgagggcacggccgccgcgctgctcggcgcctttgccgcgctggcggcggagcagggagaggagtcgctggcgggtcggccggcgccggtgccacgggagcgcatgcgcgccgccatcgccgactgcctgctctga

SEQ ID NO: 2147 - DNA, 1392 bp, Chlorella protothecoides
  modified_base (153)..(162): a, c, t, g, unknown or other
  modified_base (487)..(496): a, c, t, g, unknown or other
  modified_base (1228)..(1237): a, c, t, g, unknown or other
  modified_base (1328)..(1337): a, c, t, g, unknown or other
atgtcaccagcagggatctcgggtctacggatgcccccctacgtattcagaatgctgcaatggcccaatgcacctcggccttacgatccaagatcgggagtgattggggttggcagcttaaactgcctgcacatgttcggagtgtcgtacgcnnnnnnnnnncgtgctagggcttgtgattgggaatctaatagcttgagctgcctgcacatgttcggagtgtcgtacacaagcattggtagggcaccgatcgtgcaccctgcaggcagtcctgtgtgggggccagatcttagacgtgtgttgatgcattgccatcacgtttttaatgtaatgctttcttcgttcactttaaatcacgtcaccttgggaatcggccttgacgtattcagtaataggcatagcctgatgcgttcggaggcaccctaccacgagagcagtcacgaaaccatccctcctaatgtatggcaagctgggaagcttcgtactnnnnnnnnnntttaccacgagagcagtcacgaaaccatctctcccaatgtatggcaagctgggaagcttcgtactggcttgcagtccgtcaggacgacctgcatgcttggacctgaatggatattgagatatgcagcgcgcccagctgtcgctgcggctcgtgaagtgttcacccgccgggtatccttgtactcgccatttgtgttcgggcttgggacgatgcccgccgtccagcctacagcaagctcggcacgggcgggtaatccatgcataatccgatcgtaccctgcagcatgcgtgcaggcagcctctcgtggcctcggaagacgtcaccccccgcagccggatgccaggccccagcgactaggtggcagttttccaagcaggcccaggcacaccgcccgcggccccacccccaccccgtccgccagcctctctcccgacgcacccctcgcgccatccagcgatcctggctttggggcgcgcctggcatccctggccatcgcgctgaccaatgccttccccgtctttgtcgtgggcgcagccgttctgggcttgatgcgccccgcgtcctttgactggttcagggccgagtatgtcacggcggggctggcggccaccatgctgggcatgggcctgacgctgacctttgaggtgcggcacgaggagtggacattactgtatgagaaaggatggaatggcaatgaccctggccatcatgttgctgctctggctgtcgtgnnnnnnnnnncaggcagccgcggaagcacagaattctggggcccccctacatcacctccttcccccgtgctctcccaacctggcgcaggagctgcgccagnnnnnnnnnnccccctcatgggtcatgctggagtgctctgtattccgtgtctttggccatcctag

SEQ ID NO: 2148 - DNA, 555 bp, Chlorella protothecoides
atgcaaggcgttgacattgtctatggcgccgtgcgggtgccggaaccccaagatgcacccttccccgctcctccgacaccgcagtatccaggggtgtacccattcactcgtgggccctacgccagcatgtacacgggccgcccctggaccatccgccagtatgccgggtttagcactgcagaagaatccaacgccttctacaggggcgtcagcgtggcctttgacctggccacgcaccgtggctacgactcagaccacccccgcgtggccggcgacgtgggcatggcaggcgtggccatcgacagcgtggaggacatgaaggtcctgtttgacggcatccccctggaccgcatgagcgtcagcatgacgatgaacggcgccatcctgcccgtcatggccatgttcatcgtggccgcggaggagcagggggtggcccctgccgcgctcatgggcaccatccagaacgacatcctcaaggtgcgtgggcttgggttggagcattctgtatgctcttgttgtgggaggaggggggaagagctggagaggggggggtga

SEQ ID NO: 2149 - DNA, 714 bp, Chlorella protothecoides
atgcatctccccaaaccactctactcttcccccctttccccctttccccctttccagctgggctcgcaccccctcttctcccgcctgtcctcccacctggaccagcaggtgctgacacgcgggcgcgacgtggcgggctcgctgcgcgagcggtgggagacctccgactcccccctggtgcaccgcctgcaggacgccgcggactcgtggtcgcaggagtcggagggcgcggcggcgctgcgcgagatccgcgcccgcgaccccgacttcgacatggtccgcttcctcgcgcgcgtcagggctgacgtccccgtcatcatcggcgcctacctgcgcggcgaggcggacgtcatccgcgagcactgctcgcccgagatggtggagcggctgacggggatcatggccgccaccgcgcagtcggggcaggtgccggaccccacgctgctggacacctccgacgtggagctggtggacctgaagctgtcggaggaggcgccctgcgtagtggtccagttcacctgccagcagatcaactgcgcgcgcgacagccatggcaacgtcgtggacggcgcgccggacgatgtgcaccgcgtctactacttctgggcgctgcagcaggaggcagagggctacatgggcaccgacggcacctaccagcccccgcgctggcagctgcgggagatgatgatccggggcatgcaccacctgctgtga

SEQ ID NO: 2150 - DNA, 441 bp, Chlorella protothecoides
atggcggcggtgctcggcggcacacagtcgctgcacaccaactcctttgacgaggccatcgccctgcccaccgacttctcggcgggcctggcgcgcagcacgcagctgatcctggcggaggagacggggatctgcgacgtggccgatccgctgggcggctcctactacgtggagcgcctgacggcggagatggaggcgcgcgccggcgcgctgatcgacgaggtggagggcatgggcggcatgaccgaggccatcgtggcgggcctgcccaagctgaagatcgaggagtgtgcggcgcggcagcaggcccacatcgacgccgggcggcaggtcatcgtcggcgtgaacaagtacgccaaggagggcgaccagggagaggcgctggacgtgcgcaagatcgacaacactgccgtgctgcgcgcccagaaggcccgcctggag

SEQ ID NO: 2151 - DNA, 345 bp, Chlorella protothecoides
atggagctgcggggcctgacccccgcctggacggtggaccgggtggtgcagcttctgggcagccgccagcccctgtccatggcctgcgacacccacccactgaccctggccctgaactggccggggccagccgacgccgcgcgggcgcgggaaagcaaggcttcaagggacgtgggcgcggcgctcgtgcgcggggcctgcagcgccgaggagggcgagcggtgggcgtgccgcggggccgggcagccgagcatgggctgcaatgtgctgcggggcatggaggccgacggcaggggcaccttcacgggcctgctgtcctccaagtccgcggagcacatgctttga

SEQ ID NO: 2152 - DNA, 381 bp, Chlorella protothecoides
atgcacctgcaggaggcaggtgccacgcccaccctcgagctggcctacaccctggcagacgggctggagtacctgcgctgcgcgcgggacgcggggctgagcgtggacgacgtcgcgccacgcctctccttcttcttcgccatcggcatgaacttcttcagcgaggtcgccaagctgcgggccgcccgccgactctgggcccgtctcgtcaaggagaaattctcccccaaggacgagaagtgcctggccctgcgcacccactgccagacttcgggctactccctgactgcccaggagccacacaacaacatcatccgcaccaccgtcgaggtgggtggatgggtgggcggaggtatgtggctgtcggatggcgaacgctga

SEQ ID NO: 2153 - DNA, 1131 bp, Chlorella protothecoides
  modified_base (455)..(464): a, c, t, g, unknown or other
  modified_base (1032)..(1041): a, c, t, g, unknown or other
atgtctgtcctagcctctattgccggctggcttgtagcctttattttcctcagctatctgatcccacacacctttgttgcttggttttacaagacgcaaaacctgaagaagaagtacaatgctcagtgggcattggtgactggtgctagtagcggtataggcaaggctattgccagccgtctggcatcgcagggactgaatgtcgtcatggtggcatacccagacccgctcttggaagccagccatgaggagctctccgcccggtttcccaatgtcaccctcaagaaggtgccggtggaccttggacgcccaggctacatgccagctatcgagaaagctatagaaggcatagatgtccaggtggtcttccttaacgctggttacgtcctcacgggcttcttcgcggatgtaacgtacaaagagattgaaagggggcctctcaccccagccctcgnnnnnnnnnntaacgctggttacgtcctcacgggcttctttgcggatgtaaagccgtacaaagagattgaaaggggggcatctcaccccagccttcgatccatggaacgccaacctggagtgcaacgccgtgaatgcggtccagataacccatgtgctcctccaaaagctggtgagggtggaggagcttggggggcaccaagggaatctcataccaagctgcgggagttctggacatgctgctgcccatggcacaaattcagtgcagctcaaagtatatcaattcatccagagaaggacgtaaggaccaagcactacaaaaattcaccccgcaccctagattctgccgccacacatagctctcccttccgatacccccacacgcagctggacaagcacctgaaggggtgctttgtgtacacctcctccgcagcggcggccatcccaaaccccttctcagttctgtacgcttccaccaaggccttcatatcaactttcggcgcctccttggcggcggaggtcaagcccagcggcattgatgtgctcgcgtggtcgccgaggatgctgagtcacagtacnnnnnnnnnnaggcaagataccccccttggtgtcctgacattactcacggctgttattccttttgaagacgcggtcgctgaggatgctgaggcacagtag

SEQ ID NO: 2154 - DNA, 1197 bp, Chlorella protothecoides
atgaaggccctggcggccgaggtgacctccgcctttgcccggcgcctcgcccccctgggcatctcatcctctagtctctccaccaggaccgtctttccctcactgattttcccccttccctcccccactcatccctccataggtctgcgcgtgaaggagttgaccggggacatgcagctgagcaggaaggagatggcggagacccagatgatcgtgaccacgcccgagaagtgggatgtgatcacgaggaaaggcggcgaggtgagcgtggccgccacggtgcgcctgctcatcatcgacgaggtgcacctgctgaatgacgagcgcggccccgtgatcgagacgctggtggcacggaccactcgtcaggtggaggccacccagtccatgatccgcgtggtggggctgtcggccaccctgcccaactatcaggacgtcgccgccttcctgggcgtcaaccttcagaccggtgtggtggtggtggtggtggtggtggtgatggtgtggggggcgcaggccgggggaagggcacgaggattggtggtggaatcaccagagggggggactcggcatggtggtggggtggcacgaggattggtggtgggatcaccagagtgggggactcggcatggtggtggggcgtgcggccaggcggcaggacctgccagccgcctttctcatacccctcctttcctgatctcagccgcgcaacacacacacccctcccttccccctgaccccccccaaaccccgaccccctcgccaggcctgttctactttgatgcctcgtaccgccccgttccgctggagatgcagttcatcggcatctcggagaagaactttggtgcgcgcacgaccatcatggacgacgtgacctaccagaaggtggccgactcgctgaagcgcggcttccaggccatggtctttgtgcattctcgcaaggacacggggaagacggcgcggtccctggccctgcgggcgcagcaggggggcgacctggacctgtttgactgcagcggggaggagacgcacgccctgtatgcccgggaagtccagaagtcgcggaaccgcgagcttgccgaagtcttcgaagcaggtgggttgggtcgagtggatgggagggtaacggggcgtgtgaggtgttttatttgtgatgagagacgcattggtttgcggcggctcggccagatcacgtga

SEQ ID NO: 2155 - DNA, 345 bp, Chlorella protothecoides
atgctgcgctccgaccgcacgctggtggagcgcatgtttggcgccggcatcatcaaggtgctctgctgcacagccaccctggcctggggtgtcaacctccccgcccacaccgtcatcatcaagggcacccagctgtataacccggccaagggcggcttcaccgacttgggtgagcaagggtcgagcgagatttcaggaggggcgggtgggtgggaggaggggaagcggcaagaggcacatggcaaagagcgggcgggcagccatctgcagctttctgtgagggcccggcatgctgtgcgaggtcgtgccctcacccaaccacctgcaccgccgcttcctggctga

SEQ ID NO: 2156 - DNA, 378 bp, Chlorella protothecoides
atgctggacgtccagcagatctttgggcgggcggggaggccccagttccaggactccggggaggtgagccgtgcgggggtcctggaatgggacgggcagcaccttggcgaaagcggtgacatgttgagccaggtcagcatcctgccagatgagaaggcaagcgatgcgctcttaaaaccatcccgagccccaacactgccgcagggcatcatcatcaccacacacgacaagctggggcactacctgggcatgctgactcagcagacgcccatcgagtcgcagtttgtcatcgggctcgtggatcacctgaacgccgagctcgtgctggggacggtgagagaagggggaaggatgccagttgcaagggtccaggaatga

SEQ ID NO: 2157 - DNA, 564 bp, Chlorella protothecoides
  modified_base (247)..(256): a, c, t, g, unknown or other
atgccctcagcacagcttgacatggccctgctgctctgcgtctattcatggcctacgggttggcggagacttgcggctgccgcactgcgttttccatcccctttccctgttccttcattgcacctctactccatccaaccccctgtcccttccacgaaattctcccctggccaggtcaccaacgtgcgcgaggccatccgctggctgtcctacacctacctgtacacccgcatgcgcaagaaccccnnnnnnnnnnctggcggagacttgcggctgccgcactgcgtctcccatcccctttcccttttccttcattgcacctctactccatccaaccccctgccccctccacgagattctcccttgccaggtcaccaacgtacgcgaggccatccgctggctgtcctacacatacctgtacacccgcatgcgcaagaaccccctgccctacggcgtgtcgtgggaggagctgatggccgacccgaccctggaggccgcgcggcggcgcctggtgggggaggccgcgcgggagctgcagcgctgccgcatggcgcgctacgatga

SEQ ID NO: 2158 - DNA, 1440 bp, Chlorella protothecoides
  modified_base (90)..(99): a, c, t, g, unknown or other
  modified_base (671)..(680): a, c, t, g, unknown or other
atgccatgcttgttgcccctctcagcccatgtacaagaacgccatgcttcaacccacctcgacaggggcaatacagggctgccaggacgnnnnnnnnnngccacagtgcatgccacgccatgcttgttgcccctcacagcccgtgtacaagaacgccatgcttcaacccaccgcgacaggggcaatacagggctgccaggacgcaatcgattggctgtcctggaccttcctcgcgcggcgcctgctgcaaaacccctcctactacgacctgcggggcaccgaccaggcccaggtggaccgcttcctttcctccctggtcgaacgcgcggcgcaggaactcagggaggcggggctggtggcggcgcggggccgcgggggcatccagcgcctgccgccggcggggccctgcgcccggcacggcctcctgccgcgtggcatcccacggctgctccaggccctgcccagcgcgcgcagcgtggaggacgtgctcgccatcgtgagtggcgcagcggagttcgacgccctgcccgtgcgcttcaacgaggacaagctcaacctgcagcttgccaaggcggtgcgctggccaccgaggggtgcacgcatggcccgatcggcacctccctgaatggatgcggccccaatgcagcatcctgcatgtgctcgaatcccannnnnnnnnnggtcatgggcggtgatgtgcatgagaggcacaggcagcccggtgggcacctccctgaatggatgcggccccgatgcagcatcctgcatgtgctcgaatcccaccccctacctcgccaccctgcccacgcagacgatccacacaccaaggccggcctgctgctgcaggccggcctcgagggggtggccatgcccatcagcgactacaatgccgacaaaagggtggtgttggacaccgctgctcgcctcctccaggccatgggggagctgctgagtctgcaagggggccaagtgctggacgccacgctttcctgcgccctcctcggccagtgcctggctgaggggcggtggcatgaccagggcaaggggccgtctgctttgcctgcagatgtgctgcgtggtcgcacatccgaggcagccactcggcgccaggagaacggccatgcgccccgcggaggcagagggtccggcaaagccccggcagctccccttgccgtggtcgtcgaggccgagtgggcgacgcgcggggccgacgaagggagtcccactgcgtgccgcaccatctccatcagcatctcgacacgccaccccgagggagaggttgcattgagcaccgggcaggtgggcagctccacaggtcccaaggtgcgtccctggtgtcgtacacaggccatattatcatcgacaaagacgaccactgcgcccgctgacagtcacagccctgatttccgaccctcgtcatccaggcacactggctggtga

SEQ ID NO: 2159 - DNA, 519 bp, Chlorella protothecoides
atgcccgtccagtgttccaaagcgcctacacctttcgactccaggtacaccagcgcggcagcgcaggcttttgtggatggccttaccccgctccctgcagcgacgcccttccttgccgcctctgcggcagaggaagccgctgcggaggaggccgtcttcgtccccaagcacgccgagcggctgcagacgcagctgggagcgcgctggctggccggctggtgccagcgggtggcatcgagtggcggagaagtccccgcagactccgccagcctcgtccccgacaacgacgcggtgcccaccgccgccgcccgcctgctcttggagcagacctccgaggatgtgctggcggccgagctgtatgacctgctgggggagggcgtgtttgcgcgcataggtgggtgggctgttgggggagaggtttggggatccagggacacctgcacctggatcactaagtggaggcgagactggccctgtgttttctcaactcaccctggcaacacccggtctggcttctga

SEQ ID NO: 2160 - DNA, 453 bp, Chlorella protothecoides
atgggcggcactctccagtgctgggcatggcaatgctctcatgcagatggtgagaaaaaggccttgcggcctctcaaacactgcaacacccagggagttgcggtagccaggggtcaacagcgtggatgccatgtatccaacgaggtcatcttcctaacagccgctcctcgcattttgcccttcctgctctccccccaggtcggactggtcatcgtcgacgaggtgcacctgctgggagccgaggaggggcacaccctggaggtcgtcgtttcctcactccgccgcacggcccccacctcactgcggttcctgggtctggccactgccctggcgaacgctggagatctggcggcctggctgggcgtagcgccagaggtagagggatgtggaatgggcaaggtgcttgggagatgcgtgggtctaacaatgcaaagtgccagaccaggcctgtga

SEQ ID NO: 2161 - DNA, 951 bp, Chlorella protothecoides
atgcatgcatgccctagaggtgtgcggatcggcagcgcggtgcagcgcctgacccatgcgggcagggtgccgaggtgtggtggtggaggcccatcaggaacctcccagcactcccgcgccagccgcgcccgggctggagggctccacacagccttccgccccccaccccaccccagcttctgcctcccgccgtcggcagacccggtgggcgcctatgtccacctcccattctgcaagcgcaagtgcctgtactgcgacttccccgtcatcgcgctggggcgggcggtcgacaacgccgcccccgtccccgccatcgaggcctacgtggagtccctggaacgggagatcgccgccacgcccgcccagaaccctcatcctctccagagcgtctactttggcggcggcaccccttctttgaccccgccgccgctcgtcgagcgcctgctgcacgcgctggagcgtgcctacggcatcgcccccggcgccgaggtcagcttcgaggccgacccgggcacctttgacgcgggccgcctgcgctccctccaagcgctgggcgtcaaccgcctaagcgtgggcgtgcaggcctttcaggacgacctgctgcaccgctgcggccggtcacacagtgtggccgaggtccacgcagcgatcgaagccatacacgccgcaggcgtgccggcctggagcctggacctcatgtccgggctgccaggcttagaccccggtgcctgggccgccagcctggaggccgcggtggcggccgcgcccacccacgtctccgtctacgacctgcaggtggaggcggggacgccctttgccgctatgtaccggccggggcaggagccgctgcccagcgacgacgctgccgccgccatgtttggccaggccagcgaatgcctgcgtggggcaggtgaggggctgagtgcctgggcctggtgcgagaggggatga

SEQ ID NO: 2162 - DNA, 978 bp, Chlorella protothecoides
atgttcaagaaaaatatcaccgtgagccagacgtcgctgcttggtggcaaagacaacaagagcctgaaggctgcagcaaagaaatcatgcccctctctcagcgaagaccagctttcggatctgttctcctctaagacacgcatcaccctgagcaagctcaacaacaggtcgctcgtgtacggcagtgaggggggtgaccccctcttcttcgaccccacaggccatggcgatcgcctcttccccacggtctacacgctggcgaggtttccagacatgctcgagaagttgtacacctactcccccgtgtctgacaaggtcctgggcggggctgacctcttcctccagggcctcatcctccccaccgaccagcccatccccgctttcctggcgggcagcgtgagagccctttgcgtgccgggaaaccccatcccctttgcggtggggacgatggcggtgagcaggacagaggcacagcaggcggggatgaaggggagggggctcaccattctccattccttcggggacctgctctggcagctgggcagcggcgcggcacccaacgcgggattcacgccctcccgcatccatcccttgcctgaccaggctgggccagaggacgaggcctcccctcgagcaaaatccagcgtcgactccccgtctgatgatgcggagcctgactccccagatcagactgaggaagccgttcccagtatcgaatccctgagcgtggctgaggagagctcagcaccaccgccaaacggtgccctcggcctagatgagatgctggagcaggccgttctgggtggtctgcagaccctgaaggccatcgagctgcccatccagttttccgacttttactccaagcacatgctggcacaccggccgccaggtggattgtggggtggagtgaaggggagggattatgggagggagcctggcatggtggccaactctggaccgggagaggtccgtgggtag

SEQ ID NO: 2163 - DNA, 537 bp, Chlorella protothecoides
atgacggcgcaggagattggtgacctgctgcaccacccggcggccgggccgcagctggcagacgcggccgcctccttcccggccctgctcctggaggcccacccccaccccatcacgcgcaccgtgctgcagctggtgctgcgcatcacccccgcctttgagtggaaggagcgcgtgcacggcggctctctcaagtggcacatctgggtggaagacgccaacagcgaaaacatctaccactctggtgggcgatggaggggcacagcttgccacccacccctgctcggtccccacctccaccacctgccccacgaaccagagcaatggatgctgcagcggcacacagccagggccgggccccagaagctggagtttgtggtgcccatcttcgagccgctaccggagcagtactttgtgcgcgtggtgtcggacgagtggctgggcgcgcaattcctcctccccgtcccgctgcgccacctaaccctgccacagcgccagggcggccacaccggtgaggcagtggcatgcattctgtag

SEQ ID NO: 2164 - DNA, 375 bp, Chlorella protothecoides
atgcaggggtaccccagccggttctacagcccgcgcatggcttccatgaacaggccggcctatgtggccatccagacgcatgcacagagcagaccggcacagggagtggggcctgggctgaagggcagggtgacccgccgtggtaagggatacggtgatgttgcatccagggagcgccgaccaaccgagcactctcccggcaacccaggccattgtgtttgtgtcttcgaggcgccagactcgcgccacggcgatggacatcatcagccacgcggtggcagacgacaagccccgcgctttcctgcacatgacggaggcggaggtggaagacacgctgtactcagtgcgggtgggtggagagttgtggaggggtag

SEQ ID NO: 2165 - DNA, 216 bp, Chlorella protothecoides
atggagagctttggatttgtgcccgatgaccttgccaaggacttccagaaggccttctcctcctcatgcagtgtgggagaactgccaggaaagcaggagcacgacatggagatcacaatgcagggggaccttggtgccaaggtggcggtttggttcactgcacaccatggcatcccagccaagtacatagacgtcaagggctccaagaaggcatag

SEQ ID NO: 2166 - DNA, 261 bp, Chlorella protothecoides
atgccaccactgcaggcgcacaagctggacgctatggagttcttcaagaagatggcagtggacccagaggacctgccagacaccatatttgcctccatcggcagactggtgtggagggatgtcggacccacagccattggcttccgcctgctgatgaaggtgctggactacaacctgttctcaaccctgattgctgttttcgggcacctcatgcccgatttcaagcgccacatgaagccacgcgtgaagaagaccgagtga

SEQ ID NO: 2167 - DNA, 492 bp, Chlorella protothecoides
atgggggcagcatcctatctccaggggcggaggttcagccgacccaagtcgctgcctgcctatttgcgctggctggaagcctaccgggaaggccccagggaatctcctggcgcagaactgcccccggagagcaggagggacgtgcttcttgacgccgtcatgcttcgctcccggctcagaggtgagggtggtgctgtaagttcacccatgttccctaacctccttgcacaaccaccccagcctcaagctactgccgctgcccaccctccaccagacggcgtctggctgacggtcctgaaggacatcgccggggacaggcggcacgagccggccctgctctccgcgctcgagcctcatgtcgcagccggcctagcctggctggagcgagacggcgagggagctgccacgcacttcggcctcaccgatcccgagggtttcctgctttccaacgacgttgtcagcgacatcttcctggccctggacgagtcctga

SEQ ID NO: 2168 - DNA, 1770 bp, Chlorella protothecoides
  modified_base (131)..(140): a, c, t, g, unknown or other
  modified_base (969)..(978): a, c, t, g, unknown or other
  modified_base (1274)..(1283): a, c, t, g, unknown or other
atgctacagactggatcttccagggtctatggacgagatgggtgcattctgtcccgcctcgggattgcctggcaagtcgggcagctagcagcagaacgctggcgcgtgagtcaaggaatccctgctcctannnnnnnnnngcttacaattatgccccgtcctgcagtcctgcctcgggattgcctggcgagtcgggcagctagtagcagaacgcgggcgctgcgaagtggcaaggagccgtgtattctaagagcccgctttgggagtatgtaccagtccccagattgcccaacaagacgagcccattggggattatggcatgacggatcaatatttatggacaatgggtcgttcctgcgctatatcgagggttcagctggaagagccaaggctggcgcaggccccacctctccgcacagcgacccggcaacctggaccagaatcgcaccgatttctttcaactacgtggtgggggctctccccctgcccccgagcgtcgtccctggcctgccaccccccaacacacggccccctcgacccctggtgcagctgggagtctccagcgacctccgcctcggggatcctcccggtaaacatgcctccccaatctgcttccccctgaccatggatgagctggatcacaaggtccatggcagcagggtgttccccctcatccactccatgccctcgctggacctgtcccaggccgggagcagtgaccccggctcaggcgcctcggtgcactcccccagcgtggccggcggggcgggcggcagcgggcacggcgggcgcttcaagtccatcctgtcgtgcataggtgggccttgtgcagcaaggaggatggggaagggtgttgtagaggacagcctatcttgcagggtgagaggccggctgtgggtggcccctgtgttcgactggctcggcatgggtcccctgccttcctcctggcacttgatcttgcctgcggtnnnnnnnnnnggttgtagaggacagcctgtcttgcagggtgggaggccggctgtgggtggcccctgtgatcgactggctcggcatgggtcccctgcattcctcctggcacttgatcttgcctgcggtcaagccctcaatgtttttccagtctggggtccatgggcgcctgatcccatcaggctggttgtcctgtacatccgccggcgggagtcccccgggccgtgccgcgctgggtggatgacaggcggcacaccgccatttgcagggcccccttcccccaccagacccacccccctctttcacannnnnnnnnncgtcctgtacatccgccggcgggagtccccctggccgtgccgcgctgggaggatgacaggcggcacaccgccatcggcaaggccccttccccccaccagacccacccccctctttcacacccgcacacaagcaggcctgcagatggggcaggacgcgggcggcgaggaggaggtggcccctgcccggcgccctgccgacgtcgcgatccggcccgccttctactgggtggcgggcgccgcggggcaggaggccaaccccagtcagcgcgcagcggccgcggcggcctctcgctggctcaaggccgactgccaggacgaggcggtggtgttagacggcttcgccggcgtgcccggccaggtcttcgcaggcgtgtttgacgggcacggtccctacggtcgcgcggcagcaacgcatgccgcgcgcgcgctgccgcgcgcgctggcggcctcccgcgcggtgcgcacccccgggccgggtggcgcgggg

SEQ ID NO: 2169 - DNA, 2301 bp, Chlorella protothecoides
atgtccaactcgtccgtggacgagtgctggcgcgccgcgctcagtcgagatgccaaccagcaattggcgctctggaccaggctcattcccggcctcctccagaaggagggtacgtctggatccatccgatattgtacatccattgcagagaccccacaagggtggaggcgagggctgggtgccaagtgcacagtgtggggagcactgtgccggagtctgcacagtgtgggaagcgctgtgccggagtcgtggacaaggagcacgaaagccccccaccctcgtacaggttcagaggaggcattggtggacctcgtatttggcatagctgatcgcctggcggtcagcccgcggctccaggccagcagcacccctgtcatcaccaccgcccttggcaaccccaagttcaggcgagcctttgctgccgccctgctgcgcagcgacacgtccaagcttgctccaagggtaggtgatgtggggagccgatggcatggcaccacaggaggaattgcagtcgtcgatgtctctgctgcacttgcaggcggcgccgtcgatcgataccggggacatggagtctggcccgctgggtacacgcaagggcgttgtatttacatgcatacagcgatcccaacatcacccagtctcgctgcgcctcgccctgcgcaggccagtctcatcttcctgcaatggagcgggctgttgatcgcgagcctggatctggaaagcggcgccaaggcgatcgccaaggtggtggagtttcagggggaagtccgctccgggcctggagtccagagcgcgatggctgggcacactccaagctctccgcgcccacacccaccaaccccctcagtcgtcgctcctggccaagctggcacgtggaagcaggggcgaagctgcctccgcgatcgtgggcagggcgctgcgccgcgccccggccctcctccccgcctatttggaggtgctgcggtccggcggctccgcccacctcgccgcggccatcatgctggccgtggccggaaaggaggaacaggggaccgcgggcgctgccacgctggggctcttctgcagcgagcggggcctgggagcgcgcgaggccccgaccccggaggcgatggcggcctggcgcctcgccagccgggcctggggccccaaagagctggcggtgaggtgggcgtcccacccacccacccatcacccttccaccaacccctcccctcttctcccaactccctcccaggcaccctggcccccgcgttcgagagagccctgcgccgtgcgcccgacgccacactgggcacgctggcggcgcttgcccccggcttcgcgcccggctcagcccgtgcttcggaggccttcggcgccctcctaccccagctggtcagcgcggcgcgggcggggaaggaaagcacgcgcgccgcggcgctgcgtgccctggccgcgctgggcccccgcctgcccgccgacgacgcggcgcggggggccgcggcgcgcgccgcgctggccctcttctccggcgcggcggagggcaagatcaagggcgtgccggagcgcgcctgcctcgcgcaggccgctgcgctgctggcgccatcctttgcggatcttgcagttcttgccacgaatgagaccgacggcgacgaagacttggaggcggctggcgtgatggccgaggccgtggcggcctacgccggcgaggccagcgaggacggcaggctgggcctgctggaggcggtccgggcctgggcgcccgcggcgggcgccgccgcattcggccccgccctcctcgcccgcttcgaggcggggctgagcgagcgcgacgcgccgcgtcgcgcgcacctggtcgcgctggtcaccgcgctgcgctgcacacgctgcgtgcccccggccgccggcctggcgccggccctgctccgcgtcgtggccgacggcgccgccaaggccgtcctgcgccaggatggggtcctggcggcgctggcgctggcgcgcctggcctcagtcgacgccggcgcgcgggccgctctgcagaagtcaggcctgctggaggcgggcagccccctgctgcagccagcgacggcggccaagctgccacctgccgcggccgctgccgccgcagaactcgctggcctgctgctggaaaggcaggagctcctgctggggagggccgcctcgcaggacgtggtcccgctgctgtgcgacaccctggtgctcctgctgctgcaccacgacgccgccacgcggaaagccgcgtcagacgccgctggtctggccaaggacctgtcccccgccctctccggtgagggctgctga

SEQ ID NO: 2170 - DNA, 1176 bp, Chlorella protothecoides
  modified_base (801)..(810): a, c, t, g, unknown or other
atgaatcccactgtggacgagctggagaagaaggaggaagagctgtttcggacgggccccctgtcagttctcaccactagcgtgaagaccaactcccaggtgctgatcaactgcagaaataaccgcaagctcctgggacgcgtgaaggccttcgacaggcactgcaacatgattcttgagaatgtcaaggagttctggacagaggtgagcatcagtgcgggtccagggaggcagatgtcggatataacaaggcgatgtgcgggaaattcaaggtccccctcatcgccatcggggtccagtgtgcggggtggcctttgggtctcacactttccggccgacaccctgcgcccaggtaccaaagaagggcaagggctctgctggcagcaagccgatcaacaaagaccgcttcatctccaagatgttcctgcgcggcgactctgtcatcatggtccttcgcaaccccaagtagacctcacactgccgctgcacgacgcagggtccatgggacgagccatgcaggcacggctccacaagagcaaggcagcagctggcgcaggcgggccggctcgcacaccgccctctcaggcctgggactcaagggtgcaccccatgcagatcgaatgccaaggcttctggtgcccgagtgctccatgtgagacacacccacggactcctggcgtcacgccgagggcaggaggtcctcgaggaaggcagcaaactcgtcggcgtcgtcccccgcggggttcgagtggccccgcacctctggcgcgggggccccctgggccgccacttcctggaaannnnnnnnnngcccgcggagtgcgagtggccccgcccctctggcgcaggggccccctgggccgccacttcctgggaagacggaccgggcgacgcgtccctcccccgctcctcctcacggccacgcgccacccggccttcgccctccgaccccgccctgcgccgcttccgcgccctgccggcggccgcctccgcctcgcgctgcttgcggtggttgagctgcagggcgtgcttggggcacagcctcaccttcaccagcgccacgcgggaccgccccgcctcacagtacgcaaagggcacctcgaacgaggccaggccacgccgctcctcgcacccctgcgcggcggccgacgagcatgtgggcttgagggtggttga

SEQ ID NO: 2171 - DNA, 1491 bp, Chlorella protothecoides
  modified_base (857)..(866): a, c, t, g, unknown or other
  modified_base (1304)..(1313): a, c, t, g, unknown or other
atgcctgctgaagcatttccatatcgtcaaggagttgggttccggctcctactctcatgtgtgagttgcgagtgggtgatccttgccggcgcggtagccacggtagtcacgctcaccaattggatactattgctttctcgtgcatgcgcttgcaggtatcaggtgcagcgagtggacgatgggcgggagtacgccctgaaagccaccgacatgtccaagctgagcggcgtcgagcggatcagtctagtagaggagattcggtacctggcgtctctgtcccaccccaacatcgtgcgatactacgaggcctttgtggaggagcagtggctatgcataatcaccgagctggtgttgggaggggatgtggcaaccctgatcgagaatacgcgcaatgcgcactcctttgtgcctgaggacagcatttggagcatcttcctgcaaacagctctggccctcgaagagctccacaactgcaagatcctgcacagggacgtcaaaccagcagtgagcttgggtgaggaaaatgctaatcagacataacctcctgatcaatggcaacactgtcaagctgacagactttgggatcagcaggatcctggagcgaatcttcacccgcactcaggtggggtgaagcgcgagcaagaagatgtgggcgggaaaggcttactccctgtccagcgacgtgtgggcgctcggctgcttgaccctggagctgggcaccctgcgcttggccttccccggcgagaccgacgccgaggtggagcgcaacgtcatgctgaatcagccccccctgctgcccccgcgctacagcgacaacctggatgccgtgggaggtggagggcagaagggagggacgnnnnnnnnnnggggaaaggagggcggggaggtgtcttggcagggaggtggagggcagaagggagggacgccgagcgtgtcgggactggggaaagaaggcaccacgactgcggtggtgaaggccacagcgagggaatgagggagtggaagatatgtcctgcccctgcccgacgatcgacccccatcctcatcccccagatcctggccatgccagaggtgcgccgccagtggagcatcctgcccgctgcccttctttccaagctgcactctcacaacgacggtgcgccggcgcatcacatcctgcagccgatccaggtggggcgccctggaacggccgcaattgcttccggcccaagtgtttggtgccatgatggggagggccaagtggaaagtgatgtttcctccacagcaggtcctgggagtggcgcaccaggcgtggcgttctcgcnnnnnnnnnncttgcatccagcccaagtacttggtgccatgatggggagggccaactggaaagtgatgctttctccacagcaggtcctaggagtggcgcaccaggcgtggcgttctcgcctagaggagcctacgccctttctacatactctgtgctgcgtatttgtcaccctgccgaaggatgactga

SEQ ID NO: 2172 - DNA, 822 bp, Chlorella protothecoides
  modified_base (86)..(95): a, c, t, g, unknown or other
atgctggtgcgtatcagagtcaccgaccacggctctccgacccgctccggtcatccacccaccacgcacaggagaagacgcaggcnnnnnnnnnngcgcgggaaggaggcacaggatgctggtgcatatcagagtccccgaccacggcgctccgacccgctccggtcacccacccaccacgcacaggagaagacgcaggtggaggtgaccctgccgccacgcttggcagaggccagggaccgggcgatggacctggcagaggcggccggcgtcgcgcaggcggaagctggcctgcagctagaacccatggagtgggcggcctcggtgctccgcttcgggctcgcagagtcgaggtgcacatgcgcagctgcagtgattgtgactccctgctcatcgaccaagcgcccaccgaccagggactgcgcctgctgctgcggcacatggcagacgcagaactcaaggaacggcaccgtcgctgggggcgctgcccacgcatgccaaggggccagcactgcgcctgctgctgcggctcatggcagacgcaggactcaaggaacggcaacgccgctgggggcgttgcccacgcatgtcaaggggccaggagttccgggatgcagccaggatcatggggaacgtggaccttttcaagcagatggaggccgcgtcggagtgcatcaagcgcgacgtcatctttgctgcatccctgtactcgttccgtccggaagtctcggttcttgctggcagacactcaccccgacacaccaggccgtatcagtggaacagcctcttgaagaagctgcccttcttgggctgcttgtgtga

SEQ ID NO: 2173 - DNA, 780 bp, Chlorella protothecoides
  modified_base (264)..(273): a, c, t, g, unknown or other
atgctcatgctctactcccctggaccccgagacgagtacgccggggcgggggaggtgcaacgagacactgccgaacctgcaccggctgcgcagccggcgccccctcccggcctgaagctgatgggcaagaaaaaggtgggggtcgtggtaggattggggggctgtgtcctgttgtgggccttgccttcacctaccccctccaaacccgtccccccctccctttcgctgctccctcatgtaccttcctctttccccatcccactnnnnnnnnnnaccccctccaaacccgtccccccctcccttacgctgctccctcgtgtaccttcctctttccccgtcccaccacatctcttgacccagaacgacgacgacgacctgctgctcatgggcaagggtgggaagaaaggagggaagaagaagccggtggcagccctcgctaccccggccctcgtgctgccccaccgcggcagcgtcgctggcgcgcagtacctcatcgcggaggtaccgctgcgctgcatcaccggcatctgccgccagcggctggcggatgtggacggcccgggggtgttgcacggcacgcccgccgcgctttccacggccgtctcggcgctgctccgtgcccaggccgaggccgggccgtccggcgagcctgagacgctggacccggccacagacttgaagctccagagctacggtgagcatggagaggggggggggtctgaggagtggcgagggaggggtgggttgggagtgagggttttcgggtcattcaccccgtga

SEQ ID NO: 2174 - DNA, 1467 bp, Chlorella protothecoides
atgcagtcgcttcctgctgctgtcgcccacatggtcaggctttcagtgcgctatcccaccccaccgcccctcttgcagtctgcaaccccagactaccagcccctgctgagccagccctgctttggcgctgcgctggcagcgctgcagcgcgccacgggcggcgagccggcctccgaggacgccgaagcccgccctggggacacgccgctgccgggcccctctgcccgcttctgctttcccatcctgcgagccgtgctcagcgcgggcgaggccacgcccctgcacggcatcgccctggacgtgctgggtctgcatgtgggggccagcacaggcttgtccccgtcggacaccctggccctgctgtaccgcacgctggaggtgctgcccgtcatgcgcgagcgggtgcagcctctgctgtgcacgctgtgcgcctccctctctccggacgacggggacgcgatgagcgcggcgctggcgggtttgcgctccgcgcgcgcggccacgcgcggcgccgcgctgcgtgcgctgcgcgacgtgccggcgatcgctgacggcggcgcgcgcgacgagcccacgctctgcgcgctgtgggtcgcccgcagcgacggcgaggagcgcaacgccgccgcggcgctggcgctctgggacctgctgggtgccagcctgcccgcggggttcgtcagggcgatcgtccgcgattacctgccgtcgcgcgagggcgaggtgcgcgcagccgcggccgccgctctggccgcggggctgctggagtgccccgccgccgcgccagaggccatgcaggcgtgcctgggcctgtatggccgggacggcgcggcccccgaggccgcacgcctggggttgctggagtgccccgccgccgcgccggaggccatgcaggcatgcttggggctgtatggccgggacggcgcggcccctgaggccgcacgcctaggtgggtatcttgtgctctgggttgttttgtgggtgggaggttggccggcatgccgtcccggggggcgcagtagggctggtacttggtcttggcgcagtgcctttgggagcggacctctcctcttgcaccccctctcgaaacttctcgccagcccacaccggcttcctgtcatccccatcacacccatctccccccacccctcaggcgccgtgtctgggctggaggccatcgcgccgcagctgaccgtggccgagctgccccaggccctggacttcctgctttctcgtggcctcctggaacccgtcccggccgtgcagggcgccgtcgtcctggcaggggttgccctggtcaacgcgcacggaaagcacgcggccgcgaccatgttgcccctgtttgaggagacgctggcgcgcaaggtgcggaggcttctgggttggggatgggcatggggagggagatgtgtggggctgtgcactcaaggccatgcggcatcccatcgcccatgcgtttccatgtga

SEQ ID NO: 2175 - DNA, 882 bp, Chlorella protothecoides
atggcctccgcgccgcacgctgcccagcagcgccgggattcccaggccgctctgatggccatgggcgcgtacgagcggcacaggcgcctgctggcctcactggcgcactatggcgcgggcgcccggggacaggacccccccgcccccgcgcccctgcccagccgcaccgatgccgacgtgctgcgcgacagcttccgcttcatccgcagcgatgcggaggacgcggcgggcgacccctgggaggtgcgcctggcgcggcggtactacgcgcagctgtaccgagagtacgccatcgccgacctgtcccgccaccgcgagtccaggctgggcttgaggtggcgcacgcagcgcgaggtggtggcgggcaagggccagttctcctgcggagccgtgagtcgtgcaagggcctgcacatgtgtgccgtgggtagcattggagccatgtcgcctggctcgcctgctccgtgctggcgtttcaaccaccctcaagcccacatgctcgtcggccgccgcgcaggggtgcgaggagcggcgtggcctggcctcgttcgaggtgccctttgcgtactgtgaggcggggcggtcccgcgtggcgctggtgaaggtgaggctgtgccccaagcacgccctgcagctcaaccaccgcaagcagcgcgaggcggaggcggccgccggcagggcgcggaagcggcgcagggcggggtcggagggcgaaggccgggtggcgcgtggccgtgaggaggagcgggggagggacgcgtcgcccggtccgtcttcccaggaaggggcccccgcgccagaggtgcggggccactcgaaccccgcgggggacgacgccgacgagtttgctgccttcctcgaggacctcctgccctcggcgtga

SEQ ID NO: 2176 - DNA, 471 bp, Chlorella protothecoides
atggtggcattcttggtggccacagctttcttggaggatcatgagaaaccccgagtacccagctcagaacctgcatcatcatcgcaccgtttcaggcgcggcgccgcctttgggctggcgggtgtggtcaagggtcttggcatcgggtgcctgaagaactttggtgtgctggacacgctcaaggccgccgtccaggataagggcggcgccgacggcaaggaaggcgccctgctggcgtacgagtgcctgtcggagaagctggggcgcctgtttgagccatatgtcgtctccaccctgcccagcctcctgtcctgctttggagactcctccgccgcagtgcgcgaggcagcctccgcggcagccaggaccatcatgggccagctgtcggcgcagggcgtgcgattagtcatgcccgccctgcttcagggtgtggaggacaaggcctggcgcaccaaggagggcagcatccag

SEQ ID NO: 2177 - DNA, 684 bp, Chlorella protothecoides
atgaatgattggcctgagacgtacagcgcacccctccctctcctctttgggcagtctgtgcgggaggccgatgcggccacgagggtgttccaggccgagatgcgcgccctgctgcgcggcttgcgtgcggccgacctgcccccttactcgctggggtccctgctcctgagcaccctggacccgagcaccaagggtcccctgtctgaggccagactcctgtcagagctgagcaacatgtttgtggcaggggcagacaccaccggcaacaccctggcttgggcgctggtgagggagaggggaagggggagggagaggggggtttggtcgagcaccctgggcacgtgccatgccccgcccccccttgctgtcactccaggagtgtgcctcaccatgcagctccatccagtcatgcctgccctgtgctcgcagtacctggtgagcctccaccccggggtcgaggcacgagtggaggaggagctcaaggggctgggtctttgtggccccggcgcaaaggagctggaggtcggtgacctcggcaggctgcgctggctcagtgccgtcgtcaaggtaggatggggggcgttggggggtgcaggcaatgggagggtgaagaagggcatgcatgtggcaagggagatgctgacccgcaggaggctgctgaaggatgcgtggcatccaaactga

SEQ ID NO: 2178 - DNA, 405 bp, Chlorella protothecoides
atgtgtggcaacagacgagatgcgcgacgccatgatactgaagacgccctctgtgcctccccattgcctgctctgaggccccctgttcttcaacccctcctcaaaccaaccacacacttgcagatccgggacatcgtgggcaccctgctgcaggtgctcaacaccccctcagaggccgtgcagcgccgtgtctccgactgcctgccgcccctcatgcaggtcctgcagcaggaccggacgtatgtcgagggcgtgaccaagcagctgctgggcagctgcctcaaggcccgcagctacggcgagaggtcacaaggtctgggctgcctggggacgggggtttcgatggagtgttgtggcggccatggtggcattcctggtggtcacaggtttcttggaggatcatga

SEQ ID NO: 2179 - DNA, 141 bp, Chlorella protothecoides
tgatggtgagctggaactggaggaacttgcggatgttagcaaacacgttcctgccccacagcaccgccttgacgatggaggagaagttgtcgtccaggatgacgatgtcggcggcgtccttggccacctccgtgcctggag

SEQ ID NO: 2180 - DNA, 2370 bp, Chlorella protothecoides
  modified_base (298)..(307): a, c, t, g, unknown or other
  modified_base (1005)..(1014): a, c, t, g, unknown or other
  modified_base (1237)..(1246): a, c, t, g, unknown or other
  modified_base (2020)..(2029): a, c, t, g, unknown or other
  modified_base (2286)..(2295): a, c, t, g, unknown or other
gcgccgctgcgccccgcggacgcgcacccggccgccggcgccaacggcgccgcccggcccgccacgtccagccgcgcgacgtctggcggcgaggacgacgacgacgacgaggtggaggaggacgaggaggacgaggatgtgctggcggagggtgatggcgacgacctggacgagggcgaggagggggacagcggggccggcgaggaggatgacaacggcgagggcgtggagctgccgcccccgctggacccgctgccggggcaggagagcgccgactccgaggccacccagccctcgnnnnnnnnnnacgaggagggggacagcggggctggcgaggacgacgacaacggcgagggcgtggagctaccgcccccactggaccccctgccggggcaggaaagcgccgactccgaggccacccagccctcgggcgacggccaggccggcggcgtggaggtggtgccctggaggtgggtgccagggaaggtgggggggcggtgtgcgcgagggggcgcgcacaggatgtgcccgggaggggtgtccggcaggctgggccctgggcggcatggcacggagggcgcgagcggggcgcgaagctcgcgggcgtccacccaggcgtgtgatgcggccgggaggggtgtccggcaggctgggccctgggtggcatggtacagagggtgcgagcggggcgcgaagctcgcaggcgtcgacccaggcgtgtgtgcgtgcactttttatgacccggcgtccccacccggccccaggtcccagcgcggtcccctgaagacgtgcacggaggccgagttctacgcagacctctccgccttcctgaaggagcgcaaggtgaggcggaggtgtgctgccgggctctgcgcggtggggacgggcctgaggggcctggcgcctggctgcaacgccctgcatcacgcccctgcctcctgtggcggcgcatcacgcgcgggtctggccgacacggccaccatggtgtgggcatgtgcactgagnnnnnnnnnngcgcacgggtctggccgacgtggccaccatggtgtgggcatgtgcactgagggatccgccctgctcagccgccctgcaccccttccctcccaccccccacagggccggaccagcgggttcttcccagtcctgaatgccctgcagcttgacctcttcaacctgtacaacctgctcccccgccccctccccttcccccagggaggtgtgccagcgtggcggcttnnnnnnnnnnctgagcctgctccctcgccccatccccttccccagggaggtgtgccagcgtggcggctttgccctgggcaacggcatcaactggaagggccaggtgttccccgccatgcggaacttcacgcaggaccaccgcctgacgggggtggggaacgcgctcaagcgccactaccaggtctgcctcctggattacgaacaggtgagcacctgggcgggatggacaggagaggggcccagggtgagaaggatctgggcttgacaacaggcgcatgctctcgtggttttgtgcaagtatgggcaggggccggcgcaggggcagcctggtctgcttcacctgtcactggcgcatgccctcgtggttttgtgcaagtatgggcaggggccggcgcaggtcagcctggtctgctgcacctgtcgctggtcctcctgcgacctgtcaaacgtcgcacaacaccgtcccaggcgcaacccccttccctcgatgctcctggcccccctcattcgcaggcaaaccccgacgacgtcaccagcggcaactgtctggtgtgcgggcagggcgcaggggacgactggatctcctgcgacaactgcgaccgctggctgcacttctcgtgcgacaagcgcccccacccaggtgcgggctgtgagcctgcgacttggcgtgccgagaggcacgtgacgtttggtggtgtgtgcccacctccatggccgcccgttcgctggcgagtgtcggtgccggcggggcacgtcactcgcggcacggcgggccccgggcaannnnnnnnnngggcacgtgacgtttggtggtgtgcccccacctccatggccgcccgcccgccggcgagtgtcggtgccggcggggcctgtcactcgcggcacggcgggccccgggcaagaccgccgcctgatgcagtccctccatcgatcgatctccggcatgcacctgcccacgcacaaagcatgcacacctccgtgcgcgctcgcaccgcatggagccacctgtcaacgccgcaccccgtcctctcaccaccaaccccgacaggnnnnnnnnnnagatcgattgatctccggcatgcaactgcccacgcacaaagcatgcacacctccgtgcgcgctcgcgccgcatga

SEQ ID NO: 2181 - DNA, 1515 bp, Chlorella protothecoides
  modified_base (760)..(769): a, c, t, g, unknown or other
atgaagagcacgggggtgaacacggcaagcattgaatggtgcacctgggggggttgcatgcatgcacatcgtaggccctgcctctcctgcaccctcccaccccccgcctcactcccctcgcacagcatcatcacgatccacaacaaccccgagaacctggccgtggcggccggcccctcccgcctggccatccagcttgcggacgtgacgacggccgaccccgcgccctggttcgaccccgtggcagacttcatcgccggggcccgggccaggggcggcgccgtgctcgtgcactgcggcgcgggggtctcgcgctccgcgaccctggtcatcgcacacctcatgcgctcgcggggttggtcggcggagcgcgcgctggcgcacgtgacagccgcccgctccgtggcggcgcccaacgatggcttctggcgcgctgtgtgcgcgctggagtcgcgcctcggcctggcgcagcgcagcgatcctgacaagtttgcggggtccaggggcgcggacgccggggacgagccggcggctgcgccggcgcggggagcgggcagcggcgtcggggtgggctcgcgggccacctttgtgcccgcaggctccccgcccagagggggaggcgacttgaggagaggagagggggcggggagcgcagagacaggagcagagaaaggaggaaagggtctcggagtcccaggagcaggagatcccagagtcccaggagcaggagttcccggagtcccaggagcaggagatcccnnnnnnnnnngggcggggagcgcagagacaggagcagagacaggaggaatgggtctcggagtccaaggagcaggagatcccggagtcccaggagcagaagatcctggagcccgaagtcagggaggtctaggagcaggagccgggagggccgcgggagtgggaggaggcgggagcagggtcggcgggaggagtcgccagatgccaggcacccggcgcatgagccttgggaggaggcgggaggagtcgccagatgccagacacccagcgcatgagcctgttgttgaccctgcgctcggaccctcgctatcgatactgctgacagtgctgcgcgatgacgagaccctggggacgctgacagtcgaccttccagccccgggccaggcctgcacctttgggcggatgcccagctgcgacgtccccttggagcatccgtccatatcgcgcgcgcatgcccagatcaccctggaaggcggctcacgagcgatgctgacagacctcggatcgggtaggcatgcggggggtgggcgacatttctgcgaggatttgcttggactgcccagcatgcaggcccgcagctcaattcagacagggcgtggcatcaccttgcacccaactcattacatgggctcgtccctccaaccatgcatcacccaagccccatcttccccccaccaccccatgcagcgcacggcacaaacatctctggggtgtggatacgccccaaggtccctcgccggctgcaggagggcgatgtga

SEQ ID NO: 2182 - DNA, 636 bp, Chlorella protothecoides
  modified_base (127)..(136): a, c, t, g, unknown or other
atgtggcgttgtgtcgaagatacgcggtgcgattcagtaaaaggcggaattgcaactcgttcgtatctacgacgccataccgaaatttgcgccgtccgacctatatgttgcaggcctcgcgtcgcannnnnnnnnngcaactcgttcgtatctacgacgccataccagtacttgcgccgtccgacccatatgttgcaggcctcgcgtcgcgatgtcaacatccgattatgggttggaccgaggaacctggtgaaggcaccgaccacgcacatttgcgcactcgcaccacatctcacttataatcacagcccatcaacctcacagcatccattgtgtcagctcatcgatcggtccttggcgatccacccacatggccatcctccggcactcggagcgatggaggtgcggtcctgtgctcacgatgccatctttcgaacctttacccgctgcggcgaggacccactgacactgctggtggatctccggccagccaaggaattcctcaagcgccacatcgcactgtcctactgcatccgactaacatcgaatggccaggccctggttggtgagcgctacggcagaaaggggaattgtaacagagtatcagcaatgtgtgtgcagctgaatggctcgtag

SEQ ID NO: 2183 - DNA, 1794 bp, Chlorella protothecoides
  modified_base (926)..(935): a, c, t, g, unknown or other
  modified_base (1607)..(1616): a, c, t, g, unknown or other
atgggtgctcggcctaggctggctgggatttgccttctgggctgtgtacaatgtgccaggcgggtgcgccaacaatcagagggtcagagccctgcgggcgatcctctactcctttgtcggcctgtttctcgtcatcgtgtgagttgtgtggaggggtggagggcacaggaagtccggcgtgccatgttgaagcctgtggggttctcgtgtgtggacaatcatccccacagctcacctgacggtgtgcatgctgctcccatcaacagctcagcgtgcactctctccccatcccaggctgatgttcttgctcggatacaatttgctgggctcctacgagcccaatgctcgctggcagagccgccttggtttcatttccaagtgcctcgggtgctacgacgtcgtgaccgactccaacctcatgccagagtgagttttggattgcggtgtagggttttgtcagtccctgcccatcatcataccgggcctgaggagcagacattcagggttgaattgacttgcgccggctgcctgaccctgccctcaacgtgcacaccagcgaggcacccacccacaacgcctttcccaaccagtgaccacgacgccccgctggaggagctggcgtccacctttgcgcgcttcttcggctgcgtggatctggagaagagcgacctggtggcgggcgtggtgctcacgggcctcctccagacgcaccagcgccggtcggcgctcgagcgggaggcgacgcgccggcgcggtgtgtctggcggcaaaaaggcgcaggtgccggggcccatgcccgctctgccgccaagctcacactcctgggacgaagtgcagggcctcgtcgaccgctactgctccagcgtagcgccggggtgtccccgctgccaggggcgtgcaggccctgggcggcatcccggcggcgnnnnnnnnnnagagtgtccccgctgccaggtggaccagttgcagagcacgtcgaacgacgacgcccttcaaggacgcacgcagcatcctgatgacgagcagctgccacccaggggtgtgcaggccctgggcggcatcccggcggcgccggtgcaggatgtggcagaggcgggcggggattcagacttccagggtcgcagcggggacggcagcgccggcggcggcggctcgacgccctcgtcccaggcccccagcagcgaggcggaagggggggtgctgcgggactgggacggccccttcctgcgctgggtgacggcggtggcggcggggtgcagcacctacgtcaccccctcccactgggcgggggaggaggcgcgcgcggcgggggtggacccggacgaggcagcgcgagcgtcggcaggggccccgcaacccgccagccaggcggaggtcgacgacgcggcgtactgggcgcgccacgccatcgccgcctacggcagcaccgcctacatctggaccaccacgaggcgagggggggtttgcgtggtggttcacctggagctactggcgcaatcggatcgcgctggccctatccctgtaccccaggaagaaggtggcggctgcggcctaccctcccgtccagaagaagattgcggaggacaaggaggccctcaggcactacnnnnnnnnnncgcggctgcggcctaccctcccctccagcagaagatcgcggaggacaaggaggccctcaggcactacgtaggcgcgagaaaggtaccttgtgtttttgctgattttgagtctggtggaacttgggcggtacagtcagccaagggaaaagcttgcggagggactttgattgctcactga

SEQ ID NO: 2184 - DNA, 960 bp, Chlorella protothecoides
  modified_base (375)..(384): a, c, t, g, unknown or other
atgcattgcgcaacgctgcacgcatctctcccctctccacaccattcacatactccccccctcccccaccaatccaccagacccaccaggacagtggtgctttccatccgcggttccagcagcgtggaggacctgctgaccgacgtgatggaccgccccgtccagatcaacgactggctgcccgccgacctcaccgccgcccaccccgacctgggggaggtcagggcccacgtgggcatgtactccgcggccaaggcggtgctccgcgaccttgactcccaccgcctcctggacacgctgctgacggggcgcccgccccccagcgaagagcgcgagcgggaggcgggacggtatgcgcccgacgcccgcgaccgnnnnnnnnnnacccgcgagcgaagagtgcgagcgggaggtgggacggtatgcgcccgacgcccgcgaccgcgcgttgtgccatgcccagcaccgcctgcgcgccgagggctgggtgccggggtcaaagcggggtggcccgggggctggcggggcctcgggccgcgcagcggccgtcctgggcagcccgctgcatgcctggctggggcggggcctgagggggcggggccacccatcccctggccaggcccccgacgaggcgcagctggcgcggctgcgcgcgcggttgcggcgcggcgggccgctggaggagcggctgggccccgaggactacgccacgctgctggcggcgcggcgcgtggactgccgcggctggcggctggtgctgacggggcactcgctgggcgccgcggtggcggtgctggtgggcatgcgcctgcggaccctggcgccggggctgcgcgtctgggccttctcgccgccgggggggatggccacgcccaacctctcgcccctgctggaggactacgtgaccaacgtcgtgattgggaaggacgtcatcccacgcctgggcaccatcacctttga

SEQ ID NO: 2185 - DNA, 1098 bp, Chlorella protothecoides
  modified_base (512)..(521): a, c, t, g, unknown or other
  modified_base (909)..(918): a, c, t, g, unknown or other
atggagatcgcggacgcgcacgccagcgcactacgcagcgctgggccgcgacgccgcgggcgggcaggcggtcaacctgcgccccgcggcccgcccccaggacgtctactcacagatcgcggcgctggtgcgcgcgcgcgtggaccgcgacgcggcggcaggcgtgacgcacgcgcgcgcgctgcgcaacgccacgcccatcgaccgcaagctggtcaagcagacggtgatgaccagcgtgtacggcgtgaccttcgtgggcgcgcgcgggcagatcacctcgcgcctgaaggagcgcgggttccaggactcgcgcctcatgtacaaggtctcctgctactctgcaaaggtgggtcggatgtcttgggctgtggcgggacacattctgtcctggggcaatgggctgtgggttgggggttcaaggagggatccccggtgatgctggacattcctcgtcccatacccctcacaagcaaccccctcttccaattctcattcccccaccccccccnnnnnnnnnngtgctggacattcctcgccccatacccctcccaagcaaccccctcttccagttctcatccccccccccccgccgcatttcccccttaccccccaaaggtgacgctggagtgcctgatggagatgttcagctgcgccaaggacatcatgaactggctggcggagtgcgccaaactggtggcggggacaggggccactgtgcagtggaccacgccactgggcctgccagttgtacagccgtaccgcaggaccacacggcaccacgtccgcacactgctccaggtgcccgggtggtatgggagggtactggatgcgcgtgaggggggagttgcgaggatggaagaccccggcacagggcgtggagggctgccctggagcttggagggctgnnnnnnnnnnagagtgcgccaagctggtggcggggacgggggccactgtgcagtggaccacgccgctgggcctgccggttgtacagccgtaccgcaggaccacacggcaccacgtccgcacgctgctccaggtgcccgggtggtgtgggggagtactggatgcgcgagaggggggtgggtgcgaggatga

SEQ ID NO: 2186 - DNA, 1137 bp, Chlorella protothecoides
  modified_base (740)..(749): a, c, t, g, unknown or other
atgctcctctgtcactcatgttccccttgccacctcccagctcaaagtacacacacacatttcctcacaaaacctgccacccatacaaccacagaggctggtggtggtggagaacaacgacgagctgccggtgatgaagacgcggcagcgcaccgcctttccccccaacttcatccactccgtggactccagccacatgatgatgacggccatcgcgtgtcgcagggcaggtgtgccgcggtcgggcaggcctgtcttggggcgctgggccgggctgagcattgtgaaggtggcaagcatcagccgcgtgcctcaggaacatggaggcgtcggtggtgcgaggcgcccaggtgtgccgcggtcggacaggcttgtcttggggcgctgtgccgggccgagcattgtgaaggtggcatgcatcagccgcgtgccccaggaacatggaggagtcggtggtgcgaggcgcccaggaacgtcgcatccctttcatgcatcgcagggatgagttttgctggtgtgcacgactccttctggacgcacgcgggcgacatcgagcagatgaattccatcctgcgcgatgcgtttgttgagctgcactcgcaggtgagagggttgcaaagaggacagcacggttgccatgtttttgaagtgcagactgcttgggcaggggcgctggcgtccctcgaggagaatgatggccgctgtcattggtcggccctcaaggctcatctgagatggtnnnnnnnnnngaaaagaggacagctctgttgccatgtttttgacgtgcaggcttcttgggcaggggcgtcgacgtcccttgaggagaacaatgtccgctgtcatcggtcggccctcaaggctcatctgagatggtccctctggcatggtcatggggatcaactctcacttgcatccgggtcccaccacccttgcccgtgcctgtgcacacttgctgcctccgatggcaaagacgtccagatcaacatccctcactcccacaccttgtcgcagccgttgctggagaacctgctggccgatttcagggccagcttacccgaggtggagtttcccgagctgcccaagaggggcgacctggacctggaggaggtccgcaaggcagagtacttctttagctga

SEQ ID NO: 2187 - DNA, 792 bp, Chlorella protothecoides
  modified_base (559)..(568): a, c, t, g, unknown or other
atggcagctctgggcgttcactcggcaacattgcacccctacactctggtcgcgcggtggcagcccttggcaatgggacccaagccagccaaggagtggcgccgatggcggcccagtgaccctccacgcgcctcccgctcgatgttccctcgtgtaaatgcatctatggatactgcgaccgtggactgtacgacggcacgggacctcagtaacgtcctgtctctcaacaacatccggcagacgctcatccggctggaggacacgattatcttcggcctaatagagcgagcccagttcgcacgtaacagtgctgtgtacgaggagcctggagtggaagtgcctggctgctcccgaccgggctgctcgttgctggagtacatcctcagggagaccgagcagatccatggccgcatccggcgctacacctcccccgatgagaatgcctacttccccgaggccctgccctccctgctcctcccgcccatcacctatgagcaggaggcgttctcagcctcgttccaaggctcagacccacaccgcccgccaccccaggttctgnnnnnnnnnnaagtgccggatggtgagcaggaggcgttctcagcctcgttccaagcctcggacccacaccgcccgccaccccaggttctggctccttgtgctgcatccatcaacctcaatgaatccatcctcaagctgtaccttgagcacctcatgccggagatcaccgagcctggtgatgatggcaactatggttcagctgccatgtacgatgtcatgatcctccaggtgtga

SEQ ID NO: 2188 - DNA, 534 bp, Chlorella protothecoides
atggcccacgtgagcaggtgccctgagtccctatatccagtacctgcattctctgagataggtgtgtatatgaggcttaccacttctcccctggcacgatcccattgccaggcactctccaagcgcattcactacggcaagtttgtggcggagtccaaattcctgagccagaccgagaagtacacacggctaatacatgcacatgattcagagggcctcatggcagcaatcacagatgctgtggtggaggccaaggtgaggagctgcatggattgcagagtgccggagtgccctgtgctgctagtgattttccataccttgcagtcaccaggggtctcaggaagccagtcactgccacctgcgcaccggcgacgtgattgtgggcacggactcggaggcggcggagcagaatgccaaggtgcgaccacaggcggtggcgcagctgtacaaggactgggtcatgcccctcaccaagaaggtggaggtggactacctgctgaggcgcctggaagactagtgcatgattctttatga

SEQ ID NO: 2189 - DNA, 1098 bp, Chlorella protothecoides
atggctcgcaatgcacacttcaccaatctgcacccctccccacggttgcacaacaacccaccgcaccacacagtcagcatcgacgtgggcagctgcgacttcatccacactcagactattgtatgtcgtatctgcaaggatgtacgcctgctcggagggggcaccgattactcttgcacactaacggccaccttggctgcctcagacagtaagtggtcgggaaactggagcgtcgctcgggtgtatttgcgggcgacgaggtactcggcagtctcgggcacccgccacggataccgcattccttcgacccctcagaatcaatctggcattgtgggaagaaggcatcggatcgcttgtggtggagcaggtggcgctatgctgtcccgtccgctgcgggcctgttacaaagccttgctccgacaaatctgggagttggagcggacacctctagctttcaagctacagactccattagacaagcatgcatggctgcgacagggcggtggtcacgggtgggccaaggttggatccgagcaccgagcgcagacggcgcgcctgctcctgccctggctggctgaggtgagggatgcaggctcagatggggcgagaggggatgcagggtattttgttgttggcaataccctgcagggcatcgagacactgacggcttccagcctgcggaccctagtacgagatcaattccgacaacccctcccgccagatgccgagccgaatgacctggaccgggccatccaggggatccgagtgctgagtgaccagattcacttagcacgggggtccagctcagccaccactcgtggagtgcaagtggaggtcactgcagactttgtgggggtgagcgcgggaagtgagtcgagtgagccatacatggtcattgtggcgagtggtgcgaaatccatgcctgcaccagctaacaaaagccccacagccaatcccctgccaaacacactgcagcatgaagacgacattcagactctccaaataattgaggaaggcgaggacgaggaggaggaggaggaggcagggggctcgaagctgttctacacatatcgtgtccgtgtggcaaatgtcgggtag

SEQ ID NO: 2190 - DNA, 771 bp, Chlorella protothecoides
acgctgggcgccgcggcgctggcggcggggctctacgtcgggcccctgctggagcgtgccgcccccgtccccgtcgacggccagctcagcaggttcacggtgttggtcatgacctacgcggcgcgccggcccatgctggccgggtttgtggtgcactacgccgcctgcccctccgtccaggaggtcgtcgtggtctggaacaagggtgaggagggggtggggtggggatgggcacgagtctttcaccccaaaagggcggctggaggatgggggaggggttgtgaaggggccgataagggaaggggacgtgtgggaggggtggtgtgcttgtgcagcgctcccagagccgggcaggtgcctgtggcggcgtcggcgatgggctgtgcctgtggcggcgtcggcgatgcgctgttgagctggcccccacctccctcgaccgaggcaggccccacctctcagcatccgccctctcccaccccctccccccccacacacacaccaggcccccttcccgagccgggcgtggactacgacgaccgcgcggtgccggtgcgggtccgcgccgaggcggccaactcgctgaacaatcgcttccgggtggacccggcgctgcgcacgcgggcggtgctctccatcgacgacgacatccgcctgacctgtgccgacgtggaggccgggttcgcggcctggcgccgcgcgccggagaccatgcacggcttcttcccgcgccgcatggcgggcgagcccctgaccttccacggcgagaggtag

SEQ ID NO: 2191 - DNA, 345 bp, Chlorella protothecoides
atgcgccgctgccagaaatgcgttgttgcggggctgtggtccgtggccagggtgtcaccacttcgacaagaaagcgtcacagccccccacccagacatcaatacggtgcggcagtcgctttacacctttgaggactgcctggggggcggggtgcccaaggcccaggcggctgcagaggcgctgacggctgttttccccggcgtcgatgcgaggggcctggccatgagcgtgcccatgccggggcacgtcgccactccggacgaggaggccgaggtacgagggtccgtgcgaggattgctgcccactgcccagctcctctgcactggtgtctgtcggggacgctga

SEQ ID NO: 2192 - DNA, 510 bp, Chlorella protothecoides
atgacagcatgcgatgagcacttgaagacatgcggtcactttgcacaccttgtgacgatagctggcctggaggatgcagcagccgacgcaggggcagcaggcccggctgtcagctgccaccccctgacggagtggtccagcctggcaattgcaagccaaggcccccgcacctacctggccctccaggacagcagttgcgagacggagcgccccagcgcctcgctccgacccctgcttctcctggcggccgcgagatggaaagtgcggagcctcgacgtgctgtgcctgcggcagcgccaggggcgcagcagcgcccagggctcgatcgtgctgggcgtcgacctccccggggtagatctcgagggttctgcccccgctggcgcgggcggctgggaggtgaactcgcgcggcaagcccggaccgcgtgtcgccgatctggctgccgccatggaccccaagcgcctggctgcctcgggtgggcaggcgtatggcctgggaggaaggtcgtga

SEQ ID NO: 2193 - DNA, 456 bp, Chlorella protothecoides
atgcgccggtaccacatccaggaccgggacgactacaagaaatacaataagctggtgggcatggtgaccagcctgacctccgtgctgaagaaactggcccccaccgaccccgcccgcatcgagctcaccgagaagctgctggaccggctgcacgacatgggggtcatcaccaccaaaaagagcctggtccagctggagaagctgagcaccgcgtccttctgccggcgccgcctccccgtggtcatggtgcgagccaagatgtctgagaccctgaaggaggccatcaccttcattgagcagggccacgtccgaataggaccagacacagtcaccgaccctgccttcctcgtcacgcgcgccatggaggacttcgtaacatgggtggacacgtcgcgcatcaagcgcaaggtcatgcagtacaacgaccggctggacgactacgacctcatgcactga

SEQ ID NO: 2194 - DNA, 216 bp, Chlorella protothecoides
atgcgctggcgcgccgtgcccagcctggaggttggctccctctcctcccagcgctgcctcctgcttggcgccggcaccctcggctgctccgtggcgcgcacgctgctggggtggggcgtgcggcgattgaccttggtcgacaacgcccgcgtttccttcagcaacccggtatggtggcggcgctggtcccagagctggggtcgatgtcggatctga

SEQ ID NO: 2195 - DNA, 603 bp, Chlorella protothecoides
atgttctcgccttccaactggcgggaggtggtggatgaggtgcaggccctggacgccatttatggcaccgacttccgggtgcagtctctcacccgccctgggtggggtgacgccgcgtgcacccatgggctcagctcggaggagctgatgcagatggaggacccgggccccggcgccacctggtccctggcctgcgccgtcaccctcgacctgtccctgcctgcgcccggcctccccctctgcgtggaggccggggaggggcccagcagctcctccccatccgccgacgacccccccccccgcatccagtacttaccccccctggtactgcgcctgaccctgcacgaggcctaccccggcctcgccccgccccggctggcgctggaggcgtcctggctcgccgccccgctggcggccaagctggccgcggcgctggaggccctgtggcatgccgacctggccacccagccggcgggctacgcctgggcggagtggctgcgcgagggagtcctggatcggatgggcgcggggtccggggcgctcaggctgcaggtgcgcgacgaggacgaggcgcagacgctgctggccaacctgctgaggtga

SEQ ID NO: 2196 - DNA, 516 bp, Chlorella protothecoides
atgcgcggcgcgctgaacgccatgctcttccgcaccggcgaccagtcccgcgactttgtcgtggtcctggccaccaaccgccccgcagacctggaccccgccgtcatcgaccgcatggacgaggcactggagttcgcgctgcccgccgccgacgagcggcggcgcatcctggacatctactttgaccgctacatcctcaaggcgggcactgcgcagggcggcgcgggggctggcagcaacaccggggcgtttgcgaggctgggagcctggttcaggggccgcggagatgtggaccgcatcgccgtcaagggcgtggacggcgcgctgctggacgaggcggcggccgccaccgagggcttctccgggcgcgagctggccaagttcatggcctcggtgcaggcggcggtctacggctccaaggacgccgtgctggacgcgcccatgttccgccgcctgctggacatgaaggtgggggagcacgcgcagcgccgtgccttcatggcgcccgagctgtga

SEQ ID NO: 2197 - DNA, 987 bp, Chlorella protothecoides
atggggcgggtgggagcgagggagcgggcacagggcttgccagcaggcaggcagcctggaccacagccgagtggggggtgtctaccaggggcagcccatcacgctggcggccgcatggcagtggagggcaggcggttgacgcaggctggccgccacgaggcacgctctgacacgctttgcgacaggaagaagcggactgccgccgctcattcacgcctgccctgcccgtcgcgccgccgccgccgcagggacaccatcgaggccggggcgtacaacgtcatcctcaccggcgctgccttcctggactccgccaccgccttccccgcctactgggccgacgccgtcgcgcctgcccgtgccaccggtgcgccgtcgggtgctggtctgggttgggaggagggtgcgcggtggacctcatccctcccaccagacctggagaggtggaggtggcgctcgacagccggcgggtctcagggcccgctgcatgccgacctcaagcgtgccctagaggcccctgcagcagcgtggcatggtatacagcgaacccacacctccactcacacacacgtgcaccctctcatccctgcagtcgaccgcctgttcaacggcgaggacgtgctgatgaatttcgtgctggccaaccgcacggcggcgctgcagcgcggtgcctcgaacgctgcgccagtccgctatatctccttcctccgccccaaggtccgctgggaacaggttgtggggggattcctggagtcgcagcggcacagggcaccgtcgatctgtgcagggacagcactttcactcctgtttgacaggctgaagcccgtgccaagtccccttcgcctacctccacctcccgctcccgtgcagcggcgagtggacatctcgaagctgtctcccgtcggcatcagccacaactttgcaaagttcctggacgcgacgcaaactgtgagcgggcagcgcatttcttggcgccgtgcagggcgctga

SEQ ID NO: 2198 - DNA, 264 bp, Chlorella protothecoides
atggccatgctcgccgcagcaaagaaggccggggtcctgggcggcctggccgtggcctcgggtctcgggaccgtggcctactgtgagcctgacagcaagtactttgatcccgaggccctggagagaggtgccaaggccttacgggagatcaaccagtccccctatgcgaaaaaggtgggcctgggtatgttgggccgcgtgggaaatggcgtcacggtcaggaacgcaccttgcatcacattgatgattacctggcagtcgtag

SEQ ID NO: 2199 - DNA, 402 bp, Chlorella protothecoides
atggtggttgcgctggcgtccacgcgcctcaccaagctcagggtcctgacgtcggcgaggtcggcggccctgcggcggctgccgcggaacaaggtgttctaccagcctcgtgacattccggaggaggcgctgcgatacgtactccactacaagcacctgtacctgcccatgtaccctgccggccgggtgatgcacctgcgccgtgtggagcgagagaagggcagccgggcctgggacgcggtgtgggtgagccaccgctgcctcatagacgagggtatcctggtgtccaggcaccagagcagcgaccactccatcgccaggctgcgcagcgtgtttgctgagctggcagggaaggatgttcctgagctagctggggcagacggcggtgaagacctggtttga

SEQ ID NO: 2200 - DNA, 336 bp, Chlorella protothecoides
atggagaccacaaaaggccgactgatggcatggcactggcatgaagaaggcacagagacagtgcagctcctggggcggcactggatcatccaggactcgcggggggtgaccgtcaccgaggtcccacggggaacacggggcgtgatcggctgcacgcccatcatcaagcccgggacctgcttccagtactacagcgggacggaccttgacgaggcgcctggcagcatgcacggctccttccagatggcggtgctggacgaccggtcgcagccgctggagagcttcgacgccgaggtcgcacccttccacttctggcccccatccacgccggcttga

SEQ ID NO: 2201 - DNA, 1506 bp, Chlorella protothecoides
atgccacaggtgtttgagcaaatcaaggctcaggaggccacgaagcaggcggagctgaaggccaaggaggcagagttcaaggccgaggccgagaaggccgccatcgtgagccaatggggctttgtggggatggcattgtttggagcccctgcgcactgtcgctgctgcgatagatctggccccgaccttgctgtttggcacccgggcaccccctccctgacacccccccaacaccccccctcctccacatcatcgcagcaacacgagcgggtgcggtgggaggagcagcgcaaggccatgcagcaggactcgcagcagaaggcccagctggcgcagtaccaggacgagctggcgcggaagcgcgccgaggcggagcacgagaagcagcgcgcgcgtaacgcggagctggtggcgctgcaggacgagtcgcaccggcgccaggaggcggagcgtgcgcagatcgcggcccagatcgaggcggagcgccgcgcgaccgaggcctacaaggcggggctggagaaggaggtgcagcgcgagcgcgctctggcggaggcagaggggcgcaccgcggagcgccgcgccaacgccgacctgtaccgcagcgagctggcgcagaagctggaggaggagcggcggcgcctggtggagggcatcaacaccgtgtttggcaacctgggcgccgcggcggcgggcctgctgggcgaccgcgaccgcctgctggccgcggtgggcggcgccagcctgctagcgctgggtgtgtacggcgcgcgggagggcacgcgcgtggcgggcaaggcggtggaccgctggtttggcacgccgcgcctggtgcgcgagacctcgcgccgtccgctgctgggcctgcgcgccgcgccggggtccaagtccgccgaggccgtgcgccgcgacttctccgacatcgtgctggagccgcggctgcaggaccacgtgcgcgcgctggcggcggtgaccgccaacaccaagcgccacggcgcgcccttccgccacatgctcttctacgggcccccgggtacgggcaagaccctggccgccaagcgcctggcccgcacctccggcctggactacgccatcctgtccggcggagacgtcgcccccctgggcggcggcgccgtcacccagatccacgacacctttgactgggcggagcgctccggcaagggcctgctcctcttcatcgacgaggcggatgccttcctctgtgagtgccagggtgttgttgttttcttctcaacttggagcgtggggatcccctgctgcggggctagaatcacccgggcacccgcacctctgcatcctctgcacctcgctggcctcactccatctcgtgggcacagcccccatcgctcccatgcggacaccccattgggcgcccagcccctgcccttcctctctacagtgacccccttcctccttctgctcacctctcggggaccctcccccctttccccgcctccactcacgcagcccgccgcggtgcggggatga

SEQ ID NO: 2202 - DNA, 555 bp, Chlorella protothecoides
atggccgccgaggcccagttgtccccggatgtattatctatcccgcaacagaaggcctcgcaagcgattgcctcgccggtgggggacctgctggcgacgctggagaccatgggccgggtgctgagcttccaggacacccctcccccacctcccccgcccaagtacccccgcgccttcagccccgtgatgcaaaccatggcgtaccacgagcagttcatggacgagactccagagggcaaggccctgcgcgacaactggcgccgccaggtggtgctggagacgcgggcggtggaggcggcggcggcgcggtaccggagggacctggccgctgcggtgcagcggggggagggcgccaacctgccggcctcgcgccgactcctgctgcgctggtacgcgccgctggtggacgccatcaaggaggagcagcgcaaggtgcggcggaggagcagcgcaaggtgcggcggtgttgctggagccgaggggtatggctgtcgagatggcgacgccctgagggcaacagcaagcatgggtgtcttaccgcatgatgcgctgtga

SEQ ID NO: 2203 - DNA, 528 bp, Chlorella protothecoides
atggaggccgcagggagtctatcaccccactggacatggccggatgtgcccatccgccaactggaaccagaagctttgactgcttccggcgccgggctggcctcctgtagggctggggatgagcatgcgcagacggattccgctggcggcgcgacgcgaggcacctgctgtgcgaatcaaggcgactgcagcgcgaccgcccctgcagattccagtgtcggggagctgcgagccgcagggtaccgctggagcggcactgagatgggtgccggccccgtgacctacatttggataggagcgccagatgcacctgcactccagctcctccaactcacccgctccacgctgccctggtggacccttgatcccacgacgtgcaccctggaggagggcctgccggtgggagtgcggcgcctgctgcggcgccggtacgcgctgatggagagggcacgggatgccagcatcgtcggtgcgtggactggacgggtaacaggggtttgggggagagggatgattacggagcactag

SEQ ID NO: 2204 - DNA, 525 bp, Chlorella protothecoides
atgtggggctgtcattgcccgctccatgtgcgccagtgcagtgatgtcatcaccgcctcccacctcaaccatcctcattccagaccatccgcatcagccccaccccctcaaatccacacacccaaatgccagttccgcacgtcctacttcccggggctgggctggatgctgtcatcccggctgtgggaggagctgggccctgcctggccgcagcagcactgggaccactggatgcgcatggagggcgtggcccggggtcgcgactgcgtggtccccgaggtcaaccgcaaccgcaacatcggcgaggtgggggccaacatggaccgtgccaccttccgtaagtccctgcagaccatggcttgggcgcgggaggcccccgccgctgggttcggggacgtgcgctacctgctgcagcccgcctacgacgccgcggcgcgcgcggcggtggccggggcgcagatcctccccccggccgcgctgcgcggcgccgccccgccgcccgacctgcgcggcggcgcggcgctg

SEQ ID NO: 2205 - DNA, 948 bp, Chlorella protothecoides
  modified_base (635)..(644): a, c, t, g, unknown or other
  modified_base (918)..(927): a, c, t, g, unknown or other
atgtgcgcgggcgacggtgttgggcacctaggtgcccgaggcatggctcgcagggaccccccatacgcctctttgctcacggggaccctgtgcctcctcatcttcgtggagctggtctgggtacagctccgatttgcgtccgtgctgccggggaaccagagagatgccgtgaaatctgttgcccgggacgtcggggtctcccacgctccgctgcaccaggatcccccctcactgctcaaccctgccatcatcgtattctgctatgaccgccccggctatctcaaccagaccctgacctccctggcagccctgccagagctagccgacttcaccttgtacatctcccaggacggcaaccatataggggtccagggcgtgattgagacgcatcgagccgcgctggcggccctgacagctggctttgagagctggcagcggccacgagtgccccagcttggaccgcgccagccggggcatgcctggcttgcgcaacactacaagtggggcctagacaggctctttttgaagggcgggcacagccacgccgtgatcgtagaggatgacatgctgttcagccccggtaagccatcttcgagattgaaggcttacaagaaaggggctggaagtctgtcgcnnnnnnnnnngaagggcgggcacagccacgccgtgatcgtggaggatgacatgctgttcagccccgcacagcctttggggcagcaacaagactactggtattccccttcccacacagatttcctgacgctcttcatggagacggggtggttgctagatgcagaccccacgctgtggtgcatctcctcgtgggtgagggaggctgatggggatcacaaggggctgtgcccaatgggcaagattgtcgatttgcatcgacgatgtaaaatgcaggttgctttgcannnnnnnnnnctcgtgggtgagggaggctga

SEQ ID NO: 2206 - DNA, 600 bp, Chlorella protothecoides
  modified_base (191)..(200): a, c, t, g, unknown or other
  modified_base (500)..(509): a, c, t, g, unknown or other
atggatgccggccctctgccggcacccgttgcaaaggcggccttgaaacagctgtttgaggcggtgggcgccctccacgacgcaggtgggtggtactatgggctgcgctggcctggaagctgctctgtgtacttccttaacttgctggacggtcatcactgcatcatgctttgcacatcgggacctggcgnnnnnnnnnnggaccccgtcccacataatggacacttgcagcgcttacctctgccctctcactccccacccccatgcccaggctttgcacatcgggacctggcgccctccaacgctctgctgactgacgatgggagggtgctgctgtgcgactttggccaggccaggcgcctagaggacggtcacccgcaggcagatggtgaggcgccggagcgcgaaggagcgctaacccccgtcgtcggcacgcgctggcctcttgctcctcagcatcgatgcccatccaccagtccaagtgcccctacttgccaccnnnnnnnnnntaggcgcctgggggacgggcaacggcaggcagatggtgtggcgccggaccgcgaaggagcgctcacccccgtcgtcggcacgcgctggtga

SEQ ID NO: 2207 - DNA, 1368 bp, Chlorella protothecoides
  modified_base (593)..(602): a, c, t, g, unknown or other
  modified_base (798)..(827): a, c, t, g, unknown or other
  modified_base (894)..(903): a, c, t, g, unknown or other
  modified_base (967)..(976): a, c, t, g, unknown or other
  modified_base (1197)..(1221): a, c, t, g, unknown or other
atggagagtgggctgtaccttcacaagccgcttgcaccggggaattgtgctgggggctcgccaggccctcttgctcctcagcatcgatgcccacccaccagtccaagtgcccctacttgccacccaactacaaaaccgccctcaacccccacctttcccattgcctcaaggtatcgcgcccctgagctgctctttgccgcgcggtcctacaaccacgccgtggactgctggagcttgggcatgatcgccgcacacgccctgcgcggcgccccgctctgccccggcgcgtcggacatcgaccagatctgccgggtgcaggcggcgttgggcagcatcgaggaggccagcggtgcccccgtggcagactgggcggactggggcaagctggtgttcccccccagcccgggccagccctgggaggcgctgctgccggggacggagcccgccgcacgggagctgtgcgccggcctgctctgctatgacccaggtgtgcgatggggcctgggctgcagcggtggaggacgggggctccccagcctgcctggcaggctggggacagttaaaacgtgggaaggccgacccctggcatgcannnnnnnnnntgatggggcttgggatgcagcggtggaggacggggctccccagcctgcctggcaggctgggcacagttcaaacgtgggaaggccgacccctggcatgcatgtactccactgtgcagcatgccctagcccgagcaggcgcttcccggccaacacccaaggactggggtgtcccattccctgccttcttccccgctannnnnnnnnnnnnnnnnnnnnnnnnnnnnnatctgccatcatcctctggccatgcagagcgcacggcacttcgtacccggctgtgacctcccccttnnnnnnnnnntgccaccatcctctggccatgcagagcgcacgacacttcgtacccggctgtgacctcccccttnnnnnnnnnngtgccctagcccaagcaggcgctccccggccaacacccaaggactcgagtgtcccattccctgccttcttccccgctacgctgcagcccagcgctggagtgtggcccgtgccctgtcatcagactactttgacggcgccgcggcgccagcagacgtggctgcgcaccttgcccacctgcctctctgaatcgcaggacgttttgaatctgcgcagcacatcnnnnnnnnnnnnnnnnnnnnnnnnngcgcttgcggagctgttaaaccccctattcaacgccacgccaggcggttgccctgccctgctgaccctgtgccggcactgttgtattgtacacccttttggagtccagggttcctggaacgaatcaggtccatcgccaaacgtctga

SEQ ID NO: 2208 - DNA, 687 bp, Chlorella protothecoides
  modified_base (165)..(174): a, c, t, g, unknown or other
atgaagaaggggtacgggatggagtgcgactggtggagcctgggcgccatcatgtttgagatggtggggcgacgtcttcctcctcggccagtgcgacctgccgtgtgccagtcccagtcctcccagtcacgctgccctcacgccccacctccccgagcacccacnnnnnnnnnntgcaggggcgacgtcttcctcctcggccagggcgacctgccgtgtgccagtcccagtcgtcgcagtcacgctgccctcacgcctcacctccccgtgcacccatgcagcaagatcgtgaactgggccacgtacctgcgcttccccgccgaggcggaggcctcgctctcccccgcggccaaggacctcatcatgcgcctgctctgcgacgtggaccggcgccttggcgggcacggcgcggcggagatcaagcgccaccccttcttccgcggcgtggactgggtgcggctgtacgagtcgccgccgccctaccgcccggccatcacccacgagctggacacccagaactttgagcaatacgaggacccggaacgcggcgcgcgcgcggggcactcccccggcagcgccagcagcaggagccggccggtggcggaccccaacttcatcggctacacctacaagcccttcgaggcggtgcagcgcagcgactcaggcgggtctccttttatttcttga

SEQ ID NO: 2209 - DNA, 981 bp, Chlorella protothecoides
atggaccggccttcggctcgccgcttcgagggcaaggtcgcgctggtgacggccagcaccgctggcatcgggctgggcatcgcccggcgcctgggccaggaaggggccaaggtggtggtgtgcagccgcaagaaggccagtgtggaggacaccgtcgctgccctgcgcgccgagggcattgaggccgcgggccggccctgccatgtgggcgatgccgcccagctcaaggccatcgtggacttcacggtccagacctacggcggtctggacgtcctggtgtccaacgctgccgtgaacccggcatccggcgccctcctggactgccctgcccccgtcatcgacaagattttcgacatcaacggtgagtgggcgggtggtggttttttggatttgagaggattgaggaagttggactcgctgccgtgctggagggtcatgccgccatgccgtgacacagcacctgggccacgggtgggagtccagtgcttcttccaccccctctcaccccccccttcaatgaaaccctgcagtgaagtctgcgctgctgctgacccaggaggccgtgaagcacatgtcccgaggcagctccatcgtcttcatctcctcctattcggccttcaacccccccgcccccatcgcgctgtatgccatcagcaagaccgcgctgctgggcctgaccaagggcctggccacggaactgggcccgcgcggcatccgcgtgaattgcgtggccccgggcatcgtgcccaccaagtttgcgtcggccttggtggccgacccggagctggaggccgcgcagcgcgacgccaacctcatgcggcggctgggccgggtgcaggacatggccgcggcggtggcctacctcacctccgacgacgcctcctacgtcaccgccgagacgctcaacgtgtcgggcggcatgcccagcaggctctagggggggacagacacgcttggatcgagaacgttcagagggtgtga

SEQ ID NO: 2210 - DNA, 795 bp, Chlorella protothecoides
  modified_base (270)..(279): a, c, t, g, unknown or other
atggaggtggatggggtgggggttgggaaatttagaggagaggcggagggacaagccgaggacatacattctgctaccgcaagggtagtggcaagggacagcacgactattcgtgctctctctcacactggtgctctcatgctcctgtcagggaggggagagacacccccggtccccccctcacaccactttcccccaaccccgagccccagccaccgtcaccaacacaatccaagcaggccgctcacccttggggtcaaagtcggcgcnnnnnnnnnnacacactgggccctcatgctcctgtcagggaggggagagacaaccccggttcccccctcacaccacctccccccaaccccaagccccagccacaatcaccaatacaatccaagcacgccgctcacccttggggtcaaagtcggcgccgcccttgccgccgcccatgggcagcgtggtgagtgcattcttgaagatctgctcaaagcccaggaacttgatgatggacagggtgacagaggggtggaagcgcaggccgcccttgtaggggccgatggcggaggagaactggacgcgcatgccgcggttcatctgccacacgcccgcgtcgtccacccagggcacacggaagatgacctggcgctccggctccgtcagcatgcggaaggccgggaggtactctgggtgcttttcgaagacaggggcgatgctgagggccatgccgcgcacggcctgcaggaactcggcctgctccgggttgcgggagtagacctcctccaggatggcctggccacatga

SEQ ID NO: 2211 - DNA, 2847 bp, Chlorella protothecoides
  modified_base (322)..(331): a, c, t, g, unknown or other
  modified_base (623)..(632): a, c, t, g, unknown or other
  modified_base (749)..(758): a, c, t, g, unknown or other
  modified_base (1427)..(1436): a, c, t, g, unknown or other
  modified_base (1880)..(1889): a, c, t, g, unknown or other
  modified_base (2251)..(2260): a, c, t, g, unknown or other
atggacgcgcaaatgtctcgagatggtcatcgtgagcagcttgtcaaagtgaattgtgcctcaagggtgtcgtgcggggttctcgatggacagggggaatgccgtggaggaacatcgggaagtcccatgaagcgttctgatggaatttgcctggaatctgtgcagctcctcatcaaatgtgggcgatgtattgctcagcagcctaagatcgtattattaacatataagacgacacaaaattgctgctctccaggcggccgaacttgggaaaacccaaggcacaatcgtggtttccatgatcaagtccagggcccgctgattnnnnnnnnnnagcacatcatgttctacgacacactgtggcagcagcttggggcttcacatgatttggagacaagtactgttcacagccacctgtcacaagggcgtccagatgagtactgtggtcccatccgaccattgcaaagggggaaacgcgaagcacgactcttcgacaagatcaggtgtccagctcttgcattctgcgcatcgccgagcccatctgtacacgttagctacactggtctatttacactttttctctgccttgctgtgtctcccacagaggctggcggtgtcgggagggnnnnnnnnnncgggcgaaacatggcagccccagaccagcagagccctaccgcagggccccaacaactttggctccttcccaaaccagcccgggccccggaccttcacgtactaccccaacgagtccnnnnnnnnnncgtgcgggatgctttgaagccccttacattcacctccgtcccgagagccctaccgcaggcccccaacagctttggctccttcccaaaccagcccgggccacggaccttcacgtactaccccaacgagtccctgaggaggttgtggcaggaggcaaaggacgaaattgccatgacggagcctgacccagcccagttcaagaaccagaccctgcccctggcacgcatcaagaagtcacggtgcccagctgaagcacaccgttccctcccctgctctgtccttcagatcatgaagtcggatgaggatgtgcggatgatcagcgccgaggcccctgtcctcttcgccaaggcgagtggggtgtacggctgtgtgggggtgattgcgcccccccctccacccacccctcccttcaactcttgcccccctctcttgatccctctcaggcctgcgagcctgcgagttcttcgtgctggagctgacccagcgtgcctggcaggcggcggaggagaacaagcgccgcacgctgcagcgcaacgacgtggccatggccatccagcacatcgacgtcttcgacttcctgctggacattgtgccgtacgaggagcccgcgcccgacggcgccggggtcgcggcggcccagcccccgccctcccccgcccagcccggcgccnnnnnnnnnncgtgccgtacgaggagccggcgcctgacggcaccggggtcgcggcggcccaacccccgccctcccccgcccagcccggcgccggcgccccgcccaccaccgtacacccggtgcccgggcagggcgcggcatatcatgcacagcaggcggggccgggggcgtacggcaccagcccgcgcttcctgcagacgcagggcatgcagtacccgcagtaccacccgagcatgggccccccgccgcaggcgggcatgtacgggtcgggcgggggccagcagcagtttgtcgcgccctaccaccagcccatggcgcccgtgggggggcctccagagccgacccctgggcggccagtcaacctctcccctgtgcgttctgtgtactccacccctccaaggcgacctgcaggagtcgtttccgaagcgtccctcacccgccgccgtgcagcgcnnnnnnnnnntcctctccccagtgcattctgtgtactccaccccttcaaggcgacctgcaggagtcgtttccaaagcgtccctcacccgccgccgtgcagcgccgtgccacccacttttccacgtcttttccacgtaatgtgccaaggtcccacctccgtccctgaccctgtcccaccccctgctccatgcttccccctgagacgatccagcctgtcacatacactcttgcgatgcccaggagggggtacgacctggagcccatcaccagggactcggctgcctggggtggccggcatttgctcctggcgggcaacattcacaggctgtgcttttgaggaacaagagtcagctcaggcggcggtcagtcagnnnnnnnnnngttgctcctggaggcaacactcacaggctgtgccttcgagaggcaagagtcagctcaggcggcggtcagtcagcccggccagcctcaacactcctccggcccccccttgtcctcctcgccgcggctcaggtccgcggcggcaggcacccggccatggcatccatgaaggcctcggcgaagcgcgcgtcggagaagcggtcggcgcggcgccgggccgccgccgcgacctccagcctctccagctgttgcatgcccagcacccgggtcagcgcggcggcgtactcctcctcggtgacgcagcggaagcccgtgggggtggccccgcccgaccccgggccgccgccctctggctgcacgatgtcttcccgcggcccgcccgagtcgtggactacgggcaccacgcccgcggccatgaactccacgatgccgatgccaaagtgctcgtcgcgcatcgtgtgcaggcccaccaccgcctcgcccagcagcgcctgcagctccgggaaggggaggttgaccaggaagtcgacgctaccctcgaggcccagctccttcgccagggctgcgggtggtggcgggggggtggaggg

SEQ ID NO: 2212 - DNA, 663 bp, Chlorella protothecoides
atggtgcggcgcgggcaggtcgaccatgtgcgcgcggagcgcaatgtgctggccgaggtgcggcaccgcgccgtggtgcggcttctgtgcagcttccaggacgaggagatgctatacctggtcatggagtacatgccggggggcgacctcatgaccctgctcatccggcaggagatcctgccggagcccatggcccgcttctacctcgcgcaggtggatggggtcgcgcacaaaggactgaggggcgtacgaaaagggcggcggtgcacgctatgctgcccttgccgttatgcatgggtgaccctaaccactctacccaggctcaccgtcccacctgtcccgctgcagacggtggtggccctggaggccatccatgccgcgggctacatccatcgtgacatcaagccagataacctgctgctggatgccagcgggcacatgaagctgtcggactttgggctgtgcaagcccgtggacgtcagcctgctgccggccttcaaagcagctgccgaccctgtggccttcaggtgggagttcgagctgggggatggggagttggggcagcggacaaaggatactgatccgaacacaggggtccagggggggagcccacgggtgctccagtgcagacgagtgaatgtccacctcacgccgcagggatga

SEQ ID NO: 2213 - DNA, 381 bp, Chlorella protothecoides
atgggttacgaggacgagtacttcagcgaagaggtcctggccaaggccaagaccgccaaagtgtacatcgaacatctttacaaagttcagagtcagcaccacaaggatcgcaaggaccggcggaaggcgctagaagaggagctgcagaaccccgggctcacccctgagcagagggatgcagcccgcgccgagctggagcgcagggagcgggacttttcccgcctgcagcgccagcggctcagcatggacgactacgagcccctcaagctgatcggcaagggagcctttggggaggtgcgtggagctggatgtgggggagaagggcctcatctgtcgtgtgcagatccagagggtaacatggtcccattggtcgggtgctga

SEQ ID NO: 2214 - DNA, 429 bp, Chlorella protothecoides
ctggcgaaggagctgggcctcgagggtagcgtcgacttcctggtcaacctccccttcccggagctgcaggcgctgctgggcgaggcggtggtgggcctgcacacgatgcgcgacgagcactttggcatcggcatcgtggagttcatggccgcgggcgtggtgcccgtagtccacgactcgggcgggccgcgggaagacatcgtgcagccagagggcggcggcccggggtcgggcggggccacccccacgggcttccgctgcgtcaccgaggaggagtacgccgccgcgctgacccgggtgctgggcatgcaacagctggagaggctggaggtcgcggcggcggcccggcgccgcgccgaccgcttctccgacgcgcgcttcgccgaggccttcatggatgccatggccgggtgcctgccgccgcggacc

SEQ ID NO: 2215 - DNA, 867 bp, Chlorella protothecoides
atggagcggccgatgcggcctagtagggtatgtgttgagagtcgcggatgccactgtatcaacaagaataaagcaccatcgattctcggtcagcggcgcagaaagcttttgggagccgtcagccttgccggtgcatcggatggcacggtggagggttcgggttcggcaaccacagactcaggctacagcgcatccggacaagtcgcggggtcggcctccggcaacaatgcgctagccgaggcgggattggaggccaccaccagtggaagcggatcgagcatcgacgggttcggaagtggatcgagcgatggcagtttcacggctcagacatccggcagcttctctggagttgcagcaggtcctggcagactggccgaatcgaactacaatgcattctcagagtcgtcccagcctgggcctgtgagcgccgaaggatctggcgcagctgctgcggacgaaactggggctacggcttcgggcagcagtacatcggaagccaatgggattacccagatcataacaggatctgcttcaggaaccacaggtgctcaatcatctgggaacaccacgatcgcttcacctgcaccgtctggcggatcgccaactccagagggctcccccagcccagggccaactcctagtccctctcccggtggagaacccagcccaagtcccagcccaagtcccagccccacctccagcccccaagcatctccatctcttagccctgaactctccccgacctccagccccagccctgcgccttccccatctcccagctccagcccagtaacttccccgatccccggccccagccccgagccgtctccgaccccaagccccagccccgaggagtctccttctccg

SEQ ID NO: 2216 - DNA, 1575 bp, Chlorella protothecoides
atgctgcccatgggtcctgcaaaacacgccttccgcctggccaagcatgcctgtttctccactcgctcgtccctccaggaggaggaacttgccttgcaggatcagatggggtttacagaatactcggcggggcctccccgtctgggctggcttgtgaacctcaacacggtaggcttgcatgccacatgcagtagggcagcacagtgtttacacggaatgatcgtgctgatgagctcgacaggaggccctgcctcgaccatcacctttgtgacctcacgtgtttgcaggttcagacagtggacaagagttctaatgctgcaatcagtgcaatcatgggctacttcctctcccaggtgggctacatgttgggaattatgtccagccgggcgtctgagccaccctgccaccacaatcacccctgtcccccaggatgggaccatgttcaggagtgccttccccttcagcccctacttttacctccacgtcaaggcggggcaggaggctgaggtggacagctggctgcggcgcaagcatgagggcttgatcctggatactgaactggtggagcgagaggatcttgatctggtgtgtaaggatggcccggctcagaataaggccgaggcacagggatgccgagctgcacaactgtggtgttgtgtgttgggcgctgggcgtctggaagcggggcctgcacccagcagtgatcgtctggcaagacatcaccgcctgcatgctgaccatccgccctgctggcctgaggtggttcggactgcgcgccaaccgccgccccccctcccgctctcaggaaaaccacctgtcgggcgcgaagcgcaccctcctgcgcgtgtctttccgcacccaggatcagctgtccaaggtgggggccaggggggcgcagcgtcgggaaccccagcccgtgcgggccgtggaacgagggatgtcgccccgcccagctcgccctccctcgcacaccgccggtgcctgcaggtccgccgggagctcatgcccatcctctaccgcaacaagtccaagcggggcacagcctcggtggccggcgaggagtcgtcgcggcgctggaacaggaagggccaggtgggtgtcgcgtgccctgcgcccaggatcggagtgcccggcctcgcgggtcttcccctctctgcgccagcctccgcacggcggcgagcccctcccctgccccgcgcagggcgccgaggacgcgctgctggacatgagggagcacgacgtcccccaccacgtgcgcttcgccatcgacaccgacgtgcgctgtggggcgtggtactccgtctcggctcaggtgcgagggcgggaagggttccgggctcgggggggtgctggcgtggtctcgcagctcccagcctggcgccctgccggctggtgcgtgcgggtgtagcggccggtcgtggggaggggagtcccaggctgcacaccagcccgctgtcggctggtcatccgcaggcagccctctccgccgcaccaccctgtgcagcaagggaggatgtcgctggagcccaggcccgaaatggtgcagcgggcggaggcacgggtgtgcgcctttga

SEQ ID NO: 2217 - DNA, 903 bp, Chlorella protothecoides
atgctgaacgtcatggtcgccgccaacaacacaaatgaccaatttgctgtgagtgaggcgcgtgcttccggtttcgtggcaaaagcttggatcgtgggttgtgtgtatctgtatgcgtttgggagcatctccatccggcatgcccatctggtggggcaccaccaggcccttgacagcgacctgactccacgccgtgcgacggtgacagcctctgctccgacccatccacgacgccaggtcctccacgatgaccgaaccaaagagtatcgcaccgagtcgcgcatgagcatcgaattcgaggtggatggcccatacaaggtcagtcttggagccggcccggcccctattcctgggtacgtggcgatgatcctgccggcatccaaggaggagggcaagctgatcaagaagcgctacgccgtgttcaaccacgacggcacgctggccgagctcaaggtgaggttcggggatgcgcacctcgaggacccctgcccctgggactcccatggtcttcagtgctggcgctcgcctggctctgcagcccgacggactcagctggctccgactgccactctaactcttcagggctttgagctgaagcgtcgtggggagctgaagctcatcaaggtcttccaggctgagattttcgaccagttcctgcgcggcgactccctccagggctgctatgacgccgtggctggggtggccaaccgctggctggacatgctggacacccaggctcccattgcactgcgtgcaaagaatgcctggaggttggacctggaccgctcatgcccgtgccactttacctctggcgtctcggcagggcacggacctgacagacacagagctcgtggacctcatctcggagatgtgtgtcatgtccaagagcctggaggcctatga

SEQ ID NO: 2218 - DNA, 423 bp, Chlorella protothecoides
atgctcttttcccccaccattcacacccttcaggggctcctggacaacctggacgctgatctcaagtatgcaatcgagacggaggggaagatggacatgggcgacgtgacgaactatgcagagtcttcgctctgcaaagagatgattacgatcgctggcgtcgatcacagctgtggactgatgacggagctgcgcagctcactccgcccactgagagatgtggttgcctctgcagacaggaccatgtgcaaacttcgctccctcgtaaacatttggtttccgcagatcagagctgcaatagccacccagctggaggcgctccgagactgccccatcagggacgagacccccctcatatatcatctggatgtggcggccatgtaccccaacatcatcctcaccaacaggcacgacggtgcttga

SEQ ID NO: 2219 - DNA, 606 bp, Chlorella protothecoides
atggtccagtgcctgcccgaaggtgccgagtttgcagccagtccgcctccctctcgtccaagcccacacaaccccaatctaccaccccctgcagcgacacggaccgagtacttttcgttgaagacacagctccagtctgagatgttcccgcccctcggccctggggcgccacagcgcagctggtacgagttgaccagcgaagagcggagcaaaaacttgaaggctcgcctgaagggctactgccagaaggtgcgggccgggggggccagtcagtgcgggcggttggaggctcggacacgacggcatctcagcaacgtgccctgctgccacgcgatgcacgacccttgtcagcagccaggaccgatctctagggccattcccacgacccaccacttgggtgcaggtgtacaagcgagtcctgaacaagcccactacggagctgaggagcgcaggaatctgccagagagagaattcattctactacgataccgtcgagtccttcagtcaagtccagaccaaggatgccgcagcaaccccgacaggggtgcgggcctggggtccgaagacggcgacggtgcgttgcctgtgcggtccccggccggctga

SEQ ID NO: 2220 - DNA, 240 bp, Chlorella protothecoides
atgcactctgaggctgccccaggcccctcttgtccgcctgcaccctccctacagcgcgccaacgagctgatcgggcagattgggcggcccctggaactggacaccgacggcatctggtgtgcgctgccggggtccttcccagagacgttcaaggtgcccggccgtggggtgagggagggaaaggggatccctgtgctgctgcccgggacccgttccttgtgcacatgtatgcgctcgtga

SEQ ID NO: 2221 - DNA, 255 bp, Chlorella protothecoides
atgcacaagctcctgctgcacctcgtgtcggagctgcggcggctgggggtcacggtggtccacgcggacgcgacctccctcatcctgtgcacggggaaacgcaacctggccgccgccgtcggctacatcgactacatcctggagacgctgggcaagcgggagctgctgcagtacctctccttcacccccacgcgcatgtggcacgccctgctctacaaggacaggtgtgccaactgggcctgcagaaaagcgtga

SEQ ID NO: 2222 - DNA, 597 bp, Chlorella protothecoides
atgtcacaggcacgcctgctacagacgcatggagaggagctggaggtgagtgcagaggagctcaacgcccctcgcttcgactaccacttcacactgaaggcacgtgaggatgtatggtttggaaggcaaggggctcgtgtgcagatcttgggcccctcaatatggcaagcagacacagccagtcgcttccgacagatgaggagcccagacctccacctcacagccttcaagctctccatgcaggacttcttgccgtctgccctgcatgccaccttcatgacgctggtaacagagttcctgtggctcccatggcaagccgccatgcagggactggagaaagggcccagccagggaggctcccaggccagcaaggacacctcacagagcctggaggcacagacgctctggttgcggaccgccttgcccaatcagttcacctccaacctcttgaagtacgtcaagtacatatcaatgcacgttggagcgaacgatgggatcgaggcccatgctttccccgagcgtgctgggtctcacctctctgcggtgagtgggctggtcgggcgatcaaagggtcgaattgagcagcctgcgtcttga

SEQ ID NO: 2223 - DNA, 537 bp, Chlorella protothecoides
atgggccgagattgggccatcgacgccgccgatgcgctgttcgcgcgccagctgcgcgccgcggggcacctgctgtgggtcagcacccccgacgcggcgaccgctggcggcagcctggcggcgcggccgccggaccgcgcggaggcgctgctgctggaagagcaacgcacgcgcaccgaggtcgccgcgccgggcgtgtaccgcacggctcacccacctggccgtgaacgccgtgctggaggtgagggctggccccagggtcgtccgcctggggtgtggggcctgggaacctcgcacggggaagcgcagtgtgcgaagccctggagcacacgctccagtggctgggtcgagggggatctggcatggctcaacaagcctgtcccacccggcccccgcaccatgcaggcggccgccctgtcggagttagagggcacagccctcgtggacgatggcaagggctgcggggccgcctttgtggtcctgcgctccctggcccaggcatggctggacgacgcctcccgccactccaacgtgtga

SEQ ID NO: 2224 - DNA, 1071 bp, Chlorella protothecoides
atgctgggtcctgccacggccaagcccagcatcggtctggcaggagcaccacatgcaccagtggaggaggggcagcccagggtccaagggtatcccgtggcgctccgagcggcggccctgagctctgaggaggatcctgcgagtggggaggaggcacccagcgaggcctgcccctcccgtcacgaaaactacgcccagtggctggaggtcaagaagcggctgtggcgacagggcgtggaggcgcgcaagaagcggcgcaccgcggccgagcccaaccaccgacgcggcggcagggagggcccggcccagaatccggaggcaggcgcagggggtctggccggcatgctgcggcagcaggctgtctctgctgcctccctgcactggcagggtcggggtggccggtggcacctagctggagccagcaaaaggacagcaggaattcgcccagaagcatggccgcatgggtcaggcggggtaggaggcggcacgaggccgtgcctggaagcactaccctgccctgctctggaggggaccccaacgcatgctgcgaaacccgcagtgctgacacctcaacacaccccccttcatgacacctcctgcccccccaacccccaccccaccctcgcaacaggcgtgtacaaatgctgggccgtcctgggtgggcgcatgcacgccatcccgctccgcatcccccgcaccttcttcgccaacctgctggccccacccagccacccactggtggccgacatgggggtgctggcgcgccgtgcactgccccacggtgcagccgcagcgaccctggtccagatcgtcatggatgaggcgtccttccgagccgagcaggcagccctgaatgagcgcttgctggcgctgcgggccctcagagtctacgaggacaccctgccgcccacatacaacgcctgcctgcaggtgagaagaccttttgtcgaatggttggtcgtgcaagggggcctcctcgcctgcttgggcggaagggtggtggtgctatgcacacgtcaccaggactgtatgagttgtgctgtggaacccgccggggttgcttcccattga

SEQ ID NO: 2225 - DNA, 846 bp, Chlorella protothecoides
atgcagagcaaccaccacgatgcgggcgggactgctgcagccagtccttcccctggagtggaggcagcccccgctcaggcgcccggtgtccccgcctccatcccgggcatgctcccgggcatgatgccctttttttcgaacatttcaagcttgagtgaagtgagcggcatcccctcccacctcctcaacaacccggccatggtcctcgcagcgcagcagattgctgcccagcgcttcatccaacaccagtacatgaccgggcagatgacgggcgcctatggccatgccatcggccctcccccctcaggaacggcccctcgaccagctgcagcgcctgcgcagcctcctgcgagtgtgccaagctcccacgcagcccctcagggggccatgcagccacacatgacggcagagcctgcgccgctccgcgccccagcagcccttcccatggcggctgggccgggctccgcccagcccattgccgcaagccctcgcgactaccatccaagcactgcacctgaggcccctgccacacacagcatccccacccctgtgcctgtcccggatcggggctccgccccggcccctgcgatcgagggtgacgcgccccctcgctcgccccgcaccgaccctggcggccggctggtgtgggccaaggtcggagcgtacccctggtggccggcaaaggtgctgacgcggggcagggacctgtcgttccctccgagcgaggagccgccacgccctaacgccgtgcccgtgcgcttcttcggcacccacgacttctcgtggatcgggagcaagcgtgccatcatggactgggaggaggtgaggacgggctggagccggtga

SEQ ID NO: 2226 - DNA, 756 bp, Chlorella protothecoides
atggtgcacgtaaaggagttcagcgccgaggccgtcttccaggtgggtcaacattgggttttacccttgagaacgccttgctgtacaggtatgaagattctcgagctgccccctcactccagcctgcaagtcgtcgtcatccccctcatcgtcgtcgaacccccacaggatccctgcgccagccttgtgctgcgtgacgtcatctgcccgcactgccaggactgccaggatctggacgtatgcaaggacccccaggtatgctgcatcgagcaggggccatgctgccgcagtgcgtgccgggcatgggtggacagaatgggctcttttgttgctgcgctgtcatgcccgcggggcaaggggctggcgccatgcaacggcctggcaggcagagttccctcctcctgcatcccgatcacccgcaccccctccccaatccacgcccacgactggcgctgcggcgcatgcggcgccccgcgcgaccctgtggaggtggagtccgcgctgggcgacgctctgggcacgctgtgtgacgcctccgtgctccaggatctgcagtgcctcaagtgccacagcgtggccaccgaacacctgcgcgcccagtgcgaccattgtggcggcccgctggcgacctgccggccggccgcggagacactagccagggtgcgggtgttcgagagggtggcgcgcttccacggcatgccggtgctggaggagctggctggctgggtgctggcccagcagggcagcaccgcctga

SEQ ID NO: 2227 - DNA, 555 bp, Chlorella protothecoides
atggacagggcctttactggatcccaggtcgtggagcccacggccgcacaggtggcggcagcggatgcgctcatcgcccacctccagctgggagagttttcgagcgacatcattgctaaccctcacctccaaaggcactaccaggtgttggaggcgcttgccatgggagaagagcctggcgaggatgtcatggacgataccctcccagatgtggaggcattcagggctgtcgggcctgtggtccgcgccttcagggaacagggcgcgattccgactcggattctctccgctcctttatggcaggaggctgtgacggtggcagaggcctcacccagcccaggcagcaaacggaagggagctccgccgtccagcggcacccacagcgaaacgttcgatgacgacgcctgcattcggcaagtgcaggtggccgccgaggcgggcactctcggaaagctccccatttccaccctgaagccttggctgaaggcgaagcacctgccagtctccgggaggaaggacgagctggtggagaggatcctgcagcacatgtcatga

SEQ ID NO: 2228 - DNA, 633 bp, Chlorella protothecoides
atgccggaggcagacatgcaggctcccaagctctactttccaaacaccaaggacgcacactacaagtatgccaactttccaaaagtgtacttggagccacacgagattcagagcgtgaaagctgcgcccccccacaccattcgggtgctgggcttcaagtccacatcatgtctcaaggaacaccatcagctccgcagctcatcgttcgtctaccctggtgaggcgaaactccatcagctgacacccccttctcccctgcttcatcacacactttgggcagacgacagcggggtgcccgggagcagccaggtcttcgtcgcgctgcacagcgccatgctggaccaggatcaggtggcgtttggcgtgtttgcgcgaagccacagcgggggcctgcgcctcgtggccctgctgccgcaggaggcgctgagcgacgaggaggggatccaggtgaggccctggtgtgctgtgccgggatcaaatttggagggattgagtaggtgcggtgcctgcgtcgccattccatgccgtgcgaggaatgtgctgctggagccccatcaccactcctctgcctgcctgactcaaacagctcgcggccccggggttccatgtcatctacctgccttttgcggatga

SEQ ID NO: 2229 - DNA, 228 bp, Chlorella protothecoides
atgcggggtgtgacgacatgcagcccgggcgacgacttcaaatttccctgcctggtcctgactctccgccacctcgagcatgctgtggatggtctacccacccaccccactcctccccgcccccgcccagcggagaggccccaatccatggccagttacagcgtatcagatgcagtagccacctactacctgtacatgacctacgttcaccccttcatcctgaggtga

SEQ ID NO: 2230 - DNA, 1545 bp, Chlorella protothecoides
  modified_base (603)..(612): a, c, t, g, unknown or other
  modified_base (793)..(802): a, c, t, g, unknown or other
  modified_base (1459)..(1468): a, c, t, g, unknown or other
ccccgcgccgcggacgccgaggcgcgctgcgcgcgcttccgcctcgccggcaccgcggcggccaaggcgctgcaggacgggcgcctgctggacctgcccctgtcgccgctgatgtggcgcatggtggccgctgtcgacggcgccgccgcggagggcctggccccagacctcgtggatctggagactgtggacccgggcctggcgcatggcctgcgccggctggaaagcgcggcccgcgccccgggccccgcgcgcggcctggtggacggtgtcccgctcgccgacctctacctgcccgcagaccggctgccggggtaccccggataccgcctggccggcgtggatgacgcgccgggtgcgttggtgggcgtcgcctcggcgccgcgctacatcgcggcggtgctggacgcgacgctgggcgccggcgtggcgcgccaggtagccgctttccgggctgggttcgccgccgtcctgtcgccggacgtgctcctccggtttcagcccgaggagctggagctcctgctctgcggtgggttgagcaatggggcagggggaggatctgtggacatgaatggtcctcctccagacatgggaaggaggtcnnnnnnnnnnctttcgacagcagcaaagggtcgaccttctccggactgttggaagaagaggtcctcctccagacatgggaaggaggccggccaccagccgcatgcagtcccaaacctctgtaccgagacagcagggtgccttcccagtcagaacccagctccaccccctcctcctcctcccttccttcgtnnnnnnnnnnccaccgagacagcagggtgcctccccagtcagaacccagccccaccccctcctcctcctcccttccttcgtcccgctcccagggtcgggcgaggcgtggacggcggaggagctgcgatccgccatccactgcgaccacgggtacaccccggcctccgcccctgtgcgctggctggtggaggtgctggccggcctgggccacgcccagcgccgcgccttcctttccttcaccactggcgcaccgcggctgccgcccggcggcctggccgcgctgcgcccgcgcctgaccgtcgtgcgcaagagcgcgcggtcgtggcgagaggagggcacgggggcgcgcccggcgccacccagccccgcgtcctcgtatggcacgcccggtgcggtttcttcgccgggacagggggctgcactagacgcggatgccgacctgccctccgtcatgacctgcgccaactacatcaagctgccgccctactcgtgcaaggccgtgctggaggcgcggctgatgtacgtgcttgcggagggccagggctcattcgacctctcctaggctggttggacggtttctgcgtgttctcagggccgccgctgtggggagggtcctcagaggccactgacatgtcaattccatggacgaggcgacccagcctgggannnnnnnnnncggcacgcccggcgcggtttcttcgccggggcagggggctgcactggacgcggacgctgacctgccctccgtcatga

SEQ ID NO: 2231 - DNA, 2115 bp, Chlorella protothecoides
  modified_base (94)..(103): a, c, t, g, unknown or other
  modified_base (619)..(628): a, c, t, g, unknown or other
  modified_base (701)..(710): a, c, t, g, unknown or other
  modified_base (1230)..(1239): a, c, t, g, unknown or other
atggccgggggcctttgccagtggcttcatgcgtgctgcacaatacatgcaggggcaatggaccttgtgtgccggtcaccaccaccagtcgccnnnnnnnnnnacgtggggtggtgggatgggggttggaagaggggctggcatggccggggacctttgccagtggcttcatgcgtgctgcacgatacacgcaggggcaatggagcttgtgtgccggtcaccaccaccagtcgcccctgtgcaacacaggtggagatcatcgcgctcatcctggcgaatcctcgccccgccgcagctcctgatgccgagaagggcgtcctacccaacggcttctctcacaggcctgcagagtcagcgtcacctcccgtcgaccctggcgacccgccgcccgcccccctcgcgtccagtccccatgccgacaaccagcgcatgcccgggggcacgctggtcgtctgccccccggccctggtgcagcagtggcgtgctgagctggcagcccacgcggggccgggcgtggcggtggctgtgtacgacggcttgcggggactggcacccctgacccccgcggagtcgcgccagaccatgattgccccgcacccaccttcttcctttcccatgnnnnnnnnnnccgtccaacgcccatgccgacaaccagcgcatgccgggggggacgctggtcgtctgccccccggccctggtgnnnnnnnnnnagattgggggggtgcaactctggacccaggggcgtgtgcggcgtgcctcgcacctttccgtgatggccagatcgccccgcacccaccttcttcctttcccatgccggactgtgctgacaccacctgtccccccactttcctccccggtgccaactccgcgcaggcgcagcgcgaggcggagctgtacagccggctggccgcaggcgaggcgccctggccctccttctcgccggaggccgaggcgggcgaggcggccgccaagctgcgcgccgcggacgtcgtgctgaccacctttgaggtgctgaagcaggaggtgcactactcgccggacaacaagctgctggggtcgctgcgctacgccaagcggtaccacgtgccggtctgccccctgctccagccagggcaagatgcaggctctcgaggtcgcggctgtgccatccacactcgcgacgctgcgtgttcacgtcccgacacctcgccgctctccccctgggcttcccctccaacgccattttctccnnnnnnnnnncgtgccacccacgctcgcgacgctgcgtgttcccgtcccgacacctcgccgctctccctctgggcttcccctccaacgccattttctccgtcgctcgtccccccaaccaccaccccccgccacaaaacaagcacagatccgctggtggcggctggtggtcgacgaggcgcagatggtgggcccgctgtcggcggcgggggccatggtggagcgcatgtccgcggcccaccgctggtgcgtcaccggcacgccgctgggcggcttccacgagctggacgacctgcacggcctgctgatcgcgctgggccacgacccgctgggcggctccgaggcctggcgccgcctggtgcgccgccgcctggccgcggggcgcggcgacctggcctggcgcgcgctgcgcgccgcgctgctgcccctgctctggcgcagcaccaaggcggtggtggcggaggagcacgcgctgccgccgcgcagcctggctgcctcgcgcctcgccttccagccgggcgaggccgagttctacggccaggtgctggagcgcacgcgcgacgcgcgcgcgcgcctgcgcttcctgcaggaggcggcgggcggggctggggagggtgtcgtggggcgcgcgggccaggcgcaggggcaccgcaagaaggccaagacggggctgagcagggcggaggaggaggcgctggcgggcgcgacgcagctgcgcctggcctgtacccacccgcagctgacgcggcactggaagaacctgcagagcgacctgcagctgactctgggcgggacgctcagcatggaggtgggggcgggcaggcattcactggggtcgaaggggtaccacaccaagggggtgggcctccggcagctgcacgagaataa

SEQ ID NO: 2232 - DNA, 501 bp, Chlorella protothecoides
  modified_base (181)..(190): a, c, t, g, unknown or other
atgcagcgcctggtggacaaggcccagttcgagctgcagaacctggagcgcgccctgtgcgccaccctgaacaccctggccctggtgctggtggagagcgtggcgaccggagccggtgcagaggatgccagccccggagcggtggacggggaggtcagggtggaggtgaagagggaggtgnnnnnnnnnnagagccggcgcagaggacgccaaccccggagcggtggacggagaggtcagggtggaggtgaagagggaggtgaaggcgggccagttgcccccggagggccaccctccgccctccgcagcgctcgggtcggggactgcagagccaaagtcgcccacggccgcgggcggcacggtgtccacttcgacccaaaaacgcaggcgctcggtgccggggaggctgagcgccgacgaggcgaggagggaagccatcaagctgctggagcagtccttcaggtgtggaagggaggagtaaatggtgttctcgttctctga

SEQ ID NO: 2233 - DNA, 1749 bp, Chlorella protothecoides
  modified_base (28)..(37): a, c, t, g, unknown or other
  modified_base (337)..(346): a, c, t, g, unknown or other
  modified_base (789)..(798): a, c, t, g, unknown or other
  modified_base (1383)..(1392): a, c, t, g, unknown or other
  modified_base (1585)..(1594): a, c, t, g, unknown or other
atgctcaggcgaggtgggtgcacgtcannnnnnnnnngtgtgtgtgaggggggaggggtctggggcgcacccgagtgcagttcctgccacgcctcgttgcgtgcagggagggatgatccaccctgggttgaagggcaccctcgcacctcactccaaaccaacacccaacacacggcccccatgtcccctcgcaggacgcgtcggctgaggaggagggtgagtttgacgacgaggcataggcgacgcctcctcgccgcctgcaccttggcccgtgctgtatcgctcctgcacgcccccctctcgccccccccaccccccagtgcattgacccactcgnnnnnnnnnnggggaggccgcggacggggccgcgagcggccccgcggcctctcgctgcgcggcgccggacgcggcgcgcctgctgcccctggtgcgtggcatggcgcgcgggctgctgcacctgcacacacgcacaccccccctgcagcaccgcgacatcaagctcaggtggtgcgaggggggagggtggtgggtggtgcaggtggcggagccatggctgacctgactgcaggcgaggggagtggggcaggctgggcagacggcccgccgggcagacggccggctgggcagacggccggctgggggcaggcgctcgccggcgggtgggggaggggggactgcggcgccgccccgcgcaacctcccctcctcgaccaccacgaccccgcgcccccgtggcggggaacgagcatggatcgcgctccccacacgaccccctctccccccacacgcnnnnnnnnnngcgctcgccggcgggtgggggaggggggaccgcggcgccgccccgcgcagcctccctcctcgaccacgaccccgcgccccctggcggggaacgagcctgggtcgcgctccccacacgacccctctccccccacacatacacgaccctccctccccccgcgcatgcatccacccactcccgcatccccttcccagcaacgtgctgctgggccccggaggcgtgcccaagctcgcggactttggcatgtcggtgctggtgggcgcgcccgaggctgggcagcggcacgtcatcggcaccgccgcctacgccgcgccggagctgctggagcagggcccgccggcggccggcgtcgccgcgctcaaggccgacgtctactcctttggcgtggcggtgtgggaggcgctggcgcggcgcaggccgcaccaggggctggacgggtaccagatccagacgcggtggatgctggacccggaggccatgcgcctgccggggccgggccggggtcgtgcggagctgggccccgccgcagccctgctctgggtaggcaggctgtccccctcggggggggggggggggaaaaagggnnnnnnnnnngctggacccggaggccatgcgcctgccgggaccgggccggggtcgcgcggagctggaccccgccgcggccctgctctgggtaggcaggctgtccccgggggggaggggggagagggggggaggctggtggctgctcgcgccgaactctcgccaggcattccaccgccgacggggttgagctcgtggaggcggnnnnnnnnnnggggggccccccccggggggggggggggggagaaaaaggctggtggctgctcgcgccgaatcgtcgccaggcattccaccgccgacggggtcgagctcgtggaggcgagcatgcagatcgctgccagcgacctcgaacactccttccgggcctga

SEQ ID NO: 2234 - DNA, 237 bp, Chlorella protothecoides
atgtctggcaccttcatcggcaactccacggcggtccaggagatgttcaagcgcgtcagcgagcagttcaccgccatgttccggcgcaaggccttcctgcactggtacacgggcgagggcatggacgagatggagttcaccgaggccgagtccaacatgaacgacctggtctccgagtaccagcagtaccaggacgccattgccgaggaggacgccgagggcgacgaggactactga

SEQ ID NO: 2235 - DNA, 1890 bp, Chlorella protothecoides
  modified_base (1312)..(1321): a, c, t, g, unknown or other
  modified_base (1682)..(1691): a, c, t, g, unknown or other
atgactgctggtttggaaagggtgtgtgtatgtggtggacaagggcaggatgagtccccagggctggatgcgccgcgcatggcttgcaccgaccaatcggcagatggaggacttgacgttgttggggatccactccacaaagtagctgctgttcttgttctggacgttcagcatctgctcatccacctcctgcaatggtgtggcggcgatggggaaggttgggagtgggatggtgaagggggtgggcatgggatgggtggtggaatatcgctcaaggcccggccatcaggccgagttgagggctgggtcatgacaacgaccgcattcgtgaccaggcgcatgactggtggtttggaaaaagtgtgtgtatgtggtggacaagggcagggtaagtccccagggctggatgcgccacgcctggcttgcaccgaccaatcggcagtcagaggggtgaattttattaccggccgtagcagcagcttcaatcgagcacatcccattcccccgcccaaaccgcccccctcccaccttggaggacatgcggccgcggaacatgaccgaggcggtgaggtagcgaccgtggcgagggtcggcggcgcacatcatgttcttggcatcccacatctgctgcgtcagctccggcacgctcagtgcgcggtactgctggctgccgcgggaggtgaggggcgtgaagcccaccatgaagaagtggaggcgggggaaggggatcaggttcaccgccagcttgcgcaggtcggagttcagctggcccgggaagcgcaggcagcaggtgatgccggacatgacgcccgagatgaggtggttcaggtcgccaaaggtgggatcatgtgcacccctccccaaaccggcccctcccaccttggaggacatgcggccgcggaagagggccgaggcggtgaggtagcgcccgtgcctcgggtcggcggcgcacatcatgttcttggcgtcccacatctgctgcgtcagctccggcacgctcagtgcgcggtactgctggctgccgcgggaggtgaggggcgcgaagcccaccatgaagaagtggaggcgggggaagggcaccaggttgaccgccagcttacgcaggtcggcgttcagctggccagggaagcgcaggcagcaggtgatgcccgacatgacggcggagatgaggtggttcaggtcgccaaaggagggggtggtcagcttcagggtgcggaagcagatgtcgtacagcgcctcgttgtccaggatcatgcactcgtccgcattctccaccagctggtgcaccgacagcgtggcgttgtagggctcnnnnnnnnnncacgaagcactcgtcggcgttctccaccagctgatgcaccgacagcgtggcgttgtagggctccaccacggtgtcggacaccttgggggagggcaccaccgagtaggtgcacatcatgcggtcggggtcgccatcatgcggtcggggtactcctccctgatcttgctgatcagcagggtgcccatgccggagccggtgccgccgcccagggagtgggtgacctggaaacctggggcaggtgggtgggagggtgcggggcggtgaggggtggacagtcgaggggtcttggaggggcctgggcaactcggtcccgacttgggcgcggcctcatggctgtcgagatgcagccgacaaatgaacnnnnnnnnnnacccagggagtggcacagctggaagcctgagagtgggtggggaagggagagggaggatgcatgggtggggggaagcaacggatgtaatacaaactatggtggtggatgtggtgggggactgacatcacagagctcccacatgtcacacatactcccggtatgcaggggcatggagccctctcccacaccaccaccatga

SEQ ID NO: 2236 - DNA, 549 bp, Chlorella protothecoides
atggggtcaggtgtgggcgctgggcggcgacgctcgcccatcctccggcagcgcggccctcagattcagccgggagctggagtggcgcgggagttggggcaggggccgcagcgagaccacggccacggtgatgttgtcccccggcgtgccggatgtgaagtaagataccctgtcccaagcgcaaatttgctgctgccggggtttagcaggcgccgggcactcctcacaactactgttgcttggcgccagccatgccatgccctagtctaccccggtccccgccgttgccaagccctgcacccctctgcatccctctgtccacaggagcccggcaccatggatgccgtccgtgctggtcccatcggccaggtcttccgccccgacaactttgtgtttgggcagtctggcgccggcaacaactgggccaagggccactacaccgagggcgccgagctgatcgactccgtgctggacgtcgtgcgcaaggaggccgagggctgcgactgcctgcagggtgaggttgtgggttgcaggggtagttggatgtaa

SEQ ID NO: 2237 - DNA, 1026 bp, Chlorella protothecoides
atggcgattcctgctgtgctgaaggtcacagagagcggtaatgtgagttcacggctaccagggagcggcaatgaacagattgggcccggccgggccagggcaactggcgggacggggcgcagctgtggtacctgcgtaccctcatcaggccacgggacgaggaagagggcgcgagtgtcatatgtcgagactgttgaaggggcttggggaccttccaaacgtgtgcgccatgaccccatgccggtgaccaaggggagcagtgccaaggttgtcgatgccggctccccgcacagcgtgctgggcgatgccggcatcgacgactgcgatcctgcgaagctcacccagccgatcaaggaggtgaaggacaagtaccagctgctgccggccttcttgagggtgcggggtctggtccgccagcacatcgactccttcaactacttcatcaaccatgagatgaagaagatcatacatgccaagggcaacgagcgcgtgacctgcgataccgaccccaacttctacctcaagtgggttgctttctactgggttgctgaggaggatgctcaagggctgcactcctcccctaaggggggggttcttagtcttcctcacctgtttctcctacccttctcccaccctcattttctgcccccaaaccaccaccaggtacctgaacatctacgtgggcaagcccagcatcgaggaggagtacatcgtcacagacatctcgccccagcagtgccgcttgcgcgacatgacctactccgcccccatctccgtggacgtggagtacacgcggggcaaggagatcgtgatgaagcgagggaagaacggacagggcgccctcttcctgggccgcatgccgctcatgctgcgcagcgaccgctgcgtgctgaagggcaagtcggaggcggagctggccaagctgggcgagtgtccgctggaccccggcggctactttgtggtcaagggaaccgagaaggtgatcctgatccaggagcagctgtccaagaaccgcatcatcattga

SEQ ID NO: 2238 - DNA, 336 bp, Chlorella protothecoides
atgtccggcatcacctgctgcctgcgcttcccgggccagctgaactccgacctgcgcaagctggcggtgaacctgatccccttcccccgcctccacttcttcatggtgggcttcacgcccctcacctcccgcggcagccagcagtaccgcgcactgagcgtgccggagctgacgcagcagatgtgggatgccaagaacatgatgtgcgccgccgaccctcgccacggtcgctacctcaccgcctcggtcatgttccgcggccgcatgtcctccaaggtgggaggggggcggtttgggcgggggaatgggatgtgctcgactgagcagactttgtag

SEQ ID NO: 2239 - DNA, 1236 bp, Chlorella protothecoides
atgatgaccacatcgcctagcctcccgcatcgccgatgcccaagcatccccccatcctggtcttcttatgctcctgagcaggtgaagtcgtgcctgcaggcggtcctgcgcgtcgccaccgagcacgtgaagaagctggcccggggtcaggctcccgaagacatgggcctgctgagtcggctccccctccccgcctgcgaggcccgcctcgaggccatgcgcagccaggtgcgtgctgcgtggtgctttgtgcatggttacccaactgcttccatcacccggcgcacgccacccacacccaaccaggtgcacctgctgcgcctgctgcgcgaagagcacgtgcaggaggccgccctgcggctgcgcagggcccagctggcggacaccgatgccacgctggcggcggcagccgcggacccgccggagaagcgggcggggcccgaggtcttgcgccgccgggtggagagcctgaaggcggaggccctggagctggccgcgcggaggcggtacatggcgggacgcgcagaggaggccaagcaggcgctggaactcccgggattggccggcatgggtgcagctggaacgagcgccgacgccccggcggccgggccgaccgccgacgcctcggcggccgggccgacgtcgcagggcacctctgcagccggtcaggccccagggcctcaggggcccgccggggcgcagacgtcggacgcccctccgccctcccaagcgcagcgcgcgccgaccgcgccggctctgcgtggcacggagtgccccatctgctacgaggtcatcggggagggcgaggacgtgtacgtcttcggcggctgcggccactccttctgcaaggagtgctcggcgcagcaggtgctgcagtccgggcgctgcgccgtctgccgcgcgcgcgtgacgggaaagcaggtcttcagggtggcggcctcctgcaccgccgacgtcagcgccaccgaggcatgcgaccccgacgctaggctgcaccccacggtgggcgcctgggtgtcgtgggcccagctccgccccgctggctgggcctcgaaggtgggccagccaaccgcacctcacacccacccacccctgcgatcccctgccctcccgcaggtggcgcccgtgcgcggggagtggagcatcaagatcacggccctgctgcgccgggtcctgcacctgcaggagactgcgccccaggagaagtccctcgtgttctcccaggtagtaggttga

SEQ ID NO: 2240 - DNA, 600 bp, Chlorella protothecoides
atgatgacgcgcatcacctcccagttcgagaagacgcgcaaggtgagcggcccacgcgcgctgcagcccagccagtggggcatgctgtgccccgccgacacgcctgagggcgagtcctgcggcctggtcaagaacctggccctgatgacgcacgtgaccacggacgaggaccccgcgccgctggcgcgcctggccgccgcgctgggcacgcagccgctgtccctggtccccggcgcggagctgcaccacgccgacgccgcgctggtgttcctggacggctgcatcctgggcacgcaccgccgcccacgcgcgctggtggccgcactgcgcacgctgcgccgcgccgcacgcctcggcgagttcgtctccgtgcacgtgcagcacgacgcggtgcacatcgcggccgacggcggccgcgtctgccgcccgctcatcatctgcgacgcgggcgtgccgcgcgtgacgggcgcgcacctggcgcgcctgaaagcgggggagtggagcttcaacgactttctgaccgcggggctcgtggagtacctgggtgggtacgtcgggggggagggaaggggggccgagcccagcgctccagggctatga

SEQ ID NO: 2241 - DNA, 1182 bp, Chlorella protothecoides
atggaggccctggccgcgatgcctgacatcccctccgacgcctcggccacggtgcacgcctggaaactgctccagctgaacaccgcggcccagctggcgtcgctgtacggcgccgagggccgcaccgaggacggcgcggccatggagcgcgacgcgcgggacaaggccgcctacgtccgcgccgcggcggagatggaggtgacgcaggtggagtcgcgcctggcccagaccgcggggcagtacgccggcgcggcgcgcgtcctggactcggggtggcgcgccgccgtggccgccggcttcccccgggcctggggcctggaccccgcgccggacccggctgcctggctggccggcgtgcgtgcggcctttgccgcggagcaggcggcggaggcggcggagctggagcaccaggcctccgcggtggagcacatgctgggcacgcgcgtgcagaagctgctggcgcacctggacaccggcctgcagggcgggctgggcgcgctggagcgccacgtcaacggcgcgctggcggaggcgcaggtggcgcggatgcagaggacgctggccagcctgacggggaggaaagaagggaaatccgggatggaaaagctatactccgcctgccacacgcccctcaccccccgccccaacccctccacaaatgcagagctgtcgacggaggcggagctcaaggcggcatgtgagagcgccatgccggtcctctccctgctgcacgactaccagcgccgccgcatcatgtcgcagtggttctacctgctccccgcagaggcggtggaggggcgccgcggccgggcgcgccccggatcacgggctgggcccgaggccaggggagtcctgcaggaaactgacgacggaaatggagcggagcagcagtgcggcgagagacccagcaccggtgccggagacctgcccgcagtgctcgacggcgaggccgccgagctgcggcggctgctggcggagcaggcggcccccttccatgcggcatcagcttggatgggcgcggcggcagggtatgttttcaagctgggcgaggctgggctgggctactacgcggacactcccgtggaggctgccccgctgtacaccccaaccctggtgagaggcctctctgctttccaagaggcggtcgaccgcactgcgccctcgccaatggtcatggtataa

SEQ ID NO: 2242 - DNA, 750 bp, Chlorella protothecoides
atgggcgtggagagcgaccaggagtttgtgcagcttgtggggtcggagccggcctttggcagcctgctggcgcccaccttgcagcactgccgggaggagagcacgggcgtgttcacccaggcgcaggcgctggagttcctggcggcgcgcgtcaagtccagccgcccgcctggcggcttccagcgccggggccgctcgcgcgtcgacgaggcacgtgacatcctgtcgggcgtggtgctctgccacgtccccgtcccgcgctacaacttccaggccaaggtggtttacctggcggtcatggtgcggcgcatgctctgcgccatgctggacccgggcttcgtggatgaccgcgactactacggcaacaagcgcctggagctggcgggggggctgctggccctcctcttcgaggacctgttcaagaagctgaacgcggacctgaagcaccacacagacgccacgctgtccaaggctaatcgcgcgacgcaatacgacatcgccaagtgcctgggcacccacaccatcaccgccggcctggagaacgccatcagctcggggaactggaccatcaagcgcttccgcatggagcgcaagggcgtgacccaggcaagggtgatggagaggacaaggggtgactcctttgtgtgcactggacagtcacacgcggcactcccctggctacctggcgatgttgaggaagcaggcgtggtgcactgggccaggggtgtccccatgcgctcggcgggctga

SEQ ID NO: 2243 - DNA, 438 bp, Chlorella protothecoides
atgatcctggacaacgaggcgctgtacgacatctgcttccgcaccctgaagctgaccaccccctcctttggcgacctgaaccacctcatctccgccgtcatgtcgggcatcacctgctgcctgcgcttccctggccagctgaacgccgacctgcgtaagctggcggtcaacctggtgcccttcccccgcctccacttcttcatggtgggcttcgcgcccctcacctcccgcggcagccagcagtaccgcgcactgagcgtgccggagctgacgcagcagatgtgggacgccaagaacatgatgtgcgccgccgacccgaggcacgggcgctacctcaccgcctcggccctcttccgcggccgcatgtcctccaaggtgggaggggccggtttggggaggggtgcacatgatcttgagccaagagaccagggcgtgtga

SEQ ID NO: 2244 - DNA, 1743 bp, Chlorella protothecoides
atggcgggccgagcccagcgctccagggcaatgagtgtcgaccagcactggacggcgtggcattccccttccatcaacggcaagccccctcacacagaatcatgccccctccccccccattcagacgtaaacgaggagaacaacgcgctggtggcgctgtacgagtgcttctgcaaccccgccaccacgcaccttgagatcgagcctttcaccgtgctgggcgtggtggcggggctcatcccctacccgcaccacaaccagtcgccgcgcaacacctaccagtgcgccatggggaagcaggccatgggcaacatcgccttcaaccagctgcagcgcatcgacacgctcatgtacctgctgcagtacccgcagcgccccctgctcaccaccaagaccatcgagctggtgggcttcgaccgcctgggcgcgggtcagaacgccaccgtcgccgtcatgtcgtactcgggtgtcgctcccctgccaccgtcgcccctccccagccacgcaaccccacccaatcacaggtacgacatcgaggacgcgatcgtgatgaacaaggccagcctggaccggggcttcgggcgctgtgtggtgatgcgcaagtatgcgaccacgctcaaaaagtacggcaaccgcacgcaggaccgcatcacgcggccggcggaggcagcggcgccagccggcgccagcagcaccaccaccacccgccccggcggccgcttctcggtgctggacgcggacggcatcgcgggggcgggccgcgtgctgacccagggcgagtgcctggtgcacaagcaggtgccgctgaacacgcgcgatgccgcgggccccggcggcggcgcgctgcccgagtcggggtaccgcgccgcgccggtgatgtggaagggcttcccgggggagcgctgcgcggtggaccgcgtgatggtgaccagcaacgacgactcggcctgcgtggtcaaggtgctggtgcggcacacacgccgccccgagctgggcgacaagttctcctcccgccacggccagaagggcgtggttgggtgcatcgtgcccgaggccgacctccccttctccgagcgcggggtggtgcccgacctgatcatgaacccgcacggcttcccctcccgcatgaccgtgggcaagatgatcgagctgctggggtccaaggcgggggcggtgtccggccgcctgcactacggcaccgcctttggcgagggcagcgggctggcggaccgtgtggacgcgctgtccgcggagctggtggcggcggggttctcctattcgggcaaggacctgctccactccggcatcacgggggaggcgctggaggcatacgtcttcatggggcccgtgtactaccagaagttgaagcacatggtgatggacaagatgcacgcgcgcgcgcgagggccgcgcgtcgtgctcaccaggcagcccaccgagggccgatcgcgcgacggcgggctgcgcctgggggagatggagcgcgactgcctcatcgggtacggcgcgtccgcgctcctcctggagcggctcatgatctcctctgaccagttcgaggtccacgtctgcacccactgcggcctgctgggctactgggacgcggcggcgcgccgcgcgcgctgcccgggcaccggtcgagccgacgccatggccaccatgaagctgccctacgccgccaagctcctgttccaggagatgcaggccatgaacatcgtgccccgcctggtgctggccgaggcctga

SEQ ID NO: 2245 - DNA, 2004 bp, Chlorella protothecoides
atgtgttccccctaccaaacaacccagcccacaaccaacccccacccaaacacccaggcggagcaggatgagaaggagcggcggcgcaaggagaaggcggaggcccacctgtacaccctggtccgcgtctccaccgacgccgacatggcgtcccagattgggcgcgagcgctggttcgacctggtagaccacgagggcgtggccaccttcaagctgagcaagcgcgcgcccttctccgcgctgcgcgccgaggcggcgcgcgcgctgggcgtgccccccgccgcgcagcgcttctggcgctgggccgcgcgccagaacgggacctaccgcccctcgctgccgctggagccagagtcggacgaggtgcccatcagcagcctgcgtgacggccgccgcgacctgcgccccggcacgatgagcacgctgaacctgtacctggagacggcgcccgacgggggcggtggtgtcgggggcgcggcggggggcgtcggggccggagccgacggggcggcgcccgacggcggctcgcccggcgcccaggacggcgctggcgatgcgagcagggccacgaacacctcgtccacccgccaccccgcggccgcgcggcgcgaacgacatcctactcttcttcaagcacagtttgtgcccgaccccgaggcgcccgcgctgcgctacgcgggctcgctccaggtgcaccgccacagccggatcggggagctggcgcccgcgctgcgcgcgctgggcggcctcgcccccgatgccgcgctggaggtgtacgaggaggtcaagttcgagcccagcgtcatggtggaggcgctgcgcccggcgctgaccgccgccgccgcgcagctggagaacggggacgtgctggtgttccaggccgcggcggcgagcctccaggccccgcccgactgcccgcgggagcacctctccgcgccggcctacatgtcgcacgtgcgcaaccgcgtgcgcgtcgccttccggccgctggagtcccccggggaggagggcctgctcctggacctgcgcaaggacatggggtacgaggaggtttccggcgcgctggcggcgcggctgggcctggaccacccgctgcgcctggcgctgacggggcagaacccgtacagcgcgctgccgcgccccgcgccgctcaagtacgcgcctggggccatgctggaggagatgctgcgggcggggcagtacggcgcggcggcgggcagcacgctctactacgaggtcatcgacctgcccctgcccgagtacgagaagctggtgaccttcaaggtaccagcgcgggagtcggggggtcgggggggtggagaaaggatgccgagggtgtcgttccacaacgccaaggcggaggaggtcagcgcgcacagcgtgcggctgccacgcgacgcgcgcgtgagccagctgctggaggagctgcgtgcgcagctcccggccggagccggcgtgggcgacgcgccgctgcgcctgatggaggtctaccagtggcgcgtctggcagctcttcgacccggaccaggcggtggggtccatgtccggcgacgcgctgtggcacctgcgtgctgaggtggtgccccccgaccagcggggggcggggggcgaggagggcctgcacgtgcactgcctgcaggtgacggaggaggcccacaaccgcgcctttgccttcagcgaccccttcatcatgcgcgtgcgggagggcgagaccgtgggcgagctgcggcgccgcgtgcaggtcgcgctgggggtcggcgatgaggagtttgcgggctggcgcgcgctgctgtgcccgccgctgtcggccccggagccgctggaggacgaggaggtggtgaccgcgcgcctggcgcgcacagacctggagcgcctgtacggacaccacgaccgcgcctgcatcgggtgggagcacgagaaccggaacccgcgcaagacgcacgcacacctcaaccgcaacgcggcctggtacgggcaggagcgccagctcaagatcaaggcctga

SEQ ID NO: 2246 - DNA, 768 bp, Chlorella protothecoides
atgacgacaccggaggtgaccgacgccgagatccctaaggcgctactgaagcgtctcatcaaggccaaactttccacagtcgctggggcagatccaaccagggactaccaaattcacaaggatgcactgctggcctttcaagaagcagccaagattttcatccactacctgacggccccagccaatgacgtgtgccgggatgcacggcgacagacgattagcgccgaggatgtgctaactgccctcaatgacctcgactttggggaggtcacaggcgagctgacggaagctctggaaggtgagacattgcgtttccaaggattgggccctggtggggtgcaccgcagcatatcgcatgacataaggctgtatgacgaccttcctgcctcgcacacagatttccgcactgaggcgagggagaagtcaaagaagaaggctgaggggaagaagcggaaggccgaagactcacacccctcctgttccttcctgccatctgcttcagagacggccgatgctggggagggggagcaggccggggcgagcatgcctgccggtactcgagacacagatggggctgagcaggcagatactgtgcacgcccagccacccagccagaacccagaggggttgcaggttgcccaggcatgggttgcccaggcagggtttggggaggcagggccgaaccctgaagccccagcaccgcccgtaacggccggcgattccctcccgacatccattgcccctcctgctgttaacccttccgcttga

SEQ ID NO: 2247 - DNA, 1581 bp, Chlorella protothecoides
  modified_base (977)..(986): a, c, t, g, unknown or other
atgcgcccgctgagccctcctgggtgtaccctggaaccatgcaatgcgggcagggcttgctgcaccaacacctggggctgcctgggagctgaaggcgtgcctggctgccaggcctgcaattaccggtcatcaccatcccgactctcaatccagaggtgcaacccgcatcactctccccctctgcttctccccgttctcaccccgctcctgaccccgcgaccccgccgccccacctggtccttcagcgtgccaaagcggatgacattcacctcctccttctccatgtactgctcgttcagctgctccacgtcccgcgtcagctccgcaacaaaggctcgctcgccctcgtccagagcagcggccgcatcctgggcgctgtcggccagggtggctgcggaggcgtccagggagggcagctccagggcggtgtctgcctcatcctcgtccccgctcgcggcctccccgaactcggaggcggggtccgccaccaggctggagtcgtcatggccggcatcgccgcaggggatgcgcttcagggacttcttcaggtgcttatatagggtgaaaagctccgcggcatcgggcagctcttccgcgctgttccgcaaggcagccgcaaacttcatacccccggatgaaagaaatgtagctgcaggtttgggaggctggggagtgggtcagacctgggcaggagggtcccttcaggttatcccttccggtaccaggttgggtgcgggggtgtacctgggtggaagcaggtatcgaggctgtcactcggcaggcaggcacgggccaatcagggtgccgagggacatggggtcccaggggtgctcagcagctccagctggtgactggtgcctcccactctcggggtacggagagaggagggtcggtatgctccaaggcttgtgttctttgcggggaattacctctctgcgaatcagtgcgtcggaatccgaggccgtaaattcgaagannnnnnnnnntgcggggaattacctctctgcgaatcagtgggtcggagtccgaggccgtaaattcggagttggacctcattcagactgcagtactcgcaggcacggcatctttgtcgcatatattccgtggatccatgccgctcccgaatgcccaaaagaaaggggaggccgggctcgacacactgagcctgagccacataaccctcatcgcgcctcccaagacagacacagcgagatggtaagtgctacacctgttttgccctgtcctgcgcgcacatcagtggtgaaaatccaacccccggagctaaagggcttcatggagaagaagctgagcagtgagttgggaaaccatcactcagtaggccagctcactgcaactgttgacctgacaatgctccatgcttttcttccgcccactcctcatcccgcagttcatctgaacgctaaccggcacgtgacgggagtgctgcgggggttcgaccaattcatgaaccttgtgctggacaacactgtggacgagaagctgaaggttgacattggcatggtcgtaatccggggaaacagcattgccacgattgaggcccttgaagccattggcgagtag

SEQ ID NO: 2248 - DNA, 357 bp, Chlorella protothecoides
atgtcatgtagagatgcactgccacccaaccctgaccatcccaaacccaaccaacctcaggctgcggcggccaggtctcgccaggagctgcagcgagcctaccgcgctgtggtcgacttccacggcgagctcctcctggtcctgcactggagcatcctggcatacactggccttgtcaaggtgggcggccatggccggtgcaggggcgacaccgtgggctattgcgctgccgcgcaagtctggccgggcaggtggcggtgtgtgggtcggccacgtgcttcctcttgggcaccgcccactgacgctcgaggccccaccttgccaatcggggtcaagcttcacgtaccctgtccgtga

SEQ ID NO: 2249 - DNA, 459 bp, Chlorella protothecoides
atgaagtttgcggctgccttgcggaacagcgcggaagagctgcccgatgccgcggagcttttcaccctatataagcacctgaagaagtccctgaagcgcatcccctgcggcgatgccggccatgacgactccagcctggtggcggaccccgcctccgagttcggggaggccgcgagcggggacgaggatgaggcagacaccgccctggagctgccctccctggacgcctccgcagccaccctggccgacagcgcccaggatgcggccgctgctctggacgagggcgagcgagcctttgttgcggagctgacgcgggacgtggagcagctgaacgagcagtacatggagaaggaggaggtgaatgtcatccgctttggcacgctgaaggaccaggtggggcggcggggtcgcggggtcaggagcggggtgagaacggggagaagcagagggggagagtga

SEQ ID NO: 2250 - DNA, 831 bp, Chlorella protothecoides
atgggcgccaggtggctccccatccgacgagggtgctgggcgctgctcttgctcgccatcgtgagcacttgccgcgcctggaactcctctaacacatgcgaattcatagaagagcagccgagatacgttgcgctccgcgccgacctccgcctggtggccagccagagcagtctctacctgggtgatgctctggctagcaccctgcaaaccgccctgggcctcccgccctgcgccatacagctgagccagggaacggcctgcaacccctccgaggccgtggcatcctgctccagacccttttacgtgtgtggagagcaggccatgtcgtccgacctccacgccctggcgctgacaggcacctgcctcgagggcaatgccacggccgtgccggcatgcgacctcctcatcgccagccccgacctccaggacctggcagcctctggcagctgcaaggtggcttgcctcacgcccagctcaggcgaggctgcagtggggtttgctgccgcgatgccacccactgtcaaccaggacacaggctgcacccgcttcagcctcagcgtcctgctttcggagggggaggaggtggaggaggtctccgctgccctcaccagtgacgccactgctgcagcggtggttggcggggtggccaacttcgccacccgttccacccagttctacgccacacccgcaggcgagcaatggcagcgagaccccatcagtagacaaggactgggccccttgaagccttgtgtctcgccagagactcaggctgcttcaaatctctctccttcctttctcatctgtgtcgcatctgttcacgagcaggcgtcg

SEQ ID NO: 2251 - DNA, 1764 bp, Chlorella protothecoides
  modified_base (73)..(104): a, c, t, g, unknown or other
  modified_base (355)..(364): a, c, t, g, unknown or other
  modified_base (675)..(684): a, c, t, g, unknown or other
atgctgtggcctggatctggtcggagacctgttgactccctcgccgcattggtggtggagggatgtgcccctnnnnnnnnnnnnnnnnnnnnnnnnnnnnnnnnccacccaggcaccgacctggtcatcgtctcccgcgcctccttcagcccctggtctgaggacgggtcggatgcgctgccgcagtttttcaacaaccacaattccaacgccatctccttccaccgcatcaggcacttccgtgcctacgccaacgcggagtgggccaacgagcaggctcttgaggaggtctcacgccgcctgccgccccacccgctccgttcaccgcctcccacgcagggcgagtactctgggnnnnnnnnnnggagtgggccaacgagcaggctcttgaggagggctcacgccgcctgccgccccacccactccgttagccgcctcccacgcagggcgagtactctggcccagagcgcaagtccaccaactcggtggggagcctggtgcagaccctgctgggcgactccaaggccggcgcggtgcagcagctgggggagtcccagggcgcggccggcgcagcagagggcgcggccggcgcggctcagggcgccaaggcctgatgcgccggaggcagggcccggggccgcaccttcggccggcccgcgcaacacgaggcgattnnnnnnnnnnccaaggcctgatgcgccggaggcagggccccgggccgcgccgtcggccgccccgcgcaacacgaggcgatggaggctcggagggcggcgcgccgtcctgctccccttccgggagccacgtcagaaacccatccatcagtacccctctgccatcttcgtcctactttccccccacgtacccccacccttcaccaggctcattgcgcaccctcacgcactgcacaaaagaaactttcctctttccatttacacacagaagccttgccccttgatctttatttctggcacttcacgtgtcgtgcttaggctggtgtacaggactcaaacctcgcacgtacaccccaatgttgaccgacctcgcccttcatggagtgagtcatgggagtaccgtggaccaagccacggtcaggttgcacgcgctcctggccgcgatgtccaagctcgacgacgagatgcagcatgtgcagctggtcctgaacaagagactggagcagtgtgccctcaaggaagagagcttgaggtaggcccgaaggctgagctgctatgtcctccatggggcctcattcaaacatggaaattggcctgcacactttggtcaggtcctcagggcttcttcgccactccgatccgttccagtgacctcagacggcgccaagcccagctggagtcccagtcgaccgtggtggatgatgccctgttggagaagattgctgccattgaggccctggaaatccagttactcagcgcgggcgtctcggtccctgaaacagcaagtccttcagctacgccgcaatgcctacgtgtggtcgagcaagcatggatgccaaatcgtggatctccggtgttcccccgtgagcaacccacttcccctggctgccgcttcattgacatccccacccccctgacaggttggatgaggtggaggaccgtcccagtaagccgatgcctctacaagctctttggaggaacactggaagaatggcagctgcctttcccaccatgctgtccaatgcacggacggcactccgatccaaatcaggcaaagagagcaaggagccacagctgggttaaggatcgctag

SEQ ID NO: 2252 - DNA, 567 bp, Chlorella protothecoides
  modified_base (13)..(22): a, c, t, g, unknown or other
  modified_base (189)..(198): a, c, t, g, unknown or other
  modified_base (527)..(536): a, c, t, g, unknown or other
atggcgctgcgcnnnnnnnnnnggcgggcatgccagggctgcggcggcgcggcagtagaggggcaaggggatcacgcccccgctcgcccccatggcgccgcgccgtcccttgggcgccgcgccgtcccttgggcgccgcgcgtcccttgggcgccgcgcgtccaggcacctgtttgccatcctcagtannnnnnnnnncccttgggcgccgagtgtcccttgggcgccaagcctccaggcacctgtttgccatccccagtcccccctgcctcccgcccgccagggtcaaatgtgtacggcggcgtggactgggtggccatggccatgagtggggacgagggcgccgacctgacgctgccggagtcgtggacgatgagcacgccgctggggaacccggcctccgtttacgccaacgagatgcgggtgctcttcgacgtcgccttccggccggacaagggggtgtgtggggggggtagagggggggcgccttggagggaccacaatggagacgaggagggggggcggcnnnnnnnnnntcgccttccggccggacaagggggtgtgtga

SEQ ID NO: 2253 - DNA, 801 bp, Chlorella protothecoides
atgttttcggccacttggcccaacgtcatccgtaagctggcgtcggagttcctgtccaacccggcccgcgtcatcatcggctcccaggacctcgccgcctctcactctgtcaagcaggtgatcgacgcccccgcccgggacgcgcgcctgcatgccctgctgcagcagtaccacggctcccgcaccaaccgcgtgatcgtgtttgtgctgtacaaaaaggaggccacccgcgtggagtccctgctccagcgaaagggctggaaggcggcggccgtgcacggcgacatctcccaggcccagcgctctgctgccgtggacgccttcaaggccgggacggtgccggtgctggtggccaccgacgtcgcggcgcgcggtctggacatcccggacgtcgaggtggtgatcaactactcattccccctgaccacggaggactacgtgcaccgcatcgggcgaacggggcgggccggcaagaagggtgaggctgtgggtccttctggccccacagcttcatgcctccacatcaccttaccgccccaaccatctcatgcctcacccctgaactccccaataatgacaccaggcctggcgcacaccatgtttgtgggggccaacgacaagccacgggcgggggagctgatcaacgtgctgaacgaggcaaagcaggaggtccctgccagcctgttccagttcgggacctcggtgaagaagaaggagagcaagatgtacggggcgcacttcaaggacgtggacctcacaaagaaggccagcaagatctcctttgacagcgacgacgagtga

SEQ ID NO: 2254 - DNA, 726 bp, Chlorella protothecoides
atgtcgactgatgcagtggagaaggcggagcgcaagaggctgaagaaggagaagaaggccgctgcggctgccgctgccgccgccactggggcaggccccagtgccagcacagccgaggccgaccccacccccagcaagaaggagaagaaagagaagaagaagaagaagcgggaagagggatctgaggccgcccctgcccccaccggcaagaagagcaagaaggcagcacccccggccggccccgccccccttgccgaggtgggcgaccgcgagctcgtggccaagcgcccccccctggtcaaggccctgtacagcgaaactgcggaggtggcctctcagagtgacgcagaggtggcggcctggcgcgaggcacgggcaatcgtggtggagggctgctccctgcgtcccatcaccgcctttgcccagaccgggctgtcgtccacccagctgcacgccgtgcgtgctttctcggcgccctcccccatccaggcccagtgcctgcctatcgcactgtctgggcgcgacgctgtcggcatcgccgccacggggtcgggcaaaaccttagcctttggattgccagccctggcccacattgccgcccagatcggggcgggcgtggtgacggggaagaagcccatcgccctggtcatcgcccccacccgtgagcttgccatccagatcagcgtggtgctggaggaggcgggacagccctgcggcatcaggtga

SEQ ID NO: 2255 - DNA, 1353 bp, Chlorella protothecoides
atgtattccatcgctatgacgccccgactgtctagctgctcccgtacggggggcgcaggggccgacaggctcgctgcgttccggcccagccgcggtccccagcggccgacccgggccgcacgccaggtcttcgccaaggcggtcgccactcccacgaaggaggccagtactagtgcgtccaagtcggccagcatcagctctgagacggccaaggagctgtaccgggacatggtgctgggccgcgagttcgaggagatgtgcgcccagatgtactaccgcggcaagatgttcgggttcgtgcacctctactctggccaggaggcggtctccacaggtagggcggtcggggtctcgatgcgtattgaggtgggtgcccggccggcgatcgccgctcacctacccgggtccacttcccttgatctccaggcctgcctgcgcaaggacgactacatctcctccacctaccgcgaccacgtgcacgccctgagcaagggcatctccgcccgcaagatcatgtctgagctgtttgggaagaagacggggacgtgccgcggccagggcggctccatgcacatgtttgacgccgagtacggactgctgggcggctacgccttcatcggcgagggcatccccgtgggcctcggcgcggccttcaccagcgcctacaagcgccgcgtgctgggtgacgacggcgccgaccaggtggccgtcaacttctttggcgacggcacctgcaacgtgggccagttctacgagtccctgaacatggcctccctgtacaagctgccctgcatcttcgtggtggagaacaaccggtgggccatcggcatgaaccacctgcgcgccacggggtccaccctgggcgacgaggagccctggatccacaagaagggccccgcctttggcatgcccggagtgcatgtggacggcatggacgtgctggcagtgcgcgaggcggcgctggaggccgtcgcgcgcgcgcgccgcggcgagggccccacgctgatcgaggcagagacctaccgcttccggggccattccctggccgatcccgacgagctgcggtcgcgggaggagaaggagcactacgcggcgcgcgaccccatcccccagctccgcgcctacatgctcaagcatgggctggccagcgaggccgacctcgcggagctgcacgcctccgtggcggccgaggtggacgactgcgtggagtacgccgacgcctcgcccaagcccgacatgagccagctgctggagaacgtgtttgccgaccccaagggctttggcatcgcgccggacggcaggtaccggtacgagctgccgggcttcaccgccggcaccgccgaggtgtcctaa

SEQ ID NO: 2256 - DNA, 1710 bp, Chlorella protothecoides
atgggaaggcttccttgccatgctgctgggcatgatggcagccagccccggccactaatctgcccggaacgctcccctctgaacacctcggctgggatgaagtcgcgacttcaagttagtcagagtcaacataataaccgaggagagaaatccaggaatggcttgaccgcccgatcgatcctgcatcctcctcatgcaaggggtgtcctgtttccagaggctggtgccctgcccatgccgaaccgtcttccagccgatccataccaagagtctcaggaaacctcaggtcggcttgggcgaggatgcagcggcattcagcctggaggatcagagcctttcctcatgggtcaaattttccgtgctgttggcaggcgtcttcgccctgctctaccccgtgagaggggtgggaacgggggggggtggatggatttgggtgccccccctctgagggttgcctcctggatgccatgggtgactattctgacgactgccggctcggaggaggatggaccctgcaacccaggccggactctagcacgtcatccccctcacacccaccaacagatctggatctccccggatacggggctgggcaaggaactggctgcccttctgagctcggtggggtcctcctccgaggtcaccatggtcctcatcctgaccctgtttggcgtggtgcacagcggtctggctgccctgcgaccacaaggtgagctggagctttcggcagtggtggggaggcgcggggtgtggactcggcagagtgccacccctgggctgtctcaggcgccgcttcgtccgcaagaccactttggagctgatgatccacgacggtcccagaatccgctggcacactcgcaccaccggcatcaatcccgccaccacacacacacaggtgaagcgctgatcggcgcccgggccttcagggtggtcttcgcctccctcagcctgccgttggcaggcctggcggtaatgtacttcatcaatcatcgttacgacggcgtcgcgctctggaacatcaggcgcgtttgtgttctgtggggcatgttgggcttgaagggttgtgctggcggggcatgtcccttagatgccagggtcaaggcacatgcatctcggttctgcatgcccctcagcgtgtcgactcccttgcccacccacaagagtgcctttaaccccccccaccctcccaaacacgcacgccacaccatgcccaggggcctgcccggcgtgcacagcacggtgtgggcactgagttttctctccttctacttcctctacccctccaccttcaacctgctggaggtggcggcggtggacgagccgcgcctgcacctgtgggagaccggcgtggcgcgcatcacgcgccacccgcaggcctttggccagttcgtgtggtgcgccgcgcacgccgcctgggtgggctcctccttcatgatggtcaccaccgctgcgctgctgggctaccacgcctttggctgctggcacggcgaccgccggctggagcgggagcatggcgaggccttccgcgcactgcgagaccgcaccagcgtggtgcccttccaggcggtgtgggaggggcgccagcgcctgccgcccgactactggagggagtgggcgcgcctgccctacctggccatcaccctgttctgcttcgggacctacgccgcgcaccctgccatgcagcaggccgcctactggctggggtggtag

SEQ ID NO: 2257 - DNA, 264 bp, Chlorella protothecoides
atgggcgtggggtgcaccatcgttcaccatgtcgccgcgttcgtgcagatcgcactcgccgtggccatcgctgtcattgtcggcatcaagctgttccgggtggacgtctcaggcgatggggaggaccccaccgtcacctccacatgcctccttggcgaagactacgacaacgaaagcctctgcgtttattgctgtacatgccacctctgcggcctgggcgccatcctggacaccatctttgccgctgctggcactgcctggtga

SEQ ID NO: 2258 - DNA, 1113 bp, Chlorella protothecoides
atggcgattcattctcgtatcccaatgatcggattcaaggtctgcattattaaacccgcccttccctcctcctccatgtcgcagggccagtttgaggcagccctcaagctggctccccacccgcccaatcttgctgccatagaagccagcatatatctggtggggcagaggaaggagtcggaggatgtagtcatggcgtttcgttcctcaaaaggcgtctgtcagggtttgggcgaatgcctgcagaactggggcgagacgacactgtcggccgcttccacccttcctgacgacgtgctgacttgcgaggtggaggccgaggcgcagaccagggcatgcgccctgttccgccgcgctgtccacgcctacggcgccgccgtcccctgcgaccagccctccacctcggccgctgcgactccctgcgccgcgccttccacctcggccgcgccccgcgccgacgtggcggtcaactgcgccaacactctggccagctgggcggaggctgccgtggaggggcaggagggaccccgccagctcctcgcccaggcgctgcacctgtaccgcgccgcgctttccagcgagccggacgcccttacctggggcaacctggccgacgcggaggtggcaacggcggtggcggctgccggcgacggcgacggggcggcggcggaagcgtgcgctgagcgcgcgcgcgccgcgtacgccaccgcctgccagctgtcctccaccgacaacggtgacgacttgccgggcctgctggccaactggggcacggggcttgtggccctggcggggctgatgcaggtgggcgctgatgggggtgtgaatggcttcccactcacgttgggatcccccgtgcatattctccaaccttccacataccagcaggactctgcaacaaaactggccacgctggaggaggcggtgcagcgcctgagggagagcgcgagcttcgaccgcgccgaccccgccccgctgtgcgcgctgggcgacgccttcgtggcggcggcggaggcggacgccgacggccctgccacgctgcgcgcgctgtgctccgcactggaggatgggtatggcgcggcgctgcgcgtcgacgcgcggcacgccgaggcg

SEQ ID NO: 2259 - DNA, 594 bp, Chlorella protothecoides
atgcccatcttcacctactccaccctagtgacggaggcgggcgcggcggtgctgaccctggcggcggcgtgcatcgaggggtccaccccccgccatgacccccgctccgcccactacggcctcttccagtgggcctcctccgcgagctactttcctaaaatcgcctacctggcggtggtgcccggcatcctgggccacaccggcttcaacgccctggtcaagtacatggaccccctcatcctcaccctggtcggcaccatggagccgctggtgggctcctttgtgggccacgcgatggggctggtggagctgccgcaccccctcacctacatcggcggcgcggtggtcctggcctccaccgtgatcgtctccgtcgcgggccaccaccgcgctggccgcaggcctgtgcgcctctgcgagggtatgcgccgaccctcgccccgccgtcacaggttcataaggaagacgagcaatgatcaacatgttcttttttccatgctcttacacagtgacgaccgccagcgtccagttgacctgaggcatgatgcctggtctctctggacaccaaatctgtgcacgggcgcagtcacctga

SEQ ID NO: 2260 - DNA, 429 bp, Chlorella protothecoides
atgaccaccgccatcatggtccccgcggctgtgttcgaggtagtggcccagatggacaccaacacgcgctggcgcctagcgcgggccgtctggacgctgctgctcaatggctcgctcctggcgctccactttgggctgtgggtgctgtcgctgaagaccacctcactcccgcacgccatgctcttcgtctgcatggcgccggtcattgtggcgctgagcatgtggatcatgcgccagcccatctcctggggtaaggggaatttagggttgccgggtaggtcgcgcagggggacgagtggtgattcgacttgctgctgcgttgtgcatcacattaagagtatgtccaacagcctgctcaacccgaggctccaacctccaaatcgtgcttgcccacccgctcctgcccgaatgctcggcagtgctgactaa

SEQ ID NO: 2261 - DNA, 99 bp, Chlorella protothecoides
atggacggcgaggggtggatcccggtcagggccatcgcagccttcaaccgcgtgcgcatgttgaccccggagccggggctgatcgcgcaggccatgcag

SEQ ID NO: 2262 - DNA, 1530 bp, Chlorella protothecoides
atgatctacagcctggggcctgcgcatgttcctaccacggccggctttcccatctatgttgcatcggtgaatgcggggcccagaccctgtgcaccatgcaggagccggcccgcacctcctccacccctcccactgccgtctcgccatctcacccccccacccccccaaaactcaaggtgcctcttcacgctgctggggcacctggactacatccgcaccgtccagttccaccacgagtcgccctggatcgtgtcggccagcgacgaccagacgttgcgcctgtggaactggcagtcgcgtacatgcatcgcggtgctgacggggcacaaccattatgtcatgtgcgcgcagttccacccgcgcgacgacctggtggcctccgcctcgctggaccagacagtgcgcgtgtgggacgtgagcgcgctgcgcaagaagggcgccgcccccggcggcgcgggcccgccctcggacgactcgatgcgcctgccccccatcaactctgacctgtttggcggctccgacgccgtggtcaagtacgtgctggagggccacgaccgcggcgtgaactgggccgccttccaccccacgctgccgctggtggtgtcgggcgcggacgaccgccagatcaagctctggcgcatgaatgagagcaaggcctgggaggtggacaccctgcgcggccacgtgaacaacgtctcctccgtcatcttccacgccaagcaggtgtgttggattttgtttccttttttttgcctgggccgggcctcaatagtctggacagcagggacgataggcgcaccctctgcatgcccgacagctgactcagtcgacgcccgtgccccaccgacgcctccacaacccgcgcaggacctgatcatcagcgacagcgaggacaagtcgctgcgggtttgggacctgagcaagcgggtgggggtgcagaccttccgccgcgagcacgaccgcttctggatcctggcggggcaccccagcatcaacctgctggcagcggggcacgacagggatgcagggctggggcccgtcgaggctgtgattccgtttgcccaccggagctgcggggttccaagcaccccactggcggctgtgccgcccctgcgcctcgcggccgtctcccagtcgcgtggccgagctcagtatcggcacacactcacacacaagagtaatcccctctcaatccactccattccctcccgtccccgcccccagcggcatgatcgtgttcaagctggagcgcgagcgccccgcctacgcgctgcacgccggcacgctgtactacgtcaaggaccggtacgtgcgctcgcacgagctggccagcgggcgcgacgtgccgctgtgcgcgctgcgccgcaacccggcggcggcgtacaaccagggcgcgcgcgcgctggcgtacaacccggccgagcactcggtgctggtctggagcgacgtggacggcggcgggtacgagctgtacgcgctgccgcgcgagccggcggcgggcaaggacggcggcgcgggggcggagccgcg

SEQ ID NO: 2263 - DNA, 1902 bp, Chlorella protothecoides
atgcagctcactgttgtagctgagattgacgggcgagtcctacttgtggataagtatctcgcccacccccggatccagctggacggctcggacgagctgagcaccctgacggccattgtggaggccgagaccggcattccagctgccgctcaacgcctcacgttgggctctcgcaccctgcagcccgaccagaccctcggcgctcagggactggcggaaggcgacctcctcatgctgtccctggctccaactggccgtgcccccgccccgagccagaacccctcgtccctgcgcgccttcctgaggccggacggaagcgcagaggacccaggcgcgctcctgcgcatgctggcctccaacccacacgcactgtcccagctccccccggagctggcgcgggcggtgcgggactcggacatccccgccttccaggacgagatgcggcgcctgacggcagagcgggtgagggccgacgaggaggaggcgcgctttgcccgcatggcggcggaggatcccttcaacccggaggtgcaggcgcggctggaggaggccattcgacagaagaacgtggcagagaactttgaggctgccatggagtacaaccctgaagcattcgggaacgtgaccatgcttgtgagcatgggtaggaccagcccttgccacgctgccaagccagaattactgacccagtttccagttcccctgctattggcccaggtatgtgctcatgcaagtaaatggggtggccctgaagacgttcgtggacagcggggcccaggtgaccatcatgtcacagtcttgtgcggagcgctgcggcctgctgcgtctcatggatacccgcttccagggcacggctgtgggcgtgggctctgccaagatcctcgccccatcttcgcccgtacaggccgcatccatatggcgcctctactggcgggggggcaccatctgcccatctctattgctatccttgacaacctgggtcaggacttcatttttggcctagacaacctgcggaggcaccagggacacagtgcaggatacaaaccccgaggtgcccgaagtgggatgtgtgagcatatgcatcgtggtggcctttggaagaccaaaacagcgctcactcctgctaccctgcagtgctgcgtcgatctcaaggctggagttcttcggtttgggtccacggaggcacagctgccatttctacccgagcacgagattccacaaggggaaccagagcggaacccgatgggggggctctctgcctcaaataatgcaggtgtgtgcatatgtgcagggataaacaaggtttgccaggcctctgcggacgccgtagcaggcgctctgaggctgaatagggctgagacagggggcgctgctcatttgaagggattcttgcccttgcatgcccttgctaaggtgctataccgtcccactcccctgtgcatcgttgtttggcgatccaggatgcttatttttcccctcctgcacagagcggagtcacaccacggctgccagtgcgccgcaggcaactccaagccctgcagtcgggacccaagcgtccgcaccacccgccgctgcggcccagacccagcctgtgcagaccggggggcaagctgggtgggagggaaaggtgttgaaactggtggagctgggattctcaagggagcagagcctggctgccctcagatccgcccagggaaacgaggacgttgctgcatccatcctgttcacctcataggcctgaggaacgtcggcgggagggcccctttcagcgctcctctgaaccccgctgcatgctgggcagtgccggcgagcagcattgatgtgtgcacctctctgtggccagggactctctcggtgacaaatcaggcaggagatacaatttttcaaggatggtggagataa

SEQ ID NO: 2264 - DNA, 1317 bp, Chlorella protothecoides
atgagggccactgcccatattcactccccctgtcgccctccatttccagggcgcgatgtggaccgatcaaagattggggccctggcgcacctgtggacgaagtcttggtgtcctgggagtgggcctatcactgcggaaccaccgggtccctcaacctcgaagggaatcctcacggatgctggggtgccagcccctcaagcacagtcttgtgtctcatgcgagaccttcgggtcccctctgctccgcacctctgcggctaggatgttccctgggccgggggacagcaggagtgcctacccggcagccttgcagtcgcactcaggtcggtgggcattgtacctcgcgagacgagtcttggatccttgtgtccgtggagctgttatggaatacctcctttcgtgcaaggtcgtgggatactctgaactatgcctccatgcaggacactcccagcgcagtatcacaagctgggacatgccccttgattcatccttgtgcctgacaaagtggtactctcaacagtactccctcccctgcgatccatcaccgcagcccctccatgcgcgtctgcgggaacctcgtgcccctctgccgccccttcgtgcactgtcccctacccctgctgcatccccgccccccaccttggaccctgaggtcgaggatgcgcgggagcgactgcggcgtgccgcgctctcctgctctcggtggggctggctcagcttctgggtccagctcgtcctctgcacggtggccgcggtcatcaccctcttctccatggccttcacctcccaggtagccttaatgtacaatcgtcctggaggctatgggtcgcctggtgacatgctgttaaagacgcttggtggtcaagtgcaggcgcccaacctctctgcgtgccgcaactctgcaaagagtccagccggttctcgtaccacccaccccgagcacgcgctcccatcctaccaccactatccacccccccacccccccttgtcaccctcagactggccctggcgtctccctgctcctcagcctgtttggcattgccatgggctacctgtccaccttctgggcgtttgggtacacgcgcctctcgcgccgcatgttccgctttctggacactgggtcgccccgcattcggcggtacgacgtcatcgggaccctggagaaggtgggattgctggggttacgagggggctgggtgcttgccgcagaataaacaactggatgtcgggccgtatggcacggaagggttgcatcgtggaggggcccgcgcatgcttgtttcggtgaacagtgcggatcaatgcatggacaatgctag

SEQ ID NO: 2265 - DNA, 249 bp, Chlorella protothecoides
atgaagctcatcctccgcttcatccccatgtactacaagcatgtaaaggccgagcgtaagactctgctggtccgctttttcggcgtgcaccgtgtatcgccgctgctgggcaggaggaacgcgctgcccacacacctgcgtctgcaccggcggtacgacctcaaagggtcgcgatacggccgcaccgcaggggcagagcgcgagaccaagccctttgtgacgctgaaggacttggacctggacgtgcgg

SEQ ID NO: 2266 - DNA, 597 bp, Chlorella protothecoides
atgcgcaggggcaagtccgccgtgagcatgcgtgtgtacgacaacggcaagctggagaaggaggagatcctggaggtggcgggtccctcacacaagaccaaggccagccggaaagagaggaaaaaggccaaggaaacgtatcgctcgccacgtcctggagaggcagtgtatcgaggccaccggagttttgaccttgtgcagcagctgcagcttgggctcacgtacagcatagcccagagcagatcgcaggtggggaggctgggagggtctggcatggtgggctgcatcgtgggtggaaagtgcatcatgcaggcatcgaccttgcccctgcaagcagggctgggccctgcggagtgggaagcacacacatcccgctccaatgtcatgtcacccacacaagtgcatgctcaggaggcattccagcaaccgctccatccacagaaggattccgggaatggggacgcggacttgaacggcgaggaggtgaagaaggctgccattccggccacaggcagtgtacccggttttgtctggaaggactacttgccctcgctcttccaggcactcagagaagcattcggcattgataacgggtga

SEQ ID NO: 2267 - DNA, 579 bp, Chlorella protothecoides
atgctgccggccggcgaggagctgccggcgccgctgccgcgcggcgccacgcccgccagcctgctgcccaaccagcgcgtggcggggtacgttcgtggcgcggggcccgcgggcgtcttcctggcgctgggccgcgcgctggacgggcggctgcgcctgtccaagctgaacgcggagggcagccgcgtggaggacgtgcaggccgccttccccgtggggcggctggtgctcgcctccgtcatccgcgtgcaggatgggaaggtggagcttacgcgcaaggcgaggaaaacgcggccggagcgggacgtcgctgcgctgggccggctggcggtgggcgacgcggtcaaggccctggtccgcagggtggagaacttcggcctgatcctggatctggagggcggcgcctcgggtgggtgggctggccgtgcctggtgggctgggtgcattgatgggggtgggaaagggggttccagctggtggatctgggaaacggtgaagtctggcaaggcacagggaggccatgcatgctggcagacgactgtgcactggacccacagcatgagaactgaggaccagtga

SEQ ID NO: 2268 - DNA, 2004 bp, Chlorella protothecoides
  modified_base (1583)..(1592): a, c, t, g, unknown or other
atgatccctgcggcggccgccacctccctggagtttgtcaagggcaagcccgagccgtctgtgcccgaggtgaagctgacgaggagccgcgatggctccagtggcgtggcgaccttccgcttccccagcccctccgtgttccaggaggaggcggacatgagcgacatcaccggcctctacatgaacgatgaggaggggacgctgaccaccgtggaggtcaccgcgaaatttgtcaatggcaagcccgatgccattgaggccaagtacgtcatgcgaagccgctgtgtggatgtgggacgcacctcaacccatgccactgcgcatgcccggcctgcggggacccatctcacccaaagtacaactgacacccgcacccctttgtccccatcgagtgcagtgccatcgagtgggacaggttcatgcgcttcatggagcgatatgcagaggagcaggggctgggcttcaccaagggctgatcaccctgcctgggcttgctcttcaaaggggctactccctccgagaaggcaggcggagacatgtgcacactgggctggatgctgggttggtgcatttggcaagggtctgctaggttccatgcggcgctgcaactcgggaaccaaatggccaagctgggacgatctacaccggccccggccaggccctctggccttggatgaggaggatggccgcccccagtgcggcgatgcttgtcaagctggacaggacggcaaccactgccgcggaccgccgcttcctcctggcccctggggagctgccgcggagctgggggaggaaggtcgctcgcaagcgcaggatggtggcccgtgcggccttgatgcctgtgcaagttgggggccatgcatcgactcgggttgcactgactgtgagctggggttgcagcgggagggccggccgagggtgaatgcgggccgggaccaaaccccgcccatgaccacctgtacaccccacagcacccgctcaccctgcgtccggtaccgcagcgcggagggcggtacagcgcggtacagcgccgcggcgtccctggccagcgcatcggccccggggccagagggcgacaggaccttgaggcccttcagtgcagcgtacacggcgggaccatccgagccacatgcaaacaccgcttgcctgcagctctgcagtgagggttcatggcagggtgtggttggaggtgtgcagaaatggtggagagtggcctcccacgtgacagaatcttgcacgtcagccatccatgtacctgcccacaccccatgctgtgttcaacaaacaccaagtccatcattcagatgccctgccctcacccctccagctccccttgacagccactgcggccaggtagaggggcatgagggggtgggaggcgaggaacaggtcgaagaggcggcatacttggttcaggtctgccacgtcgtgggcaaaccaggtgaggtgccagctcagcgcgaagaacgggacctccagggccggctcgtccaaggaaagaaggtgggtgtacagctgtgggtcagcctgttggggggggagacgtgtaatgtcatggatgggggggtgtgggggcgaggagnnnnnnnnnncaagcgccgtcgtgagccagacccctcagggcgctggtgctctgagttcaatctccctgcatgtgcagatccttgggtcagcttcatcgcgccatgccagttccccttcccccctccccagccccagtgtgaatggccctcctaccgcgcgcagcaaggggtacagcaggccgagggtctgcgtcgccgccaggaggtcgggccgcgtggcatcccgcaggtgagtcaccaccagttgactcagcacggcggcgccgcccgcctcgcccagcgtgaacaagagcacggacgcgacgtcgtgcaggccctggtagtaccagacatcatcctggtaccgcagggcgcgcaggaggacacggcgcagggccagccgcttgagtgcccgagcctcctcggtccagcctgtggatga

SEQ ID NO: 2269 - DNA, 1470 bp, Chlorella protothecoides
atgtgcgctgccggggtggtgtcaccgaagcgtgagacccaccccatcctccctcccctcaccacccctcccactttgtccccgccaggtgaggagctgaaggaggtgtctggtgcgctgtcgatcgtggacgtggacttcaactaccccgcccgccccgatgtccccgtgctgcacggcttcagcctggagatcgcggcgggggccaccgtggcgctggtgggcgagtccgggtccggcaagtccacggtcattgcgctgctggagcgcttctacgaccccaccgccggcgcggtgctgctggacggcgtggacctgcgctcgctgcagctgcgctggctgcggcgccagctgtcgctggtgtcgcaggagccgatgctgttcgccaccagcatccgcgacaacatcgcgctggggcgggcaggggccacggacgcggaggtggaggccgccgcgcgcgcggccaacgcccacggcttcatctccgcgctgccctccggctacgccacgcacgtgggcgagcgcggcgtgcagatgagcggcgggcagaagcagcgcatcgccatcgcgcgcgccatcctgaaggcgcccaaggtcctgctcctggacgaggccacgtcggcgctggacgcgcgcagcgagtacgtggtgcagcgcgcgctggacgcgctcatgcgcgcctgcaccaccgtggtggtggcgcatcgcctgtccaccgtggtgggcgccgacgtgatcgcggtggtgggcggcgggcgcgtggtggaggccgggacgcacgccggcctgctggctgcgggcggggcctacgcgaccctggtgggcatgcagcgggccagccgtcgcgacgaagcggcggtgagggcgtacgaggccgaggaggccgaggaggacgacgacgacagcggggagggcgtggctgagctgggcatggccgggtcggggcgcgcggcctccggcggcctggtgcctgccgactttggcgcgccgcggcgcgtcgcctcgcggaccacctcgcgcacgctgtcgcagcccggttcgccggtcggcgcgcgcatggacagtctggtgggcgccgccgacccggcggtcatggccccatccaaggccctgaccccaggcatgacggggacggcggccatcggcggctgggctcgcttctggaagggcgtgggggccaccaagggtgggaagggcggcgcgccatgcgtcccgcgcccgcaccagcgccccgacgaggccaagcccaaggcggtgtcgatcgggcgcatcgcgcgcctgaacaagccggagctgcccgcgctcttcttcggcctgatcgggtcgggggcgctgggcttcatgatgcccgccttctccatcgccttttcgtccctcatctccctcttctacaccgtcggtgagggggagagtggggcatgtcatgttatgggtggggggaggtttccggtgccttgcagccccaagtga

SEQ ID NO: 2270 - DNA, 3084 bp, Chlorella protothecoides
  modified_base (70)..(113): a, c, t, g, unknown or other
  modified_base (1286)..(1295): a, c, t, g, unknown or other
  modified_base (1852)..(1861): a, c, t, g, unknown or other
atgctggcgactcctcagcctgcgttgcgcccagggggtctcaacccccccccccccccccccccccccnnnnnnnnnnnnnnnnnnnnnnnnnnnnnnnnnnnnnnnnnnnnacccggaggagctcaaggccgggacccggaagtggtgcctggtcttcctgggcatcggcttgggcgccatgctcttctccatcatccagtcctatgcttttgggctcatgggtcagcgcctggggaagcgcgtgcgcgtgctcatgatgaccgcgctgctgcgccaggaggtgggctggttcgaccaggagtccaacaacagcggcgtgctgaccagcaagctgtccaccgacgccctggcggtcaagggccagttcggcgacaccatgggactcctcacccaggactcgctggagccaccgacccaggagtgcatttgcttcgtcggtgccgccccctcttccctcctccaagcatccaagcccacgtgctcaccgccccccccccctcgtcgacagaacctggtgaccttcatcggcgggtacgcgctggccttcagccacggctggaagatgacgctggtggtgacgtcggtggtgccgctgatcgtggcggcggcctggatccagaccaagtacatcaaggacgcggcgacgcgcgaggacggcgccttcgcctactccaaccagaccgcgcaggaggcggtgggcaacatccgcaccatcgccgcctttgccatggagcgcggcgtgaccgacctgtacgagggccagctggtggagccgacacaccaggccaagcgccgcggccgctccggcggcctcggcttcggcttctcccagtttgtgctcttcggtgcctactccctggccttctggtacgccggcctgctggtgtcgcgcggcgagtccaccctggaggaggtgctcagcgtgttcttcgccatcttcctggctgcctttggcgtggcccagagccagatgttcttccccgacgtggccaagggccgcgccgccaccgagcgcgtcttcgccatcgtggaccgtgtccccgcgatcgacgcctccgacccgtctggcgaccgcatcgccgactgtgcgggcaccatcgagctggtggacgtcagcttcgcctaccccctccgccccgacgccctcgtcttccgcgacttctccctctccgtccccgccggccgcgtcgtggcgctggtgggcgagtccgggtcaggcaagtccacggtcgtgggtctcgtggagcgcttctacgaccccctctccggctcggtgcgcctgnnnnnnnnnnagggtcgggcaagtccacggtcgtgggcctcgtggagcgcttttacgaccccctctccggctcggtgcgcctggacggccgcgacctgcgcgagctcaacctgaagtggctgcgctccgtggtgggcctggtcagccaggagcccgtgctcttcaccatgtccgtggccgacaacatccggtacggccgccccgacgccagcatggaggaggtggaggccgccgcccgcgcctccaacgcacacaagttcgtggcgcggctgccggagggctaccacaccctggttggcgagggcggcatccagctcagcggcgggcagaagcagcgcatcgccatcgcgcgcgccgtgatcaaagaccccaaggtgctgctcctggacgaggccacctcggccctggatgccgagagcgaggcggtggtgcaggaggcgctggaccgcctcatggccaaccgcaccaccattgtggtggcacacaggtttgttgccatgttgtttcggtggtggtggtcggtgggaaatcggagtggtgtggggttggacgaggcgaccatccacnnnnnnnnnncgcacacaggcgaccatccacgccgcatcgctgttcccggcccatctgcgcggcagcagcccaagccccccacatcaacaccacctcccaccagtcacatcacccattcacccaccactcccttcccccaggttgagcaccatccggcacgcaaacagcatcgccgtggtgtacaagggcgtgatcgtggagagcgggacgcacgacgagctcatgggccggcaccacggcgcctacgccaggctggtgcagcatcagctgactgggctgagcggctaggctgcgaggcgctggacgcttttgcatgcgaggggggagacatgcgccaccccgcatttcagaacatgaatcgcacggcaagaaggggagcggaagtctctcccaacttcattctatgtagaacggctgcgcaccttcacccgcccagcttcccggagatccggcagcggtcccctccggtatgcacaccaccgcacagctggacacgacccttgcacttctggccattgcctcgttctcccgtcgacccagggcccttctgcccggaatcaaagacacgacaagctgcaggacaagttcatgcaacgaagatcaaacagagaaggggggctgctcactgcactgcgcctggaaggtgccactccccagcctcaagacagtggggccccctcccccgcccactcctgtgtgctcaggctgtccatgcaatcgtggatggccctgatgagagtctgcggcgaccccacgccccgctcttcctcttgctttggggcaacaccgggccccaggtccagccccaggctcttggcatggatgcccggggtgtgccacttctcgtccccggaatcgtcggaggaggggaccgccaggcggcgaggggtggtgcagggatcggtgacgcagtcgcggcgcagttgggctgcgctttccagcctggaagtccagaaggccagcttctcgggggtggggtttgtggctgccgacgcctctgccagacctgggacagaggggggcgaggtgtgatgggggttggcttccttggtgccaggctgagagggcaatggggggccactgtcagggcagcccaagcaggccatgggataccaagacatactggtctctgcagagggggtggggttgatgtcaaccagggacatgtactcctcaatggttgtcagcagggtgtagtacgaggtctcccgcagggaaagcatgtcagctag

SEQ ID NO: 2271 - DNA, 1599 bp, Chlorella protothecoides
  modified_base (446)..(455): a, c, t, g, unknown or other
  modified_base (710)..(719): a, c, t, g, unknown or other
atgcacgtcccccttcacggtggccatgatgacgacacccgcgttgtcgctgccggtcttcccgctccgcgccttctcctcctcgatgtaggggatgaggtgtgccaccgcgcgcttcatcacccgcgccgacttgatgacctggggcaggaacatcttgcccgcgccgaagaggtcgcccaccacgttcatgccgtccatcagcgggccctctatgacctggatggggtaggggtaggcgccgcaggtgcggcactcctccgtgtccgccaccacgtgggtgtcgatgcccttcaccagcgcgtgctcgatgcgcttggtcaccggcaggtcgcgccaggagtcctgcgcttgggaggggaggggggcaggtgcgggtgttctgtcagtttcatgtgtgtggcagggggaagacaggaaaaggaaggtagaaggaacttggcaannnnnnnnnngaggggggtaggtgcgggtgttctgtcagcttcatgtgtgttgcagagggaagataggaaaaggaaggtagaaggaacttggcaaggggagagagcagggaatctgagggtggaggcagatgacaggggtccacactgggcgaagaatgggcaactgggtgcatacgcaagcaggcagactccacgatgcagccacatcctgaggcctgtgtacagcgcagggcaagctccagatccccccgcgctaaccccttnnnnnnnnnnagggtccacactgggcgaagaaagggcaactgggtgcatgcgcaagcaggcagacaccacaatgcagccacaccctgaggcctctcccaccaattgcccccctccaccaccccagccccaactccccaccccaaaccaatccactcgccttcttctcggcagcggccgcgcccccaacctgacccttgcgcttgaccgcggtggggtggctcttggggtcaagcagcgccgcatagtccagcaggcgctcagtggcattctcgcagcggttcagcagcacgtcctccaccagctccagcagctccttgtccagcagctcatacttgtcggcaatcacctggcagcgtggatattccagcgcgagaagaagattgcttgggcccactgcacaccagaccctcccctgatcaggcgtccaaccttgccagcgagcacacatccaccccacctgggcggcattcacgatgcccatgtccatccccgccgcgcaggcgtggtgcaggaaggcggagtggaaggcgcggcgcacgggctcgttgccgcggaaggagaaggcgatgttggacacgccgccgctgaccttggcgccggggcacaggcgcttgatctcgcgcgtggcgcggatgaagtccacggcgtagttgttgtgctccgccatgcccgtccccacggtgaggatgttggggtcgaagacgatgtcctgcgggtcaaagcccacctcctccaccaggatcttgtaggcacgcatgcagatgcgaatctgtgcagggggaaggatttgagaaaggagggttgcatgcaggcagcgggtgtggtcttcagggttgagcagggatcctgtcgagcaagacatgatgcagcgctgcgtgctgctgagtag

SEQ ID NO: 2272 - DNA, 819 bp, Chlorella protothecoides
  modified_base (671)..(680): a, c, t, g, unknown or other
atgcggagcacctttttgaacattggagagcggtgcaatgttgctgggtcgtccatctacaagaaggcgattgtggatgggaactacgacaaggcggcagccatcgcagtgtctcaggtcaaccaaggcgctgacattctggacatcaacatggacgatggcctgatcgagggcgtgggtgccatgacccgcttcgtcaacctcctggtctctgacccggaagtcagccgcgtgcccttcatgatcgactcatccaagttccacatcgtggaggcgggcctcaagtgctgccagggcaaggtcatcgtcaactccatttccatgaaggagggggaggccaagttccgggagcatgccgcgatcgtgaagcgacatggtgctgcagtcgtggtcatggcctttgatgaggagggccaggctgccacctttgaggacaaggtggggaggctttggagcaggcggaggatcaattctggtgtgcacctcgtggagcatgcacagctcagcagctgtggctccctcccagcacctccctttccacctgcccccttgcatcccaccatgcaggtccgcatctgcctgcgtgcctacaggatcttggtgaatgaggtgggctttgatccccaagatgtggtgtttgaccccaacatcctcacggttggcacgggtcnnnnnnnnnnatctccacaaccatgcgttcaccttgtagggcaaggtcatagtgaactccatttcgatgaaagaaggagaggccaagttccgggagcatgcccggctcgtgcgtcgccatggggcggccgtcgtggtcatggcctttga

SEQ ID NO: 2273 - DNA, 267 bp, Chlorella protothecoides
atggtggcctgggagaagatcctggacgccgcggtggagcacaacgccgacgtgatcggcctgtcgggcctcattacaccctcattggacgagatggtcacggggagtgctgtgcggtctggggcactgggatcaaggggttttggggtaaaacggagtgtgtacggatgccctcaactgcgcaggacgctacaggctcaccgtgtgggaccctgcgccttggcagctggggtgaagctgggctgcctgtcgcccagcgcctcctga

SEQ ID NO: 2274 - DNA, 438 bp, Chlorella protothecoides
atggacatgggcatcgtgaacgccgcccaggtgattgccgacaagtacgagctgatcgacaaggagctgctcggctacgtggaggacgtgctgctcaaccggcgcgaggactccaccgagcgcctgctggactttgccgcgctgctggaccccaagtccccccccaccgccgtacggcggctgaaggaggagagcgcgctggcaagcctgccgcccagggtcaaccccatcgcgccgggcgtggacaccctggcgcccgaggccgacctgccccccgtgcccaagtacacgccctacgtggacaggatgaggaggactgaggcctttgagcagctggaggagctgctggagtcgcgcatctgcttcatcgatggcgccatgggcacccagatccagaagtggaagctgacggaggacgacttcaagggtgacaggtga

SEQ ID NO: 2275 - DNA, 492 bp, Chlorella protothecoides
atgtggctgcatcgtggagtctgcctgcttgcgtatgcacccagttgcccattcttcgcccagtgtggacccctgtcatctgcctccaccctcagattccctgctctctccccttgccaagactcctggcgcgacctgccggtgaccaagcgcatcgagcacgcgctggtgaagggcatcgacacccacgtggtggcggacacggaggagtgccgcacctgcggcgcctacccctaccccatccaggtcatagagggcccgctgatggacggcatgaacgtggtgggcgacctcttcggcgcgggcaagatgttcctgccccaggtcatcaagtcggcgcgggtgatgaagcgcgcggtggcacacctcatcccctacatcgaggaggagaaggcgcggagcgggaagaccggcagcgacaacgcgggtgtcgtcatcatggccaccgtgaagggggacggctgggcgcccagctttgggcttgagagttga

SEQ ID NO: 2276 - DNA, 1851 bp, Chlorella protothecoides
atgcccggccatggcccccaccctccaccaaccaaccagccagcgacccacctgggtgaggagtcccatggtgtcgccgaactggcccttgaccgccagggcgtcggtggacagcttgctggtcagcacgccgctgttgttggactcctggtcgaaccagcccacctcctggcgcagcagcgcggtcatcatgagcacgcgcacgcgcttccccaggcgctgacccatgagcccaaaagcataggactggatgatggagaagagcatggcgcccaagccgatgcccaggaagaccaggcaccacttccgggtcccggccttgagctcctccggaccccctgggcgcaacgcaggctgaggagtcgccagcatgatggaggctggggctttgctaccagcacctcacttggggctgcaaggcaccggaaacctccccccacccataacatgacatgccccactctccccctcaccgacggtgtagaagagggagatgagggacgaaaaggcgatggagaaggcgggcatcatgaagcccagcgcccccgacccgatcaggccgaagaagagcgcgggcagctccggcttgttcaggcgcgcgatgcgcccgatcgacaccgccttgggcttggcctcgtcggggcgctggtgcgggcgcgggacgcatggcgcgccgcccttcccacccttggtggcccccacgcccttccagaagcgagcccagccgccgatggccgccgtccccgtcatgcctggggtcagggccttggatggggccatgaccgccgggtcggcggcgcccaccagactgtccatgcgcgcgccgaccggcgaaccgggctgcgacagcgtgcgcgaggtggtccgcgaggcgacgcgccgcggcgcgccaaagtcggcaggcaccaggccgccggaggccgcgcgccccgacccggccatgcccagctcagccacgccctccccgctgtcgtcgtcgtcctcctcggcctcctcggcctcgtacgccctcaccgccgcttcgtcgcgacggctggcccgctgcatgcccaccagggtcgcgtaggccccgcccgcagccagcaggccggcgtgcgtcccggcctccaccacgcgcccgccgcccaccaccgcgatcacgtcggcgcccaccacggtggacaggcgatgcgccaccaccacggtggtgcaggcgcgcatgagcgcgtccagcgcgcgctgcaccacgtactcgctgcgcgcgtccagcgccgacgtggcctcgtccaggagcaggaccttgggcgccttcaggatggcgcgcgcgatggcgatgcgctgcttctgcccgccgctcatctgcacgccgcgctcgcccacgtgcgtggcgtagccggagggcagcgcggagatgaagccgtgggcgttggccgcgcgcgcggcggcctccacctccgcgtccgtggcccctgcccgccccagcgcgatgttgtcgcggatgctggtggcgaacagcatcggctcctgcgacaccagcgacagctggcgccgcagccagcgcagctgcagcgagcgcaggtccacgccgtccagcagcaccgcgccggcggtggggtcgtagaagcgctccagcagcgcaatgaccgtggacttgccggacccggactcgcccaccagcgccacggtggcccccgccgcgatctccaggctgaagccgtgcagcacggggacatcggggcgggcggggtagttgaagtccacgtccacgatcgacagcgcaccagacacctccttcagctcctcacctggcggggacaaagtgggaggggtggtgaggggagggaggatggggtgggtctcacgcttcggtga

SEQ ID NO: 2277 - DNA, 345 bp, Chlorella protothecoides
atgccatcgcgaaggaccccctactgcccgctcacctcaaccgccgcccacacacaggggatccgaccggcgccgggctacccctcccagcccgaccacacagagaagcagaccatgtgggacctgatggacatcgaggcgaggatagggatggggctcaccgagtccttctccatgacccccgccgcctcggtgtcggggctgtactttgccggcgcggcgtctcagtactttgcggtgggcaagatctccaccgaccaggtcaccgactacgccacgcgcaagggcatgccgcagcaggaggcggagcgctggctgcgctccatgctcacctacgaaccctga

SEQ ID NO: 2278 - DNA, 675 bp, Chlorella protothecoides
atggggttggaatgcaccgcattccaggcgttgcctaccacgtgggaggccactctccaccatttctgcacacctccaaccacaccctgccatgaaccctcactgcagagctgcaggcaagcggtgtttgcatgtggctcggatggtcccgccgtgtacgctgcactgaagggcctcaaggtcctgtcgccctctggccccggggccgatgcgctggccagggacgccgcggcgctgtaccgcgctgtaccgccctccgcgctgcggtacctggatctgggccaggcagtgatcccagacgcctacctcgtccaggggctgtggaaggtcccagcccagcccctcgaccggacgcagggtggtcatgggcggggtttggtcccggcccgcattcaccctcggccggccctcccgctgcaaccccagctcacagtcagtgcaacccgagtcgatgcatggcccccaacttgcacaggcatcaaggccgcacgggccaccatcctgcgcttgcgagcgaccttcctcccccagctccgcggcagctccccaggggccaggaggaagcggcggtccgcggcagtggttgccgtcctgtccagcttgacaagcatcgccgcactgggggcggccatcctcctcatccaaggccagagggcctggccggggccggtgtag

SEQ ID NO: 2279 - DNA, 549 bp, Chlorella protothecoides
atggccgaccaccctggccagcgcaagtttgtggcgggggctatcgggcccaccaacaggacactgagcgtctctccgagtgtggagaaccctgccttccgtgggatcacctacgacgaggttgagctggcttactaccagcaggccaaggctctgtacgagggaggcgtcgacctcttccttgtggagaccatcttcgataccgggaatgccaaggcagctgtgtttgctctcgagcgcttgtttgaggacctgaatgtacgcatcccggtcttcatctccggcaccatcgtggacatgtctgggaggacgctgagtggccagaccaacgaggccttctggaacagcattcgccatgccaagccaatggctgtgggactcaactgtgctctgggggcatccgacatgaagccctacattgccaatctggcagaatgtgtagactgctacatcctgtgctaccccaatgccgggctgcccaatgccatgggcggatacgatcagaagggccacgaaatggccgaggagatcaagcctttctgtgagtag

SEQ ID NO: 2280 - DNA, 840 bp, Chlorella protothecoides
atggaggagcgcgggctgaagctgcccctgctcatcggcggcgccaccacctccaagatgcacacggcggtgaagatcgagccccagtactcgggccccgtggtctacgtgctagacgcctcgcgctccgtgcccgtggtccagtcgctgcttgacgtgcgggccaaggccgagtttgccgtcgacgtcaggtggaagaaagaaaggggaaatggggcgggggaggggggaatggggagagtgcgggtgatgcaccacgtgctcgtgcttttggcctctgcaatgccggagcaatatgcggagctgcgcgacgagttctacgccgggctggaggacaggcggtacttgaccctggcagaggcccgcgccgccgcgcccaaggtggactgggcctccgcggagaacgcgccgcatacgccctctttcaccggggtcaaggcctacgaggacttcccgctggaggaggtggtgccctacatcgactggaaccccttcttccaggtctggcagctgcgcggcaggtaccccaaccgcggctaccccaagattttcaaggatgaggcggtggggcccgaggcacgcaagctcttcgaggaggcccaggccatgctcaaggtgcccgagggctgggttgagggggctggaaggcgactggtgctctgcgcgggtgtcgaccagtctgccatctggcgtgagtcgcaggggtgtctgccaatgaccctctgcacaccacccaaacccctggccccctccaaacgcccatcaggacatcatcgacaacaagaagctgcgcctcgttggcgtggtgggcatcttccacgccaactcggtgggcgatga

SEQ ID NO: 2281 - DNA, 243 bp, Chlorella protothecoides
atgggcgtggagccgctgatcgaggcgttcaaggaggccggcgacgactactcctacatcatgatggaggccctggccgaccgcctggccgaggcgtttgccgagaaactgcacgccatcgtgcgtcaggaactctggggctacgccccggacgaggacctcaatgtggacgacctactcaaggtcaagtaccaggtacgtgagacagggctaccacaaggaggctgcgcagtcggggagtag

SEQ ID NO: 2282 - DNA, 474 bp, Chlorella protothecoides
gccggctctcaggatgcggacgaggccggccccggccacatctcagcgggcgtggtccccgaggcgggggtttcgccgcacgcagaccaggacgcgtccacgcagccgccacccagcagcgcgtcactggagcgccacctgctgacggggcactccggcacggtgatggcgctgtgcgcctcgcacgacctgctcttctcgggggccacggactgcagcatcaaggtgtggagcctgcagtcgctggcctgcgtcgccacgctgcgcgggcaccgcgaccccatccgcgcgctgaccgtctgcggcacccacctggcctcgctgggggccaagacgctgcgcctctgggcgctctcctccgacttcacctgcgcctccgtcctggccgtcgcagacgtgacagggaacgccaagaccgtggtcgcgccctgcccagcggccactgcctcggccgccgcctgggtctacgtcggg

SEQ ID NO: 2283 - DNA, 345 bp, Chlorella protothecoides
atggccacacctggtacccccagcacggccgtgcagacctgggacctcctgccccgcgtcttccagtacctgctcccgctgctgggcgccgagctggacagcgtgcggagcgcggcggcagacacgctgggcggcctgctggaggcctgcgtggacgccgcggcgatccgggccgcggccgaggcacccgcggcggggcgcccgcgtggtctccatgccctggtctccgccttggagtcggcactgtcggcgcacagcgaggcgggctggccgggggcgctgggcctctgcgcgcgcctgttcgcggcgctggggcgcgagggcgcggaggccgcggcgccgctg

SEQ ID NO: 2284 - DNA, 1437 bp, Chlorella protothecoides
atgtttgcgatcaccaccatcaaacttatactttggtatccaaggaaccaggcaggtggaggtcgaggctctcctgtggcgtgtcgtgttgctgtccggtgcagctcgggaagacggagacgtgcaccgtgcacctcggggcaacagggaacagccgcaacgttttgcggtgagtgtaaacccactgtgctggccgcaatgcggttccatgctcggaatgggtactctacaacagccgtcctggtgctctgtgccatagctttcttcacagggataatggtgcagcagtacccaggcttgcccagcgccggacgagggttgacggtagagcgagagggaggcagcgcacgctccctgcaacaagaggagagcgtgccagcagtttccacaaccgggcccacacgcaactggacctcgttcgaggaattgttggaatggtcgggcatgctcgccgacaggccagtgttgcagtcaggagagactggactcgaccattacgtcgtccagcgtcaaggaagccgcaatcctggggcatcgcttctgtccttccatccaaacccctccctggatcccaccctccacacacagcctttccagttgctcagcatctacccccgggcctacatcttcccaaaattcttaagcgaggcagaggccgacaaaatggtggagctggcggccagcagactggcaccttcagggctggccctcaagaggggcgatgaccccaaccaacagaaggatgtaaggaccagctcgggcaccttcctgtcctcaggcatggacaagacaggcaccctgagggcggtcgaggagaagattgcagcggtgaccggcgtaccctcaggcagggacagcacccagacactcactccacctcggtgctctccacctcccaacccctcagcatatggtgagcccttcaacgtcctgcggtacgagaatgggcagcactaccactcgcacctggacgccttccctgagaaggactatggaccgcagagctcccagagggcctgtggttggcaaggagggggggaaagggcatgtgtgttgctgcaggcatcggcgggtgctgggtggaatggcgtgcacatgcgtcaagggttcctcatccagtacagtaccttacgatggagtaccatgcctgcccctcaaatggtctggttgggaacgagtgcctctgatatccactcggctctgcccctgcaccaccctgcacagattgccaccatgctgctctacctgacggacgtggaggaagggggtgagaccaccttcctcctggaaggaaaggacggcctggaccgcctgcgcaacatcgactacaccaagtgtgacaccggcattcaggtgagcgttgggggacggaggggggaacatggtcatttgagagcgacggagtcgacgcagcctccgcccgcatggcctcgttga

SEQ ID NO: 2285 - DNA, 312 bp, Chlorella protothecoides
atggcatcctcccccagttcccacaccccaccgcaggacgtatctggctgggccgacgacagcccgcgctacgcatccatcccctccaacctggaggcgcagctcatgcccttccagcgcgagggcgtccggtttgcgctagcacggggcggccgggccctgatcggggacgagatggggctgggcaagacggtgcaggcgctggcggtggcggccgcctaccgcgacgcgtggccggcgctcatcatcgcgcccagctccctccgaggtgcggcatgcagcttcgaactgggtggggggtttgtgctgtga

SEQ ID NO: 2286 - DNA, 3678 bp, Chlorella protothecoides
  modified_base (161)..(208): a, c, t, g, unknown or other
gccagacgccgcgcgcgcgaggccagcacgcccgccagcgcggcgcgcgcctcggcttccggcacgccgggcgcggggcgcgccaccagcgacagccccgccaccaccgagatggtgcaggggcagacgatggcgaagcggcgggcctgggacaccgctgnnnnnnnnnnnnnnnnnnnnnnnnnnnnnnnnnnnnnnnnnnnnnnnngctgccgccgtggccgacaccgacccgtccgaggtcacccgggacgaggggggggcagcgggggccggggggggcgcagcagggtcctgggatgtcgcgccgacgcacgacgcacaggtcgcactgccacgccaggctggggtgacggatggcacccgccacggccggccgcaggctgcgcggtcggggacgccataggcgtagcccgcggcgtcggggggcggtgggaggggcatgaccgccgcgctgcgcgccagcagcaggctgtgcggcacgcccccggccagcggcggggcagggcccccgccgacgtcgcagtcgaggggtacaagcccgccacccgcgccgacgtcggccaccgccgcggcctggacacggggcgccgcggcgccatgctgcaacgccacatcggcgcgcgcgatccagctgccgatctgcgccagctggtcgtcgggcatgcccgcacggcgcgccagcgtgggcgaccgcttgagcagcgacttgagccggcccagggacagcaccgccgtctccaggtcgggctcggtcagccagaagtacatgcggctgctggcctgcggcgccgcctgctgctgccccgcgccagcctgctgcagggcgggcaggcgctgctgcgccgcctcggcggccgcggccacggcctcgggggcctgcggcgcgggcgccgcatcgggcccgatggccgaggcggtggtcgcgacgttgcgcgccgcgatgtcgtcgcgcaggcgcaggtagaaggcgcggccgccggcgtcgccacggagcatgtggatgtgggccagctcctcccacaccgccaggcggcaggaggactcagtgacctcgcgcaggagcgggctgtcgcatgctggatcggccatggtgtcgcccaggccctggccgcagcccacgctccggctgctgtgccacatcagggacaggttgtcgttggggagcagccagaggctcagcaccccgcgagcctccgtgggctgcagcttgacgggggaggccagctggcgcgtcatccggcccacgctgatctggaccaggggctcggagatggcgctcagcagcgcgctcgcctgagatggagggagagaggatggggggaatcatcccctgccacccgttctggtggttgcccgccgcacccaccacccggcatgcctgcccgcagttccgccgtcctcgcgcattcttgtgccatggcgcacctgcttcgcggtgaccacgggcgccttgtgcgccgggagcccgggtgcagccagcatcacggtcatctgctggcgggcacacgtgtactcgttgaccagccgcgtctccagcctacaatctggaactgccggtcgcggcatgatttcgggcatgcgaccgaggctcatgccctggccggggtgccctacggggagctccgacagcgccacggggtccccgaacgcgctgtcgctgtccgagctcgactccacgcgctcgtggctcacgccacggtgctgtgccagccagtgttgaaaagagagccagggcgcagaggagccgggttccatggcgccctgtggaggagggcgcaatacaagttttcaagtgcgtatggggttgtgcgtggggcttccaccggagccgtgttaacgcctcgagacaccctcacccggcgttacctgatcaggtggggggcaattccggtgacaggtccggcgtcgatggtgagcgccctgcccaggggttgtgcgtccggaaggtatcgcgtttccagcgagaccagcgggaagacccggctatctgctcagttcagggggttgtgttcaaaacgtttggggagagaaagcgctgtgcctggaaccccgcggtcagcgggcatatccccaacctctgggtgcgtgagagcttctcggcgggagagcgggagcggtggcgtgatccaccgtaccaaatatctttacgtaatccgcggaccccctgactcggcgattatcaatgttataccactggcatctccgccggtccttacactgctgggcaggcacgaggtcactctccagggtcaccccctcccccggtggggctcgtgcgctgcgcctgcatgcaggcgcgccgaggcgcacccctggcacgcttcaggccttggcctcggcggcgggggtcaggtccaccaccttctcccaggtgaagacgtcgggcttgtcgtcgcggccaaagtggccgtacgcggcggtgtggatgtagcggtccccaccccgcttcaggtccagggccttgccgatcatgcccgggcggaagtcgaacttggccagcaccagggccaggatctcgcggtcggggatggtgcccgtgccgtaggagtccacaaacacggacagcggctccggcacgccgatggcgtaggacacctggaccagcgcgcggcgcgccagcttccccgccacgatggacttggccgcctggcgcgcgatgtaggcgccggagcggtccaccttggtggggtccttgccggagaaggcgccgccgccgtgcgcaccccagccgccgtaggtgtcgatgatgatcttgcggccggtgagcccggcgtcgccgtgcgggccgccgatgacaaagcggccggaggggttcaggtggaagatggtgcggtcgtccaggtacttggcgggcaccaccggcttgatcacgtgctccagcaggtcggcgtggatcttctcgttggacacatcgggcgagtgctgggtggagatcaggatggtgtgcacgcggatgggcacaactgcgccgccgtccttgcggggagggtgggcgcacagcggggagacagggcagtaccctttggagtcgagatcaagatacctgtcccaaagaagatgctaagagagcggcctgggagcggaatttgcatgcggagagaacagggcggagcaacagcggggacaccttccccagcatccttcaatccccccccccctgaacagcctccctacctgggtcttgccgtcggggcgcagccagggcagggtgccgtccttgcgtgcctcggtcagccggtagcccagcttggtggccaggacgtgggtcaggggcatcagctcctcggtctcgtcggtggcgtagccaaacatgtggccctggtcgcccgcccccgtctcctccagggtcttggtgcccatgccgtgcacgccctggccgatgtcggggctctgctcctccaggtgcaccagcaccttgcacttgtcggcgtccaggccgacgtcgtcggaggtgaagccgatgttgcgcaccgtgtcgcgcaccaccttctcgtagtccaccttggcggaggtggtgatctcgccgaacaccatcaccatgttggtcttggtggcggtttcgcaggcaaccttggactcggggtcctgggccaggcaggcgtccaggatcgcgtcggacacctggtccgccagcttgtcggggtgaccctcattcaccgactctgcagtgggtga

SEQ ID NO: 2287 - DNA, 1707 bp, Chlorella protothecoides
atgccggcgcagcaggatgtataccctgcctgggcccacagcccggaggatgtggccgcacatttcaacgtagatttagatcacggtctctccgatgaacttgtggcgaagcagcgcgccctgcacgggttcaacgagcttgatcacgctccggccacccccctttggaaactggtcctccagcagtttgacgacaccctggtcaagaggcccgccatacatcccgctgacgagtgtcacgctgttgttcccaagggtaaacccttccctccccccatctccctcccccgccagatcctactcctggcagcgggcatctccttcgccctggcctggttcgacgagggcgagggcgctggcgcgggcgtgcgcgccttcctggagcccgccgtcatcatcctgatcctggtgctgaacgcggtggtgggcgtctggcaggaaggcaacgccgagtcagcgctggaggcgctcaaggagatgtcagcagagacagccaaggtcttccgcgcgggccacctggtgcccgacctgccctgccgcgacctggtccccggcgacgtggtggaggtgcacacgggcgacctggtccccgccgatgtgcgcgtagtgcgcctgggcaccgccctcttccgcgtggagcaggcggcgctgaccggcgagtcggccgcggtgtccaagcacgcggcgcgcctggcccccgccgcctgcgagctgcacgccaaggacaacgtgctgtttgccgggaccggggtggccgcggggacgtgccgtgcagtggtgtatgccacgggcatgcgcaccgagatcggccgaatccaggcccagatccaggcggccgccgaggaggagggcgacaccccgctcaagaagcggctggacgaattcggcgaggccctggcccgcatcatcctctacgtctgcgtcgccgtctggctcatcaactaccgccacttcatctcctggaagacgctgcccgggtcggccttcctccccgaccccgcctccgtggagttctccctggccaaggccaccttctacttcaaggtggccgtggccctggcggtggccgccatccccgagggcctccccgccgtcatcaccacctgcctggccctgggcacgcgcaagatggcgcggcgcaacgccatcgtgcgcaagctgccctcggtggagacgctgggctgcaccaccgtcatctgctccgacaagacgggcacgctgaccaccaaccagatggcggtgtcccacgtcgtcaccctggccggcgccggcggggagctcaggacgctggacgtcacggggaccagctacaaccccgccgacggcgaggtgcggggtctgggcgccgccgccagcggcgcgggcctggacgccggcctggccgcgctggcggccaccgcggcgctgtgcaacggcgcgcgcatcgcgaccaagcacggacacgcggtggcggtgggccagtccacggaggcggcgctcctggtgctggccgagaagctgggcgcgccggacgcgtcggagcgcgacgacgccgcggcgcgggccccgctgccggaggacggcgaggtggagctcagggcctgcgacgcctacgccgccaggtgcgcggatgccgtgctcgtcgctgcacggccgggggggtgttgcgtgacgctggaggcctcggtagagggcccgctgggggggcgagggggggggccctgctaa

SEQ ID NO: 2288 - DNA, 1281 bp, Chlorella protothecoides
atgacgaccgacaccttcctgttcacctccgggtatctttttgaagcaggtgtgtccacgatcggtggccgtgcacctccttgctccccccaaccgatcaccccctcacccactgcagagtcggtgaatgagggtcaccccgacaagctggcggaccaggtgtccgacgcgatcctggacgcctgcctggcccaggaccccgagtccaaggttgcctgcgaaaccgccaccaagaccaacatggtgatggtgttcggcgagatcaccacctccgccaaggtggactacgagaaggtggtgcgcgacacggtgcgcaacatcggcttcacctccgacgacgtcggcctggacgccgacaagtgcaaggtgctggtgcacctggaggagcagagccccgacatcggccagggcgtgcacggcatgggcaccaagaccctggaggagacgggggcgggcgaccagggccacatgtttggctacgccaccgacgagaccgaggagctgatgcccctgacccacgtcctggccaccaagctgggctaccggctgaccgaggcacgcaaggacggcaccctgccctggctgcgccccgacggcaagacccaggtgacggtagagtaccgcaaggacggcggcgcagttgtgcccatccgcgtgcacaccatcctgatctccacccagcactcgcccgatgtgtccaacgagaagatccacgccgacctgctggagcacgtgatcaagccggtggtgcccgccaagtacctggacgaccgcaccatcttccacctgaacccctccggccgctttgtcatcggcggcccgcacggcgacgccgggctcaccggccgcaagatcatcatcgacacctacggcggctggggtgcgcacggcggcggcgccttctccggcaaggaccccaccaaggtggaccgctccggcgcctacatcgcgcgccaggcggccaagtccatcgtggcggggaagctggcgcgccgcgcgctggtccaggtgtcctacgccatcggcgtgccggagccgctgtccgtgtttgtggactcctacggcacgggcaccatccccgaccgcgagatcctggccctggtgctggccaagttcgacttccgcccgggcatgatcggcaaggccctggacctgaagcggggtggggaccgctacatccacaccgccgcgtacggccactttggccgcgacgacaagcccgacgtcttcacctgggagaaggtggtggacctgacccccgccgccgaggccaaggcctga

SEQ ID NO: 2289 - DNA, 588 bp, Chlorella protothecoides
atgaactgcacaagcccggcctcatacactgcacgagcccgccgctacatccgcaacatgcgcccacactccccccccctgccaggcaatcaacccatcgacccgaggccgggcgtggttgagctgtttgacgcagcaagaaaggacggtctcaaggtcgctgtgtgctctgcgagcaccaagattgcggtccagtacgccctgcaaaatgtgttgggggaggacaggttcttctccctcgacgccttccttgctggcgacgatgttgctgagaagaaacccaaccctgcaatctacaaggtggtttcccatgagaatgcctgccaacccaaccgctctcctccctggtccccgcaggaggctgcggagaagctgggtgtggatccaagcgcctgcctggtcatcgaagacagcgccatcggcctggaggctgccctcagggccggcatgcggtgcgtgatcacctacacccaccagaccgcgtcccagagctttgccggggcggaggctgtggtggaggatgcgcgcaagctgccctacacagacctggtggagggcaagctgtctggagtggacgatcgagtgtag

SEQ ID NO: 2290 - DNA, 1332 bp, Chlorella protothecoides
gccctgggcgccgcgccggagtcgctactgctggccgcctcgcccggcggcgggctcaccctcgccgtcggcctggccacgggcctgctcctgcgcaccgaggtggaccccgtcaccggcgccctcagcgacacgcgctcccgcttcctgggcacgcgcgcgccgcgcctgttccgcgtcgccctgggcggcgcgcccgccatgctggccctctcctcccgcccctggctggggtacgcggaccaggggcgcttcgcactcgtccccgggtcgcacgccgcgctggactgggccgcgcccttcgcctccgagcagtgccccgaggggtttgtggccgtcgcgggggggcagctccgcgtgctggccgtcgagcgcctgggccagcgcttcgaccagagggcggtgcgcctgcgctacacgccacgcgaactcctcatccacccagaccacaagggggtggtcccgctgagagagcaggaggggctggcggagggggcgctggccgtgcccgaggccgccgcggagctcggcccgcccccgctgccggacggcggggccgcggccgagcccgggccgtccgacgtgcagttccacgccgtcgggctcgaggcgggggaggaaagcgccgcggcgctggaccaggtggggtgcccgacgggcctgccggggcgctggggctcatgcgtgagggtggtagacccgctggccctggccaccaccgactgcgtggagcttggggggaacgaggccgcgctatgcgccgcgctggtcggcttcgagggcgaggacgcgctggtgctggccgtgggcgtggcgcgaggcctgtccttctatcccaagcagtcggaaggtgcggtgtatttaaagttggttgttttttgggggggggctggtagctgggggagaggatgtcagcgggggggacatgagagatcagaaggtggcatacaaggagagacaccagggccggggtggggagcggcggcggcgacgaggacagacgaccagcccagtggcggggcctgccgccttggcagcgtgcatggcactccaatagtcgaacaccgtcgactggccttgcagtgttactttggtcacgcctggatcccgcttgccaggccgctcatccctccaccgcatcaccccgtctccttgcacaactccccacatcccaggcggcgccatccacatctaccgcttcggccctgggggccgggcactggagctggtgcacaccacacccctcgacgacatccctcgggccatggtggccttccgggggcggctgttggcaggggtgggggcctccgtccgcctctacgatctgggtga

SEQ ID NO: 2291 - DNA, 915 bp, Chlorella protothecoides
atgccggcgggcccaagaggtcttggatgcgtggatgcctcagccactgcatgcctggggatgcaccctctggctgcacggggcctcgacccctcctgtgccccattcgatgaatgccacgcctcactcctgcggacactcaccgctctcctacctccttttcaacccccaggtgggggagacggtgacggcgctgcagcgtggaacgctgcagccgggggggcgggaagtgctcatctactccacaatcctgggtggcctgggcaccctgttcccctttgccagccgcgaggacctcgacttcttccagcacctggagctgcacatgcgggcggaggccccgccgctactgggccgcgaccaccttgccttcaggtgcggatgcctgggagcagagttgctgcagagcctggggctgcagcagggtcccaaggctgctccctgccacagcccgggccgctgtgccctgtctcttgtgagagaggtgccccgtcgcgcccagtgcacggggtgtatcatgccagtacaccagctcccgaccgcccgctgtccaggtccgcctacttccctgtcaagtcggtggtggacggggacatctgcgagcaatttgcacagctgcccatcgacaagcagcggcaggtgggcgggatgaggggaaggtgggggcgtcagggtcctgatcagggccgggagtgtgagtggcaagggcgcatggactggcctgtgccgcctgcgacagggaccttgcaggcaccaggtgtcgtgtcagggattgctcaggctcaccacccagccctgccctcagatcgcgagcgagctggatcgcagcccaggggaagtgctcaagaagctggaggatgtgcgaaaccgcataatctgacccatgctcctgtctgttgggcacccaatttgtga

SEQ ID NO: 2292 - DNA, 1170 bp, Chlorella protothecoides
  modified_base (354)..(363): a, c, t, g, unknown or other
atgatcaagctcttctccctcaaggtaggcaaggtttcgagcgggaggtttgctctcggaaactgctgctcagaccttgaaaatacgtcattcacaggagaagcaaaagcagacggccgctaccgggacaagaaccctcaagcagtccccaggcgagctcaggctacagaaagctccgtgaaaatctccttccccaatggcaaggagaagatcatgagctttgatgtggtgctgacgcctgacgagggcatgtaccggggaggggcatttctctttaccttcaccgtgccaccaacgtatccacacgatccaccaaaggttaagtgcctaacaaaggtgtaccatcccaacatnnnnnnnnnnccatgcaagcctgaaaatcgatgtccaggagtaatcccttcttcacatccgcccctgcaggtgtaccatcccaacattgacctggagggcaacgtctgcctcaacatccttagagaggactggaagccagtgctcaccatctcttccctcatatacggcctcaacttcctcttcctagtgcgtggagttggattgcgctcggggcggggtgtggagattgcgctcctctttgcctggtcaagaggcatccatattgcacagaggctggcgagcatcaagccgagtgccctctcccatgcaggcaccaaatccggacgatccactgaacaaagaggcggcagaggccatgcagaatgcgccgtctacatttgcacggcacgtttctgtgaccatcacgcggggaggcaccatcggaggggagtacttccctccggccaggggaacagcatcaggacatcacctgtagtgaggcctcggggagacgctgcagagccttgccgcacacttggcggccctgtgtctggcagtgaggcaaggaagctaggtgtactaagagcttgtacagaacattcgaagcagactcattttagagaatcccactccggtgcaagcaggggctcggaacgccctggcacactgtccagggggcctgactcgactgcagcaagagtctcgtacataaggcccggcagacttgagctcataaaaagaagtgctcaaggattcgaccccggaaaaaacgcttgccggccgagaggcctagtccgcccaggccgacggaacctgtctctttcacatcgctggtaa

SEQ ID NO: 2293 - DNA, 1032 bp, Chlorella protothecoides
  modified_base (139)..(148): a, c, t, g, unknown or other
atggtcatcaaggaggacggcatcctgggcttgatgggccggggcctgaagaccaaaatcctggccaatggcctccaggtgggtcagcatctgacgctgcgccgtctccatgatccgtgggccgctggtgttgcacatnnnnnnnnnnttgtgtgcgtggatcatgagggtggggagtgtgaggtgcgtatcagggtttcattgcagcacagcagcagccgctcttcacatggggtacagtcacaaacccagaatgcagggtgccgcagcaagacatacctggggcaggacctcgttcagctcccagcaacgctgaagagcttgaacccagagtatagatgccctcatctaagacttccaagatgtactgttcaacctcaagccacccccccggcaacccatgcagtggagcccaccgctgccaacccaccaggggaagtgtccggcccaggtggcggccgcagccgccagagctccgtggtacaggacgctgacgccgccggtcctgatcttggacatgaggatggggatgccgttcttgccctccacctgcatggtggtcttcagcgcgtccacgggcatgaggaagatgcggaagccgcccgccgccgccgacgccgctgcagtcttgatggggatgggcagatccttggtggacgccgactcgttgagcagcgtgagcacgccggcgttggcggcggtgtccccgaagcggctcatggggccctgaatgagggcggggccgacgccgcggtagaagcggagcacgcccccctccttgtacagcgtcttcatggcggccgtggtggtcatgccatctgcggggaggggcggggggtggcacagggtggcgtgcaggatcatgtctgtcaagacgatgcgctggccgtgcattcagggtatcattcccctggaccagaccagctatggctggagactgggcgtcttggcactggccgccgccacccatctccaaagctcaccccatggcagtctagaccttggaaccaaacggcgatgccagaccactga

SEQ ID NO: 2294 - DNA, 696 bp, Chlorella protothecoides
atggcggacgagactcacaccaggaagcgtaccttcaggaagtactcctacaggggagtcgacctggagcagctcatggacatgtccacggatgagctggtggagcttttcgccgctcgccagcgccgcaggtacgcattgtcacacttgggtgttgggaggaaggtggagatgggattcaggagcgtcccacacagccgtgcacgtccggcgactgcatcgccgagtcgagctccatgcggggagctgtgtgggtgctcggagatgcagctcgtaatttcgcgactgagtcataagcgattggagtcctcggcggcctgcccttccctggcaatgcccttggcgcacctctggacctgcgacactttgagggcgctggcagccagtgcagggctgccctgccctcccacatcgcaactcgcccgggcccaagatgagcttccgcccagcacgttccagcgcggcctcaagcgcaacgctcttgctctgatcaagaagctgcgcgccgtgaagaaggacacccctgccggcgagaagcccgaggcggtgcgcacccacctgcgcaacatgatcatcctccccgagatgatcggctccatcgttggtgtgtacaacggcaagaccttcaaccaggtgcgggccggggtgctgcagttatcgtgcactgccggaggaaagggatcaagtccctggtga

SEQ ID NO: 2295 - DNA, 294 bp, Chlorella protothecoides
atggcttggcctgcaagcacacaggcctttagcacccctatcgtccctgccctcgcgagtcagcctgggtactgcgaggcatttggcacccgatcacgccccggcctgcgtgatctggttcccgcggtggcataccagcccagtgaggccactcccctgtcacaagtcctgcgcaacgccggaaagaaggcgcttggcggtggcattcccggagccgctgccatgggcatccaggtggtgtccctcatgtggctgcgcaccacagtcaactaccagtaccgatgtgaggactga

SEQ ID NO: 2296 - DNA, 2793 bp, Chlorella protothecoides
  modified_base (1384)..(1393): a, c, t, g, unknown or other
cccgagcatgcctcgctccggaccatcgacgaggcccacagcctgcccggctcggcggtgccggaggacatcccacccctggtcccgccctcccagcctagccccctgccctccatccccgtgctggccacctccgcccgctcctcctcctcctgcgcccttgcctccaccggctcgctgcccacctcccacaccacccacggcacggccagcaccggcgccaactggcccgccacgacgctgatggcccccggccagggccccccccgctcctccgacgactggcagcgcctgcaggcactgcgcgcgctgggcctggacttttccgtgcccgagccgcgcttcgaggcggtcaccggcctcatccgctccctcttcgacgtggcggtggcctctgtctccctggtcgaagagacgaaggtccacttcttctccgccgccggcgactttgcgtcgtgcgcggagcgcgagggctccttctgtgagtggggcatggagtcccccggcgtgtttgtcgtcgaggacgcgtcccgcgaccgccgcttccgcgaccaccccgccgtcgctggcgagccccacatccgcttctacgccggcgcccccctcctctcccccacctcgggccactgctacggcctgctctgcgccatcgactaccgcgtgcgctccttcgacccctcccagtacgccatgctggcccactttggcggcatcgtggtccgcgagctggagcgcgaccggcagtttgccgcgcaggccgcggcgttgcgcgaggccgcggcggggcgcgggcgcatgctgcgcgcgctggacgtctaccacaccggcatcatgctgctcaacgtgcgccagggccactggccgctgcactacctgaacgaggccggggcggctgagctgggcgccgtgcccggcgatgtcgtgagcacgcacgcgggcttctggcagctcttcgccagcccgccgggtgaggccggcgcggcggctgacggcgtggccgatgccgccgccggccgcaagttcgagctcaccgtcgtccccgcccgcagccggccgggcgccacgccgcggccgctgcgcgtcgccttccggcccgcctcctgcgacgacgcggcgggcctttccctgacgcagggaacgccggtggtgacccgcgacgcctccaccccctcctcctcgggctcctcggccaccggcggccacgggtggggcggcgcgagccagctggaggccgcggccagcgcggcctccatcgcgctcctccccctgacctcccccttcctcgccgatccctccgtcttcctctactttggcgtgttcgagatcgcgccaggcgtcgacgcgggcgctactcctggcggcggcggcgaccccggcgccgcgnnnnnnnnnngcgccgacgcgggcgctgcgcctggcggcggcggcgaccccggcgccgcgcagcagatcgaggcggggtctccggagtccggcgaggcggacgccccggctccgctcctggcctcccagacctccttcattgcgcaccgacccaagatcatgcaggaggtcatcctggggccgctgctgggcgtgggctcgcgcggccgcacctaccgcggcctctggcacggctcccgcgtcgccgtgcaggtggtggagtggtggtccagggcgggcgacgccggcggcggggaccgaggccgtgcgtccgtggattccacggcctcagggcggagcgcggcggcgccggaggaccccgtcctcgcggcggcactcagtcgggccctggcacacccccacctggtggggacctacgtctacggcaccacctcggaggagaaggaggaggaagttggtggggcagaggtgaggaagaggggagcttcctcagggtttggtgtatggggaattttcttccctgctatcctgcgagggcagccaggagctggcggggtgcgtgccagttgtgcaaggcgccagagccgcgcagtcgtcgggatggggggtgctgtgcgtgcgggactgctgtcatgtcttgcagcgacaagtgtagggagggcaggcagtctatcctcaagcaccccggaagcacttggttccctcaatcgggccatcacctcgcctcgccgcccgcacttgaaacatcacacacactcgccacctcctctctcgcatcagaacggcgctgcgcgccacccggaccgcgtctaccaccagacctggatcgtcaagtgcttctgcaatcgaggcaacctgaaggacgcgatagagcgtggcatgctgctcaagccggacgacactccggacctgcagggcatcgtggcgaccgcctgcgagatcgcgggcgcgctgtcgtacctgcatgcctgcggcgtgctgcatggcgacctcaccggcaccgccgtcctgctgaccagcgtgcctcaggaccagcgccgctgggaccagcgccgctgggtggccaagctgtccgactttgggctggcggagctggtggcgaggggccagggccgcacccgggccctggcccgtgcctcggtcgcctccgtggctcactgggcgcccgaggtcctggtgggcggcgtgctgtccgaggagggcgacgtctactccctgggcgtcctggtgggcggggtgctgtccgaggagggcgacatctactccctgggcgtgctgctgtgggagatgtgcgccgggcgcagcgcctgggagggcctgacggcgccccagatcctgcagacggtgggcagggagggccggaccccggcgctggccctcctgccggagaccatcccccaggacctcaag

SEQ ID NO: 2297 - DNA, 504 bp, Chlorella protothecoides
ctggccgacgcggagcggcgcggcctgctggccgccgcgccgcccgtggtcgcgcgcatccacgaggtgctggagggcgactttgacccgctggcgctctgcgcgcgcctggcgccgctgctggaggcgctgcccggcgcgctcccccccgcccccgcatccggcccagtggccgactgggacctgggtgtgtacgtgccctacctgcagcaggtggcgctggcgcacactgtgcgccagctgtcccacgtctactccgtcatgcgcgtggaggagctggcacggctggcgcccgcgctggggcacggcgcggcggagcgcctggtggtggagggcgtgcgcgccggctacttctccgcgcgcttcgaccaccgccgcggcaccgtgcactttggcgggcgcgggctggagggcgagcacgtgcgcgggcatgtggccgacctggcgcgcgcgctgggcgcggcgctgggcacgcccggcgcggggctggacgcgggcgtggcg

SEQ ID NO: 2298 - DNA, 462 bp, Chlorella protothecoides
  modified_base (86)..(95): a, c, t, g, unknown or other
cgacgcgggtccgcgccggcgccggggagcccggcggagggcgccgccggcgccgcgtccgcctcccctacgcacgcccacgggtnnnnnnnnnncgggtccgcgccggcgccggggagccccgctgagcgcgccgccggcgccgcggccgcctccccgacgcacgctcacgggctgttcgacgtggggtcctacctggagctgacgggggaggcggggcgggccgacgccgccgccgcgccgctgtccctgccgcgcctgtcgtcttgcacctccgccggcagcgaggcgttgtgccccgtctgcatggacgcggcgccgggggtgcggctggcagggtgcgggcacgccttctgcgccgcctgcctgcgccaggtggtggccgggcagagggggcccgtgcctctgcgctgcccgctgtgcaggggcgccgcctacgcgctggagcctgagcagggctga

SEQ ID NO: 2299 - DNA, 699 bp, Chlorella protothecoides
gcgcagcccaggcgcgctggtccttctcctgctcccgggcgctgtgcaccgcgcagtagatgcggtactggggacgcccctgcccatccacgcgcgccgctgcggggggggtggggtgttttgggtcaggggggaggatgtgtggggacgtgctctggggatggactgcgatggcaggcggggacgccggggaatcgtgcgatggaggcgggccccgcggtacaccagtccctctccaggctgtcgccggcagcccacccacggcgcagcgactgcgcccctgcgccctcggcacaccgccctcctctcatcgcccctccactcctcctaccccagctcacttcccccgcatcgcccgcctcccccctgatacaaagaacgccaccctcacagccccgcaccgaggtacaggcccaggttgcgggcgcagagcgggtggaaggcgtaggcgcagcccgaggcgttgcaggtgaccaccgacccgctggcctggccgcagatggcgcaggaggcgcggtccagccgcacaccctccagccccgccaccacgccctcctgcgtcaggtatgtctccggcgtccacagcgcgcagaccgagtgcacccagcgccccgccccgcccgccgcgcggcggaaggcgccgcagcgcagcgggcacagcgcgcaggccacgtcgcgcgcgccgccgggcaggcgccg

SEQ ID NO: 2300 - DNA, 2109 bp, Chlorella protothecoides
  modified_base (1965)..(1974): a, c, t, g, unknown or other
  modified_base (2075)..(2084): a, c, t, g, unknown or other
atgaggcgccgtggcgcgaggtccgggacgtcttggacgcctgcatcttcctcgcctgcgacctggaggtcgccatgcgtcgcgtcacgcgccgccaagtggccaacggcgccagcctggaggccgcgcaggcgcgggtggcgtccaacgacctccccaacgcccggctggtggccgcgagctcgggcagggcatgctggctggtgccctccatgccccacgccgccgagtgagcccgggggtgggagcgcggtgcgcgtgatttccgctgtgagcggagtccgaccggcagcgggtcacagggatgttacagggaggggggtgttcgagatggaagaatgtcacagagtgggaagatgcttgcgccggaaaagcgcttggcagggggggtcgtgtccgagcggtgattttggtgaaggaccctgcggcggggccagtcggggtggggagcgggccagaggggtcctcagggtggtccccacgaggcttacatgcggagcgttgggtccggccgctggcatggtggtggctcgcagagggccctccacgcactcaggcgcgctcccagaccgcccactggtcgccccagcagctcaggctccaatcccgcgcgtttggcggctgccagtcctccggccccagcttgcagaccagcgccgcgtcgacctcggccgcgtagaggccggcgcgcgcctccagaacgcgcagcgcgctgcggcagtgcacgcgcgcgcggcgccgcgcggcgagcagcgcccggatggcggcgcgcaggccgccgccccaggcgaagaagtggtcgtggaagacgcagggcgtgcccgggtgggtgaggcagtaggcgtacccctgcgccacggcgtgcgccgggaagggccagtgcccctggctggacccggtgtcgtggttgtccacaaaggtcacggcacgcgagggccagaggcccaccagccccggggcgcggccgcaggcgtcgcgcaggcgccagtgctcgccgcgctccagcgcggcctgcagcacgcccttggtggtgacgtcgaaggcggcggcgcgcccccccgccgcgttcagccaggccagcagccggccgcggtgcgcgtcctggtcgtggtcgggcgcgccgtcggggccgtaggccagcccgtcccagaactcgccgacggcgaagcgcggggccgaggcgcgcatgtagtcggcgacgtgggcgccggcgaagccgcggacaaagtccaggcgccagccgtccaggccgacgtcggagcgcagccaggccagccaggcgcagaggtcggccttgacgcggggggaggcgtggtcgatgttgggcgcggcgtggaagggggcgccggaggagggggcgccggtgccgccgtaggcggcgtcgtcgcccacgatggccgcagcgtcccagtccagccggccgccgaagaggttgtagcggccgcagggaccgcgccgctctgcgcagcggtggttcagcaccacgtcgcccagcgccagcaggccgtgggagtgcaacgcggccacgcaggaccgcagcgcggcctcgctgccgtaggcggagtccaggtcgtacaggtcgctgggcaggtagccttgggggctgaccgagcgggtgggtgggggcagccagaccgcggtgaaacccgcgtcggcgatctcgcccgcgcgcgacgccagctggtcgtaccagccgtgccgccaggactcccagttgaagccctggagcaggacctcacgcccgctgccctcaggggccgggggcggcgcggtggcggccgcgtcccaggcgccgtaggtcagcccctcgccgcggggccagagggtgctgcaggggctggagccgctgcacgcgccggccagcctggcgtgctgcgcctcgctcacgccctccagctcccgctcgatggcgcgcaggcgttgccaggcggacagggggtgcgcctggcgcgggggggggggggnnnnnnnnnngggggaggggggagggtggtgatgggcgtggggttgaggggaggtagaacgtgtctctggaacggggacagagccaagacgcaggacggtgtaggatgtgnnnnnnnnnngggggggggagggggagggtgctga

SEQ ID NO: 2301 - DNA, 726 bp, Chlorella protothecoides
atggggtccatcgtgtcttccctggccaacaggatcttggcacaagctgccgcgctgaggcccttagagaacaggaggtacctggtgggcattgctggggtgcccgggtcaggcaaatcgacgctcgcggcgcatctccaggcgcgcataaacgccctgacaggcggggcggtggcggccgcggtccccatggatggctaccacctgacccgcgcgcagctggacgccatgccagacccagaggaggcgcacatgcgcaggggggcgccctggacctttgacccggggtcctacctcgccactctgcgctctctgaggacgcctggcgccggtgagtgggactggcgttggtgtgcagtggtgggtggtgccgatgttggaccccaagtgattactgcctctgcggtcgctctttccaggctgcgtggtacactgagaagcgcacatgcacagcgtcacagaatgaagaccaggacacgctgcacaccactgtccctggctacatccatgcaaagtgcaggctcgcaggcctgcccatcgtttgaccacggggtgggcgacccccgcccaggcgacgtccaggtggagccgcaccacagcatcatcctgacggagggcaactacctgctcataggcaggcacacgttgtgttcagtgtccttgcaccgccctgatttcccaggccctgcctgccttcctgttccttgcacgaccaccagcgtctga

SEQ ID NO: 2302 - DNA, 945 bp, Chlorella protothecoides
atgtgggaccgtgtgcagacggccagctttgacgtgatgtgcggcgtgccctacactgcgctgcccatcgccacggccatgtcgctgcagcacggcacgcccatgctcatgcggcgcaaggaggtcaaggactatggcaccaagaaggccatcgagggcgctttcctccccggccagacctgcctggtggtggaggacctggtcacctccggcgcctcggtgcaggagacggtggccccgctggaggccgagggactccaggtccgcgacgtcgtcgtgctcatcgaccgccagcagggcggcgcggcgcgcctggcatcccaaggcctgaccctgcactccgcattcaccctttccttcatcctggatgtgctggtggccgcggggcgggtggaggcgggcctggccgacgccaccaaggccttcctggctgccaaccagacggggccggcgggggcgaccggcgccgcgccggcggccgaggcaaagccggccgcggcgcccgcgccgcggcgcctggcgtacgaggcccgcgccgagctggccaagaacgcgcagggcgcggagctgttccggctcatggcccgcaagcggaccaacctgtcggtggcggccgacgtggagagcgcaaacgacatgctggctctggcggacgcggtggggccccacatctgcgtgctcaagacccatgtggacgtgtttgacacctggacccccgaccacgccgccaagctccaggccctggccgccaagcacggttggttcgactttttggaggggtattcttgggcggtggggcgccccggaaggggagggaaggggctctttgatggagggacccgggacagcaatacgcagctggagcctcgtgcgagggcctttgggggcgggaggggggtccgacactacacgcccaggctggtgcgcctggccactgccccgtga

SEQ ID NO: 2303 - DNA, 483 bp, Chlorella protothecoides
atgcagtacggcggcggcgtgtaccgcatcgccgactggtctcacatcaccaacgcccatctggtgcccggccctggcatcatcgacgggctgcggcaggtgggcgcgcccctgggccgcggcctgctcctcctggccgagatgagcagcaagggcacgctggcgcgcggcgagtacagcgcgggcgtggtggcggccgcggaggccaaccaggactttgtcatgggctacatctccgtgtcccccgcctcctggcccagcgggcccgggtccccgggcctggtacacatgaccccgggcgtgcagctgtcggccggcggcgacgcgctgggccagcagtacaacacccccgcctcggtgatcggcgagcgcggcagcgacgtcatcatcgtagggcggggggtcatcgcggcgcaggaccccgccgcggccgcggcagagtaccgccgcgcggggtgggaggcctacgaggcgagcctctga

SEQ ID NO: 2304 - DNA, 1767 bp, Chlorella protothecoides
atggcccatcgaggtgttggtggtttaaaaccttgtgcatctcccgtatcggtcagggcttcaggatgcaggtgcgtgggaggggcaacagcttacggatgcttgtacgtgtattggcactcaatcgagtgccccgaggccggtcctgagaaggagtcctcgggagtggctgcctgcgactgtggtttctggcacccacctacccggcaggagcagtgttcaccatttcacctcgtcgcgccgtgcaggtgccatgccgcgccctccacacagcagacagggcacgctccattcaccatcggcacactggaggaggcctgccggtcggcggagcggtccctggtccagtacaggttcaagcccgccaaggcacaggcgcaccccctgtccgcctggcaacgcctgcgcgccatcgagcgggagctggagggcgtgagcgaggcgcagcacgccaggctggccggcgcgtgcagcggctccagcccctgcagcaccctctggccccgcggcgaggggctgacctacggcgcctgggacgcggccgccaccgcgccgcccccggcccctgagggcagcgggcgtgaggtcctgctccagggcttcaactgggagtcctggcggcacggctggtacgaccagctggcgtcgcgcgcgggcgagatcgccgacgcgggtttcaccgcggtctggctgcccccacccacccgctcggtcagcccccaaggctacctgcccagcgacctgtacgacctggactccgcctacggcagcgaggccgcgctgcggtcctgcgtggccgcgttgcactcccacggcctgctggcgctgggcgacgtggtgctgaaccaccgctgcgcagagcggcgcggtccctgcggccgctacaacctcttcggcggccggctggactgggacgctgcggccatcgtgggcgacgacgccgcctacggcggcaccggcgccccctcctccggcgcccccttccacgccgcgcccaacatcgaccacgcctccccccgcgtcaaggccgacctctgcgcctggctggcctggctgcgctccgacgtcggcctggacggctggcgcctggactttgtccgcggcttcgccggcgcccacgtcgccgactacatgcgcgcctcggccccgcgcttcgccgtcggcgagttctgggacgggctggcctacggccccgacggcgcgcccgaccacgaccaggacgcgcaccgcggccggctgctggcctggctgaacgcggcgggggggcgcgccgccgccttcgacgtcaccaccaagggcgtgctgcaggccgcgctggagcgcggcgagcactggcgcctgcgcgacgcctgcggccgcgccccggggctggtgggcctctggccctcgcgtgccgtgacctttgtggacaaccacgacaccgggtccagccaggggcactggcccttcccggcgcacgccgtggcgcaggggtacgcctactgcctcacccacccgggcacgccctgcgtcttccacgaccacttcttcgcctggggcggcggcctgcgcgccgccatccgggcgctgctcgccgcgcggcgccgcgcgcgcgtgcactgccgcagcgcgctgcgcgttctggaggcgcgcgccggcctctacgcggccgaggtcgacgcggcgctggtctgcaagctggggccggaggactggcagccgccaaacgcgcgggattggagcctgagctgctggggcgaccagtgggcggtctgggagcgcgcctga

SEQ ID NO: 2305 - DNA, 2892 bp, Chlorella protothecoides
atggtgctgcggccgcgtagcccctacacctgcgggaccgggcgcgggggcgtggcttggcgcgggcgcgggcgcgggcgccaggccgccctccgtctcgcccgacaccagcgcgtagaggttctcgtcgcgctgcagaaagtgccccgccgccagcacaaagttgacgctggccatgtcgcaggcgtcggccatgtactgcagcaccttttccagcgaggcgcccttgctcacgcccacgggccgcacctcgatgctgcgcccgccctgtggggtgacgctcgagtcactcccgtcgccccctcaaaggcatcaccaaacgcgtcgccctcagtttcctccgcccctcattcccaggcgctccccctccctcccttcacaaaagatcctcaccctcacgacatccacgggcgcggaggagatgggccccgagatgagcttcctccgccctcattcccaggcgctcccctccctcccttcgcaaaagatccttaccctcacgacatccacgggcgcagaggagatgggccccgagatgaggtgctggagcaggtctcgggcctgcaggcgcccaaactcgacgtcggcggcacggtagttccacacgatgctgtgctcccgctgctccacgaagctgcgcggagtgcgctcgcaaaagtactcgaacaccagactgacgctgtccatccactcgcccgagggcggctcgatgacgggcacccactcggtggcgccgggggggcgcagcagcatgccgttctccgccgccagccagatgcgcgtgccggcaaacacctcctccagcacctccttctcgctcccgctgaacaccaccacctgcgttgtcgcccgctgtatgggcatgcatgcacagcctaccccagatctgctcctgggtgggagacattcacgacgcctcttttctcgcccctccaccaggtcgttactcccccaaaacacccccctctgtcccccgcttccccacaaacacatgtgaaccccccttcctctcacgtggacagtggggtcggcggcgagggcggccagcgcggcgacggcgtccgggtcgacgcgggcgcgggcgcggcccgggccaaagggccccgccgcgtgccctacgcccggacggtgcgtcctcccccccggcccctcctctcccggcgtcagcgtggcgttgtagcccaggaccaggaggcgccccgccgcgctaccgaacgcagcggccacgtccggcacggggagcggcggcggcacgccccgcgtgcgcagctccgcctccaccgccgtgtcgtccagctcggagatgaaggtgtcggcccaggtctgcgcagtgtgcacggtgacgtgcgcgtagttgtggcggtggcgctcgcgccgctcgcgctccggcatgcgcagcgcgtagccgatggccgcggccaggtcggacacgttccaggggttgaccaggagggcgcccgcgcccaggctctgcgccgcgccggcaaactcggagagcaccagcacgcccgcgttgtcgcgctggcaggccacgtactcgtaggacaccaggttcatgccgtcgcgcagggaggtcaccagcgcgacgtcggtgatggcgtacagcgccaccagctcgtggaaggacagctggcggtccaggtggtagatgggcacgtgggtgagcgtgccataccggccgttgatgcggcccacaacttcgtgcaccatgctgcgcaggcgctggtactccgggacgtcggtcctgctgggcaccgcgatctggaccaggagcacgcggtcgcaccactccgggtgctcctccaggaacttctcaaaggccagcagcttctgggggatgcccttgatcatgtccagccggtccacgcccagcatgaccttgcgccccgcgtaccggttcagcagctgggccacgttggcgcgcacctcgggcgcgcccagcgccgcggtgaagcggtcggggtcgatgccgatggggaaggcggcgacgtgggtcagcgacccgtcgtcctccacgccctccggcgtggcctccaggcccaggatgcgggtgcaggcggacacaaagtggcgcgcgtagtcgtaggtgtggaagccgatgaggtcggcgcgcaggacggagcgcagcagctcctcgcgcacgggcagcgtgcggtagatctcggaggaggggaagggcgtgtgcaggaagaagcccacctgggggtgggcagcgttccgtgcgtgggaaggtgggtcgagaggcgcaggagggcagaggcgatcagcccacaacacaccgaccttcatgttggggcggcgctccttgagcaccgcgggaaggagcatgaggtggtagtcctgcacccagatgatgtcgccctcctggtagtgctgcatcaccgcgtcgccgaagatgcggttgaccatctgcggcacgtagtggaacagctgccacagcacggagttgcagaagccgttgtagtgcaggtccaccatcttctggtccaggtacaccggcgcgtagccctcgccgtgcagcgcagaggtcagcgcgtcgcgctccggtcccgcctcgacgtacaccccgggccagccgatccacttggtctggaagtgggccacgcccatgagcgccgacaccaggccccccgcgctgacctgcagctgccacttgccctccgggtcgcggtacgccgacaccggcaggcggttggccaccacgatcaggcgctgggaggcgcggccgtcggcgagtgcggggtggggcgccgcggcgcagaaatcggggggggcgccggcgccgccggcgcgggggtgcaccccgggggactcggcgccgggcacgccgggctggtcgccaaacagtactgtggtgctctggctcttcctcatgcgctggagcaggaggcg

SEQ ID NO: 2306 - DNA, 1515 bp, Chlorella protothecoides
  modified_base (449)..(458): a, c, t, g, unknown or other
  modified_base (1187)..(1196): a, c, t, g, unknown or other
atgttcttccctcctcacagcaggctcacccataccccaacccttccccaactccccgctgcaggagatgcagctggatccggcggcctgggcacccgccaagcccctgtctcagggtgccgagcgaggcgaggcctcgcccgcccaggagggcggcggccccgccccccccctcgtccaccgcgggttcctcaaccgcgcgcgctccgtccccgtggaggccatctacgcggaggccgaggcgcgcggcaagcgcctggtgctgtgcgggcactccctgggcggcgcggtggccgcgctgtgcacggtcagcctgctggcccgcctgccgcgcgccgtgcacgccggcgtgtcctgctacggctttgccacgcccgccgtggccaacggcgtgctggccgatatctgccgcgaggcgggggaggggtgcagcgtgccgtcctgggacnnnnnnnnnncatgccaggtggggggctggggagggtatggggtggccaggtgggaatgaagaaggaatgtcggcatgatgaggtgtccgacagggaggggtgcatcgtggccgtcctgggattcggctcccgccccgctgtctcaatgttccgtcgcctggtgttcaggagggtgcctgtcaaccgggaggcgtcccatgccggtcctgaaccctatcaggcgccctgtcccatccccctcctcccaccacacacaaccgcagaggaccccatcccacggctgctatcctggagggcggggtctggagcgggcaggcccgagggggcaagtacggccggagagcccacccccccctccgagggcctggccaacaacatcgccgtcggggcggagcgcttctcctccctgccgggcttggggcccctgagcgcccgccccggtcgggtggccgaggaagcatccggcgcaggggcgaggtcccggacggggggtcccgccgccccgcccgactccgccgaagaggctgcgagctcgagcgccgcgcggggccagcagctgaaagatcgcttctccgccgccgcgacgccccccatcagggtgcgttggagggaaccggagggcacagggcagcacaggcgtaccccgcgctgtggcaacccgggtctcgacgccgagggctgtgctctagcgctcccgcatgactgtgtccctcctcaactcccccctggcacacatannnnnnnnnnctgtggcaacccgggtctcgacgccgagggttgtgctctagcgctccggcatgactgtgtccctcctcatctcccccctcgcacacatgcacaggtggtggcccggacggccggcgcggcagcgcggtacctggccgccccgctgggcgcggcagcgtccgcgcccctccgcgccgcgcccaacttcacgccccttggccggcagctctacgtcacccccggccgcgtgatcgtgcgtggcgcggcggcagacgccgcgctccgcgcgcaggccgagctcatggccggcctgggagcgggtgcggacgccggcgacgtc

SEQ ID NO: 2307 - DNA, 1185 bp, Chlorella protothecoides
atgttgagtcagggctgggcatacgtacgcactgttgccgtcggattgtgccagtcaggtcgatccgatggggtgaacgggccatcaccccttgcatgcatgcagtacccttccgcctgggcccccccgttctctgaccgccaagtccacccactcccgacccaccccgaacaacaggccgcgctgcccagaggctgcaattgtggtgggggcgacggaggacgcgtatgtctgccgcgaggcggtgctggacctgcaccacttcctggaggggagcgaggtgcgctgggtgccgggggggcacgtctcctccttcctcctgcaccaggaggccttccgctcggccatagcagactccctggcgcgcctgccggcgtgagctggcaccgggaagtgctagtctggctggagtggtcgtggagtcatgctgagctcgtcccaagcacgtttgcaatggaccggccctcgacatccaattcacgtccgggatccgatctggaaggcctagcctcgatctgcattgactcacacccattgaagaattccagccggattctgagatggccgaaacggtgtcctgccgctccgagaagcaagcaagtcggcttgggggtcgggacgtgctggcggcattggtgggggcagcactggtggctgccaccgccgcagctcgacgggcatggaagctgggtcagcgtcgcaagcgtgtggtgcgcagttggagtagaaagtacgggtctgatcggtggacagggatgctggatgcagtgcttgatgatgggaaggttgaccctcagatcacatcacctcccacaggtcggcatccttcctgcccgctacgactcctcgcgcttccctggcaagcctctcatcccactgctgggcaagcccatgatcctgcacacctacgaccaggttgggagttgccccttggaacgtgctgttgctggagtagggctatcacttttgcgctctgttcgtgtgctgtctcgagaatcttcccaagacaatcctgacacaatctcccaagccttgctttcccaggcctgcaaagcaactaccctggatgcagtggtcgtcgccacggacgacgagaggatagcctctgtgtgtcgcgcgcatggagcccaggtggtgatgacacggcccgactgccccaatggtgagccggaagtacatgcttga

SEQ ID NO: 2308 - DNA, 648 bp, Chlorella protothecoides
atgcccgcgacacccctgatggtgggcgcgtctcagaggggtgggggaaggggattgcggacctggttctggcgccgcctgcggtcctggcatgctgttgctgttgctgtgccgtcagcagcatcagaacaaacccattccccttatcgcctgccaatgccaatgcaggcaatggaggatctggagcagctcaaggttctggagaacggctacaagatgaagtgcaagatggtcgatggtgtaggcctgcagactccatgcatcccagcgtctgctcggtgtgtctgcaaacccaccctcctcacacctctcctgcccaaccccctcgcaacaggtggtggaggtgagccacagcgcgcatggcgtggacatgcccgaggatgtggcctccatcgagcgcctgttgaccgcgcaggccagtgcggtgggggcagtcgccgccgccgtccggcgagcgtagatgccacgtcaaacctgggtggtctgcttgcacaagggtttacaagagggcgtgtaaacgcgtcacatggattgttgatgcatggtacagctgcaaggagacgtgcatgggccgtgtccacggtgggcaaccccccgtctcagtgttgcagcgtcagacgctctcgacagtcagtgcacagggtttga

SEQ ID NO: 2309 - DNA, 1584 bp, Chlorella protothecoides
  modified_base (49)..(78): a, c, t, g, unknown or other
  modified_base (405)..(414): a, c, t, g, unknown or other
atgccacgcacaaggcgggagtgttcatcttgcccgcctgcagtcagcnnnnnnnnnnnnnnnnnnnnnnnnnnnnnngccttgaagcttgaaccagagaacccagaattcctgagtgcatacggagcgttcttgtcggagactgggagccgtgatgaggccgtcaacgtgctcaggaaggccgccgaagtacagcctgacgccggatttgaaaagtacatagctgcttctgagtgcccttgcctcgtgtctcttcttgagttctccatccgagctagcaccccccctgcattgtcaacaccatgcaggtaccttggccagctgctgcatggtgagctggcggaagcggcgctcaggagaggcgtcgacattttgagagtcgaactggaccgttcggtgagtcgnnnnnnnnnnggaagcggcgctcaggagaggcgtcgacatattgagggtcgacctggaccgttcggtaagtcagggcgtatgttttcagctttgagggttgggagtggagtgcgaatgtgcagtctccgcgtcagcaaccacccgctcaacaaccgggatctcttttctgcggccgccctaatcaatgcggttgggcgccgggggctcaagagccccccaccccggccgcggagcccgcgcgtgaccggccaccacatctttggtagtttcagtatcatccacctgtttcatgccgaggccgccgtgccctggcatcgacagcctgcttgccgaccaccgaaggctctggtctgtccgagctcaccgaccatttcccccttcctttcccctcccaacttttaccaccagaacgcgctcatcgcctcgcccgacaccgaggacgagctggcgagccaccgcgccgcgctgtcgtcgcagctctcctcctccctctgctgcctggccgaggaggtgatgtcctcggcggccgcggcggccgaggaggccggcggcctgggcccggaggccgccgcgcggctgacctcggcggtggagccgctgctggccgaggcgcgcgcgctggacccggccagccccgagccctttcagaacgccgcgcagctggcgctgcagtgcgggcgcgccgacgcggccgcggacctgctgcgccagtcgctgggcctgtggtaccgccccggcgcggacgagggcggcgacgagggcggcggcgacgccgacgaggaggaggatctgggcagcgaggacagcgggagcggggcgggcgccggggacgagcccgagccgcccagttttgagttccggttcgagaccgcgcgcctgctcctggagctggacgtggagcgggacagcacgctgggcgtgctgggcggcctgctggaggagaacgacggcgtgccctccgtgcacctgctgctggccgaggcgctgacgcgcggcggcgagtacgacgacgcgctggaagcggccgaggaggggctggccgccgccgcggcgctggggcgggagggcgcggagcccgacgtggtcacctccctggaggagctgcgggaggagctgcgggagctgatgcgccacggccccgccgagcccatggaggaagggtcacagcccgccttgtga

SEQ ID NO: 2310 - DNA, 810 bp, Chlorella protothecoides
atggcccgcgcgctgctggcgggcacgtcggtggtctacgacggcgacccgctccgcgacctcacccccgcagccttcctggacaagttcatcgcgcggcggcccaaggccggcggccgcgcgcgcggcgggtcggccatgcagcccttgcccggggtcgcggagacgggggcgcccgactttgggcaactgtccgaggcggacgtggccccggaagacgtcttcttcctcaagtactacagcctggcgggggtagcgcggcggcgcgcggcggccgcggccaggaaggcgcgggcggcgggcgcgggggaggaggaggaggagctgctgtccgacgccgactcggaggatgccgatgcctacctggagggcgaggaggaggggggcgaagagggcatcggggccgaccccgaccgcgccgcggggtacgactactcccagctggcggacgccatggcagactcagggggcgaggatgacagcgacagtgaaagcgatgccggcggtctggaggagggcgacggtggagaggagtctgcagacggagaggaggaggttgttggaggtgatgacgagggcgaggctggtggggacgacaaagaggacgcggacggctcggagctggagggcgcagagttctccgacatgtcgtctggtgatgaggatggcgacagcgacgacgacctggccagcctgcctgactcgggtgcgcagccggagcaaggactccggggtttggagatcatgagttggatgagaattggtggcgggggggcctggagtgcaatggatctcctagcaggactctga

SEQ ID NO: 2311 - DNA, 2112 bp, Chlorella protothecoides
  modified_base (267)..(276): a, c, t, g, unknown or other
atggagtgtcacccatggcctccgtaccatgtcctcccatcggcaacgagctgcccaagcggtcgcagcgggtctatgagaaggccccgaggcctaatccggagcaaccacccatgcaatagcacacatgaagaaccgggaactcgcgatcgacagcccggaacgatatattggtgtccttttgggtgtcgtaatcccctgatcttacttcctgattggctgattccttaccgtatacctaatgatttttacctgatcttcctgggnnnnnnnnnngatgccctgatcttacttcctgattggctgcttccttgccgtacacctaatgatttttacctgatcttcctgggagggctctcttgtaaacatggaggcggtgatcgcgagactggaggcagtggcaacgcgtctagaggccacagatgtaaggatcgtacttcttcgatctggatttcatccatcgagcatgtcctcataatatttatttccctcccacagggacgcttgcgacagtctggtacatccacagcacacggcgtcccagccactgtctcagtgccacaaggaggatcgaaatccgctcctatcaccccgccgacctcaaagtatcaggatccagactccttttctcaagtgatcagcgcaacaaccgccttccttgatgtggcggaacgtatcgggggagaggtgggtggcctttgtttgcaagggattgtggttggactcctcccagctgtcacagacccctgcccaccggatagagacatgaccaataccgtttcagatcatcccagcccgcatcctttgccattctcttccaagctcagtggccccgaggagctgcagcagctccttgcaccggtagcaacccagctggaagccgcagggaggctggggtcgggatcccgctccccatacctcaatcacttcaaggtggtgggggaggccgcccaggcgctgtcctgggtcgcatactctggccccaactgcggtgaggaggagggtaagagggggagaagtggctgcaattgcctgctctataaccggcatggcgttgaaggtgtaatggatgccctgccttaccacgagcacaggcatgcgcagccccccagaccatgtgtcggatgccttgcaggctgccgaattctatgcaaacaaggctggagcggctgcgccgccaatgcgtgtaatccaaggcctcctcctcccgtgttcgcccaggtcctcaaggactggaggcccaaggatgccgcgcacggggagtgggtagctgcactcaaagccgtgctgaaggccatgcagagttcgtgtcggctcgtgggcccccacacactagctgacaatcaccacatcttccagccgaaacgcattcgcgccactcccccatcatgtcaggacttttgtgcggccgagtaccccaggggacctgcctggaaggagggcggcctgtccgccgcatgcttcctgcagggcgacagtggggcgccctcctccacgcgggctcccgcggcgcagcctccctctgcgccgcccgccgcggccaccacctcccagccaggcgccgcgcagcctgccaagcgcgccggccaggtcccgcgtgctcccccgccccctcctcctggccacctgaccaagcccaggggaggtcccgctgatgaggaatctagcaaggcctccggccccaccggcgtggctgccctcttcgccgacctcaaccgcggcacggccgtcaccgccgggctgcgcaaggtgaccgccgacatgaagaccaagaaccgcccggcccaggagggcgcccgcgcggcgcccacccccgcggcccagcccccacgcttcgagctggtgcaggggcagaagtgggccgtggagcaccaggtcggggtgccagacctggtggtggcagacaccgagcccaagcacaccgtgtacgtgtacggctgccggaactccacaatacaggtgtgtatgtttggggggaagggggccaagctgacagggtgtggcgtggccaatgccggcagtgcccctgcgacgcttgagactgaacacgagcaccgtcgccctcgcatgaagcctggcctgtggtactaccctatccctcagcagacttga

SEQ ID NO: 2312 - DNA, 2109 bp, Chlorella protothecoides
  modified_base (471)..(480): a, c, t, g, unknown or other
  modified_base (848)..(857): a, c, t, g, unknown or other
  modified_base (929)..(938): a, c, t, g, unknown or other
  modified_base (1219)..(1228): a, c, t, g, unknown or other
  modified_base (1371)..(1380): a, c, t, g, unknown or other
atgtcttggggggggaaggggtccaagctgacagggtgtggcgtggccaataccggcagtgcccctgcgaagcttgagactgaacatgagcacgaccgccctcgcgtgaagcctggcctgtggtaccaccccatccctcagcagacttgggcctcccatcccccttcccaatatcacccaggtcaagggcaaggtgaacgccatctccctggacaagtgctcgcgagtgggcctgctcttcgaccgggtggtggcgtccgtggagctcatcaactcctcgtccgtcgacgtccagtgcacgggcggggtgcccacgctggccatcgacgcctgcgacggcgtgcaggtgaagaaaggggggcgcaggcaagaataggggggggtgcgttcacggagaggggaggtaccaatgaggatcaggatcgtggtgcagggttttcaaactgcggcttggacggagatcggcggcgnnnnnnnnnngggcaagaaaggggggggtgctttcaagggaaggggagcaccccagcccctgcttaccacaccgcattcccccccctctcccccccactccagctctacctgccgcgctcgtcgctggacacggatgtgaccacggcgaagagcagcggcgtgaacatcatcgtgctggcgggcgacgaggacggcggtaaggaggcggaggggcccgctgaggcggcggtgccggagcagtttgtgacgcgcttccgggacggcgcctgggtcaccacgcctgtgcaagcggggctgggcggtgctgctcaaagggcaggcacacaacctcctcttcatctgcagccccctgctctgccattgcatgttccacaccnnnnnnnnnntgcgtcgccgccgtcgccgcccacggcctcggcgccctcgacctcgttctcctcctccagcactgcggggannnnnnnnnngacctcttcttcattcgcaggcccctgctctgccattgcatgttccacaccagccttcctttacagcagccgcgtcagaggtccatgggcgcggggccgtcgccgccctcccccggcgcagcgtcgccgccgtcgccgccgtcggcgcccacagtctcggcgccctcggcctcgttctcctcctccagcactgcggggatcaagggggcacagggcggtttgtagattgatggtgtgtgcgttggctgcaaggcccatggctgacgccgtcgccagctcgnnnnnnnnnngttgtagattgctggtgtgtgcattggctgccaggcccatggctgacgccgtcgccagctcgattcggggttggcttgcatgtgcgggtctgccatacctcctcacaccagcccccaaagcaggctgcgatgccactggccannnnnnnnnnctgcatctgcgggcccgccacacctcctcacaccaggccccaaagcaggctgcgatgccactggccatcgccccaggcccaccaatgacactcaaccccccgcgagcccctgcaagaccgcccacctgcaatgtatggctccagggtggcctcctccaggagggtgaagggcacgtcccgccccacaatggccaccgtgcaattcttggaggtgaggtcgccatcctgggaggaaagggaggggcaggaggccggctgagtgcagatggaccggacaacaccgggttggccctagaagcagtcagagaactcctggcttggcatggcgtggccacccactctgcaccacgcgcgatcagggcgtctgcaccacccagccagccgcggcatgacatccaaggtctcgaagctgcgctccatgtacgtcttggcggcctggcgaggggaggcgggggagaaaacgcaggggctcaagaccgttgccttcttcatgctgatccaacaggtgctccacctgtccaattacccacgagctcacaccctgacaggcagcacctgagatcgggcgcccatggcaaaggccctgtagtcatagtaattgcccgatggacagttgtagaagatgtgaggacctgcaagggggggaggacaaggagctgcattagcgtccgttaccttgcccagcaatgcggtttgattcagaggccaggtggaggttgcaatgcttga

SEQ ID NO: 2313 - DNA, 735 bp, Chlorella protothecoides
  modified_base (449)..(458): a, c, t, g, unknown or other
atgctgcaacagagcaaagacgtggctgtgatggccactctgaagagggcgccctctgagctctcctcctaccagcgcaaagtgttcaaggtggggagtaggagcggagagtctgacattttcctgtttgcttgctcctcaacgtgcccctctcctgtgatgcctgaacctcagtcctccacaactcgtcttcctcctcagattgatgaccacatggggattgccatctcggggctcacagctgatggtcgtatcttgtgccggtacatgcggaacgagtgcctgaatcacagatttgtgtttgattcacccatgccgctgggccgtctggtccgccaactggctgacaaggctcagaacgtgtgggacattgcatgtatgcaccttggctccaatcaggcgggggcggcaggtgtcaggcccaactgctgcagggcacagggatggannnnnnnnnncattgacaaacataacactcttgcttggaaggatgagaacgtgtatgggacattgcaagtatgcaccttggctctaatcaggcgggggcgacaggtgtcaggccccactgctgcagggcacagggatgggttcacacatgatcaacaaactgtcctccgctttctccaacaggtggggacgcagaggtcatggaagcggccatatggtgttgggctcattgtggcgggggtcgacgagtcaggtgagatggggaggcgcatatatgtgggcccttga

SEQ ID NO: 2314 - DNA, 279 bp, Chlorella protothecoides
atgcgccagctgctggagtttggtctgttccacggcgacccgcacccgggcaacatctttgcgctgcatgatggccgcatcgcctacgtggatttcggcaacgtcgcggagctcagtcaacgcaacaaggaggtgctgatcgacgccgtggttcatgccgtgaaccaggattattcgggcatggcggaggacttcatcaagctggggtttcttgccgagagtgagcgctggagttgggagctgcgcgcctgttatggacctctacccaccattagatga

SEQ ID NO: 2315 - DNA, 603 bp, Chlorella protothecoides
atgggcgtcgccagcgtggctgtaatggactccggtaccttctcggttccgagccgagctgcgctgaacgcaccgcgccgtcgacggcaggctcggggctggctcgcgcccgagacgtttgtgtttgacaaccttcctccgcaccagaaggacaaccaatacatccgtcgctactaccgggccaattattcctggaagcggagtctgctgagcctcttctccctgcacaacgagacgggaaacatatggacacacctcatcggtgcgcgcggaaggggcgtggtcatctttgtctgcctgatctgcgccacggtcagggtcgcccccgagcccctggccctgggcagcagcgccctgtccaagctcgagcagcggctgtacgcatatggcaagaccaacctgtacgagctgctggagacggtggagtcgtgggaggccaaggtgctcaaggtcggctcctccggtctggggtccatcgaggagcggttgggctcctttggcctgcacaacctgcacgacctggtggagttccaggagacactgcgccggtatggaaagcgcggggtcaaggagctgtctggctttgggcgcctcatccggtga

SEQ ID NO: 2316 - DNA, 234 bp, Chlorella protothecoides
atgaagaaggcaacggtcttgagcccctgcgttttctcccccgcctcccctcgccaggccgccaagacgtacatggagcgcagcttcgagaccttcaccgacgccagcgtggatgagcttgtacgccatgcgctgctggccctgcaggccaccctgcaggtatggaccagaggattgtcggctggcgaccttggatgtcatgccgcggctggctgggtggtgcagacgccctga

SEQ ID NO: 2317 - DNA, 519 bp, Chlorella protothecoides
atggccgacttcaatttccgcactgtgacgaccaagttcaacgagctggtgtaccagtaccccatccgagtgcctgagcgctatgccctcgtcatcaggtgggtgccgcagggactgggcggtgttgctgaggatgtgtgggcgctcaggaaaggctcagggccaacttcacaccctcccacctatatacacaggtccctgctgacgcaggagggcgtctgcctgagcatcgaccccaacttccagttcctggcggtggcatacccctacattgcccgccgcctactcaccgaccctgacccctccctcagatctcgcctcatccagggcgggaagttcaggtgggacaggctgcagaacctggtgaccctggcgcagagcgggacgggagctgtggcagctgacctcaccaccaccgtctcggatggcctcagggtaagccttgtggggcggtctagactggcggggtctgttgaattgtgctgggctcacaaaggcttgcaccattttgcaatctga

SEQ ID NO: 2318 - DNA, 660 bp, Chlorella protothecoides
atggagcccgagacgggcggggctccctccggggccgaggccctgagcgctggagacctcagaaatatgctcggtcagtgcttgaagctggcctccgagaacaaaatcacggccaagaacacctggggcctccctctcatcgagcacctggatgacctgatcaaggcagagccagacagcacaaacttccagcgcgccagtgtcaccctggatgccggagtcaagatctacggcacccgcgtggactcggtgcacacggagacctttaagatcttgggaggccttgggcgagctgctgcgcccgaggaggccctcgaaggaactgcgtatctattccagactgaacccaaacaccctgcagatggcgcccagggagaggagggtgtgggcgagggcgcgacgagccgacgacgcaaggtcttggctctggatcagaatgccaccctggagtccagcccggacgctctgaatctcaagcagttcgacctggctttcgatgtagaccccctgttccaacaaacgtctgcacagtttgacgagggcggcgcccaaggtgcagagcgtgggggcaggtccatgggcatcgtgacttggatgggtgcggtggcttacccctgcttcccccttgtccgcctgtacctggtgtccgcaccgccttga

SEQ ID NO: 2319 - DNA, 741 bp, Chlorella protothecoides
atgaaccccgtgccggaggcccgcctgcccctgccgccctgcacccatgtcccacgcccgcgcagttccggttcattccttgttcaccccgccctggcaacggtaccaccccacaggcgcttctcccgcagcggcatggaggagctggccagcatggagcagcgcctggtgggcctgggtccgcgcgccctggccgacgccgacgaggcggtccagcgcgccctggcggcggtgctggacacgcagtggcccgcacggcgctggcccgtctacgttttcatggccggcgcggtggtgtgcctggccacctcctccctctgccacctcttcggctgctgtgcggctcatgtctccacccgcatctggcgcctggactacgccggcatcgccgtgctcaccgtcacctccttctacccgcccgtctactacggcttcatgtgcgcgccggccacgcgcgccgcctacctcgcggcctccacgggcctgggcctggccgcgctggccgtcacgctgctccccttcttccagcgacccagctatcaccgcgtgcgtgccgccacctttgccgcgctggggctgtggggagtggtgcccctgctccacgcctcgctgctcaacgcgggtgtgaaagaggtgcaggccgccatcaccctggacgtcgtcatgggcgtcatctacctggtagggtggtctgggtgggtgtctgctgggagggttgagagaggggggttgctcccttga

SEQ ID NO: 2320 - DNA, 630 bp, Chlorella protothecoides
atgacgtttgcggttggggcggcgggggagggcgggtgctggcctggtgaggagtccgaggcgagtcccggcggcgaccccgtgaccaccgtcaccccccgctcgcctccgcctccgccccacggcgtggacctgctgacgccgctggcggcggcctgcgcggacccggccctcctccccgccacgctgccctgggtgacgcgctacctctggttcctggcctgggacggagaggcgcgcgccgcgccgcactaccgcgccgcgctgcgcctgctggcgcgcttggcggcttccccgaagctcttgcccggggacgcgcggttcggccccgccgcgcggtgcctgaggggggtgctggacgcctttgcggcgcactgcccgctctggcccggcggggggggcgggaacgcacggcgcgaggtggatgggcagggcgtcggtcctccagatcggggcgcggtggccggccccgacgccatcggggcgcggcggccggtctcgacgccgtgccgggaccgcgtgcgagcttcctgccggagcccgcggccggtgcggcgatggccagaacggcagacccacgcctgctggccctgtgctgccccggggcggagcggtgccagcgcctgctga

SEQ ID NO: 2321 - DNA, 408 bp, Chlorella protothecoides
atgcagatgccgctggtggagccagacgatggggcgcaggatgctttgcgaccaggtgctggcgaggcaagtggtagtggaccactagccggaggggacaccgggtcgccaagtacaggaccctccaatcgtgaacgacttcagggcggtccggcgacagaggacagggcaactgcactcccttgtcctgcactcgtgccatcagctgctatagcaccccctgagcgcttcaatctctttgccctggaggagcagatgtcccaggccaagcacccagaagtagaggctgagaagcgtaaaaaggtggcaaacaggggcgaccagaagacccagacgtcggatgccaagtttgatgagcgcttcaaatttgcccatggtctgaccggctccagctcccagccatggtga

SEQ ID NO: 2322 - DNA, 1143 bp, Chlorella protothecoides
atgtgcaacctttgtgcctgcacaagcgcctgcaccccaactcccgctcgtcggaggtgttgggcccacaaggctggagtctgtctaacgcacaagaaaagtaccggtggtgacgaggcgtggctcaggaactggcgaatcagatgcagcagtactggggtggcgcaccctgggcctgggctagacactaggcacaggtgtcgtgcagccacagacgctgtgcctgctgcttgcattataccagtcgcaaatttaagaaatcgctcgaggggacttggggaatcgaaggcccgcccccgctcatcctcccgtaccgacatcggtgcgcttccgaatcgcagacaccatgcatgccgtgctgcgctcggggccagaggtgaagataaggcgcaagtttggagccagacgggtggcctggcatcgcaaccaagacccaatccaagatacactcgcaaagtacttgtcgaacaacaggtggagtccagcggacggagtgctcagtcgtgtcagggagccatggcttccgccctatcctctgctccggctttcgctttcaaaaccaacgtgggccgaccgcgtgtgagcatcagccgcctcatccagtgcaaagagagccgaatcggtgtcaaggcgatccccgttcccaagggcgtggatgtgaagctggacggccacaactttgtcgtgaagggtcccaagggcgagctcgcgcggactctttccactctcgtcacggtgtcgagggtgagctgtggcaagcgtgcgtggggactgctgcggtggtgcccagcacggcctcgcccgtgcgctcctgaacaacatggtggtgggtgtgtccaccggcttcacgcgcacgctcatgcttgtgggagtgggttaccgagccgcagtctcggggacgaagctgacgctcaatctgggctactccaagccggtggagctggctattccaggcggcgtggaggtaggcatgcatgggagtgccctgctgtgtacacatgctgccggggcaggtctcagaggatgtccacagccaatccccaccgcatctgccggcaggtgtctgtggtgaagaacaccaccgtgaacatccatggctacgacaaggaggttgtcgggcagtttgccgcgaccatcaggtag

SEQ ID NO: 2323 - DNA, 297 bp, Chlorella protothecoides
atgctttccgcaattctcgctgcgctgacggccgacgctcgagctcaatctttgtgcaccctgcagggaggagctggaggccaaggcaaagggtgtcgagaatccgtggcacgaggcatgatcctgactggtggatctgctccccgcaggttggatgccccatttggcacggagaccaaccccgtagaagtgaccagcgagttctcagagcgcattgtcggagtggcagacccagatgatgactccctggtgagcgaatggaaccatggcgtgatcgacagatgcgacagcacttga

SEQ ID NO: 2324 - DNA, 906 bp, Chlorella protothecoides
atggggttcacacggcctcctaaaccccgccgcccactgcgcagtgacctggacgctgaatgcacatgctgctttggagctggccctgtcggcggagcggggcatctctcatgccctcatgtcggccgagaggtgcgtggtttctcacagacggggcttgcggtgcagggcccatcgcggagcaggggtgctccggtctgcggcttcccaaaccaacctcccctttgcctgggtcagggatgctgcggagtgcgaggcggcgctcctccgcgtccagaccgtgctgcaggccgtccacgagcgggcgatggcagcgctggactggcgcgatcctcgcccccacctcgtccgcctcatcagcgtggtgacttcgcccagccactttgtgaggtgagggtgcccctgggtcgccgcacccctcgccccagcatggcaccgtgctccacaagggcggtgttcatcgtgagcgaaacacccctcccacagggacctgctggagcgcgtgggggcggacgccggcctgagcccacaagacctgctgtccctgttccacgagtgcgctgtcaacggcgcaccgggcctgctgtctgccgcgcggctcggccaggccctgcagctctacctggcagtgatgaactgctggagccaggtggactcagcggatggcggggaggatgcgcagttggcgacgtgggtgaaagccgtggatgcacgcgactcgatgccctcccgcaggctgatcctggagctggagcgggtgctgcagagcagcgtggcgacagtcgtgctgtctggcctgcgccagccgcaggtcgccaaactcctggcgagcagctgtgctggcctgggctgatgaggagcctgagcagcagaggggttgttgtgggggttccccttgaccgggcc

SEQ ID NO: 2325 - DNA, 777 bp, Chlorella protothecoides
  modified_base (464)..(473): a, c, t, g, unknown or other
  modified_base (689)..(698): a, c, t, g, unknown or other
atgggtttcaaacaacagaacattaggctgccagccttccaaaggggctgccaccttgtgaccagcgacattgtgcgggagatcaaccccctcctcaaggggatccatgcgggtctctgccatattttcatccaacacacctcagcatcattaacgatcaatgagaatgcggatcccgatgtccgagcagacatggagaccttcttgagcgcagtcgtgcctgaaggctccaaagccccctgggtgcatagtgacgagggcacatgtcaagtccagcatgtttggagcgtccgtttccatcccaatcacccgaggacggctagcacttggaacatggcaggtggggtagccatggttggaagtgccagtagggcgtggatgtgtccaaggagagggctgctccacggggggcaaccttggattcagcctggcactgtcgcagcgacacgggatctgaggttcannnnnnnnnnaatgtgtccaaggagagggctgctccacggcgggccgccttggattcagcctggcgctgtcgcagcgacacgggatctgaggttcagcacaactttgcgcatcatcctccacagggcatctggttgtgcgagcaccgaaatgcgggggggcgaaggaatctcgtcgtcacggttcagggggagtgaagggcagaaagtgtctgaccccgggggggnnnnnnnnnnaggcgtaaaaagtacagagagcactttggtggagacatctccgacagactgcacatcgggaagaaccatttcgtggtag

SEQ ID NO: 2326 - DNA, 1107 bp, Chlorella protothecoides
  modified_base (848)..(857): a, c, t, g, unknown or other
atgcgggaactgctggtcgcccatgttggctgtacattgttgcacaaaagaggcgccctgcaagcggccccctccccacttcttgagctcagggtccagtggctgccagggcccctgatgcactctcagggagtgctgccgcggagaggtctgccgctcccgcctcccaggctcagtcctctgtgcttccagggctgtcaggcctggctgcctgcctgcagggcgtcagcagcctcacactctccctcccagggactctgctggaggtgcctggctgggaggggcatccgggggcggggtggagatcatgaatgcatcatgtccttcagagggactgggagctgccgtgcgtgcaagctggcgccagtttgggggttgaccgtattttcatggtgcctgcgaggctggtcactgcaccagcttgacacggccctcccaaacccacctccctcctgccctcaggagccctccgccaatgcgctggaggactcggccagcgtgatgcccagcatgatccccctggtgctggagctggcacggcgggggaacctgtatgccctggcgcacgtggcctctgacgtcggcgaggctaccgttcggggagccctggagcatgcggggctcctgggcccaaaccatggccagctgcccccccaccgcctgctgttctgcgggacgcgggagggcaaggcctccatggtccggcagctggagccgcagctgcacatcgatgccgatgccgagacggtgaggaggcatccagcgggtggctgggaaagggtgcagagaagattacgtggacggcaggtggctcgtgggtgtggagtgtatgtggctgggggatcggnnnnnnnnnngctggagccgcagctgcacatcgatgccgacgccgagacggtgaggaggcatccagcaggtggctgggaaacggtgcagggaagacgacgtggacggcaggtggctcgtggggtgtggagcgtatgtggctgggggatcgacggagctgtgcacccctgcacttcatccccatacccttgtatggacagcagcccatttaaggtcctgcccctgaagtctctcccgatcgaccagacatcaccaccataa

SEQ ID NO: 2327 - DNA, 1293 bp, Chlorella protothecoides
atgctagcctccctgcaactgagcgttgtcgtcattatccttcggcaggctccgaattcgcattccatcaggttggccttcttctggaggccgctcggaacttgtaagggagggggtgctgtggggggcaactggggcatgatatgcagctctcccacaaaaatctccaaggattatttttacatgaatcttcatgcttttgactcatgttcagccaacgccttcttgctcgccagggagacaatggcaccccaaaaccccggggaggtgaggccgcacaacacgaccattgaggaggtcttccggaccgtggatgcactccgcattccccgctatgacataacaccactggtgagaatggtggagctcctgcatgtaggtgcaactgcatatccctattttgttaagatggactcgctgcttcgagcatgccctgtcgtccccattatcttgagatcactcaccaacatttcagatggagcactggcgtatccttggaaagcctctgcagcttcatggaaagttcctgtgcggtctgcgggaaggatttactatccaaacgtctctcatgacagcagaattccaccacagcggaggcaacacagatcctatgttgctgctagcaagaatgcgtgccaacgggcgtccttacgttcgacaccaacttggcgaactgccggaaatggtccaggtcatgtaatcgttcgcaacagtcttgctgacagttggaacaacccaaaagagtcgacaaagcgccttgacgtggcactcgagatggccacgatggtgcatgaaatgcaccagcgcaatgttgcgcattttaatttgcggctcgagacggtgatgatgagaaaggatggggacgacagattactgtatttcacagggctggactatggtgagatgagggatgtgtctcagtgcgcagcaccatccaaagggagaattcttggttgcagtgcagagcacattgtggcgtggactccagcggcttcacccatgcgcagcaatgggctccgccttgaaatgggggatatgcagccccatatgaccaacatcaatggctattatgccagtccggaactgctcggggagatggaaaatctgactatcaaatctgacgtcttccagttgggcatcatgatctacgagattctcgtcgggaagaaaattgacaagtggttcagattccactctgcaattggttggtttgggagagcaggggcttgggggggatatccagctatggataaaattcacatctgttggatcgtgtcttcgacttccagctag

SEQ ID NO: 2328 - DNA, 1539 bp, Chlorella protothecoides
  modified_base (202)..(276): a, c, t, g, unknown or other
ccaacccccccccaaccccccaaaccaataccctggaccacgcagggcgacgggcgagtggtcgccgagctggacaccctgctggcgcaggaggagcatgtcgcggcgcggctggctggcaccctggctgcgctggaggcgctgggcccgagcgctgacgcggcggcgctgctgggcgtggcggggggcgtgctggcggggnnnnnnnnnnnnnnnnnnnnnnnnnnnnnnnnnnnnnnnnnnnnnnnnnnnnnnnnnnnnnnnnnnnnnnnnnnnccgacccggccgtcttccgcgcccacgcggcgcgctatgaggccgagttcctggccgacatggaggcgttgggggtgcgcccgcccaccgtgctcacgcgtgtcagcgagtacctgccggaggtggtggagttcgtgcgcggcatcgagcgcgccggcttcgcctactcaacgcacggctccgtttactttgacaccgcggccttcaggtggcgaggggtctgttgaggttggagggagagtgggtatgcgggtcgaagggcgctcccttcgatgcatcgctccttgcgccggcacttcaactcctcctcgcctgcttgcccagctcaaaccacgccgcacccaccccacttcccaccgtccttttccccctcctcctcctcctcctcaggagcgctgggcacacctacggcaagctggcgccgtggtctgtggggtcggtggccctggccggcgaggcgggcgcggacggcaagcgccacccttccgactttgctctgtggaaggcgcggaagcccggggagccggcctggccgtcgccctggggcgagggacggcccggctggcacatcgagtgcagcgccatggcctccaagatcctgggtcgaaccctggacattcacactgggggggaggacctgcgcttcccgcaccacgacaacgagctggcgcaggtgggagggcttgggtttgcatgcgtgcgtggtacggggatgtccctagagatcctttgggactccgcttgtatgtgtctgaggaatgcaggaggtccctgcccatgtacctctccccacccacccaacccaatggtttgcagtcagaggcccactaccacgcctgcggctgccggcagtgggtcaactacttcctgcactctgggcacctaggcatcgacggcctgaagatgagcaagtcgctgaagaacttcatcaccatcaggtattggaggttggaggtggggagctggggggaacaccgggtgatttggatggaggcaactggtcagccagcgcaaaatccaggctgcggaccaagtaccagaggcacacagctagccgcgtggggtcaggagatggttgacccccatgcaagttcgcgagaaggaaaaggttttccgtgccacaaagacttcatctgggggggtctgggctccacgctcgcggcacgccgtgacgcggcgccgccccgggagagtggggatgggccggtgccgctcggcacctcggtggcccccttgcccctggggcgccctctacatccttga

SEQ ID NO: 2329 - DNA, 426 bp, Chlorella protothecoides
atggccatggtgttaatcgcaccccaggttggccgatggcgcatcaagcacgcttcgccggcggtgcctggagacctatgcttacatgtttcggccttgtgccccgctgacgatcgggccccctttgcccctgacaaccaacccctgcaggcagaggaggaggtgctgcaggccgccctggaaagcacggcggagcttgtgcacgccgcactgtgtgacaacatcaacacccggggggcgatggacgcgttgggggacctcatcaaggccttcaacgtgtaccgctctgcccggggaccaggtgtgctttcgaagaagtggggggggaccgcgtctggtggggcgacggctgggaggcatgaatgccgggaatcgtgtgaaggggttggacgatggtggacggggcctagtcgatgtctaatctaa

SEQ ID NO: 2330 - DNA, 465 bp, Chlorella protothecoides
atgccttcctacccccctcgtctccgtgcagggtcagcaagcccgccccagcgcctactcatccgctcggtagcgtcctacgtgtcgcgcatcctcggcgagtttgggctggaatttggcgtgacttccagcgcggggcccgaggcggcggtcagggacgagacgccggccgtgctggacgcctttgccgccttccgcgacgagattcggcgcctggccaaggagggcgccggcgccggccaggtcctcgccgcatgtgacaggtggcaaggttctgggaggggtccgagaggtccagccttgtgtagagttgtattgtgttgggttgccccatgccactgccgtctgtcgcatggcgtcggtcttccgtcgctcattgcaccaagcacacatcgacgaactcgaccccctcccacctttcctcctttccacgcagcgtgcgggatggtcccctggtggacctag

SEQ ID NO: 2331 - DNA, 435 bp, Chlorella protothecoides
atggtgtgcaatccgaaggatgaccctcgcttgcaccgccgcatgcgcctggacggggccacgccccgaacctcaaacaccctgcacggctcattagggttgaggatcgtcgaatcacggccagcattcgcgcgagatagggtaggggcaacaccatcatggaggctctctccggcacccgtgcatcctttgcaggagccacgcatgccttcaccgcgcgcaagctccccggtacttgtcgccggatcagcctgcagggagatcagggaccgcatctcttccgtgaagaacacccagaagatcacggaggccatgaagctggtggcggcagctaaagtgcggcgagcgcaggacgctgtggtgcggggccggccctttgcggagaatctcgtcaaggtggggttatgggcggggatcgaggaggctggaggttga

SEQ ID NO: 2332 - DNA, 891 bp, Chlorella protothecoides
gcgctgcaggccccgctggagcgcgcggggctgcgggtcgtagggccgggtggcgggccgggcgcgcccgccggcgacggacaccccgccgaaggttccgaggccgatcgcgctccccagagcaacgtgtccagccccgcgctcgccgtccccgcgctccccgtctcctgcgtcgacggggccgggcttcacgaggtccacgccatgctgcgcgcgctgccctgcgcacccgtcccggacgccccgccctcgcccgctcgacgacagccgctgcgcttccgggtcgaagcgtggcacgccaggccgggcggcctggtcctgcacggcacggcggtcgccggccggctgcggcccggggcggcgctggcgttggggccctgcgccggggtcgcggcctgggcgcccgtgacggtggcctcgctgcagtgctgcgggcgagacgtggcgcacgccgccccaggcaccctggtctccgccacggtgcgtgctgccggggaccgggcacgtggggatgcaggctcgggcttgcgccacgcctttggcgcccagatcgcgccggagctggcggccctgcatgccgcctgggcggcgacagaggaggtggcgcctgggcctgatgccgtcgacatggatggggccggactccgtactctggacgagatgtcggtgcacaaggggacaggctggattcgaggctgtggagtgcccggcgacaggacgggtcgatgtcttgacccagcgggcggtcacccccaggtgcccgaccgacacccatgctccctccgccttttgaaaccagcggggagcctggctgctggactggagtctggagcccagagccagccgcactttccaggcggcactcgcctggggccagcaatttctgtgtga

SEQ ID NO: 2333 - DNA, 2652 bp, Chlorella protothecoides
  modified_base (898)..(907): a, c, t, g, unknown or other
  modified_base (1093)..(1102): a, c, t, g, unknown or other
  modified_base (2038)..(2047): a, c, t, g, unknown or other
  modified_base (2258)..(2267): a, c, t, g, unknown or other
  modified_base (2573)..(2582): a, c, t, g, unknown or other
atggaggaggacacgggcacctcccccctgtccttcaccgactttttggagaagatgaaggaccctgcagcggccaaccttgtcagaaccgtgaagaggtgggaagtggttctagcactctctgccaacaacaatgctggaatgacaagtcccagaactcgatcaatccgctaccatcctcgctgtggtgcagcttcatcaaggactttgaggagcggcacagtcaaggcaaggccacagcagaagacgattctgcacgtgtgcaggtatgacggttgtggaactgagggcacagaggcggcgcttctaggcactttgtgtgcaatctgcagtcacagtaccctgcgtcttgaaagcctgacggttgcggacggccaccgatatacacatcactcctcgcccccctgctaccgcatcgctcgctctgccaggcattcctcacgcaatcggaggagctcttcagggttcaccccgtctggagggggagtgcgccccaggtcttggatgaggcagtggagcccccagcttgcacggcactcgtccacctgtacgccaggtgggccgcagtacggcgatgccctggagctgtgcgtgctcagtttttttcctccccctcattcctggcagggtctggaaaagtacctgatgagcaaggtctggcgcctcacctttgccacctcgcccgaggacgttgagcgcgacgagcgctgcgctcggatcctggacgccctttctttcgtctccctggacaccctgatgggctcctccggggtcgaacccgacccggccctcctcaaggtcgccgtcggcgagttgctcaagatggacaagtacaaggtggggtggggggaggcagagagtctggtctggcagatgaagcggtttgcagtgcttttgnnnnnnnnnnctcaagatggacaagtacaaggtggggtggcgggaggcagagagtctggcctggcagatgaagtgcttgagtcgctcatcctgaaggctctgccaggtcccgggccaggaagtgcagcaggtggcatggcaagatactcagcaaaggggaccacgcaaacttcttgttcaacccccctcctaaacnnnnnnnnnncaagatactcagcaaaggggaccacgcaaatctcttgttcaaaaattcctcccaaaattcaggcgcctcgcgacaagctggtgtgtctggtcaacgtcaagaccacggcggagtccctggtgcaggtggcggcggcggcgggcgcgcgcatcggcggcgccgacgctttcttccccgccctgctgcttatcgtcatccaggcgcgtccccaaaggctggcctccaccatcgagtacatcaagcggtttcgagggagcagccggctgcggggccaatttgattacatgctggcaaacctggtgtggccgcgggttgccggggggcttgctgatgtgcatgtagttccatgcttggcctcgcagtcgcgatggtctattcaagggctccaattctttcgagatcccccagttcaccccacaccccttcaccccctccatgctgcatcgcaggagtcggtggcgctgtacctggacaccgtgaactacgagcacctccacatcagccgagaggagtttttggcccgcctctcggccgccggccttccagaagctgccctggagctggagaagcgggccagcctgccatgctcgcccagcgggacggcgggcccatccggcgtgtggccactggaaagtatggcgctgggatccgcaccatcacagggtgatggcagggggcccattcaagacccgacaaccagggaagctccgagcgaggcacggttgccggggtgggaacccagcctggaggcgggcacagagcacgagccagagggggggcaaacccaaaccctgccccgcctgagcagccaggatgagctggctgggttattggatgtggcaacctccccgctccaagcgcccaagactactggagacttcgaatcggactcccagtcctcggagatagggtgccaaagagatcctgcaagggtcnnnnnnnnnngcaaaatctggaaatcgaggcatcgccatctccccctatctatctggagagtcaggtgccaaggagatcctgcaagggtgaggcccccgcagcccctccctgctctctatctccacaccccaagcaccaccagaaaccatccctgttgcagactcctggcccgcgattcatggcaacaacgggagcgggtgtaccgtttgacaacactatnnnnnnnnnnaccatccctgttgcagactcctggcccgcggttcatggcaacaatgggagcgggtgcaccggttgacaacactaccgggggagccgcccttcatagccgagctggttgcagacggggtgggtgcggtgctgcgcgcggaagccgccgggcagctgcagcccaggtaccccttcatgtatgcctccgccgccgacctgagcctggtgcgcatagggggggcctggattcgcggcgtttctggcgagtttggattgcagcatgctgtgcggggcgcactacttgtcctatcccgagcatgcgtccatnnnnnnnnnncctccgccgccgacctgagcctggtgcgcacaggggaggcctgaattcgcggcgtttctggcgaggttga

SEQ ID NO: 2334 - DNA, 1758 bp, Chlorella protothecoides
  modified_base (380)..(389): a, c, t, g, unknown or other
atgccccgcctgatcaatgcccgaccaaagactccctctgaggtcatattctctgctttctgcagtgggcaccaccgtggcaatggctgccagcaaccaggagcgctccttcatcatggtgagtgggtgcccagtgaagggatgcctggtgggttgtgcctggaagtccaatgcctggtgactgagtgcttgggcagcattggccagaggtcaagcccgagggcgtgcagcgcgcgctcgtcggcgaggtcatcaagcgctttgagcagcgtggattcaagctggtcgggctcaaggtggggacaacgggtggtggacggggtggcatacgttggatttccatgcatctccatccatggggtccccatgtccatatgctnnnnnnnnnngcgctttgagcagcgtggattcaagctggttgggctcaaggtggggacagcaggtggtggacggggttgcgtgctggtgccctccaaggacattgccaacgtgcactacggcgagcacgagggcaagcccttcttccccaagctggtggggcacatcacctctggcgcggtagtggctatggtctgggagggcaaggacatcgtgaagacgggccgggccatgatcggagccaccaacccgctggcatctgccccggggaccatccgaggagacttcgccatcgatctggggaggaacattgtgcatggatccgactccgtggactccgcccagcgggagatcgccctctggttcagccccgatgagctggcggagtacgatcccaccaatgccaacacagtgtctcgcagtgcagcgagcaagaccaggcttatcgaggaatcgcgcgccatgttcgaatcgtgctcgtcctacctgatgaggtggcctgaaatcacgggggggtacagcggtcaggatcgcgatgattgcaatcgcctgcatcttttaaaaattacacatgctcctgcacctgcgcgatcgaatggaagcacgtgccaggaggcggtgaagagtccaaaatcccccagtttcactatggccttctcattcggcaacaccgcggcttccacccctgcattcggcacgcccagcacgccctttgggtttggggccggtactcctgccacagccgcagccagcaccccggcgttctccttcggcaatgctccggcctttggggccagcagcccttccccattcggagccagcagcgccccggcgttcggggccagcagtgcatccctgtttggggccagcagcacccccgccttcgggttcgggtcggccccggcctttggggccagcagcacgcccggtttctccttcaacgccgcaccaactcaagcccagacagcctctgctttcgggggcgggctgttcggtggcgccagcaccgccgtcacgccctttgggggggggccaaatgcgcagcaggcgcagcaggcggcgacctcgctgctcaccaccgacggccggccgctggggcacaacaccaagtgggacgacatcagccctgcggcccagaaccagctgctggagctagagtgcgtgtgtgggtgtgggtgggattcgttgcgtaccccccctcgccacgctcccccccaccccctccaggaagttcatcgtgcgcctgcgggaggactgtgcggtgctggacgccgacgagcgcctgagcaacccggccgccgccaagcagcgcctgcccgaggccagcgcggctctggagcaggtgcggggcggtcccgccgcgcccctctgacagggtga

SEQ ID NO: 2335 - DNA, 1362 bp, Chlorella protothecoides
  modified_base (419)..(428): a, c, t, g, unknown or other
  modified_base (645)..(654): a, c, t, g, unknown or other
atgcctgcacacccgctgcaaccccgtgcctccggtccgcccgcagtggccaaggacaagagcgagaagaaggaaaagaaggtgaagacacccaaggccgagaagacggtggtggttgcagacactgccgccctggaggctgcagatgagttcaagcgtgcaaatgtgtgtgccattgccaagccgctggccaacgagaagctcgccaagaagtccctctcccacacaattcaatcaggtcttgaagctggcgaagaaggcggccaagcggaagcagatcaagaggggggtgaaggaggtgatcaaggccatccgcaaggccaacaagggcgtggtcatcatcgcgggcgacatctcccccatcgacgtcatcaccccgctgcccgtgctgtgcgaggatgccgacatcccctacatcnnnnnnnnnncatcatcgcgggcgacatctcccccatcgatgtcatcaccccgctgcccgtgctgtgtgaggacgccgacatcccctacatatatgtgccctccaaggaggagctgggagcagcagggtgtgttgggttgtggagatggagcgctcgcagtcagggttgcatgtgtagggagggatgggtggcgtcaccgacggctcgcctcaaaacccccgccccnnnnnnnnnnggagcagcagggtgtgttgggttgtggagagggagcgctcgcagtcagcgttgcatgtgtaaggaggaatgggtggcgtcaccgacggctcccctcaaaacccccgcccttgctcctgtttgcagattgaccaagcggccgacatcctgcatgctagtgctgcccaagccgatcaagggggcacctgctgtgaccgaggaggatggctttgacgccgcatttgatgaggcaaggccacagggttccgtgttggtgtcttgcagcctcaaaaaggaattcatgacacagctgtgtgcggttgaaggggtagtaacacaagatgctggtgtagcatggcctcctctcagtctgttccaccgtgcactctctccactccagacatatcgccggcccgtcttggccatttcccctagttcaccacccacctcctgtggtggatggaacggcagcttatccgctttgcgccgtccgcaccagtacccgcatgctgaacccgcattggcatgccatgacatgtacgtcggtccgcaaagcggcattgtaaggttcagagaccccagacattgctcgacgtcctttccgacgtggcttacggtggcccggtacggccaagctcaccctctccgtcccattcacccctacaccgaaatcgcgttccgccacagcgtgacgcagatccgaggcattcatgcgcgtgctccagtgtag

SEQ ID NO: 2336 - DNA, 651 bp, Chlorella protothecoides
  modified_base (216)..(225): a, c, t, g, unknown or other
  modified_base (284)..(293): a, c, t, g, unknown or other
  modified_base (388)..(397): a, c, t, g, unknown or other
atgcccctgcgtcccgtggaccggcgctggcctgcctgggccaaccctgcgagcctgctgggtgtgatctgccccaagggtcgtcgcccactcagcgccacgctgatgttccaggggggagcttggatcaggccatgctctgcgcctgcctttgccgtcaacgaccctcgggacatgcccacactatcccgccctcccttctcactctcccctcannnnnnnnnnccaacgaccctcggaacaagcccacatcatcccgccctcccttctcactctcccctcannnnnnnnnnttctgcaaaaagggtgtcggcctgggccgatcaagcacgccattgttcatccatgcgcctgggcgcattgaccagattgggaagtcgaggcaccnnnnnnnnnnggcggggcatcgagtcctgcggtatcctggcggggacgctgtcggtggatgacgcggtgttcaccatcaccaccctgatcgtgcccaagcaggaggggaccagcgacaccgtccaggtacttgtgttcctggttatctggggaaagggtgtcggcctgggccgaccaagcacgcccttgttcatccatgcgcctgggtgcattgaccagattgggaagtcgaggcacctcgactacgataggcacgcttcatga

SEQ ID NO: 2337 - DNA, 2616 bp, Chlorella protothecoides
  modified_base (168)..(177): a, c, t, g, unknown or other
  modified_base (395)..(404): a, c, t, g, unknown or other
  modified_base (744)..(753): a, c, t, g, unknown or other
  modified_base (1063)..(1072): a, c, t, g, unknown or other
  modified_base (1466)..(1475): a, c, t, g, unknown or other
  modified_base (1969)..(1978): a, c, t, g, unknown or other
atgtgtttgttgagaatctcgagtaaaagcgaggaggagaaccggggcggagcgacgggtggtgtgattgcaggtaaacctgaagctgcggccctcgcccggcaggaactcatccacccgctccaagggaattatgacttgaggtctaagtggctaaacgtggtgcgnnnnnnnnnnggtaaacctgaagctgcagccctcgcccgcccccgcggctaccaactcggccctggcgaacatgccaaatttggggtcggttgtctcgggcacgttccgcataaattgcgagctaaaagggtgatgagggggatcaggcacgcttggtcatgcaccccagcgtcgtcctcgccgcggaggggagcatgcgcggcagccgcgatatttgggaagtgccnnnnnnnnnnggcacgcttggtcatgcaccccagcgtcgtactcgccacggaggggagcatgcgcggcacccgcgatagtggggaagtactcacaatggatccggcatcgagaacactccattatatcgcacatcgcgcgtgcgggtggcgggggctttgggaagcaacaggtgtgcatgggaagggcagtaatgacgtggttcatgccctgacctcttcaaatcattgctggctccatgcagccgaagcttgcgcccccccctccacctgtaaaggcgggacccgccaatgccagtcggcccaagaagcaagagaagcaggaacctgccccaggcaagacggaaaccgnnnnnnnnnnacctgtaaaggcgggacccgccaatgccagccggcccaagaagcagaagaagcaggaacctgccccgggcaagacggaaacccggccaagtgccccagccgagggagacagagtttgagcggcgcctggagtctctgcggaaccagacgtcagccgcagctgcatccaagcaggtcaggagcttcagtgtgctcgttcttcaacttgatcacgaaagcgcaatctgtactggaaaccctcaactgcgtcatgattcatgaccctagcctctcagcactcttgccaatatctcgaatgcctcccctgcacnnnnnnnnnntctgcggaaccagacgtcagccgcagctgcgtccaagcaggtcaggagctccagtgtgctcgttcttcaacttgatcacggaagcccaatctgtactgaaaaccctcaactgcgtcgttattcacgaccctagactctcagcactcttgtcaatatctcgaatgcctcccctgcatcccaaccaccctcaggagccggagaggtctgggtctgtccccaactacgactcgcccccccccttgctcaacacgctgctgaataaggcgccggaggcggagggggagtataaatcccttggcggcggacctcccaagcctgggttccctgccagcactcacaccaacagaaccgcccccaacattgtccctttcctccccttccctcaaaatcaggnnnnnnnnnngcctgggttccctgccagcactcacaccaatagaaccgctcccaacattgtccctttcctcctcttccctcaaaatcagatcctgctggcggtggcctcggtggccatcggcgccatcttcatcctcaccagcgtcgattttgggggcggctcgccctccggcccttcgacctcctcttcagccagccgccccgagcagaccctcaccggcccagagcgctccgcacttgaggccgcccttgagcagcagcaggtcacgttgtcctccaacccccaggatgtgaaggcactggaggcggcggccaccatcgcggggcgcctgggcgatttccgggcggctgccgccagcgcgacgacgctgacagagcaaaacccgggcgacccggccgcctggcagcttctcggcgagtgccaggaggagctgggggacgggcaggccgcggaggcgtcctacgtccggggctgggaggcgggggggaggacggacctcctannnnnnnnnngaggagctgggggacgggcaggccgcggagacgtcctacgtccggggctgggaggcaggggggaggaaggacctcctggtgctggggcgcctgaccaccctgctctccaagcagggccggcacgagcaggacttggagagagctgggaggctggccgcggtgggccagcaagcgcagcatgtggcggtgtggagagggggcactcgaatggcagcctgtggagtgacacaggtttctgctgcggggttgatggtccacccgatcactccctttcccttcttatctcgcgaattcacctcccctcagtgcagcagcaaaccatctgcccccctccctcgccatgcatgcaggccctggagcgcatcgattcggccccgccctccgtgctttcctccctggacgcccagctggcgcgcgggcgcgtgctggcgagctggcctgggcacagcctggacgccaagcacctgtatgacgggctcattgaggcccaccccgacgacgcgcggcccatgctggccaagggcctgctgctgcgccagcagggccggggtgtggacgccgatcgcgcgttcctccaggcgcgggccctggtgcccccggagcagcgggccggcctggacgccgtcatcgggcgctga

SEQ ID NO: 2338 - DNA, 837 bp, Chlorella protothecoides
atgccggagctggagcgattgaagctgagcctggacctgaaggaccgcacctcccgcctgtttgaggaggagccctgggcccccaccaagcagccaggcacaatccggctggcggcggggaacgtgccagaggtgcactggcggccccacggcggcgaggccgtcggctccggtggcgccggcccagtggatgccctggatcagcgtgcccacggcgccgccccccccctcgaccctttcctcctgcccggagcggccggcgacgcgggactcacgtcggcggggctcacctccgcagggtctggagccgccgcggcccccttgcccgccatcgccgatctgcgactcgacctcccgcgctcgctgcggctgcccgccgcctctgccgcagcgcgcagccggcacgccatcctgccctcctggcagcagccggcggaggcggcgacgcgggatgcgggccctggatcgacgcagaccgggcagcgggctggcctgtacccggccctccccgccgacctggcgcagctggaccagagcaccggaccgggatcgggtccagaccaacgccccccaaaccccctggccgacgcccgcccccccgaccccctggccgacgccgtcctgggactggggccgcaagaagtgggcgtggagtttgtggcggggcctaccgcccctccgcggccaggggagtcttgctgcaccgagccgccgccggcgacgcagaccgtgccggccgtcgggccggccaccacgggcgtggccgaggtggccaagcgccagagcgtgcgtgacgtgcacgtctccgtggccctcatggacgagtttctgaggtga

SEQ ID NO: 2339 - DNA, 405 bp, Chlorella protothecoides
atgacccctcggttctcaaacccacatcgctgctccttccacacacagtctagcagcaagcccacggtgacgatctcgggcacggacgatcatgcgctatacaccctgatcgtgactgacccggacgcacccgatccggccaacccaaccaggggcgagtatgtccactggatcatcaccaacatctccaagggcgacatcagcaccggcaaggagatcctgtcataccagggccccgcaccaccaatcggggtgcaccgctacatcttcctgctgtacaagcaagccagtgagatcagctacgaggcacccgaggctcgtttccactacaaggtcaggcaggaggccgagaagtatgagctgagcgaccccgaggcgatcatctactttgtgagctccaagtga

SEQ ID NO: 2340 - DNA, 456 bp, Chlorella protothecoides
atgccagccccacggggccccagggccccagactcctccctggtgtctcgactcaatgccacgatccagatgcgccccgccaacaatctcatgcgcgtggacaagtactacaggtccgctgacttgctggaccgtcaggtgcgtggggacagaaggtgggtgaaggccgctcgcacccggctgcagaaggggcttggggctgaggcagtcctgctcaaacctcctatgcctctggtgcaggcccgccagtacaggcggcaggccaacgaggaacagctgtatgtgatgctcatgcggctggtgagcctggtggtggagaccatccctcagcacagcggcttccaccgcgaagaccccatctaccaggccctgcgcaaggtagggcgagggctgggttgccgcgggtgcaggggggatgagagggacatcaagacattctccaatgacctcaggtga

SEQ ID NO: 2341 - DNA, 852 bp, Chlorella protothecoides
  modified_base (800)..(809): a, c, t, g, unknown or other
atggacgagtgggttccgctggcaaacctacaacttgacaccgtcatccctcctgagccaccagagctcggtgacaagtacgctgggatggggcaaggcctacccactttgacagcccttcttgtcactcacgcctacagaacccggcagcaaaagcggaaggtggacgacgagcacagcgaggaggagggggagggacacgaggactttgaccccgcgcagctgcgggagcacgaggagtttaccaaggtcaagaacatcgccgacattgagctgggaaagtacgagatggagacctggtacttcagcccctttcccccagagtacagagagtgcaaggggggggcgccctttctaagtggtgagggaatgcagatgccattcctgctctttgccctccatcaagttttcatgcaccatctagggagcccctgggtcctggtcagcccccgccatcatccaaccaccctctcttctttggtatgcacgcagaagatgtatttctcagagcacgacctgtgcttcttcaagcaccgcgagcacatgctggcgcacgtcaagaagtgcaccatgctgcacccacccggcacggagatctaccgcaacggcaagatctccatgtttgaggtggggttgagcgggaaggtgcttgactgcgcactcgtgtatgagcatggggagccgctgccgaggcccctgtgctcatccactttcctgaagtcagtgcatgtgctttgcagattctgctgtcctaatcctggccccaacaccgcatgcccctctgccaggtggacgggcgnnnnnnnnnnggtgctcatccactgtcctgaagtcggtgcatgtgcttcgtaa

SEQ ID NO: 2342 - DNA, 369 bp, Chlorella protothecoides
atgcccctctgccaggtggacgggcgcaaggccaagggctactgccagaacctgtgttacctggccaagctattcctggaccacaagacgctgtactgggacgtcgacctcttcctcttttacattatgtgcgagtgtgacgagcggggtgcccacatcaccgggccatcgtggttgtcccccgccccaaagcttctcacactcgaccctgcaccgattcctcaatcccgtgcggcgacagatactttagcaaggagaagagcagcgaggagggcttcaacctggcctgcatccttacgctgcctccctaccaacgaagggtgcggcgtgggtgggagggttggctgggatcgtgtgccgggttggtag

SEQ ID NO: 2343 - DNA, 273 bp, Chlorella protothecoides
atgaacacccggttcgacgtgatcgggggcgcgctgtactacctgctggtcgtctcggtgctgccgcgctgccgtcacctggcggcggtgctggaggcgccggattggggcaccggcctgagcctgctcctgggcgccgcggccgacaccgtcggcgacatcttcctggagtcctacgtgtcgttgctggccctgctgtgcatggccgcgctggccctgggctttgccgccacaggcggcatcggcgcaaaagggggtgagcctgcaagatga

SEQ ID NO: 2344 - DNA, 1326 bp, Chlorella protothecoides
  modified_base (125)..(134): a, c, t, g, unknown or other
  modified_base (979)..(988): a, c, t, g, unknown or other
cagggaggaggtggtggcgcggcggcgccgtgcgcgcgcctggcgcctgctggcctcgcaggccgccagccccgtgctcatcccggggctgccagggtcgcgcggagccatgggcctgttggacnnnnnnnnnncgcgcgcgcctggcgcctgctggcctcccaggccgccagccctgtgctcatcccggggctgccggggtcgcgcggagccatgggcctgttggacgccgtgggtgcgctgctgcgcctggcgctgcgcaaggcggacgacgcgccgcgccgccgcgtcgccctcggtgtcgtcgcagcgcttgcgggtgaggggttttggtcgcttttgggggagggaggaggggaggagtgggtgaggctgggtttccttgttttggggggggctgggagcaaggggccacggccggcgctggcccggtccagttctgcagctgtgctggtagacagcaatctggcagcagcggccgagtctcaagctgaaaagacagccgaattgatgacccggatcgataacgtaccagtgccgtcagcaagctttctcctctcacatccccccatcttttcttccctcaccgcagaggcatgcctggccgccgacgccgggtccgcgcccgccgccccgagtggcgtgggtagctacggccagccagcgccctccccgcggggtagcagcgcgggcgccgcgccggccacggcggcggcgatcacccgcgtcatgtccgcactgggcggagaggcgctggcgctgctggagggcccgctgagcgggccggagcgcgccgccgcgctgcaggccgccctcctcctccaggtgtgtctgagtgtgtttgcgctttctttctatgtctgctgcgaccgggaggggctttgtgtggcaccactgtcatgccatccatgctcggagcacaatgctcgacacatccacaccctccacgcaagggaatgccccttcccccacaccctcnnnnnnnnnngggcaccactgtcatgccattcatgctcggagcacaatgctggacacatccacaccctccatgcaagggaatgccccttcccccacaccctccccaccatcactcacccaggcggcggggctgtcgtcgggcctgacgccgtccaagatcctgcaggccggggccgcccgcggctggaccccggcgctgcagggcctgctgaacgcaacggtgctggagtgcgcgcgcgcgcggcccgccgaggcggccgccttcctggcccgggcccacgcggtggtgggcatgtgccccgccgcctgcgagcccgcggccctggtcgcgctgtgggacgcggcggc

SEQ ID NO: 2345 - DNA, 1731 bp, Chlorella protothecoides
atgcccgctcacccaccccaacgcgtgcaggaagacaacaccggggcggggctgctgctggagcaggctgcgcactccctgctgcgcctgcagccgccgcgagcgcgcaagttcgccttccacctggtgctggcggggctgcggtacggcgcctgcgaccaggatggcctggcccagcgatgctacaggtggccaggggtattgatggggtgggagggcggggcactcggagggtggcccggcgaggctcccaaacgagagcctgtgctgtgccgagccgcgatgcgcgggcgtgctgggttgagatgccccgctgcaggaccacgaggaggggcaccggacatggcggtgtgtgtcccgggtcaggcaaggtgcaggtggtgcaggatgatgggagccgcgtggattagtggcatcacatcatcccattcctccaacttccgccccgccgtcgtagacaagtgctggaggtgtaccgaggcaagggctggggcctggtggaggagcacctgcacgatgtgctgggccggtacgccaggtaggcttgcttccggctggtttgttcatccccgggagaggggtcggggccatggggcaatcttttcacagggttttggtcgctgggcgggagctgggcgacctggcctccgcggcgcgctgccacgccgccttgctcggcgcgcagcgcagcgggcccggcacgcagcgctcccacctcgaccagctgtacgacgccgtcaggctggctgccgccaaggaggtggggcttggcgaagggggaaagggtgctctggcggtggaggctggggggagtgggacggcggacaggccacggactgctctcgcagacgggacgtgggtgggacgaagtcgaagggcgccgccgctccggggtccccaccagggccatccggccgggagggccacgacagtggcggtacacctagagcggcggggcaactgtatctcattgcactcccacccgacccacccctgccgcaggtggcgctgcccccgctggagctgccgctgcctgagatggacctggagcggcccggcctcgttttccagggtcaaacctggtacggcaacgccgctgcgcggcaggcccccgccgagctgtggaggccacttgagcgcgctgtcgtcggggacgtgcgggaggcggggccctcttggctggacgggggggaaggcaccatgattcacgtgccctgctgcccgtcatcgactggcatagggtgcggccccgagcatctcctcagactgcacacccatccagacagaatcccgaacaacctgcccgtcggccatacctactcccttttggacccgccccgcccccacccctcccaaacacccacatgcaacaggggcggcgccgcagcgcgcgcagcgccgcgtgcctgtctgctgcgtgggcgagccggtgagcatcgacctgaggatcagcaacccgctgtccgtcgacctggaggtcagccgcctgcggctggtgtgccggctggaggccggggcgggtgccgcgtcatcggcccccggcgccacgtcaggctcgcgcccaaccgacgtcgccgatggggtcgaggtgtgggaggagcgtctgcgcctccgcgccggcgaggccaccgtggtctgcctgcgcgcggcgccgcggcgccgcggcacgttgcacctggacgccgtggcctggacgctggacggcgcggcggacgggctgcgcccgctggc

SEQ ID NO: 2346 - DNA, 477 bp, Chlorella protothecoides
atgcgcagcctggcggacctggcgctgatgctgggggacgtggacggcgcggcctccacgctgcgcctgctggccgccgacctgaaggcggaccgcgccttccgccactacgcgggcgcgcaggaggcgctgggcgtctgcgccgcgctctccggcgcgccctccgccgaggtcaacgcctgcctgcgcgaagccttctaccgccactcccagggcggcggcggggcagccggagccaggagcagcagcgcggcgccgggcgcacccgggcccgccccggagcgacagggtgtgcggtacgctacgcgcgctgcgctgatgctgaccgagtactgccgcggcgcggggctgcacggcgacgccgtctggatcctgatgaaggcacactacagggcgagtggcgacggcgggggtggacgtgtgtggaggggtggagtgagcctgccggaagctgggaggtggggccaggagtgctga

SEQ ID NO: 2347 - DNA, 1719 bp, Chlorella protothecoides
  modified_base (402)..(411): a, c, t, g, unknown or other
atggccgccattcctgcccacaaacccatatgtgcaggcaagtacaactccgcccactcggcggccacatacgtttactcctcctcgcgctacctggacaagctcatgtatgccgccgcctggctgttcagggccacgggggaggccgcgtacgctgccgacgcctacgccttctggcagtctgccggttcgggtgacatctacaccagctgggactccacctttgcccccgccatcaacctgctgctcaagctcgccagcgagggcaagaccgtgccggggagggcatcgtacgaggcctggatgacgtcatcgttcctctcagcctggcagaccgcagacggtgcgtgggggcatggtgcggtccacgatattcgggcaccagcagtcaaccatgtgcgnnnnnnnnnncgaggcctggatgacgtcatcgttcctctcggcctggcagaccgcagacggcaactggagcatcgtgaagacgcccgagggcctggtgtacccctcctggagccagtgggggaacctgcgctacgccaacaatgcagggttcatgatggccctgcgcgcctcctactcctccatcgaccgcgggaagaacctggcctgggtgcaggggcaggtggactatgccctgcggacgaccggccgcagcttcgtcggtcacatttcagggaaatcaaagcagatgaggaatgcgtggtcattgtgcatttggtgagaggtctcggtgggatcatgtccctgcgcaaacatcatcccggcagggggtcacaagcggatgcgggctgcccgggccagcttccgtaccggatccaacttatccttgcatgggggaaagtccgcagctgccaccacgcgacgatcttatcattcaaggatgcgacttccgggcttcgatcaaccgacaaacaggagtgcatcgaatactttaccccagtaaaggtatcgctggcctttacgggcctcgtcatcgatacgaattgctccatccctagaaacactgcatttgcggccggcagcacctcagtgctgacccgttgcgggtcccgattctcagaggtcgggatacggcatagtgttgagaatgagtccatcacggctcgttattgtatcgtacctgctccttttgggagttgtggccgtcaaggcggagaaggcgagcgaatggtgatagccgttacgtctattggttgtcggacagttgctggttccacctccagagtctcccctaataatttcaccatgaataatcccctacagatcgaagatgcatgggacaatcacgcagagatccagagcctcagacaacttcagtcttccgagaccgtggagggcatgcagaacgcagaggcactgcaacggagtctgaataccgtcaacgctctccagggaccccacaggagcctgctggccacgaagccaccgccacccccgccgaggaagaggccgccgccaaagaaaaagccgccccctcccccaccaaggaagaagccgcctcccaagaaaaagccgccccctcccccaccaaggaagaagccgcctcccaagaagaagcccccccctcctcccaagaagggcaagcctcccccaaagacgacgccccctccctcaccaccaagtacgtgctgtgtaggctgtatatgtgtcgcttccttctgtgcatacagggttgcagaatgcagtgcttggatgtggattcccaagtgtccagcaagt

SEQ ID NO: 2348 - DNA, 1041 bp, Chlorella protothecoides
cctccgcccccccctcccccacctccacatccgccacctcctccaccacctaaaggaaagagcccaccaccccagatgaagagccctcctcctccgcctggacggaaggtgcctcctcctccccccagcaaatccccgccacccaggaagtccccaccaccaccgcaaaggagtcctccgcctcctcccccatcactggccctgtacaagaaggtggggccccttgccctcgtgcatgctgccggtcatgctctggacctcgcgcaatccactctgggatggccgtgcactatcactgatcttgtttccccctttccaccgctgcccaggccctggctgcatcctggctcttctacgaggctcaggtcagtggcaagaagccctcctggaacaggattgcttaccgagggaattcccacctggacgaccctgtgcccggcggctggtgagtatgacgccggggacttcctgaagctcaacttcccgctgggcgtgagcgtctccttcctggcctggagcgtgctggagttcccgggagcctatgcgcaggcggacgccaccacccccgccctgaacaacgtccggctggcggccacctacctcgcagactgccacacggccgactacaagtacgtaggccagattggggatccgggccccgaccacgcctactggggccgtccggagcagcagccgggaagccggccggcatacatctggacggcggccaccccggcctccgacctgctcggcgcggtgtcggccgccctctcctccaccggcctgctgttcaagaccagggaccccgcctttgccgccaagcagctgagccatgccaagcagctgtatgcttgggggaagaagtacccaggtgacgtctggtccagatattttcccgtttggtgtgggtgcgtttgtcagcagggagcagggtccaggctgtggttggatggacgacggatgggaaccggagaaggcgcgagattgcgctcacagcagaagggtgctgggatgggagagggagcggaggaaggtgcctga

SEQ ID NO: 2349 - DNA, 441 bp, Chlorella protothecoides
  modified_base (298)..(307): a, c, t, g, unknown or other
atgctcaagtcttgtgccctccactctctgatctgtcccttcccaacccctgtctcctaccccctccactcctttcactccaggatctgtgaggagcacatcaaggcgcccagcttcctgaaggacggcgagctgctgaggttctgccagcgctgcggcgtgagccaccccctggcggagtttgacgggcagcgcaagtcgtgccgcaagcagctggagaagcacaacgcccggaggtgggccatgtggtacctgcctaggtctgcgacagccccatgctggtcctcacaagcagcannnnnnnnnngcccggaggtgggccatgtggtacctgcctgggtctgcgacagcccccttctggtcctcacaagcagcgatgtgactgcccgtgaagcatccagtcacacctcagcaaccccccgccacgccatgcaggcgtaa

SEQ ID NO: 2350 - DNA, 1548 bp, Chlorella protothecoides
gacgatgggcagctgctctgggggtggcctgtccggcgagccgtgctccagccagagctcaaaggcggtgagctgctcggagaagaagggggagggcacgtactccaccgcgctgcccggcgccagcatggcgggcagctggagcaggcaggcctcggcggccatgtcccaggcctgccacatggcatgctggtgcgtgggcggcaggcgcgggtgggagacgggggtgcagccgtgcgcgcgcatcacgcggtctgccagcaggaagttgcggaacagcgaggccaccagcaggtcctggcggaagaggcgctggaagagcgcacgcggcagcacgttccacgcgatggtgtcggtgatggcggtgaacacccagttcagctcgcccagcggcgtcttgcggtccgtctgcttgccgggcactcggtccgccagccccgcgcgcagctcctcctcgggcagcgcgtcgcgccagcgcggcgcgctgcgcgcccagaaccagcgcagcgccaccttgatgggggtggtcaggcaggcggtgaagaggtcggcggggaggtccgcggtctggggcagcacgtcggcctcgccgcaggcgcacagcaggatgcaggagcgcatggggtcggcgggcgggaggaggagatgggatgccctgtgcggagtggggctggggtcggggcgcattcaggccaggcggggggtggacgcgtcaccgcacacacacgcgcagttgacacccgcccagcgtgcatgcgtggcctcaaacccagacacacccgaccacccagacacatacgcacacaaaggaagccagagcccacaccccaccccgcactgacccgggagggagctggcggtggagggcgcggaggagggcgcgtaggcgctgccgttgcccgccgccccaggcgcgtagccctccgcctcctgcgcgcgctgcgccatgaactgcttgaagctgtgcaggatctggcccgcggtgctgcagtcaaagacgtagatggcgggcgtgcccagccaggtctgcaggtcatacagcgacagcgggatgtactgggtgtaggagcggttgaacacccagatctcgccgttggcggtagggcgcggcacgccgtgcccattgtagtggaacagcacgcgctcgcccctggccgcgcgccggctggaggtggccagcttcttcacgtcctccgtggtggggtccaggtgcatcttgtacttggcgcgcggctgccagcgctcgtactgcacctgcaggctcttgccgatggcgtccagggccttggccgccggcatgctcagcgggtcgatccagcactcggtgcgcgcgcagggcgacacgcggaccacgtcgggcgggtccacgccgatgttgaggcacaccaccagggccaccgccgtcgtcttcagccgctccttctggcgccagcgcgagaccaggccctcgcgcgccccggggccggggccggcgggggcgccggccagctcgtcgtgccgcgcctcgcacagcaggcgcgggcgcgcgtgctcgctctcctcccgtag

SEQ ID NO: 2351 - DNA, 264 bp, Chlorella protothecoides
atggatccatatgctgccctgggcgtgaagcctggagcgagcaaggatgacatcaaggcagccttccgccgcgcagccatgaagtgtcatcccgacatgtttgcgcagtcgggagcccaggcgcaggaacgagcggccgcaaatttcaaggcactgacggaagcatacaatgccctgatgcaaggtgcacagggggcgggtgcacgggagggtctgcatgatgcatgcgctcctaacacggctgtgccgcacggcagggactga

SEQ ID NO: 2352 - DNA, 1212 bp, Chlorella protothecoides
  modified_base (1127)..(1179): a, c, t, g, unknown or other
atgtggggttggaattcgcgtcccctcgcacgcacccttgtgccctctgtggaggctgccgtgttctcgctcgctgcctgtgccctcgactgctgggccccagggcgggagtggctcctgaactcctgggcacgggctcctcccccgtcgaggtcgactcaacggcaggtcgagggccctggcggggtggcatgcgagcgtgcaatcaattccccttttccaggcatgtggaaagtgctggatcaggggaaggagaggctcttcaccagtgattcttgcataggccgggcagtgagtgagggtggtgctcgggcggtgtgggcccggccgcagaatatagttctctgttctcgaatacaacacacaaaaacttacctagtccccagcttcaagagccctgtcgacagtctcctttacgacaccgctcacccacctccccgcacctcatcggcagctgagcacgatggcgcagcagcactttgtcaacaagatcgaggaactcgtgcaggagtccctggaagggttgatcgactccaacccaaacctcatccgcctggatggctatccccacgtatggtgaccaaggtagtgtacgatcgcaaccacgatgccagcaaggtggctgtcatctccggtaaggctgctgaggggggtggtggctctggacacgagcccgcgatggcggggtacgtcggggccgggatgctagccgcagccgtggctggggacgtgtttgcttccccctccgaggacgcagtcctggccgccatccgggccgtgggcgggcccgcgggagtggtcctgatcgtcatgaactacaccggggacaggtgcatggcacagcttgcgtgcgtgtactgctggggggatgagggggttgatggcgcggggccctcagtgcagatgtactcgccctcgtgtgcctctggggagagtgcgacaagacactcgggcgcacctcccggtgcctcgtctgtcgccacccggctgaattttggtgccgccgctgagcgcgccaaggtcgagggcatccccgtggacatggtgatcgtggcagacgacgttgcgcccatcgagggcggcaccgtcaagaaccggcgtggcatcgccgggacagtgctggtgcnnnnnnnnnnnnnnnnnnnnnnnnnnnnnnnnnnnnnnnnnnnnnnnnnnnnnggcggggggggggggggagcgctttctctctga

SEQ ID NO: 2353 - DNA, 807 bp, Chlorella protothecoides
atgagcttcctttcccgctcacctgccccgccggcccgcaccgttgcagggcaagggtccggacgccgccgtgcagccgggctcgaacgaggcgggggatggcgtgcggcgcacccgcacctacgacctcgtcatcacttacgacaagtattaccaggcggggacagacgatggctggcaagcccgaccggcagctcagaggcagggggggcctggagcaagcctgctgccacgctgcggtttggctgcctgctgcgtgtggcagcgacctgctgtactgtcgtcatcaaacgatcctgctgtagtgcaccccactatatcccaaccctcctgaccccttgctcccccgcccaggtgctggaggacatctcggcggagcacgcgcgcaagacggtcacggtggagccgcaccctcatggcgtggccggggtgcaggcggcctccatccacccctgccgccacgccaatgtcatgcggaagctggcgggcgtcgtgacggagggccgggcagacttccgagtagaacagtgcgtcggactggaggaggtggtgtgtggaagctgggtccagggatcttggaaagcatccaaggggggcgtgagatgtgctggcatgcttcgtcggtgtcggcactggtgtgcagcaacaactgctgctcattgggatccacctgcacgcactctgcctgccctgggcattgaacaccagatttcccacccacaatcccccccctccccgcatgcatcgcagctacctcatcctgttcctcaagttcatcgcgagcgtggtgcccaccatagagtatga

SEQ ID NO: 2354 - DNA, 1404 bp, Chlorella protothecoides
  modified_base (212)..(221): a, c, t, g, unknown or other
  modified_base (423)..(432): a, c, t, g, unknown or other
atgctggaggcaaccgtggccctggccatgacgctgcggcggtacagcttctccctggccgctgacccaggccttgcatcgggcgccaccattcacaccgcgcatgggctgaggtgcagcgtgcagcggcgggagggaccagccggggcaggacagggcctcagggacgagaaggagacgaacagagggaatctgaggtccgccagaatatnnnnnnnnnngggacgagaaggagacggtggcccttttatgaaaggtttcctgtggtcttgtgatcattgtacactgtggagctggttgccaggcatgcctgtatcagtttgttgtggcctagaacaaacggaatctgaggtccgccagaatatacagcgccccgagtcagctcagcggaaagccttgaaagtccgcagcaggaacacgttnnnnnnnnnnacagcgccccgagtcagctcagcggaaagctttgaaagtccgcatcgggcccgaggtctccgccagaatgtcgggtcttcggcaactgatccactccacgtacaagaccgcggcggagaaggtcctcccaacactgtcacagtcggctttcaaggagaaaggggtgctgaccccgcaagaatttgtgaccgcgggagactacctggtgcactcgtgcccgacatggtcctggtgaggtggggtacacagatggatgctctgagggaagcgggtgatgcacggaaggcaagacccttccttccagacgacaaacagtacctcataacccggaatgtaccctgcctgaggagggccgcagacgtggaggagtatggcgagcgggatgagtttgaggtggaggaaagcgcgagcggcggggatggctgggtgactgccagctcgaggcccagcgcccccctctcttccacgaacgaggaggggtttgaggagatccccagcatcagcggtgaggcggcaatgccgcatgtagtggggtggcgggcggaggggcgggatgtcagatgcccacctgatgccacgtttgtgagctgggccagtgatttcaagcattcgtgcaaggctgggagccctcgaggcaggcctgtggatcttctcgccctggagctgggctgtcaagcccacactagaagcccgtgctgcctggccaagcacctcctccgtgccctctcccttgcccctgcagacccactcaaggacctcacccttggggacggggcgggggccagccgcgccgccgcacgccttgaggaggaggacgacgatgccatccccgacctcgccgacctagatgacagcgaggatgtcggcacggtggaggcggtacgtcacgctgtgcacgctgtgctgcctgctgtcatgggctggctggccctcgggcgtgatttggagcatgggacagggctggcggcctga

SEQ ID NO: 2355 - DNA, 432 bp, Chlorella protothecoides
  modified_base (190)..(296): a, c, t, g, unknown or other
cgcggcgggcgggtctcgggcggcggtgccacgccggcgccggtgcccacgccgctgcgcgacgcgctcgggctgaacgaggccgcggccagcgcaagctccaagcgcgaggaggccgcgcgcttggccctgctgcgcaacgacctgcgcgcggggctggcccagcttccgggccctcgcaacgagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccgagggcgccgtgccggacggcttcttcgaggaggatgcggcagatgcagcgcagcgccgcgccgctgcggccgaggccgagcgctgcgccgcgctgcgccgcgcctcgcaggccgtgcagcgcggcctgcc

SEQ ID NO: 2356 - DNA, 2607 bp, Chlorella protothecoides
  modified_base (947)..(956): a, c, t, g, unknown or other
cgggcggtggccgcgcgcggcgacgcgctgggcgccgagctcgtgagtcggacggcgggcgccggcgccggggcgggggcgccgggagccagcgcatcagagccatcggcaccagaagctctgcccgccgaggactcgctggcgagcgaggaggcgctggtgggcgtgcatgcgctcctggcctcctcccagctcatgctgggcctggtggccggggcgggggtgcccggcaccagggtccaggccatgctgcgctccaccgccatgcgccactgccgcgcgctgctggaaagcatgcacgcccgccaggtggcgcgcctggcgcgtgagtttggtggaggggagggggaggggctttgtctggccgcgcaagttggctgggactctgggatgtcttggggcatgcggtggatgagcatccctgcatcggccgtgttctgtctggcggcccagtgtacagaacttctttgggagcatgtcgaccaaaagggaggtctggtcccaggcggctgtcccgcccagcacccagcgcatcgtggagctgctggaaagcgaggcgcagcgcctgcagggcggcagcgagaggggcggtgccgagcaggatgggagggagcagtcggaaggcctggaggagctggccggcgagccacgcgagggtggcactggcgatgcgaccggtgccgatggctcccaagaagcctcagaatcgacggccgacgagcgccgggaaccacctggacccctcgaagcgacagtgcctgcgccagcagaagccagccccagcccttcccccccgctgcaacagcaccggagcccggcgacgcccccagcctccccgccgcggtccccgcccaccctcaccgggcttccaccccgcagcccgccctcgcccgccccccgcggcacgagcgacgcccagcgctcgccacgtgcgcagcgcacccagnnnnnnnnnncagcacgagcgacgcgcagcgctcgccacgtgcgcagcgctcgccacgtgcgcagcgcacccagatcgcgatccctggcctgccgctcagccccggcgccacggggcgctcccccgggtcggccaccgcctcgccacgcggccctgtgccgcgcaagttcaccatcaccgtgcccgacagccacactgcgctggcgggcgggcggggtgccgcggcgggtgccgaccccagcgccacacagccgccccccgccccgacgttggccgtgtctggcgaggccttcgcctgcgcgggcgcggcgctggcgctggtgcgcgcgctgggggagtacgcggaggtggctgccgcggcgccgggcatctgccccgaggccgggcagcgcgcgctggagctgctgtccctcttcaactcccgcgcctgccagctggtgctgggtgcgggggccatggcctccgccggcctgcgcagcatcaccgcgcgccacctggcgctggccgcgcgctccgtgggcgcgctggccgctctggccccggccctggcccacgtgctgggcgcgggggcggggggcggcccgcgcgcggcagcgctggccgcggggtttgcccgcgcggcgcgcgacatgcacctccacgccgacgaggtctgcgccaagttcgtgggcatcatgcgcgagcgggtggaggcaaacctggcgggcctgggcgagagcctgagggccgcggcgtccgggggcgggtggccaaacggcgagggcagcgtcggtgtgccgcgtgcctctgccggggacaatgtaggaggcccctcagacagcaacgagggcaccgacacgccctcgctgcgctgcttgccgccccccagcgcctttgcaacgaccaccgcccgccagttggcgatcctgagcggcgtgctgggcccgctgctcagcgcgcgccagctggacgccgtgttcggccgcgtggcgggcatggccgcggagcgctgcgccgaggccttcagcacgctggaggcgccgggggcgggcggggcgcggtggtcgctggccggtgcggcgcgcggggcgccggggcgggcgggagtgaccgccgcggccttcgaccgccaggtggaaagcgacgcgcgcgagctgctggcgtgcctgggggcgctgcccgtcgacccggtcgccctggatcaagccctggagccgctacggggctgggtggactggcagtttgtcaccaagccgcgcctggccgcggagcaggcgcagcaggcggagcaaaggtcgccggcggagcaaaggtcgccggcgggcacaaggggagggcaggagggcggcgatgcgcctggtcaggccctgtcagaggaggccaatgacttacaggaggccaacgcgccagaggaggggaggcctggcgcctccgatgagacgtcagtgcctgctccggagggggaccaagaggacaatgacctgtcctccccgtatccgagcagcagcggtgaggcgggtgaggacgagcggcaggacgaagacgaagggcagccaccggtcaaagaagagaaacctgggcaagacagccccactgctgatggtgtggagggcacgacttctgaccgcgaaccggacgcatccgtggcgccgaccagcaaagcaggagagcaggctcgataa

SEQ ID NO: 2357 - DNA, 2019 bp, Chlorella protothecoides
  modified_base (599)..(608): a, c, t, g, unknown or other
  modified_base (1530)..(1539): a, c, t, g, unknown or other
  modified_base (1884)..(1893): a, c, t, g, unknown or other
atgtttgggtgggagagtttggagccgtgggcgggggggtggggtgggagggtggccagtggcttggatattctagggaacccctcggatacctggacactgcccaaaacccagtccccaaactttttttcaactgcgctccttgtattcagagatcgcggcggcgaagaaggcgcgtgccctggtggaggaggagattgcggagctatccacgaagatgcgcaagctcctggcacggtgaggggatactgtgttgaggagggaggtgcagagtgccaggattgtgatcgcaaccctgcatgcccctccaggcgtgccaggattgggatcgccaccctgcatacccctccagggatgtctatactgcgctcagatcccaatgcaaacctccttcccacctccaggattgatgcggacaagaagcggatgggggagagtggcgacctgcagcagcggctggagaaggagtacccctggatcccctcggagcgagagcactttgggcggccgggcaccgactatgactttgcggcccgcgacccagaggaggtgagtggcgaggtggaagggacctggctttggttgaacatgccctctannnnnnnnnncaccgactatgactttgcggcccgcgacccggaggaggtgagtggcgaggtggaaggggcctggttttgtgagaacatgccctctccttctgattccggccggatgagaacacgggcgatgtgcaacggctcagactcatcctctgggaatgaggacctttcagcaggcgcgcaccctcacggtcattattcatccaaccacccaaacctgtgcccccaccaacaccccacctcccaggcgtacgcggagtacgaggcggcatgcaagaccctggagagcatgaacaagcgggtgaacaagaaggtgatggccatgtttgacaaggcggaggccgagtacggggagctgaagcgcaagcgggacgtggtggagggcgacaagcgcaagatccaggaagtcatggaggagctggatgagaagaagcgggcggcgctggagacgacgtggcacaaggtcaacggcgactttggggccatcttcagcaccctgctgccggggacgagcgccaagctggagccgcccgagggcgagaccttcctgcaggaccccagcgatcaagggcctagcctgcctccgaggatcagccggacgactttttctgttgcccacataaacactgtggcaacacctcctagaatgttcacctcccccaccttctccccttcccctcctctgacatacaggcttggaggtccgggtggcgtttggtggcgtgtggaaggagtccctcagcgagctctcgggtgggcagaagtccctgctggccctctccctcatcctggccatgctcctcttcaagcccgcccccatctacatcctggacgaggtgggcgggggaccgagtccgaggaaggctttgtccgtgccctgagtgcccacacggacaaggaggaccgttcaacttgccgctcaaccgcctcnnnnnnnnnngtgggcgggggaccgagtccgaggaaggctctcccctcactcgacggccaccatcccgcaggtggatgccgcgctggacctgagccacacccagaacatcgggcgcatgatcaagacccacttccctcagtcccagttcatcgtcgtgtcgctgaaggagggcatgttcaacaacgccaacgtcctcttccgcaccaagtttgtggacggcgtgtccaacgtctcccgcaccgtgaacaagcccacggaggccaggcgagtggaggacagggtctgttgtgtgtaatcggtgacggctgctccaagctgcatggcaactcgcaaggggactcggcacgatccacnnnnnnnnnncaccgtgaacaagcccacggaggccaggcgcgtggaggacagggtctgttgtgtgttatcggtgacggctgctccaagctgcatggctactcgcaaggggactcggcacgatccaaccttgtgtga

SEQ ID NO: 2358 - DNA, 888 bp, Chlorella protothecoides
atgccggcctactccctgcaccctccaagcggccgctcacatcctgtcgaacacgcatggtccctctgccctcctcgattggatgtccgcgctgtgcctgaattgcagcaatgtgcacctctatcagcccgtcgacccatccccgcagccttcatcgatgccgacgagtacctgacggtgctggagcccgccgcctccctccgctccatcctggcagactacgagcacctggggggtctgggggtgcactggcggatcttcggggcaggtgggggctggggtgcaggcctgggtaaaggggaggctctgaaagggggtggacggcactcaagattcaagggcacactaggcagtcattcctgtgtgcgatccggagtgcccattgcactggagctcccggccacccttccatgctccccgtctcccacctcgcccccacttcctctccctgtctcagcggggcgcatcaggcgtcccagcggccgcatcgtggaggactaccacatgtgctgcgcggtacggtccggcgaggaccgccacgtcaagtccatccttaacacggagtttgcacagcatttccagtccgtgcaccacgccaactacacggggggcagggtgacgacaaacacctgcggcgaggccatcccgcgctacacggcggcggcgccctgcctggagagactggcactgcggcactacgtcaccaagagcctgtgggacttcacgcagaagctggcgcgcgggagcggcatgtcgcggcgcaaggactggacttacttttacagggtgcagaagatggcatggcaggactgtaggctcccagcggcctggcccctggggaggggccccgttgatgaggggggcctgggggcggtgacagcttcctga

SEQ ID NO: 2359 - DNA, 1179 bp, Chlorella protothecoides
atgccgacctctttgggctgtgccggtcccactcagcgtcacatggacgggtggccatgcccagatggtgcatggcaaggcagcagccattttgttagcatgcacagcacccccagcatgagaccgggatgccgaccggtcagtcaggtaacggcagcctgtaagatgctcgatcaggatgttcctaaggagcatctgagagccggccaggccccctttccctcaacagacaacggtattcgaacctccaccgtttcgcctgcatccggcaacctcgatgcctgtattgcgcaacctatcatgagggcatctgttttgcgatcgggttctccgcggcagagggcctgggcctcccgcgtattcctggtggtcatagtgtcagctctggtggggtggaccctgatcccgctgggcagggtgatctggcgcccagcaacaagttattccggccttgaagccgcgaacatattgaagaatatatcaggcaagatcagcctgttggcagatgttctttgttggggtcgtggctgtgctttccccatggtgcttggcacagacatcgcgcgggggcacctgaccccaggcagctcccacccactcgcagccaaggacgggcatacatctggaggcagggccgcaaagtttgaagctctggctgccagggcagagtcccaggccccccttgtggcctgccccgcgccctgggattggaccctggggcaggtggatgcctccaagggtccggtgtgcgattccggcatggcccgcgctgcgtatcgcctgctcgacctggccaccggtgagggcaagctgatgggcctggaatggggtacgggcacgctgacccccctcttcctccagggcaagctggcgggcctcgtcagcatagagcacaacgccaccgtggcggagatcgcagcgcgcgtcaagcaggagaatgcaacacagctggaaagccgctgggcacagcgcaccgctcccctgccagatggttcagagccgggggaagccctgcaggcctacctcgacctcgtcaaagatgggaaaccccagtaccaggtcattggcatctctggccccgctgccatagctgcactggagaggtctgtggcgctcctagtgcccaaggtgggtgtcgagggccggggaggggggcgcctcgccctggctacgcactga

SEQ ID NO: 2360 - DNA, 360 bp, Chlorella protothecoides
atgcttgctgcacgcacctggctgctgcttggagtgcatgggtggccgcagtgtaaattgcgcaggttgggagtccggtgcacccgggaccacacctctcggcatggttcccggcatgttaggcatctcatcccacacatcctccacccactgactcagctcctgggggagctgttactggacagagtcaatgtgaagatcatgatgcagtatgtctcggacgtcaacaacctcatcctgatgatgaacctgctcaaggactcctcacgctccatccagttcgaggccttccatgttttcaaggtgaggaccgggtggtgtcttctcagcacatggtgtgtgactggaccgatcgtgtga

SEQ ID NO: 2361 - DNA, 936 bp, Chlorella protothecoides
atgcaagatgtcactggcgtgcagcttgaattcagttgccgtgatcaacttcattgttcttccgttgtgtcaaagggtatccatgagaatgcttggcgcccgatgcgggccagctgtcccttgcgcgacatcgaagcattcacaatctggctgggtgttaccggtatctgcctactgacatgggcatggctacgatttcctgccccgatgagtgttggtgaacgggtgacgcccccccacatattcccatgttccgacaacgacctgaatcagggacgatgggttccaggtaacaggagcagctgtccccctctccgtggtgaggctacttgtgacccgagcttcggcaagcaatggcgattcgattcgcgcgcaacacagtgcggtctgatataccagccgcccgagcttgtcaacgcaaccatgcccagcaagcacatcctcttcatgggagactccattgcaagatacttgctccagactctgctcagagccatgggacgcaatggtgggtggcacattgaaaccatgtccgagcttggaagagttggtttgttaattgagttgaggcacttaccatatcgatgtcagggcactttggcgatggaccattcccccaaaggggagcccaccacatgcaactccacccagggctggagcccgggggtgacagttccccatgctcactcggacctgaactattccctgccgggaacggccggcgcccttgagttctggtggcgccccttcccactcaatatcagtgaagcactgcacaacctcacgaccatcaccacaaagccggatgcagttgtgacatccttctgctcatggcatctcggcttcatcagggatttggaggagtggaaggacctcttggagacactgcgcctcgctggaaaggtgtgggagtgggtgcacggagagcctgtgtga

SEQ ID NO: 2362 - DNA, 426 bp, Chlorella protothecoides
atggcgcaggagcccaggattgtcattggtctcgctcttggttggttcctggtctggtgcgctgtccgacaccccttccctggcctggtcgtcaacaggctagtggtgcagttcggcccttgcaccgacgccaccttcaatcggggagcctggattgagagcggggccacaacgtgccctccaccagcgcagtttggcacctgtgctcccaacttcggcaagcagtggctgttcagccgccgtgcacaccagtgcggcatgcgatatcgctcccccgccactctcaactcgacgctggccggcaagcatgtcctcttcatgggagattccatcacgcggtatctggccgaagccctgctcagagcgactgggaggagcggtgggtcatgggagtggttctctgggaatctgaatggtgtgggatga

SEQ ID NO: 2363 - DNA, 516 bp, Chlorella protothecoides
atgaacttcctgcagcgcatgcgcgtgaagaatgtggcggagctggctcagaaggcccaccagtccttcgagcgcctgccgtacgagagcaagcaggatcgggtggtggaggacatctcgaaagccatcatgtccatcaaggtgggtcgaggcatgaagattgggtcccttgatgggtctcgggaccggggagggcgtctcctcggtagtgaattcgcggacgtccctttcaatacccccgataccccgactcacctctcccaggaggccatctttggtgaggatgagcagtccagcagcaaggagcatgcccaggggatcgccagcgaggcctgcagggtcggtctggtgagcgacctggtgacctacctgaccgtgctggactttgagacgcggaaggacgtggtccagatcttctgcgccatcatccgcatcaccctggaggatgggggaagaccgggcagggactacgtgttggcacacccagatgtgctgtccaccctgttctacgggtga

SEQ ID NO: 2364 - DNA, 888 bp, Chlorella protothecoides
atgaggtttgccacggacagcacgcacggtgagctcggggaagttgtgggccgggggcacggggatggtgttggtgacgatgacctcggtgaagacgcccgaggacaggcgctcgacggcgggcggggagaagacggcgtgcgtggcgcaggcgtagacctcgcgcgcgccctccgcgtgcagcacgcgcgcggcgttggtgatggtgcccgcggtgtcgatcatgtcgtccaccagcactgccaccttcccgcgcacgtccccgatcacgttcatgacctgggagacgttgtgcgcggagcggcgcttgtccacgatggccagcggcgcgtcgttcagcttcttggcaaaggcgcgggcgcgggccacgccgccgacgtcgggcgagacgacgaccaggtcgccggtggagatgcgcttggaggcgaggtagtccaggatgacggagtcgccgtagacgtggtccacggggatgtcaaagtagcccacgcactgcccgctgtgcaggtccatggtcagcacccggtccgccccggcctcggtgatgatgttggccgtcagcttggcggcgatggattcgcgccccgcagtcttgcgatccgcgcgcgcgtagccaaagtagggcagcaccgcggtgatggagcgggcggaggcgcggcggcaggcgtcgatggtgatcagcagctccaccagcgcgtcgttgacggggggggcggtgggctggatgaggaagacgtcgcagccgcggatggactcgcccacctggcagtatatctcgccgtcggcgaagcgcttgatggagatggcgcccagctccaggcccaggtagcacaccacctcctggctcagctgggggttggcggtgccggagaagatgcgcaggcggga

SEQ ID NO: 2365 - DNA, 540 bp, Chlorella protothecoides
gaaagcgcggccgccgcgctgggcgtggacgccgtggtgcgcggccgcggcatcgcgaccgccgatccagcctaccgcgagttcctggaccgcgcagtggcggtcgcacgtgatgcacgcagaccgcgccgtggcgactatgcgggcgtgagcctgcgcgtgggcgcgccggggtcagcccagggggtggacgccgccagcggcgcggtcgagctccccgccgacctccccgccgcatcactcatcgccacgctgggcgcgctgggacgctccgccgcgcaaggcgcagcgcgacgccggcaggccgacgctgcgctggcgggcctcgcccgccaggtggagcgccggctgaggctgcgccgcctggtccgcgaggacggcctggccgaggcccgcttccgcgctgcctgccagcgcctgctgcagcacgcctcgagcctgcagccgttggttggggggctggcgctgcagataggcctgaccaaccgcctgctcctggaccgccaggccctctgcatcgcctgggactttgaggtctga

SEQ ID NO: 2366 - DNA, 873 bp, Chlorella protothecoides
  modified_base (16)..(212): a, c, t, g, unknown or other
atggggctggaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggatgtcttggggctggctgctggggacggagatgaggccgggctggaggtaggggatggagaggacgcagggctggccgccggggatggggaggtcgcagggctgcctgccggggacggagaggtcacagggctggctgccggcgagggtgaggacgcagggctggctgccggcgagcgtgagggcacagggctggaggtgggggacggagaggtggcgggagtcgaggcagtgggagtggatgtcttggggctggctgcttgggacggagatgaggccgggctgggggtatgggatggagaggatgcagggctagctgccggggacggagaggacgcagggctggctgctggagatgggaaggacgcagggctggccgccgtggatgtggaggacgcagggctggcttctggagagggggaggaagcgggccttgctgctggactgggagatgaggcagggatggaggcgcgaaggggagaggaggcaggtgtggagggcgtggggttgcttgtcttggtgatggccgctggggagggtatagcggcctgttgtgtaggtgggatactacttggcgatggagccgagagctgttccgggacaggtacagcgagcgtcatctgcgtttcgaaatggcgccagggttgggtgcggtga

SEQ ID NO: 2367 - DNA, 2169 bp, Chlorella protothecoides
  modified_base (125)..(134): a, c, t, g, unknown or other
  modified_base (910)..(919): a, c, t, g, unknown or other
  modified_base (1249)..(1258): a, c, t, g, unknown or other
  modified_base (1423)..(1432): a, c, t, g, unknown or other
atgggggaaccgctggcccatgtcaacacagaggcccgtacctggcccctgcctgcacgagaatgtgcgtgcccagcatgcgtgggtacctgcaaccctgttggagcccggctcccagccactcnnnnnnnnnncagggcgacgctgcatgctcccacatcctctttggtacccccctcgaccctctgtcttgatatggggaaccgctcgcccatgtctacacagaggcccctggctggcccctgtctgcatgagaatgtgcgtgcccagcatgcgtgggtacctgcaaccctgccggagcccggcacccagccacttgatcccatggagcacgcaaccatcccctgccagaagcgcgagacgctgctgggcaccggcgcgcggtccaatgcctacaccgacttccaccacaccgtcttccacgtgcacgcgccgcgcgtgaatgccggcacgggcgcgccgatgctggcgcaggtgctggacgcgctggcggagatcgcgttcgagcccgagttcctgccctcccgcattgagaaggagcgcaaggcggtgacggccgaggcccagatgatgaacaccatcgagtaccgcgtggactgccagctgctgcagtacctgcacgccgagaacgcgctgggctaccgcttccccatcggcaagatggagcaggtggcgggctgggaccgcgccgccatcatggacttctgggcgcgcgggtaccacccggccaacgccacgctctacctggtcggcgacctggagccggctgcggcgcgcgccgcggtgcgccaggcctttgaccgcgtgccggcgggccggcgctcggtgcgccgcgatccccagggcgtggccgcggtggagctgcccgaggaggctcacgcgagtgcgagcgcgacaggcgccggcactnnnnnnnnnnccggcgggccggcgctcggtgcgccgcgatgcgcagggcgtggccgcggtggagctgcccaaggaggcacacgcgagtgcgagcgcgacgggcgccggcaccggcggcgccgcgacccacctgtcgctgctccccacctccctgcgcccgccagtgcagcacgcctggggctgcggcgcggcggcgcccgccaagccgccgccccagatttccgtattccggcaccgcctgctccagctgttccagctgtctctcttctgcaagctgcccatccagcccctgaccaccatgcaggacctcaggcaaggggagcattgttgctggcgtggnnnnnnnnnnctgaccaccatgcaggacctcaggcccgtttgcgtgcacatgcgggcctgcagcggcgtgcgggctctgcgtttggtccaggaggcgctgcagtcggccgctgcgctgcccgggccctcgcactcataacctttgcgcccgcgctcacccgctgtcgacccatcnnnnnnnnnncgggcctgcagcgacgtgcgggctctgcatgtggtccaggaggcgctgcagtcggccgcttcggtgcccgggtcctcgcactcatgacctttgcgcccttccgcgtgaacgcgcggtacgtggaggccgacccgcccttcgtttccatcgagctggaccactcggactcggggcgggagggctgcgcggtgtccacgctgaccatcacctcggagcccggggactggcgcggcgcggtgggcgtggcggtggcggagctgcgccgcctgcagcgccacggcgtcagccccagcgagctggcgcgctaccgcaccgccctcctgcgcgacagcgagcagctggctgaggcggcgcacagcacgcccagcgcggagcacctggactttgtgatggagagcctggccctgggacacaccgtgctggggccgcgcgaggcgcacgaggcgctggtggccaccgcggagggcatctccgccgaggaggtcggcgcgctggcgcggtctttgctgtcgttcgccagccactttggcaacgaggctcagctgatggaggagtacgcggccgatccagaggcctgggcggcgccgggccccagcgtagccacggcggccgtggcctgcctgcccgccttcaccgacgccagcgggcacagctcgggcgggggcgtgccgctggcgcgcggcgccagcctggccaccacgcagcacgtcgatccggcggcgctgcgcgccacggcg

SEQ ID NO: 2368 - DNA, 1458 bp, Chlorella protothecoides
  modified_base (86)..(95): a, c, t, g, unknown or other
atgagcgcaaggcggcggcacgaggggtgtgccatcgtactcgacagagtggaggtccatcctatcgaatccatgtccaggcttcnnnnnnnnnngggttggggggggacggggtggggcagatgtgatgactcggcgcctgcaggtatgagcgcagggcggcggcacgatgggtgtgccagcgcactcgacagggtgcaagtccatccaatcgaatccatgtccaggctttgtccatgccaccccaggatgcccgccctggcccccaccatcacccgacccctctcactccacccacacacctggccccggcctgaagttcttgaaggggtcctcggcgttgatgcggcactcaatggagtggcccttgatcttgatgtcctcctggcccaggcgcaggggctcgcccatggccgcccggatctgctcctggatcaagtccacgcccgtgatcatctccgtcacaggcgcctgtacaaaatgggagaaaccatgacggagaaagatgtgaagagagtctcaatccgcctctccaccaaacccacccacctggatgcgggtgttcatttccataaagtagaagcccgcgggctcccacaggaactcgatagtgcctacgccgatgtagccgatgctcctggcggcggcggtggccgcggcgcccatggcctcccgaacctccggcgtgagcacggggcttggcgcctcctccagcagcttctggttgcggcgctggatggagcagtcgcgctcccccaggtgcaccacgttcccgtgcttgtcggccagcacctggaactcgatgtggcgcggatccttgacataccgctccaggtacaccgcgccgttgccaaaggcggcctccgcctcgccctgcgcggcgcggaggaggggcaggaactcctcgcgcgtcattgcaaggcgcatgccgcgcccgccaccccccgccgtggccttgatcatgatggggaagccgacggcgtcggccacctccaccgcctcctctggcgagttgaccaggccgtcggagccagggacagtgggcacgcccgcgttcttcatcgtctcgcgcgccgtggccttgtcccccatcacgcggatgtgctccgagcgcgggccgatgaactcgatgccgtggtccttgcagatgtccacgaacgacgcgttctcagacaggaagccgtagccctgggggtcgtaatgggatggggggttgggatcacaccagggtgtcgcagtggtgggcgcctgagtggagtcctccgccctcatctacaagggtgcagtacccaagacctctggaaccccaccctcctcaaagctgttgcaacgtacggggtggatggcgtcggcgccgcggctgacggccgccgcgatgatggtggggatgttgaggtaggactcggagctggaagcctccccgatgcacacggcctcgtcagcaagctgattgggtga

SEQ ID NO: 2369 - DNA, 1290 bp, Chlorella protothecoides
  modified_base (381)..(390): a, c, t, g, unknown or other
gcgggggccgcagaggcccccgccgacccggacctcctggccgcgcagcgcgccgacgagcgcgccgcgggggcggcgacgctgctggcccagacctttgcgcgcctgggcttcagcctgggcaggctcaagacgggcacgccgccgcgcctggacggtgcgtctgcctgccccgcgcggtgctcgcccgccccgtcggacgccacgccctgtggccgggcgtgggcccagccagaccccacaccccacccacgcccgccaccagctcgtcgccctcacaccaccacacccctcctcccaccgccccgcacaccgcaggccgcaccatcaactatggcgtgtgcgagcctcagccgggcgacgccgcgcccacgcccttcnnnnnnnnnnctcggccgccgtgccctttggccgggcgtgggcccagccagaccccgcacccctgcagtgcccgccaccagcctgtcgccctcacaccaccgcacacacccccctcccaccgccccgaacaccgcaggccgcaccatcgactacggcgtgtgcgagccccagccgggcgacgccgcgcccacgcccttcagcttcctgaacatggaggccggggactgggcgccgcgccagccccaggtgcggtgccacgccacacacaccagcgcggcgaccgaggcgctggtccgcgaggccatggcctcggggcggggcgcggtgtttgcctccggcgcgacggtggcgggggggggttgcgtggagccgcgctactgcccctccctggagaccaagttctcgcgcttccccggccgcgcgcaccacgtgtggctggagccggagggcctgggcacggccgtggtctaccccaacggcatctccaactccatggaggtggccgaccaggcgcgcatgctggccaccataccggggctggagcgcgcggtcatgctgcagcccgcctacgcggtggagtacgactacgtggacccgcgccagctgctgcccagcctggagagccggcgcgcggcggggctgtggctggcgggccagatcaacggcaccacggggtacgaggaggcggcggcccagggcctgctggcgggggccaacgccgccgcgccgggcgacccgctggcgctgtcgcgctccgacagctacctgggcgtgctggccgacgacctggtggggcgcgggaccagcgagccgtaccgcatgctctccgcgcgcgccgagttccggttggcgctgcgcgccgacaacgccgacgcgcggctgacgccgcgcggcgtcgccgcggggctg

SEQ ID NO: 2370 - DNA, 666 bp, Chlorella protothecoides
atggcggccggcttcctgcacacgctggcgggcgctgaccacctcgccgcgttgacaccgctcacggtgggccgccaccccgtcgcctcctccgccctgggcgccctgtggggcgccggccactgcactggccagctcatcctcggcctgtgcatggtgctgctgaaggagcgcttcgaccaggtactgcctttccaggggccttggctgcgctgggatgccgtctcacgggccgcgggctgcccactagtgcctcttctggatcgctggggcggcgcctcggtgggcatcaccctcctcatcatcggcgtgctgggcctgcgcgactccttggcccagccggagccggcggcccctgccctggcaggcgcggggccgggggtgggggcggggccgcccccgcacgccgcgcggggcctcaccgccgaggaaaccgaggcgcaggaggtggcggtggcagtggcgacgcggagcaagagcctgggctcgctgctggcaacctatgtgacgggcatcgtgtatggcctgcagccagacgccttgttcgttgtcatcccggcgctgaccctgcccagccgcctggccgcagctgcctacatgctttctttcctcgtgggcacggtcaccgccatgggggcctacgccgggatcataggtgcgttgtga

SEQ ID NO: 2371 - DNA, 1110 bp, Chlorella protothecoides
  modified_base (80)..(89): a, c, t, g, unknown or other
  modified_base (666)..(675): a, c, t, g, unknown or other
  modified_base (794)..(803): a, c, t, g, unknown or other
atggtcagacacagagaatggctggcagaccaggtgcaggagatggtgaccccggccattctcgaacacagcctggttannnnnnnnnnattcctcgatggggttgccggcccggccgcacatggtcagacgcagagactggctggcagaccaggtgcaggagatggtggccccggcaactctcgaacacagcctgttagaagaccaccctcccggcgcaggcctggaggacctgggcccctgcctgctggtgcgaggcgggcaggacatgggcgagcccgacatgctttccttcctgcccctgcagcgcagccggggccccgccaagctggtcccctggttcggcgcggtccagggccacgccctggtgaggagggccctgcggcggcccgctgtgaactctgggcaccgtcttgttcggggcatgtgggcgcgtggatgctggcggcggctttctggccaggaggccccgctgtccctcctggtcctcacggagggcgggcagctggttgtgcacgacctcgccacctggcagcccatgccgctcaccctgccgttccaggtgcctgcctggttctgtccctggggagtgagggttggggtgagagcagcgctcgccccctcatcatctcttcaccagtgaagcactcagctgcatccctctcnnnnnnnnnntgcctggttctgtccctggggagtgagggtcggggagctgccgcccgtcacggtgagcctgctggtgccgaccctgggtccctcccacacacacgggctgaccctggaggcggtgcgtnnnnnnnnnncacggtgagcctgctggtgccgaccctgggcccctcccacacgcacgggctgaccctgcatgcggtgcgcgggtgcagcaggcggcacgcgggtggcggcgcggccttcgccccggggccaggagactggccgttcacggggggccgggcggcgcttttggaccccggcgccgcggccgcaggggcacacccggccggactgctactgaccgggcacagagacggtcgggtcagggtctgggatgctgtcgcacaggtcagcggggggtgcaggagaggaatgtggagttttatcgctgggggttga

SEQ ID NO: 2372 - DNA, 2031 bp, Chlorella protothecoides
atgagcagccatctgtgcggcacccaccacgagcagggactgactggagtcataggccaggctgtcggcactggccggaaacccggtgccccccgcctggcggatggccacgctctgccgtgtcagggtgtcggggggcagtgcctgggactctcgcaagggggccgaggcctgctgcagagcccgctgcaggtgtcgagctgtgcctttcatgattgtgacctcataacatgcaatggcgcgcgctgttgttcgagatcaggggtaccgatctggggaggtcctaccagctcccggggggcccgacgtgctgcagccaccctgcgaagcagtttgaaccgatcacggcctagggcacgcccaggcctccagtttgcagcgcgagttacccggcgttgctgcaagagcttgcctatttatcttgagagtcctgcctcacctgcagcaggtccacatgccgggttcctggtaggcagagcggggacgtgctgcggccggctgccacctggatgccctcctcctcctcctccagcatggcatcctcagaccatgaagaagggcatggttcctccctgtgctgctcgcaccacctccccaccttcccgcccctgttctgactccgtccgaccatccccccacccccacatcaggcccaagcggcacgcgccagccacccgcaccccgcacagggtcggtcccccccacgccgcccgccagcggctggagtgggcggcctggaccgccctgaacctgggggccaccctggtgaccgccctcctgctgcgcacgctgccgggagaggaccgcacgctgttcctgctctactaccagcccctgatccccgcgctggccatgctctggttctggaccgtcgccgtgtggcactgggagcggcgaggcgtgcgctacgcggcctgcttctcgcccgaggacgcgcggcacctgccgggcagcgccgtgctgttccgcgccggcaccgccctctccgccgtcaccaccctctccggcgcggtcttcctgtaccagctggcagaggggcagcggggcgcggcagccctccagcccccgctcatgtatggcagcctggccgtggccctcctctggccggggcccggttttcatggggtgagggctgcagggatgggggttggtgtgtttgtagcggtgtgccccttcccacctcttgcccgcctgcttcaaccacccccctcaccaccccacccccccccgccgccactacacaccgcaaaggacacgcgccgcttcctcgccaggacgctgacgcgcgtggcgctgcccgtccacgccgtctcctgggccgacttcttcctggccgatgtggccaccagcctctccaagtcggtcggcgacggggcgcgcgcgctgtgcgctgtggcggccggccctggcgcagccttcggctccggcacctgcggcgagagcggcgcgctggcgccgctgggctcggccctgccctacgccgtccgcctggtgcagtgcgtgcgcgtcttccgcgacactggtgcgcggtcgcaggcgttcaacgccgtcaagtacgccaccgcctttccggccatcgcgctggccggggcggccgctagcgtggggcccgagctctggctcaccacgctgcgcccgctctgggtgggcgcggctgcgctcaacgccgcctactcctacttctgggacctggagagggattgggagattggcttcttctcccagatgggtgcgtgggagtttgttgttcttcttccttttttggggggggggatgagggaatggtggcgaggagaaacaaccctagatgattacgtggtgggaaaaaccaaggccatggggtggagctgtatgccgtgggagccagcttatagcactagaaggaagcctgtgtgcggtatgcccctgctcttgctccacaaatgcttggtgtcgatggcatccatggccagtcgcatgacgaggcatggctcaagagcaccacaacccctcggggccaggcctctagccgcgcctgtatacccatcgtga

SEQ ID NO: 2373 - DNA, 663 bp, Chlorella protothecoides
atgatccctcctccacctcctcccccgcagagctacgagggagggatcgggggggagcccggcaacgaagcccacgggggatacacctactgcggcctggccgcgctctgtctcctggacaggtgccaggcgctggatatccccagcctcgggtcctgggtcgcggcgcttcaggctccctttgaggggggctacgcgggccgcaccaacaagctggttgatggctgctactccttctggcagggggcggtgcttccactgctggatcgatatgcgccctccaacgcacgcgccactgatacccgtactgagcaaaggccggaccaggacctgtcgccggagaccctggcggcccgggcgctggtgcactcgctggccgtgcgcttggaagccgccgagaagctggaggccaaggtaggtggcacagggctttggaggcgcattgccatgatgcctgtttcagaccagggacgggttttgaagggaatgtctaaagtcttgctagactgcccgtcatcagttgatgggatgggactggtcggtctaccattcattgcaggaccgatcctcgtctcattccgctctttaacgatgccgccgtctccaacctccagcatgccgcccggacggcacaacacgcgtcccagaggctccgagaggtga

SEQ ID NO: 2374 - DNA, 753 bp, Chlorella protothecoides
atgcagtgccacaagcaatgcaagagacccggccccatacactccgtacctgtcaggatttctgggcttggatgcaagtcgtacatggctgtgctactggatcctgcatggcctggtgctgctggagcggcccttccccgcccagccggaccgagactccatcatcaccttcctggcttcctgccaagatccagagggaggctttgggggaggcccctaccagctaccccacctggctcccacatacgcaggcatagtggcggagggtatgggctgccagtatcatctttaaaagccagggatagcagcagcccacttctcagccctagacttgcatcatgtgcagctgtggcggcgctggtgacgctagggggcccgcaggctctgagtgttattgaccgtcccgcactgatgcgattcctccttcgcatgtgcatccctcccgagcaaggcggcggcatggtcatgcacgatggaggaccacatggggcatggtctcagcctgttgttgttgcatcggaatccctgagtgcatggccaggagaaacccagcacaaacccacttcctccattcctcccccagggggcgaggttgatgtgcggggctgctactgcgccctggcggcctgtcacatgctgaaccttgatgtgcagaccctggcggattgctgcggcatggtcgacttcatccgccgctgccaggcgtgtcaggggaaggtgctcaatatcttacgaggcactgctcgcgtctga

SEQ ID NO: 2375 - DNA, 396 bp, Chlorella protothecoides
atggtcgagtttcgtcgtaatgtaaccaagctgaacttcaggtataagcggggtccacatgctggacgtcgaaatcataagggcgcgccagcgcgctttgtgtctcggcgatgcaacagttttgatctggcatcacacttcctccaggttcggaccgacaacatcgccttaccattacgtctccagatgctggacgatggaatagccagcgatacctccagggagcagtgggccctggaggtgcgggtgctggatttgtaccgacacctggatgccagactcttggacggggacgacggagccctagaattgtatcgtgacaagcatgcaaagttcttgaggaagggacttgggtgcctgaatgctggtgaggtgccgggtcagggggcagtttga

SEQ ID NO: 2376 - DNA, 459 bp, Chlorella protothecoides
atgcgcttgtgtggcgtctggccagccacacctggggttgcggagtgcagagctacgactgaggcgtgctgccagccatgctctgccgaccccgcgcagcatgggtgcgtctggagacaggctgggggcaggctcttccgggtgcagatcgagcccccgcccgcacctgcctttttcctcactccccctccagagatcgtcgagctggcgcggtacctgacgcctctgccggaggaggcgatgcagcggaacgctgcgatccagcgcgtgcgagatgtggtggcgtgcatctggcccgaggcgcaggtcaaggtttttggctcctttgccaccggcctgtacctgcccacgtcggacatcgatgcggtggtgctggggtcggggtgcgaggatgtgccccagggtctaaaggcgttggcctcggcgctgcaccggaagcacctggccaaggacatacag

SEQ ID NO: 2377 - DNA, 384 bp, Chlorella protothecoides
atgaaaggcacagctcgacacctgcagcgggctctgcagcaggcctcggcccccttgcgagagtcccaggcactgccccccgacaccctgacacggcagagcgtggccatccgccaggcggggggcaccgggtttccggccagtgccgacagcctggcctatgactccagtcagtccctgctcgtggtgggcaccagcgacggcaggatcaagctgatcggggccctgggtgtggaagctgtcctgcaaacgccgtcgcagtctcccacctcctacctggctttcctggccaacaggggcgccatcatccgcgtcacccagggcgatgccattacggcagtcacacccctgccctcagccccatacctgctcataggtgggtga

SEQ ID NO: 2378 - DNA, 129 bp, Chlorella protothecoides
atactgcacggcaggcgtgcaccccactcgttgcggggagattgaggctgcccctgagggtgccgccgcctactgggaggcactgcgcggcgtgctggaggaggggaagagggaggggaagaccgtggc

SEQ ID NO: 2379 - DNA, 1776 bp, Chlorella protothecoides
  modified_base (601)..(610): a, c, t, g, unknown or other
  modified_base (821)..(830): a, c, t, g, unknown or other
atggctatgccactcgttgcacaccaagaatcctgtcccagtatgccctttgcccctggctgtgccgtgcgcactccccctgcccgacggacgcaggacacccccgcccccacccccgggccctccccaggggtggggttgcaccgtagcgcctccacccctctcttccaagaccaccaggcgtccacctgtctgacaggcgccgcgccgccgggcccgggtggcgagggtgccaaccgtttgccggcgccccctccgccccgccccgccgcgcagcctcccattattttcctttcatttcagcgttgccagtcctgttttcaaacgaggcaggccctcccccaggggccgagaagactgcagtcctcccctggggcgcctccaaccaattctctccctcctgttcccccgatgcacttttgccccaattacatgccgggcccggcgtcctgcctgcggcctgcctgcagcctgcccggcccagctagccccccttattgccgtcggcaccctccccttctggatgtggttctccccccttgttcacgtggagaaggggtgcggggggatggatcggatcgacagcggcgcccaggcaatnnnnnnnnnntggtctttgccaggagaaggggtgcgggggaatgcatcggatcgacagcggcgccccggcaacgggcatggccccgcagggggtgcgtcgatggccttggcaccgcagcccataagggggccaggccaggaccccgtgctcggcaccccctcatccgtccgacaagagggcgagcagggctggccagcgcccgaggctcgccggcccagcnnnnnnnnnncagggggtgcgtcgatggccttggcaccgcggcccacgggtggccaggccagggcccggtgctcggcaccccctcagccgtccgacaagagggcgagcagggctcgccagcgcccgaggctcgtcggcccagtgccgacccatccgatcacaggctcgcccggccgtccccctcctcacgacgaagctcagagctcgtcgtggtcgcccaggtcgtcgtcgtcgtcccctgccgcggccttggccttggccaggaccggcgccaccgcgtcctgcaccgacttgagcttgtcctcgtactcctccgcctccgcctcgccattgtcctccagccactccagcgcgtcgcccaccgcggaggccaccgcgtcggcgtcggccttgtccagcttgcccttcagcttgtcgtccagcgccgccttggtggagtacaggtacgcctccagcgagttgcgcgcgtcgatccgggccttgaccttcttgtccgcctccgcaaactcctccgcctcctccaccatgcggtcgatctcctcctggctcagccgccccttgtcgttggtgatggtgatcttctccgacttgcccgtccccttctccaccgcggccacgttgaggatgccgttggcgtcgatctcaaaggacacctctatctggggctggccgcgcggcgcgggggggatgccgttcagctcgaacttgcccagctggtggttgtccttggtcatcgcgcgctctccctcgtacacctgaatgcccaccgtcgtctgctggtcctggtaggtggtgaaggtctggctcttcttggtggggatcaccgtgttgcgcgggatgagcttggtcatcacgccgcccaccgtctcgatgcccagcgacagcgggcacacatccagcagcaggatgtccttgacctcgtcgccgccgtcgccagacaggatgcccccctgcgc

SEQ ID NO: 2380 - DNA, 753 bp, Chlorella protothecoides
gggggcatcctgtctggcgacggcggcgacgaggtcaaggacatcctgctgctggatgtgtgcccgctgtcgctgggcatcgagacggtgggcggcgtgatgaccaagctcatcccgcgcaacacggtgatccccaccaagaagagccagaccttcaccacctaccaggaccagcagacgacggtgggcattcaggtgtacgagggagagcgcgcgatgaccaaggacaaccaccagctgggcaagttcgagctgaacggcatcccccccgcgccgcgcggccagccccagatagaggtgtcctttgagatcgacgccaacggcatcctcaacgtggccgcggtggagaaggggacgggcaagtcggagaagatcaccatcaccaacgacaaggggcggctgagccaggaggagatcgaccgcatggtggaggaggcggaggagtttgcggaggcggacaagaaggtcaaggcccggatcgacgcgcgcaactcgctggaggcgtacctgtactccaccaaggcggcgctggacgacaagctgaagggcaagctggacaaggccgacgccgacgcggtggcctccgcggtgggcgacgcgctggagtggctggaggacaatggcgaggcggaggcggaggagtacgaggacaagctcaagtcggtgcaggacgcggtggcgccggtcctggccaaggccaaggccgcggcaggggacgacgacgacgacctgggcgaccacgacgagctctga

SEQ ID NO: 2381 - DNA, 2352 bp, Chlorella protothecoides
  modified_base (191)..(202): a, c, t, g, unknown or other
  modified_base (961)..(970): a, c, t, g, unknown or other
  modified_base (1491)..(1500): a, c, t, g, unknown or other
gggcgtgctggccgcccccgtgcccgcgccagagacgccctggctgggcggcgtgctgggcgcgctgtgccgccgcgcaggcgagctcaggatcggcggcgacggggaagggggggccccggaggtggcgccgcagctcgcggccgcgcgcgccgcctgggagccagcgcgtgccgcgctggccgaggcannnnnnnnnnnnccgacctggcccacatggcattgcagatgacaacaccgtgcgggggccctgagtgccgcgctggagggcctcagggcctgatgctccctgggtgggcggtgcgtgtgcgtgaagcgattgcccccgacctggcccacatggcattgcagatgaaaacacagtcacccaggagggaggtcacgtttccgtgcacagccagggtcgattgccatcggcccacgcccaatcccaggggactgcgtcaagtccccgggagtcggcggtgggggatcattctcgcgctgcctccctctgccttgcacccctgcccctggcgaccggatctcaccatgggagcctgtcacgacgatcacctgaattttccaaagaccaagaaggaggagaccgagggggaggagtcgggagacgaggaggagtcggaggaggactccggggaggaggagtctgacgatgagcagagctaccccgatgtggacgtgcccttgatggcccgggactgggaggcggtgctcgatgagtccatcacatgcctatccatggaccccagcggcacctacatcgccgtgggcacggcggagggacccatttccctcctgtcggctgcctctggccaaacggggatagagctggcggggcacgattggggcaccaatgctgttgcccacctgggtctcaggagactggtgtccattggagaggacggacatgcccggatctggacactcccggtgggggaactggagcccaaggtgcaggccnnnnnnnnnntgcccacctgggtctcaggagactggtgtctattggcgaggacggacatgcccgtatctggacactcccggtgggagaactggagcccaagggagggatactccttcattggagctccagctggagctcctttgtgctcaaggccccagccaatagcatcaccattggaatgcgtgacacccgttggcccctgcgtccggcacctggcagtgaggggcaatgcgtttgcgtgcgcagcagggcatcaggccacctacttcaccgtcgaacccgagacggcggaggtcaaggcctatccccagcccccaaccaagggcactgtgctggatgtgcggcttccggttgatggctcactcgttgtggccaccagcaagtcggtagcgctgcttgaggagatggagatcacctccaagcagcccaacccactagacatgcccgtagaggtaggtgggcgggagcatgtggttcaacccagtatcttgaaggattcatcacaaagctgccagataaggagcctgccnnnnnnnnnncatgtggttcaacccagtatcttgaaggatacatcacaaagctgccagataaattcaggcccggtggctgccaagaacacccatggtgctccccctcctctacatccaatcttgccctcatccctgcagggagcctgcttgagcgtggatgtggatgccagcggcaagcatgtcatcgtggggtgccaggatcaggccgtgcgcatctaccagctgaagcggacagccaagggggctgaagtggaagtgggtgctgaacgggggcgtaggatggtgatctttgacttgattgtcatttcgctgatgcctgtcgtgctcgattttcacagcgagcgaggtaaagtgaggtataaactgacggcttttaccactcctgcaaacttccacactcaggagtttgcgggcggcggctatcatggaaaggtcacccatgtgacatttgatgcccaggggcacaagatgggatccgtgggcggcaacgtcggcatagtcctggactttgagggtggccctgaggacagcagccccaccctgcttgtcgggcacagcaagaccatcaacgccctggcctggcagcccgtgggtggcctcgtggcgacgggcggcgacgacggcgaggtgatcgtctacgacctccagacagcgacacccggaaagccagactactgcagtccgctggctatcggtgactgcaaaggggacgcggtcaccgccgtcgtatggggcgatggcgatgtgctcttttcagggcacgagtccggcgcggtgcggcggtggaagggggctcccacccggctgatcattgaggaggagagcagcagcagtgacgaggagatgctaccggaagaatga

SEQ ID NO: 2382 - DNA, 636 bp, Chlorella protothecoides
atgagctggcaggcttacatcgatgaccacctcttggcggagctgcctgggggcggagtcctggctcacgcagcgatcctggggcacgatggcggggtgtgggcctccagccccgacttccccgacatcacagaagcggaggtggatgccatcgtcgcagggttcgacgactcatccgccctggcggtgaacggcctgcgcatcggcggggagaagtacatggtggtggcgggggagccaggcgaggccattcgagggaagaagggctcaggtaagcttccagaggcttacttttggggcgtaggaaattgcattgtgggcatgctgatgctcctgaacttcaagacaatgccgtccagatgccttgaaaggcggctggtctgtgggctgtatgagggcctgggcgtgatcatggccttctccatggtacattttgtcggggtgccgcttcggatgccaaccagctctccccctccacctagccctgaatccccccctccgtcctcaggcggtgtgaccatcaagaagacgacgactgctcttgtcttcggcatctatggagaaggtgtcacgggctcagagtgcaatgttgtcgtcgagaacctgggcgactacctgaaggatcagggaatctag

SEQ ID NO: 2383 - DNA, 390 bp, Chlorella protothecoides
atgtccggagccctcgctgcccgaggggcgagcgaggagggcaaccgtggacgggtcgaggccaccaaggttcgtcggtactggccaggcaagcgacctgactgggtcggcaatgaggaggaggaggacttggcggttcccagcaccgcccctgctgctgaagatgagccgaccagcgtgcagcgcacagggctcggagtcgggcccccaggcccccttgcctccctcccaacagatatagctgcaccggtggtggtgcgaaaggaggatccccggttgagacggctgcaacagcagcaggcagagcttgctgtgagtgagccgggtcgacaccgagacattactgagccccaggtgcgctgcgcgccagtgtgcggacctacactatga

SEQ ID NO: 2384 - DNA, 1032 bp, Chlorella protothecoides
atgaagatggtgaggcgccctcgtccgaggacgaggacgccttggagaggcgacgagcagctgtccgcgaacggtgaggagtgcttgtcgtgggaatcggaggaatcggaggaggagagctcagagtatgagacggagagcagcgaggaggaaagcctggcaccccggctcctcctcaagcccgtcttcgttccgaaggcggatagagaggtggggcctgggctgggtggtgtgtatggtcggcagccagctggagagcttgaggttgggaagccgggcatactactgttgtgccccgtgctagtagtgttctactcccagctgcattcccctgctctcctccctgtccatgacacgctatcctctccctgccagaccatcatggaacgtgagctactggccaggcaagaggaggcgcggctggctgccgagcaggcgcgggccgagatcagaaaggtggaaaccaaggagatcctggctcaccgtctggaggtggaggcagcggaggaggccagcgctaaggtactgcggctgtggggtcaagggctgccaggaggtcgtttgggggggaatgcggccaggcacccccctggtccctccactcgctgcatgtcatttccgcgccatccatgcttgcacctgcaggagggtcctcggggcatggatgacgtcgtcaccgatgacgatgccgatgacgatgaggaggcgtacgaggcctggcgcctgcgggagctgcgccgcatcggcatggcgcgggaggcgcgggagcgggaggagcgcgaggcggccgagaaggagcgctggcgcaacatgagcgaggaggagcggcggcgccacctggctctgaacccgcgcgaggtggcgcccaagcccaagaagaagtggggcttcctgcaggtgcgccttggagatgaatggggaagggggtcccctgcctcgaatactttgatggctcaatgcggggctgggtgcgactggtggcaggcaaatgctggcgctggggtgggggagcagctgcatgtgcgatggtga

SEQ ID NO: 2385 - DNA, 2220 bp, Chlorella protothecoides
  modified_base (106)..(115): a, c, t, g, unknown or other
  modified_base (1578)..(1587): a, c, t, g, unknown or other
atgccccaatgcctgcaactgctcctccacctcgctctcatactgcctcaggcacagccagtcgtactcgcctgggggaacaccaccgatcccctctgccaacaannnnnnnnnnggctaggtcgaagcgcggcgtgtggtagaaagcgtggtggtgcgaggtggagatctggaggcagctgggaccatgccccaatgcctgcaactgcttctccacctcgctctcatactgcctcaggcgcagccagtcgtactcgcccgggggaacaccaccgatcccctctgcaaacaggtcgagcgtccgcaggctttcaagcagggcggcagctggatgcccggctgtgccagggccagggtgaccaagtccgggcagacctggggcaggcactgcagcttatctgcatcgaggccagggtcgccctcgatggtgagctcctggaggcgcagcttcctggagggctccaggcacggccctggcccgaggcaggcgtgatgggcctcgctgcaaggtgtggcggaggtgttccgggatggggaatggggcacctgggcgcttcagcagccgggcgttcagggtggggaaagaggcacagacaccgccggcacagaggcgccgccccatcaaggagtctggtgtgtggggtgatgcgcagcagaggcggctccggcgcgccggcaactgctggagccgtcgtggggacgggggacccaccccctcccccatccctgcagcacctcatgagcgccatctccgggcgttgagggtcggttgcacgaggctcggccatacaatgtgaggtaggacgaggtgtctcagcggtggagccctctccgtcatcatcatgggcaagatccaggcattggagaagccgccgtggtccttgtgaaggatgtgcatcgtctccgtcgtggccagcctggacgcacagcgccagagaagccttgcacagcactgatgcagcactgcagggaagggtgctgctggtgaatctctcatacaaggctggcaagagtgctgtgccgtatctgcgctctggacacctagacaagattgctccacagacaacgcttgcccagcatgcagatccatacatgtccggtgcccggagccccaaaacacagcacctacaaaccccgggcatgcacctccagagcggaggcctgtcaaccgtccatccaaatcgtccgacgacgtcggtcaagatggaatccacgcctagcgccagatggagaatcttgagcagaatggtcatgggcagcgctttcctttacttcgccccatgccactcctcagggcgttggtttcctgattctttgagagactacacctggctcgagtatgccattaagggacaggaatgggatcttgaaaccccaaccgccagtcgaaacgtggttcaggagcatgggagtgcttctcgtatcgcccttcgccgcgctgtgagctacgaaggtgaggttgactccgacaccctactcgccccttccttaccgccattgtcgtcgcggtttgtgtgttcaaagggtcgcattgcagatactgacaccctcattgcctccacaccagcatccccgatnnnnnnnnnnatcttgaaaccccaaccgccagtcgaaacgcggttcaggagcatcggagcagcccgaccacgcgtgccttggcgacaaggtgcggagtactgtttcacatgcataccgccacggggggatacccatagcaagctggaacacgaggcaaaccttgccgacatacgcagatcggttcaatgcgcgaaaaacaaggtgtccgctggcttggatgatgggctggtcgggtacctgctccagcacactcgcgaaacggaggtgctcaaggatctccggcgggagactgcggagctcttccctgccgcagcgcggatgcagatctcccccgatcaaggcgccttcatgcactggctggtggccaccctccgcgccacgcgggccattgaggtgggtgtgttcacggggtacagcagcatagcgaccgccaccgccctcggacctggcgggaagctgcttgcctgcgaccctgacgagcgcgcgctggcagtggcacgaagatgctgggacagggccggcgtactcgacagggtgagccaatgtggccggggaggggtgtatgcgagtcggatgtgcggctcccgtctcctgtgcggtccagacccgctgcaaggagcagggggtttggtgccgggatag

SEQ ID NO: 2386 - DNA, 312 bp, Chlorella protothecoides
ggcccgcaggggcccatcccagcccgcgccgcgccggggcagacccgcgccgagctggcgcgggcgcggcgcgcgccgctggagaaggtggagcgccccatcaccaacggcacctacatcaaccgcctgcacgtgacgcagcagatggcgcagctcctgttcccgcagccggaggaggcgcgggagcgcggccgggcccccggccgcgagggcgacgcgcccgccaacttcaactcgctcttcaagcaccgcctggtcatcgtggatgaggcggacgaggcctggcccgtgcaggtttgcccctttctttga

SEQ ID NO: 2387 - DNA, 822 bp, Chlorella protothecoides
ctgaaagttctctgctcgcccgatgtcgggagctgcgaggaatgtggctctttccccctcccgacgatcaactcaaccatcgccatgacgagcatcacacttacattgtcgccatgttcggaagccgcgcattctcgttcttctcatcctactttccaccccaaagaccctccaggcccctcgctgcaacaccacgttcaaatctctgtccgtgtgacaggctgtggccgtcggcgtgcctctcggcgccgggcaggccctgggaatctggtccgcccccgacatcaaggactggtaccccaagctgcagaagccttcgtggacccctcccgtcctcttcttcggcccggcatggagtgtcctgtacaccctgatgggcttcgctgcctacagggtgtggcaggccggtgctcctcccctggccatggggctgtacaccctgcagctggtcctgaacctggcctggcaacccctcatgttcaaggtgcgtcgggcaggcaatgggaaggatcaaccgtatcaagtcttgtccaggatcctgcacacgatctgcgtgctgcgtcttatgacatcacagtgtatgtgcggaaaggagtcttgcaaattcctctcctggcaatcttgactcctccaccaactccccacccctttcctcactgtgtatcaacagctctgctggttgtcttggctgccaccatcgtcgagttccgcaaggtggaccctgcagccagcaccctgctgcttccctactttgctttctcggcctttgccgctgcactgacgtacgctttccgccagcgcaacccgcccaaggtggattga

SEQ ID NO: 2388 - DNA, 765 bp, Chlorella protothecoides
atgcacccacacccttgcatggccatgtgcgctgcaatgcagccgcagagcagttgccacacctcgccacccacaggcgctcaagactctggcggagaagttcaaggacaggcccttctccttcctgtgggcggccggggggtcacagccagccctggaggccaactttgggatcgggtgagtggcagggacggaggctgtggagaggaggggcagggaggttggggggcatcgccggctcaggagggtaaaagtcaggggagggtgggcaagtgttttcgaccccatgcggcacattgttgcccccttgtcagactctgcccacatccttctgggaccttgcatgcccgtgactccatgccctggctcacctgcgcccagcattggccttttgcatgcacacgccgtccacacctgagatgcatgcctcgaccgatcgacatgccgccgcctcccatctgctgtgcatcccaaccccaccgaacgaactcctcaccaatctcaccccacaggggctacggctaccccgcgctcgtcgcggtcaacccggccaagggcaagttctccagcctgcgcagcgcctttgaggccgctaatgtcctggagttcatcaactcggtgcggacggggcaggagcgggtggagcctgtcaccggcgccctggctgccctgaccacaaccgacccctgggatgggaaggagggggtcctggaggtggaggaagagttttcactggaggacctcatgggcaaggaggagctgtga

SEQ ID NO: 2389 - DNA, 768 bp, Chlorella protothecoides
atgaccgcccgccgcaccgtgcagcacctggcgcagtactgccagagggcgcacggtgcctccctgcgctccctggtctgcgagttcgcacgggacgcgacgggcgcgctgtgcctgctgggtgtcctgcgtgccgactgggcgtccagcacggcaggtcgggcggtgcgcgtcatgcgtgcagctgatgagggggacccgggcttgggacgctgttctgggcacgctggcctctgtcccggacagaccctgatcttctccaccaccctctcctcccaggtcgtggcggcgagccctgggcgtcggccaacttcctgccggctgccgcggaggcctcctgggagggggagcccgagatcgcggcctttcggccgccggcagtgccgccgcctggcagtcggggggaccagagtcgtgcagaggcgctgggcaaggcgtgggcggctgaactgggcaggcaggacatggcagagcccgcgctttccccaggactggatggcggcagccctggtgtgtcggggctgcagcgggatagatcctgcaagctttggcggcctgcctggcggggccgcgctgtgctggacccatgacccgccgcctgctgccctactccatggtcaagggtggggcggtgctgacctcccacctcacccgccaacttgtgggcgtggtggacgacctggcggccaagtcggagctggccgagcggctggtggaggagatcagggcgctgcagcacgaccggcacgtcaccacgcaggcctttga

SEQ ID NO: 2390 - DNA, 237 bp, Chlorella protothecoides
atgcacagccccttccctttggctctgcaacccctgggaggattgcagcgaggcgattcccaatcccccgcgcccacacacacgcgtgcagaggaggacgcgggcgtgcccgagctcaaggcgaagcagctgtgtgtgatcgccttcctccccgacatcctggactcgggcgttgctgggcgcaacgacgccatcgaggtgggcgacctgtgggtccgtgggggggcagtgcagtga

SEQ ID NO: 2391 - DNA, 510 bp, Chlorella protothecoides
atgccgcccaggaggagggccgcggaggctgccgcggagcagcccagcgccatccagcggacagacgatgagacgggggagccgcaggacctgggaaccgctcgcgcccaggccgcccagcgaggcgacgcccccgccacgggtggcgaggcccatgtaggaggcacggacgcccgccacctgggcccctggaacagcgcggtggagctggcagaggcccggggcgcggccctggagcggagacaggagaagctcagggaggctgcaggcgcggcggccgccgaggaggactggcggccggcccgcgacccgagcctggggcccaggtgcgatggggccgtgccgttactttccgacctggccttggaccaagtggtgagcaatatcgaggacgtggagacgctggcggggctgccctacatcctcaaggtcagggctcagggtgctgtggaggaggtggggcgttggtggggtgcggcatctcactggccggggatgtccatgccctga

SEQ ID NO: 2392 - DNA, 375 bp, Chlorella protothecoides
atgtcagcgcacgcagtggagctgctcaccggcgaccagccggacgagctggtcgtcgccgactgcacgctgctggagccagcgcaacttgaggcggcgctgctgcgcgtcgccgggccccggctggaggtggtcgacctgggcctgtgcgggcggggcatgaccgacgccaccgcgcgccggctggcggccgcggggcccttcctcgcgctgcgcacgctgaggctggcaggcgcataccgcctgggggacgagggcctgctggcgctgctgcgggcctgccccgcgctgcgcacgctgggcctgccggagagctcgcgcctcaccggccaggccctggagcgctgggcggaggagggccccggcctggagtga

SEQ ID NO: 2393 - DNA, 624 bp, Chlorella protothecoides
atgatctcgcaccccacctcccaccgccaggctgcctcgatcgcggtgcctcttgcgggaggcaccctgatcggtctcgccctgaaggatgagacccgcggcgtctggtacaagaccctgaagaaggtggatgtggttggccacacgatggaggtagtcctgggcaatcttgcaagcatcagctccccccagcagggcatgtcgccatgcaccctcatgtccccctcccccctccccaccttcctccagccctcctggaacccccccgcctgggtgtttggtcccgtgtggacggctttgtactccgccatgggctacgcctcctggcgggtgtggcaggcgggcgggggacagcttcccctgggcctctacgccgcgcagctggcgctgaacttcgcctggtccccgcttttctttggggccaaggccttgggtgtggccgccgtggacatcaccgccctggtggggatggtggcggccaccatctacgagttccagaaggtggaccctgtcgccgcgcagctgctctacccctacctcgcctgggtgacgtttgccgccgccctcaactacaatctcgccgccaacaacccctcgggccaggtacgtatctatgtggaatga

SEQ ID NO: 2394 - DNA, 441 bp, Chlorella protothecoides
atgctgaccgtggcagccgtggatgtggactctgagaaggatctgggggcggagtacaagatccagggcttccccaccatcaagctcctggtctcccggggtcaaggcaagcccgcccgcgctgtggagtacaagggcggccgcacggcggcagaaatcgtgtcctgggccatgcagcaggccgccaaggtggctgacaagcggctgggcggcggcgatggagcctccggcggcccaaagcagcgcgccagtgccagggcgagcgccaacgccaaggctggccaggccccagaggagcctgggttttacaagggcacaggtggaagggctgatgcactgcaagaagttgcacttgcgggtggctgggcgtgcgtccctcgcttgacctcacacctcgcgctcaccttctcccctgctagacgtcgtggagctgacggatga

SEQ ID NO: 2395 - DNA, 813 bp, Chlorella protothecoides
atgaagcggcaggcagtgctgtaccacaccgccctgacctcggcggggctggcccacatggtgtcgaagggcgggaatgcgagcttcctccgcgccaaccaattatcggccgaggcagcgaggccagaggtccgcttctggcaggtcctccagttcctggacccccagcttcagctgcaggccgaccaccacggcgagcgctactccctgactcagctgcttcacacctggcaggcggacctgcactcggttttcctcaactactgcctgtatgaccgcgagtttgccaaggcatggccgccccagctgggaatccagggctggaccgcattcctgaaagagtcaggggtttccacctccacagccaagcctggcgcagagaatgcgacgggagaggccgccctggagctgttctcgaggctggcagagggacagggcagttgtgaggagcccggagggtcggcgcagcctggcacggatgctctagctcagcagggcgcagagccttcccccgtcacggcctctgcgtctgctgtaccacctttgccctcggcagagcctgccaggctgggcttccagctgttttgcgtggctctggtccgcctagcacgcttgctgagcgaggcgcggcagccgccgcagcctgttgccgctgcatccctcacagagctgaccaggcaggtgctgaccccgatccttgccaaagcgggccggttggcctgcaagacgctggcaacgccgacaagaaccggcaaggggaggcgagacgttgcagggaaggggcggccaactcaaagagcaggcaaactgtaa

SEQ ID NO: 2396 - DNA, 798 bp, Chlorella protothecoides
atggacgggcgactcctggcgaggaccctgccgcggctgggtcccctgacgtcaggcgcgcccagaggggtgttgctcacatatgttgcggtttctagggaggcaatcgccgcgctttgccacatgacagtcgaccaccacaaacccatgtttccttggccctctcccacctcatccctccctcccctcactcctgctgcaaccaactcaaaccacacagtggtgctgagcggctgcgacatccccgtggccgagctgctgggcgaggccggggtgctccccacgctgcgcgctctgggcctggagcgttgcgcgggcgtgtctgacgccgcgctcgcctccctggcggccgcccacccggacctcgagtctctggacctgggcgactgcgcggcgctgaccgacgcgggcgtggcggcgctggcgcagcactgccgcgcgctgcgcgtgctgagcctgcgccgctgccagcgcgtgggcgaggaggggctggaggcggtggccgcgctgggcacgctgcgcacgctgtgcgtcgcgggcgtccccgctgcggggccgggcctggcggcggcgctggcggcgcgggggggcaaggcgctggagaccctggacgtgagctggtgcaggggcctgcgcgacggcagcctgggccggctggtggaggcctgccccggcctgcgccggctggaggtgtggggctgcagccagctgaccccagccttcctgcacgggcatggcggccacgacctggagctggtgggcaggggggaggccctgcgccccgtactgaccatttga

SEQ ID NO: 2397 - DNA, 381 bp, Chlorella protothecoides
atgcgcaccccttcctcgcagtgtggccactgcaaggcgctgaaggcggactggatcgacctggcgcgcaggctgagcggcaaggtgggcgtcgccgccgtcgactgcaccgtctccaagcagacctgcgcggagtttggcatccagggtgaggctgggcgagggggattgaccctgggacgcgaggggcgcgtggaggtcccggggtggaccatgcagcctggcttccccaccatcaattggtttgccactggggagtcccaggccgaggcgtaccagggtgccagggacgcaggtgccctggaggcctttgcgctggctcgctgggcggccacggccccgcccccggaggtgaggaggcggtgtgtgaggagggcgtga

SEQ ID NO: 2398 - DNA, 690 bp, Chlorella protothecoides
  modified_base (406)..(415): a, c, t, g, unknown or other
  modified_base (501)..(510): a, c, t, g, unknown or other
atggcgggcttggatcgagggggacacctcacgggcacaacccgcgtgtcgctcaaccaccgcgccttcggcgtccatcgcccacctcacgtgcggccccttgcgctgcatgccaaggctgaatctcacaccgagggtatccggcccaggttgcagcaacgtgccgacctgtgcgagcgacagctgtcctccctggatgtctccaccaccggaactggggagcctgggctgggcggcaacatcctaccccacgctcgtcccaggcggcgcctgaaggtggctgtggatgtggacgaaggtgcgtggtgtgaagagggacctgttgggaagctgaggcatacccatccaacccctcctgcagtgctaggtcgcttcctgcacagtctcaaccagttctgcttggagnnnnnnnnnngagggcccggtggggcggcgaatggtcggacgagaggtttgctgtgcatggttggctcagggaacacagggatgtgcaggagggcnnnnnnnnnngagcatggccgtgagtaccaggtgtctgactacttcctctacgactttgccaaggtgtggaagtgcagccaggaggcaagcaacgtcatggtgcacaacttcttcaagtcgcaccacttctcggctggcatccagcccattccaggtgcagcaaggaggggcgcgggaggcgattggtga

SEQ ID NO: 2399 - DNA, 2277 bp, Chlorella protothecoides
  modified_base (400)..(409): a, c, t, g, unknown or other
  modified_base (1593)..(1602): a, c, t, g, unknown or other
  modified_base (2014)..(2023): a, c, t, g, unknown or other
  modified_base (2238)..(2247): a, c, t, g, unknown or other
atgaccaaatgtcatgggaggaacagggggatgcgagatccccctgttcacagcgatcctcggtcgattacagcccaaaccccatgttaccacacacatttgctccaccgtgaacttgaccgctccttcacaggcatccgagtcgtccacggccagcaggaccacccggccagtcatggccctggcgcagcactcagccccttttgtaggtcgtgccgtgccggtgaagtcgtgactcgagtgagattcaacccaggttctggcgcgcgcgatctccaccctcgcggggttgcgcatgagcatgtcttcatgacagcatcaccaagcacctggcgtgcttttggggcttttcatgacaatctcactccttcctcaagatgctggcgcaaactggtgtgcnnnnnnnnnngggggcttttcatgacaatcctgctccgtcctcaagatgctggcgcaaactggtgtgctgccgagcgtgaatgtcgggagctgtggaccaggcagcggccgagtcatgctcgcccacacagcaatggcctctgctttcagcctgaggtgagcaggagactgcatgtgcatcattatgcatcctattcttcgatgggatgccgaagcattgctatcgtttgcctccagggggcacgcatgatgcacatccgcgcacgggagtcgtgcatgatctcatcctccatgctcagcttctttcccccatcccacgcaagaccatcgccacctaggggacgtaggcctggccccagatcttcactgaccacctctgccagtatgcgcagcggactcagcatccagggtcaccagcccaccagccccgccggctgggccatcatcgtggactccctgcggcgcgccgatgtgcagctgctgagcccccaggaggttcagcatgccctgcaggctgggacccagtgcgtggtggatgtgcggctgcctgcagagttcgaggccgggcatgtttcggggaccgtcaacgtccccttcttcaggcccatctccgggtgggatgcggtcagggtccttcgcaggctggcctttgccctgtttggcatacgcacgggtacggagctcaaccccctgtttgtggaggaggtgagccgcgtcgccgccgactccagcaagggcatcatcttgatgtgtaacatcggaggcgtcattgaacactcaggtaaagatggtcgcgatgtgcagagtgggttgcccaaagaggtggttccatgcccttctgataggtctgttgcatgtgaggtttcatgttggatgctcgtctgtctctcgcatagagcatccaccccaaaccctctcgcacgctatagccctcgaccaaagctcgttcaaggtcggcacgcagagtcgttcgctcactgctgcccatgtgctcgtcgagtcgggcaagtttggttccatcaaggtcctgaagggcggggtcaatggctgggcggcatcagagaggccgatcgaagaaatgtgaagccagggttggacgcagggcacctcccaaacagctgcctgggtttgcgcgcgccgcagagattcgtcgttgtgcaccctgcagcaacctctacacgacgacactattcnnnnnnnnnnatttcgcatttgagggttggaggcagggcacctcccaaacaggtgcctgggtgtgcgcgcgccgcagagtctagtcgttgtgcaccttgcagcaacctctacacgacgacactattcactttcagcgtaacaatatcggatttcggcatattcagaaccgaatatttcccccctagcagacaacatacctgggagcggaactcgtttacaccgtgtggagcacccggagctcttgcaggacctcacgcacacaccgcctcccttgggacacagaaaggctgtgcgtcagacctgcaatggcgcgtcagggtgtctggcaattgcagaaactcgtcctcaactactgcgagttttccggcagcagccggggcgcgagtggtaccaatgcgcactagcctccacccagcagagnnnnnnnnnnatcctacacgaagcagcctctgggtgcatgatcacacacagccatgcgaaggacagactttcaacggtgttcctgtgccggcatggaggacctgctttccgtgcagactgatccgacagtatgcttctactgctctacactgtgtttcagttctggttaccaaggttgatttttgcagcctggcgaggagctcaggcttgggaatgattgagagnnnnnnnnnnaacctagctctgctgtgggtacaaagctag

SEQ ID NO: 2400 - DNA, 753 bp, Chlorella protothecoides
atgagggtgcatgatgcacgggccagggtcccagagctggtgctggtgcatgtggaaacagtgggcgccgacgcgccgcatggcgccgacgccggcgtgggagccgatcccgccaagggagccccggctcccaaccgctcgacgcagaaggcctccctggagcgctacaggtctgaccctggggctggcggcggattacgatctacggcagaggtcctgaccctgctccatgcccagcttccgggggcggtgatcgagaaggcctcgatcgacgaggtctacatcgacgtgacggcagaggtggagcgggcactgagtcggcacgaggcacatgggggcctcctcccagaggcagacagcgtggtcatcggtgggcccctgaaccccggctcggagttcgagcggcgactggggcagggggcagggctggcggcccggctccgcgccgccctgtttgagcagctgggtgagctccgggtatgggcacggaggccgagaggcgactggcactggcgctgccaccatgaggttgcggtgcagatcccggtgcagatcccgctcagccatcagcaagcaatgatcacccccggacaccccttgcacaggctacaccagctcggctggcatcgccagcaacaagctgctggccaaggtggcatctgccatgaacaagcccaatcgccagaccatcgtcccgccccgcgccgcgctgtccctgatgcaggcgtgacagggggcttgggtgcgatttag

SEQ ID NO: 2401 - DNA, 354 bp, Chlorella protothecoides
atgactggccgggtggtcctgctggccgtggacgactcggatgcctgtgaaggagcggtcaagttcacggtggagcaaatgcaccagggaggggatgagtaccacgtagtgcatgtcatccccaggctccagctctcctcacagtatggagcaccctccatcgacttcctgccacaacaggactccacggcctacgaggcgctcctacagcgtgcccaggactttttggctgccagggtcgtgactcatctgggcgacgtcgaccctcctcccatgctccacctcatcaaggtggcagggtgctctgtttcggtcaggtcgagggtcggtgccgcaacccgctcgttggtgtag

SEQ ID NO: 2402 - DNA, 1368 bp, Chlorella protothecoides
atgcacaggtcctacttccggtgctacgtggtgcatgccaccagctttgccacgttgaagaacaacgtggcgttcaacagtcaggggcactgctactacttggaggacggcgtggaggagcagaacgtcatcgaccgcaacctggccatgtttgtcaacatcctggggacggtgggtgttacggtgatggcgatggtgtgggaggggtccggcggctgggccgtctctggtcccgcagcggggatcgaccagagtggggtgacgctgacgacctcgggcacgggcctggagaacccctccgacagctcggccgccggcttctacatcacgaacccctataacacgctgaccaataacgccgcgtcgggcggctactccggcttcttttacccggtcctccccgcccccatcgggctgagcaggagcacgcagctggtgccctcccagcgccccctgctcaagttcgactccaacacggcgcacagctcaggtgcgtggcggggtggggcaggcacgaaggcagatgtggatgagtggatggggggggatgctggcgcgctgcccccctgtgcgctgagtagaggggcagaccactgctggtctctgatgggctcgaccctctgcatcgccattgccgctactactgggagaacgctgggtgcatctactttggcggcaagctgtactacaacggcaacgacctcacctactactctggccgcgtggagtttgacaccaggtgcggtcgggtcggccagatggggacgatggagacaagtgttgcatgagaaggagcaagtcgcttggacacgttgggctggccccaagtcgaccacctctcaggtgaaatatctttcagactctgaatgcactgtacatatgctcaacccccccccaaccacacattgccccctgcacagagccctggatggcgtcaccaagggcttcatggacttcaccaacaccaagtctttcctgtgcatgtcggggcacatgtcgtggggcgcgcgcatgcagctcctgaactacaccgcgtacgacatcgtccgcggggccaccatgtttggatcggtgagcatttacgtattttctttgggaaggtacaggaacctcgtacctggatctctgactgcaagggcatggggcaactgtgctctcatccaggacgggtacatccagtactcctctgccaaccccaactccgcgttcccaggggccaccgccgatctccctccggcagccggcttccagtggtacgacactagcacccagaccatcatcgccgacaccacctttgcaaactacacctaccagcccagcctggggaccttcaggcccagcgtgttctacgtgagcatggtgtcttag

SEQ ID NO: 2403 - DNA, 798 bp, Chlorella protothecoides
atgggagcgggcgaggtggtgatcaatgccgaccccgtctaccccgatcccacgtacccaaccccgacctgcccctcgaccgccccgacagcggtgagtattgagggtgggatgcgtcatgcggcgatcgccagcaaccataaactggctcacatctcatccaactcatcatgtcccttgtcccgattgccacaggatgggcgcaccgactgccccttcctggctagcggtctgaagaggtggaacgatcccgccacctggggcggcacagtcccctcccccggcacctcgatcaccctccccgccaatagcaaggtcctactctccggatgcatgatcagcgccaccgcgacctacacccaggtcatcatccctgccaccagcgaggggcacatgcagggttgcactccagatggtgagagccatgctcgcgccgttcctacccgtgcacatcctctggtcccaacttccatgccgtcccgctcccctcgcagctcatcctggatgacaacaccctggtgtggaacctggggtccatcgacgtgtatggtgccctgcgcggtggcagcgcaacctgccgcctcaactcccgcctcaccttcctgttccacaccgtcaacgggatcagcaccttcctctttggcattcgcgtgcgacccggggggaccatccagctgcatggcgcgctgtacacgcccacctggacccggctgggggcttccatcaccccaggcagcacccaagtcaccctcaaggtcagcgatccgacgagggagccaacgctggagtgtggtgtag

SEQ ID NO: 2404 - DNA, 600 bp, Chlorella protothecoides
atgctgcttgagggctggcgcgtggcactttacacgccacctcctgccctcacgaaccaccagcatgcccatgcatggtgccgcgtcctctcccaggggagttcaccgtgcaggatggcaccgttgcggtgtacgtccgccgctgagcctttcggcgcccacatggaggacccgcgaactcgtcattcccttgcccaagccgggctcgccatgcgtgattgcatcaagattggcaggctcggcgcgggtgctggaacgactaaccagattcgcctgcgctggagaacatcagaggtggtcaggctacgatgtgctggcaagcctgctgctgacatgaagtccctggctcaggcattggaaactgccactggtgggcaggtggtgtaccggtcggggggcacaatcatactgcatcgcggtcagcactggcagtcaggagcccttgcacagccactgtgctctgcagagcctgtagtgctgcaaggggtctcagacgaggaggctctatgcaatcaagccatgccagcagacacggcagatttgcctggcccgcaatcagcgacctcctccctcgctggcttgctcgcctcaaatggctag

SEQ ID NO: 2405 - DNA, 1137 bp, Chlorella protothecoides
atgctcaccctgcatgcatgcctccagctggacacgcaaccccctttccaccctcacaacagcggcgactccagcggcctggtgttcagccccgacggcacgctcttcgcgctgaccacgccgtctggcgtggccatccacgacaccgcgagccggactctgcgccatgccctgcccagccccggcacgctggcggcctccttctcccccgatggccgcttcctgctgacccaggcccggccggccaaggacgtcgaccaggaccgcaacctgaagctctggggggtggaggacggggccgtgcgcctggccctgcaccagaagcactttcggcgcgaggaatggccggccatccggtttggggtgcgggacgcgctggcctactaccaggtcaccagtgccgtgcacgtctacgacacatcggacttcagcaacggcgtgacccaccgcgtgcccatcaagggcgtgtccagctttgcgcccaggccgtctggcggcgggggcgcgctgctcgccgcctactgcccggaggccaagggcagccccgccagcgtgggcctctactctgccgagccgggggcagatgggacgcccatctgccgcaagaacttcttccgggagagcgcggggcaagggtgcaggaaagggatggcgatccggggatttgtgggagcgccctccccactggcaggccatgcccattgcctgtgtgcaggagcaagagggctgaccttgggatggacccttgctgcatcagaccctgcgcactctttgtacatcccaggcaggggaacctttgtgcccaccagcctcatgctcccttcaaactcgcagtccaactcggcgcagctcctctggagccccagcggatgtgcggtgctggcactggcggcgtcggacgtcgatgccaccaaccagagctattacggggagcagaagctctacttcatggcgtccaatggccagaacgagtgcgctgtccagctgccaaaggagggccccatccacgacgtccagtggtcgcccaagggcaactttttccttgtggtggcaggcttcatgcccgccaaggtcattctcttcaacagcgcgtgtgtccccaagttcgacctgggtgagctgaactggtggatttaa

SEQ ID NO: 2406 - DNA, 285 bp, Chlorella protothecoides
atgaagcgtgccctgatgagcctggcggaggtggccacccgcctgtggccccactcccagaccatgctttttgggagtcaggccacgggcctgacgttgccggggggcgacctggatgtggtcatcctgggggtcggctccgagctggacacggcgggctcggggttctcagcacgcgagcgccagcagaaggtgcagctgctggaggacctgctggacgcgctgctcgccaccaagctgctgcaggggcgcgtggagctgatcgacgcgcgcgtgcccatcatc

SEQ ID NO: 2407 - DNA, 1083 bp, Chlorella protothecoides
atgcgggcccatgcctggcccgaggccgtccctgcgcaactcttcgagctggtgctgacccgggaccactgcaagcccgccagcgcggccgccatcgcagcacggggcggcaacccatgggacacggtcaagccgctggcgcaccacttcccccgcctggatcaggtgctactgatcgacgactcgccgcacaaggcggcggcagacgaggcccccaacatgatcgtgatgcccggctgggccgggccgggggccggaaagggcgacagcgccctgcccgtgctcgtggaggcactgctggacctggctgcgactgggcaggccctggccgccgctgggaagcccgtgccggacctgaggcggcactcgggggccatcagcgcgcgcctggcggcactggccgtccctgccactgagctcagggcgggtagcgccctggaggcgtccgacgacgcgagctcggcggacccggtgaggagctccgctggcgcgcaatcggccggcacaacgcctgcggccgacgtcgtgggcttggcccttgtgtggagcgaggccggcgggtcgacccaggcctgcgagggaggcgaggccctcgtggcgggcgagcccctcgtggcgggcgaggctggggaggcgagcacaggccgccgcaagcgcagcaaggccggcatcacgagcgagttccctgaggtgacccaggctgatgtggatcgatttgcggacatgtacccgccgcaaacgcccggcgtcctgccggagtgggccgtgcaggcggctgtgacgctgctcggacatgtcgtagaggtgcggtgcgccgttcaccacttctcctggtggtggccttgggtggctgccgtggggtgcacagaccctgcatgccatgcagccgggtgccaggggagtgctcctgcgctggcacccacagttgcctgctgcacgccattggatgccctgcagtcgcttgcttggccctggacccggccggggattgacagagggtcagcgagccacgtctcaatgggactcctcctcggcttgctccgccggagtctgccgcccctgctggccctgacagccgtttga

SEQ ID NO: 2408 - DNA, 486 bp, Chlorella protothecoides
atgctgagcagggctcgggccacaggccatctccctccggagcatggagccgaagagggcagtgtgactgcgccatccctcgaggaggcctgcttgctgtggtggcaggggttcttcctggccctcttcctcttgagccaggtccccagcgacggtgccttcccaaagtcttcctcacagcaggtgcacaagaggataaagcactcccaggctgttgtccagttctcccccctggggcgacaggtccagggctcgcggcccctcctgctctttgacctcaacggcgtactgctgcagcatcattacctcggcatagggcagcactccttcgacatgcgccctggcctggtccacatcttgcgtctcctgccctatttccgcctgggcatcttcacctccagcactcataggacagtgctgaagtcggtgcacaagctgcacgccaagcaacacgctgcagcagctcctcgccaggcgggcgagtga

SEQ ID NO: 2409 - DNA, 759 bp, Chlorella protothecoides
atggtccggtggaacccctttggccgatactttgtgctggctgggttcggcaacctgcccggcgacctggcgttttatgataagaaggcggatggcaagtgcaagcccatggggaccactagggccgaaaacggcgtggcgctggagtggtccccctgcggccacatggtcttggtttccaccaccgcgccccggctgcgcgtcgacaacggaattcaggtcttccgggcagatgccgccaggctggcggcccgcccctatcccatcctgctccaggcagcgtggcggcccgccgcgccggggtcgttctccgacgcgccccttcaaacaccagggggtgcagcgggcgccgagccggccttgccgcccccgccggcggtcacagggtatgtacccccgcacctgcgcggcaaccctgcggccgctgccgccgcgcgctccaagttctcgctggcgcgggacgccgaggacagagggggcaagatcaccagcggcggggtggtgggcgccccaccagcggccgctcgaatgcagccggcgcttccgcccggaggtggggtgcggggttgggagttggggctgggtgcggcaggacgtgccacagctaaaagcctgacaacacacttcccaccctccatgtcttctggcacagccgaggccacaccggagctgagcaaagcagcggcaaagaatgcaaagcggcgtgcggcagctgccaagaagaaagcggaggagggtttgggcaagctagccatttga

SEQ ID NO: 2410 - DNA, 609 bp, Chlorella protothecoides
  modified_base (299)..(308): a, c, t, g, unknown or other
atgcgcatcttcgagtgcgagccacctccttcctactcgcaagactggcaaagtgagctccgctgccccttgatgcgcatcttcgagtggccgactggccgctgccgaaggtgcagcccagcacgcacatcacgggtgctgccctccccgtcaaaatcgtgcgagctgttcaagacaaggtgtgcagctggagagaatcactttcgcgaggtgcaacctcacgacacattaatctttctacacttgttcttgccaagagctcctcggcgcttctgggcgggatttagggttgcttccannnnnnnnnnatcgtgcgagctgttcaagacaaggtgtgccattggagagaatcactttctcgaggcgatgcaggcaccgaccacaacgggagcgacaccggctgtcccgctgaccactgctgatatccagcaggtaggtgtaaagcttctagatcatgtgaatcaagcattacgatgcagaattgctcgtatgagcgctcttaattccgagctcgtccacactctacagatgctcgaggagaatgcaaagatgatccaggctgtggtggagaaccaaaacctgaataagatggacgagtgtcttcagtga

SEQ ID NO: 2411 - DNA, 1017 bp, Chlorella protothecoides
atgttcttctcacatccctgttggacaggggaggagtgccgcttgtttgtcggagacatcacactccagccaaacctgggtgatggtggagcaggcgtcacatacccttgtcagcaggtacgtagtgggtctgacatctgcatgcgaggagctaagatcagggctgttcctcctgccacagccctggctacatgcaggaccccaccccatccacacctgcagtgggtttcccgcacagagcacagtcagcttcaatacgaaggaaaggacggcatagactctggcgagtatcggcttcaggtccagacctctgacttgcggggtgcggggctgcatcctgccggcaggctcttcgtggtcctggagggggagctggggagagcaggtgcggagggagctgtgagatggccgccgcagggaaaggattcagcttggacctcacatggacaccgtcatctgcccagtccgccaagaccatgcttcctcatgtgtccctttcagttcggaccgtctgcacacagcagcaatccgccgttccagaggggccagctggacgctttcgagctggtagagtgtccagacgtgggtgccctgcacagcctggaggtgtgggtggagggcagtaggaagctcaactggcacccggcctggatcaaggtcgggccaatgtacggggacgcccttcctacacactttccctgtcaacgggtgcatcagctgttccagccactttccccatcaagtgctgggatcctgtcgcaccctgtgaccctttcgctgtctatgagccacgccgcgcgttcactcacccatgctgacctgactcccaggtggattcgagggggaacggcatggcggcccacaggacatgttgtgttctatgcagaaccagaatgctgggctggagtagaggtgcccagcaggggcaaaggtgattgggaggatgatagtggcaacgattgcttggagagagttttggaggggcaggtgcttcaagggctccgagactgggcttag

SEQ ID NO: 2412 - DNA, 1617 bp, Chlorella protothecoides
atggcgtccctcaccctccccgagcgtcccagagaacgtatgcgcttggtggtctcaatgcgggccgcctggtcggcgctggaggagccctgcaggttcttgtggcgggtttcagaaggggtgggctccctggcagccccatgcctcatgccaccacctcatggcctcccgacccctttcgtcaccggaccaaatgcacctgagtggcctggactaatgtcagccgtgattttactacactttggcccgccgcatgtcctggagtccaccgagatccgacgtgagggcggaacggatgggcaaggggtgccggctggaggaggggagcagaggccatggcacgccacctcacgcatgcattctgaagcttcaacatccaagattgagtccaagctggccggctcgcagtactcgaagaccagcgcgtcaagctgctgtgggagaaattccatccacgggatgcggcgcctgctgcgactcgcaggatcggtgatcgacccccccggacacgtcgttcctcagtgcagggtgatggcaggccccggccctgcccccgagggcgaggcgagcgcctcggccacggcagctaggaatatgcatgggaagctatcgcacctcatgaagaaatacggaagggtcgccctgggcgtccacctctccgtctacgcctgtttcttcgcagggtgctatgtggcggtggagagccacctggacgtgcctggctacctggagaggtttgggctcatgaccccccctgtggagggcgagcccgcgcaagaaaaggggtgggtgcacaaggcgctggccggctccagttcaagcttggcgctggcattcatcgccaacaaggccttgatacccgtgcgggtgcccatcactctcggcctcacaccgccagttgccaagggttgctctcggtgtcttcgccagtgcatgatcaagttgacctctgaacctgccagacctcctgggagtcgatggaactcctttccacttccttctcattcatcccaagatgaagcttggcatctgcacaaccaacttattgcttgcctcatcctgggatgttgcaggccattctccctggatgaggaattctggagcctcagtggttcacgatcccagccgattgccgtagccgacccagtctggctgaagcttctgcgcaaagctaatcccttgcccagactctggggtgctttggcagggtactattgcactcttgtgatcatgcatgtaccccggcttggccacatgctgtgcaaactaggttacatgccgccagctgaggtccgagtagtggaggcgacttcaagtgtggtctcctctgcaccagatgtgcatctgctgggcgtgtatggggaggacgagcggaaggttggtgacagattggagcatgctggtggtctggagatcgctcataaaggggacgcagagggcaacctgcgaaatcacaggttgctcaagatgggtgggggtcggctaaggacgtgcgaccatttgggaagacgctcccagcgacacacacatccatatgcctatgactgtactgccattatgcatcgcctatcaaacccggtgaggttccagcacttggaaatgggtgacccgctctga

SEQ ID NO: 2413 - DNA, 1020 bp, Chlorella protothecoides
atgccctcccccgattccacagactccacgctgctcatcaccggcagcgcggacaagaaccttaaaatctggggcctggactttggcgactgccaccgctccctcttcgcccatgccgactcggtcatgcaggccgccttcgtcccgggcacgcactacgtcttcacggcaggaaaggacggcgtggtcaagtactgggacgccgacaagtttgagcacctgctgaccctggcggggcaccacggggcggtatgggccatggcggtgtccagtctcggcgactggctgctcacagggtctgcggaccgctcgctgcggcgctggtgccgcaccgacgagcccttcttcgtggaggaggagcaggagcggcggctggagtctctgttcgaggccgacctggagggcggcgacgaccggcgccccgtcggcgcgcccgcccccggggacgaggggtccgccgcccccgcggcgcggcgcaccctggagagcgtgtcggccgccgacgcgatcgtggaggctcttgacgccgcggctgcggaggaggccgcgctggaggagtggcgcgccgccgcacgctccaacccctccctcccccgccccgcgccctccccactgctcctgggcctggcacccgacgagtacgtgctggcggccgtgcgccgagtgcgcggcccggacctggaaagcgcggcgctgctcctgccctttggcgatgcgctgcgcctgctgggctacgtggccggttggctgcgcggcccggcgcgcggcggcgccgccgcggagctcatggcccgcctcgtggccctgctcctccgcgtgcacctgggccagctcagtgtgaccccggcggccaggggcacgctgaccgcgctgcgcgacctgctgcacgcgcgcctgggcggcgcgaaacgcgcgctgggcttcaacctcgccgcgctgggcacgctgggccgcctggtcgccgagcaggggctgggggccgcgggggtcaagcgcagcgcggccgtggcgggactctga

SEQ ID NO: 2414 - DNA, 897 bp, Chlorella protothecoides
atgcccgctccacggcaggtcgtcctggcggcggatcggctgtgctacgctccttcgccggacccggaggaggaggctcgctacatacctctcgaccgggtccccgtgcgcgccatgccccgcggttacgctccgggcatcggggcaggcctggtggacgacaggcacctggatcccggcaggacgagggccgccggcgccggctgcgttttcagtttggcctgtggctcccacgtgcacctctttgccgccagctcccccgaggacgcacaggtctgggtgtccaagatctcgagggcgtggacgcgttgcttccaggaacctcgccgatccatgtctcccacaaagaccaggcgcgatgcagatcccaaaatgccccgcctcctgctggagcccccaggtcctgggccctggccggccgaggccacgccgccggccccgcccccgcaggtggcgccctcagccccccctctccgccaagaactctccccgcccaggcggcgggcagcgacaggcaccggatcccatgttcccacagcgcggcccctggccgtgccggccgtgtatgagatcagagtgacgacgggggatcgcagggacgccggcacctcggcgcaggtggtcatggagttgcacggcgtggaggcctcctcgggggagcacaccctggtccctgcccccggcaccgtccccttccagaggggcacgcagagcaccatgaagatccgatgcccctgcctcggccgactacgtgcggtcaccgtgatgcacgatgcctcgggtccccagccgtcctggtggctggacgaggtgagggtcaggcagcgcggctcagacgccaactgggccgttttcccctgccgccagtggctgtgcacggagcgaggggacgggtga

SEQ ID NO: 2415 - DNA, 1335 bp, Chlorella protothecoides
atggcctccacgaggccctcacccaaggctgctgctcagtctcatctcacccacctttgcaagcattgggccccagtccgcgtctggtcgctgagcagcggcgagctggaggccaccttctccgggcaccgctccggcatcagcgcgctgcgcttcagcgccgacggcgcgctgctggcctccggcgcccgcgacaccgatgtcgtggtgtgggacgtgggcgccgagtccgggctcttccgcctgcgcgggcacagtggggagatcaccgctctcgccttcctccccgccgccggtgccctggtgtcgtcctctaaggacgggctggtcaccgccctcgccttcctccccgccgccggcgccctggtgtcgtcctccaaggacgggctggtgaaggcctgggacctgggcacccagcactgcttccagacgctgacggggcacccgggcgaggtctgggcgctggctgtgagcgaggaccagaggcggctggtcaccgggtcgacggacgacctgctccgctggtacgtggtggcagagaccggcggagccggcggcgccgcggacgcgggcgggagcgccgccggcagggagctcctctctccactggggacggtgtcccgccgcgcgccggaccgcgtcgccgctctttcctttggcgctgacggcgtgctgctggcgcagtcggcggggcgcggcgtggacctgtaccgcatgtgcggcgaggcggaggccgcgcggcacgccaagcgccgccggcgccggcgccgggaaaagaagggcaaggcgggggccaagggcggggaggcgggtggtgcggacgcacccccacccgaggacgcagatgacagcgatgaagtcgcggcccaggatgagctggagacactgccggtgctgcgcagcaagcacaaggtgcgcgcggcggcgctcgtccccggcgcgcggcggggcggcacgctgggcctggtcctggccctggccaacaactcgctggaggtgtgggagtgcgcggggcgggcgggtgaggatgcggcgccgcccgcccgactggcgctgctggacgccggcggtcaccgcgccgacgtccgggcgctggcgctggcaggggacgactcggtggccgtgtcggcctccaccgccggggtcaaagtctggaacccacgcacagggtcctgcctgcgcaccgtggaggcggggtacggcaccgcgctgctcttcgtccccggcaaccgccacgtcgtgctgggtaccaaggaggggcagctggcggtcgtggacatcgccgcgggggaggtgcagctggagctggaggcgcacacctccaccgtgtggtga

SEQ ID NO: 2416 - DNA, 750 bp, Chlorella protothecoides
atgaggcatggggctgccagggagcccaccccttctgaaacccgccacaagaacctgcagggctcctccagcgccgaccaggcggcccgcattgagaccaccaagcgcatacgttctctgggacgctcggggagggtgagggacgccatcagcgagttggcctccctggccaggctgggcgtgcagcccgacgccatggcggccacctcactgctgcatgcctgcgtggagaatgggcgggctgacctggcggagaacgtcttcaacgagctgtttggtgcgtggtcagagggtgacagacatggcaccaggctgtcgagtgcttggctggaaagggttccgcagctggtcagggtggactacacgctcggtcctcattcgccagccatgccgtacagcccaccccttcctcactttccctcagccgacgatgcactggtcccggatgagattgccttcagcgtgctcatacgtggcatgggcaggagcaagccgccccggtgggacagcatcatggccctcctggacacgatggaggggcggtggggcctgcagcccagtgcgcccgtcttcaacgccctgctcgacatctgcgtgcgcacagaggacgacgcgcgcgctgacaccctgctggaccgcatgtggaccgggggagtggcgcccgatgcgatgacgctggagacggttcggcagaacaagaagctgcggtcacgggtgaagcggcttggcgccgaggtgggccgagtctga

SEQ ID NO: 2417 - DNA, 504 bp, Chlorella protothecoides
atggcacaagacttcgagcacgaagattcccagcaacgccttgtcaatgcaactcaggtgcggctggagctggtgggagaacagtcctccagcggcgtcctgcgcctggcgcggggcaggcgctccttccgtcccggcagcgaggacactttcaccttcccccacatcccctggctgggcgatatccgatgcattcgagtggccacggatggctcgggtctcttcccagcctggcacttgaggtgcgtgcacgtttggcacctgtcctccggccgccgctggcggctcgactgcagggcctggatcgaccggcgctgcaacaacagccgctggctgagcgtcgcggaggagggcggagccgcagctgagggacagggcctgcggcctcacaagcaggtccctgccgcgccggggccccgacagggcgacgacagtagcatcaaagcgggctgggcgttggagcagcagcaccctcgccagggtggctggcaccagcagcgctag

SEQ ID NO: 2418 - DNA, 2562 bp, Chlorella protothecoides
atggcatggaaggggggactgggccggcaatcatgtcatcgtttcgggcacaggggcgaccccttgctccatccccctccacaaccaaacctgccaggcgccagcaccgccttcctctgccggcagtggctctcccgggacaggggcccgggccagaccaggttgaccctggtcagccatcgaggcgacccccgcgccgcgccccacgagtactcggtgcaggtctggggccccggggtcgcggcctccggcgccctggccgccggccgcgtgcgtctgcatggggaccgcgggtccagtccctgggcgccgctggatgcggcggggcatgcggtggtgcgggccgcgcccctcggggccctgcgacgcttgaccctggaagctcaccctcctcctgccgccgagcagcaagcctaccgcctggaggaagtgcgtgtcgcctgcccctccctggacctgctggtcgtgttccaggcggggcggcgggggcgagaggggcagggcacgtcagcactagatctgttccccgccgatgccgtgctcgcagggcgggctgcgggcggggcggatgaagtcgcaaggccacccaccaatgcagcgcactctgtgccagacgccttacccactgggaccgacgccatgcagtaccgcacggcgcagtaccgcatccgcgtggccacatgccccggaacaagtactggaatgtcagcgcaggtggcgctcagcatgcacgacgccaagggctgcagcgtggggccgctgcggctgtctggcgccggcggcgccttccagccggggtccagcaccgagttccaggctgcacccatgcaaggtggagtccacaagtgtgtactgcctgaccctcgagcccatgcaacgcaggtggaggccgcggccctggagggcatcagcagcatcaccctagaaatggacgcctcgagcccggcacctgcctggaagctggactgggtggaggtcgaggtgcggcgcagcaagcgcggtggtgaccacggtgagacgtatcgtttccccgcccggcgctggctgggggatcgccatgggctctcgctcacgctgcagcctggcacaggccagccaccgtgtggggagagcgtagttgtgcggcagccggtgcaggtggcgacgacgggcgtgcagacgggaagccccagtcctattgttgctcagactgtattgcaggggagtctgcgatgcattcactgcccaatccagacatgcgcgaccccttcccgcctccttcccgctccttccagcatccttgcacctcctctcaacacctctcctgtacctcctcaatatccacgcctgcagcccgcgcaacccacccgcattgccatctacacctcggactgcgtgggcaagggccacccccagggcctgaccctggcgatctggaccgcggaccccggccagcgccagacgctgcacctgtctccgcccgcgcacgctacgcagccagggcgggtggccgagctggacgccgttttgacactggacctgagcgacatcatgggcggcgagctggggccaggtcgggtggccgagctggacgtcgttttgacactggacctgagcgacatcacgggcggcgagctgggcgtgacgcgcgtgtcccccgccggcgccacctggcactgcgagttcctggccctgagcgccggggcgcgggtgctgtacctcgccgcagacgcggagctggggcgcggttgccagtcggccaccgccccgctggccgccacctggcgcaacccgcgcgccgactgcgagctcggctggcgcgagctggcgcccggcgccgcggaagccgcctggcagctgcgccctctgggcgcgctggagcgggtggagctgcgctgcgaccgcggcgcagggccctggctcctggactccgtgctggtggagggggccgggccgggcgcaagactggcattcctcgcgctgcaccaggcctgggtggctggcggcgaccgcctggacctgcccttcatgcccgccggccaggcggctgaggtggaggtcagcctgcactgccaggccctgtgcctggggccctccgcccggccgtacctggtggtgcttgggcacgggggttcagggccccccgtcagggccttcctgccggccggccccaggaccgagctgcggcgcgcggtgctgacgcacacgctgacgctgccgcgcgccgtcaagatccaggcgttggcggtgggcgtgcaagggttgggcgccgcgggatatctggccctggactgggccgtggtggagagtgtgggcgaggctgcggcgccgcaggacagcggtggttggacatgcgagaaggtgtgcgggctgcgcatggcgtacttccagcccgcggcctggtactttgagagcagcgaggtgctggaaggcggggggcagggcggcgccgccgccgaggtctccatgaccccggtccaggcgccgcccgagcgggactgtgtcttcgaggcgagcgggggatgcgggggcaacagcctgtgctgggtgacctggcagcgactgtggatgttgggaatttga

SEQ ID NO: 2419 - DNA, 870 bp, Chlorella protothecoides
  modified_base (748)..(757): a, c, t, g, unknown or other
atgtctgggagccgcaagaatctgaagggttgcagcctgctcgagttccggaagtatgcatgggtccttgggtttccaccgccccccgccaagaagtctccgccgccgcccgccaagaagtctccaccgcccgcggccaagaagtctccgccgccgcccgccaggaaatccccaccaccgccctcgaggaagtcaccaccaccgcccgccaggaaatccccgcccccacccgccaagacgtctccaccgccgccatccagacagtctccaccgccgccatccagacagtctccaatcccacccgccaagacgtctcctcctcctccttcaaagaagtctcccccgccaccatctttaccgtcaccaccaccaactccctctcctccccctccacctcaaagggccactatcgagttcagcaaccccgtggatgggaaagttgctgtcaaagtggtgctcaccacagacgggtatgttccatacacaatcactgctgatctctactcagccagctttgataacctccttgagcttaccagtgagcacaactctgaggaggtcacgaccttgagcaaagaggacgtggatcaaacagtggcagcacgatactcattctgcatccttgcgatccaaccaactgattggggtattctcgatatcgtgtatgcccgggtgactctaatcaatccatatccccccccaagcgggccgtctcctccaccgccagcacttggatccatcagcgggnnnnnnnnnntaatcgtcaaaaggcgattcagtttaaaatatccattgtgggctataagcccaagggacttcgcatcgttatcttcgacccagttggcattgcgctcgaaatgcattccgtag

SEQ ID NO: 2420 - DNA, 1008 bp, Chlorella protothecoides
  modified_base (730)..(739): a, c, t, g, unknown or other
atgctgtgcgccctgcagttgagctggacatggtgcacgccgttctggcatgcagcccctcccttcctgggcgatgttttgtgcctggctcagatgtgtgatgtgccttgctcttctgtcatctccgaccctggcccctgccacccctcgcagacacccaccaggaggggttcgacccccttgctgccacccgcgataccctgctcttctatcggggcgggtgtgcccctccaccccccagccctaattcgggacgctttgcatccggtttgctgtcccctccctaaccctttctcccctcccgctcacgctgccaccaggaagctgctgcgccgcgccctggtgaacgcagcccagacgtccaacgccaccgatgtggacgtgcggtgcggctgcgacatctgccccggcgccctgccccactcgcaggtgctggcgcgcatgcgcgcctcccgctactgcctggtgctggccggggacaaggcttccagccgccgcggcaccgaggcggcgctctccggctgcgtccctgtgtttgtcgggccgccctggcacaccgtggccctggccgacgacatcgaccacgctgcctccagcgtcttcatcactgtgcgccgtgtgacttgggtggttgccaacgcatcgcagggcagacctgagagccaccctaaggtgctggccgactggtacctggacaccgagctgccgcccggcgccatgttacacgtgnnnnnnnnnntgggtggtggccaacacctcgctggccagggccgacaatcaccccagcgtgctgacggcttggtacctggacaccgacctaccgcccggagaaatgctgcatgtcgacaccctggacgaggtggtggacgcgctgcgcgcactgccgccaaaggtcctggctgccaagcaggccgcactggcgcgggaggcctacaagcagtactggctgcccgccccgggggaggccaagtcgcggctgggggagattgtagtgaagaaactgtgtga

SEQ ID NO: 2421 - DNA, 735 bp, Chlorella protothecoides
  modified_base (350)..(359): a, c, t, g, unknown or other
atgtcactggatgcttccagtgagatggtgagagacaggaagtgcaggcgcaggcaggatgctgtaggggggaccttctccggactctttcccctgcatccagcatccgtgcccaacgtcgtgccagcactgcctggcgcagggcctgaaaccgaagcccctctccgtgatcgggatcttacgtgcagcatccctactccaggtcatatacatcagtccacgttgtggggtctagccagccgccacaagacagggccatgggaatcagtacgcccacacaccagcataggcggcgatcaaagaggaatgaaaaacatggcaaagatgaccagggtagggtatatggatgnnnnnnnnnnccataccgctcatcagcgagctggtgaggggcatggcatgtgcctagatgacacccaggctgttgggtggggtcagcagggccaaggtggcagtcactcatctctgcgcatgataagtgcagaacactttggggacaaggctggcatcatccccgccctccagaagctgtcctttgccgggaagaacttggacgacgcccagcgcactctcgcacagtacggtggcttgaggaagggcagtgtgatttggtatgcacagtcagcattggaccctgcaagaccatgtagtcatacaatttcagcctgtccgaccattcattttaatgcagctatggagtggcatactggcatgacaagtttcccgagtggccactga

SEQ ID NO: 2422 - DNA, 450 bp, Chlorella protothecoides
atgcagaatgagtatcggggaggagagggagttggtggtggtgacggtaaagatggtggcgggggagacttctttgaaggaggaggaggagacgtcttggcgggtgggattggagactgtctggatggcggcggtggagactgtctggatggcggcggtggagacgtcttggcgggtgggggcggggatttcctggcgggcggtggtggtgacttcctcgagggcggtggtggggatttcctggcgggcggcggcggagacttcttggccgcgggcggtggagacttcttggcgggcggcggcggagacttcttggcggggggcggtggaaacccaaggacccatgcatacttccggaactcgagcaggctgcaacccttcagattcttgcggctcccagacatgttgaagcaatggtggccggtaccctcattattattcccccaatag

SEQ ID NO: 2423 - DNA, 3018 bp, Chlorella protothecoides
  modified_base (181)..(190): a, c, t, g, unknown or other
  modified_base (1258)..(1267): a, c, t, g, unknown or other
  modified_base (1557)..(1566): a, c, t, g, unknown or other
  modified_base (1827)..(1836): a, c, t, g, unknown or other
  modified_base (2892)..(2901): a, c, t, g, unknown or other
atgccaaagcgcaaggctccgccaaccgacgaggcagataaggcatcgcgagctgcagaggctgaacctgacgatcacacggaggacgtcgacccaaaggaagttgatgctcataaggcctccccgagcactaaggtcctagcagggtattaccacagaacaatgcccaccaccaggaggnnnnnnnnnnatcacacggaggacgtcgacccaaaggaagctgatgctcacaaggcctccccgagcaacaagggtattaccacagaacaatgtccaccaccaggagactcatgcatgcccactgcaggccgagactacgtctcatgcaaagaagcattgctactcgctcatgccccagaatcacacatccactctgcagcagtgagctccagacctcctctgaaaattaatcgggccccagtcctcaccttgtgggcggctgtggtggcagagaagcagggatttcattgggacgaggcagtgacgattggcaagtacatagcgggagtgctggctcacagcaaggggaagagcctgggcttgtaccacgactctcctgtgaccgaggaggacagggaggcgaggagggagcgagacaggaacatgggtgtcgagcatgtcgacgcctttggcatgtccatccctgtgaggaagaagggtcggcaccacctcgccttcagtcagggcagcaccctcgcgccggcctccgcaaagacctacctgagccacgcctttaaggaccacctggaggatgtcaagcatttgatcgaagttgtgcagactgaggccaagcagagcatactgtggccaagcagagcatgcacattggatgaagaaggatacgctgcagcaatgttggtaccctccttttccgcctcctttgccctcacaggacgcgatggcccgcctggcgtcagccgtgccagaggccgagctgggcaaggcgtgctaccccctgtacgaacacttccgcccggcatggaaagggtggggccagagcgcggagctggacatcgacggcatctgccagctggcgcacggcggcgcctggaaggaatacgccccttgacgcagcatccacctcaacgtccgcgtggcacggccgtgctgtgtcaaggtcatcattgcctccaccccaataaggggagctgttgtacacaagcatgtatggaagtgcaccggcgcttggtgtgcagcggctggccggggtcagcaccgccacacaccaagaataggccccacgggcaaagggctcgannnnnnnnnngtgcaccggcgcttggtgtgcagcggctggttggggtcagcaccgccacgcaccaaggacaggccccaggggcaaagggctcggagcggcggggcccaggcactgtgcaggcacccgtcgggccacccttcaaaccacagtccccagggccccccccactagggggtcgaacaccaggttgtagaagaggcccgaggaggagagcaggagcagggtccccggctcctgcccaaaccccactacggtcggcgcgccgtcggggaggtggaactgggcaaaggagcgctccnnnnnnnnnnggtccccggctcctgcccaaaccccactactgtcggcgctccgtcgggaaggtggaactgggcaaaggagcgctcagaggagaagtagcccgcggcgaggggcaggggtgggcaggggtttgggttgaacccagttggcaacgaggcactgggcagcacgtacattgtcgagccctgcgctggcatggggagccacaggaatgcagcccagagcatttgtgtgcgcaagtcccaccaggacccctggcccagactttgaannnnnnnnnngggcagcacgtacattgtcgagccctgcgccggcatgaggagccacaggaatgcagcccagggcatttgcatgcgcaagtcccaccaggaccccgggcccagactttgagtcacttcacccagcccccgactcacgctgacaaaggcgagcttggaggtggggttggccctcccctccggctgctgctgctgctgcgcgccgccgccgccatcggcccgatcccccgccggccccacgccctgcccccggcgcagggagaagacgtgcgcggtgccgcggtcgctggtgaccgccagccactccgggggcgcggcggccagtgcccccctccccccgctgaaggccagggagtggatgcgcgcggcgtcggtgccgcggcgcagctcctgcagccgcgtgccgtcggcggtgctccagacgcggagcagcgtgccgcgctccgaggcggtggccaggtgcttgcccgagggtgtgaggcacagcgcgcccagcgcgccagagtgcgcctggacgaagcgcgtgcgccgcgtcgcgtacgcctccagccgcacctgcccgctgtgcagcccggggcaggccagcagcgcggcgtcggggccggtggacagcgccagcaggcccgacgcgttggccgcggtctccacgctggcggtcaggcgcaggtcggagaaggcgtagaccaggaccttgtgctccagggccacggccagcaggtcacggcgcagggccacgcggcgcacgcgcgagcggaaggagagctcgccgatgcagcgcccctggtggtcgtcccacagcatcaccttgttgggcgggtaacggggcaggggcccgccccccaccagggccaggatgttgctgcggaacagcatctccacgatgccgatgccgccgttggagaactcccgccggaactgcgtgggcgtggcggacattcatcgcgggtgggtggggcaagtgcggggctgtgcgacttgtgtctgtccaagacgaggcctttaggtagaggtgagccacgggcaatgcggctttgggatggaaggagttgcagagtggcnnnnnnnnnncgccgttggagaactcccgccggaactgcgcgggcatggcggacgttcatcgtgggttggtggggcgagtgcggggctgtgcgacttgtgtctgtccaagacgaggccttcaggtag

SEQ ID NO: 2424 - DNA, 1725 bp, Chlorella protothecoides
  modified_base (1211)..(1220): a, c, t, g, unknown or other
atgccctgcaatggatctgaaagcagatcggacatggacactcccttggctgagcataaactgccgactgagggcacaggagcactattatgtaaacttgctgtgattcaccctcctaataaccatattgagctgacggcgcacggtttgacacgagcacttcttggacgccaggaagattgcatagcccctgatcagtgcctggcacctccaggattctacacaagcttgcagcccagaattcctagtgccagcgtccttaataaatctcaagtcgccctcagccccgaggcatctcgccatcccctgcgcttgtcacactttggcctgaagtatcggagggagcctcgcagggataccgctccgtctcgcatgcagtctgggtacagacctccaggtaaccagcacgactgggatgcgcggccatgcctccgcggtgccaggaaccggctggggctagctccaggcgtgcagcgacggctcgccaagcactcaatccaccctccttggcgcaggagcaccccaactggtctgttcgtggtgccgcaccctgctgacctacccccaggcaagcctgcagcatgccctggccgcaaggcccagtgctgccatgattgcaacacagcacctgaatgcgtgactccgcccattgcccatgcagggcgctcaacatgtgcgctgtgcgtgctgccaccacatcaccgaggtcccgcgccagccccagccggcggccgggcccagctccgcgccgcaggccgcgcaggacatggcgcagctcacgtgcaccaacccgcggtgccgggtgacgctgacctacccgcggggcgcctcacaggtgcactgcgccatgtgcggcacgctcaacgacgccgcgcaggtggggccgggactggcggcaccaggggggtttgcctgtgtggtcaagggagacgggttctcacggatcggccagggtcccagctgtgccctgccccgaccctctctgcgccaatggtcgcttccaggataaccctgtcgtacgcgtacggcgcttgctccgtgaagtgcgcggtgtgcaaccacgtgaccccggtccccggcgcgccggagccgtcggcgccacgcactcaggcggtgatcgtggaaaatccctcgtccgtcgacgaggcggggttcgaggtgcggcaggggaggaacatgtctgtgtaccccttgctctcgtggcgcagggnnnnnnnnnntgtggagaatccctcgtccgttgacgaggctgggttcgaggtgcggcaggggaggaacatgcctgtgtaccccttgctctcgtggcgcaggggagccattggcacgaggtgtgggttggggcgggggctgaggcgcagcccggcgtctgggaggccaccatgccagcccaccactcgagcctcgcatgccacgccccgcagatcccaaacatggcactgggagtcacgagcgaacgatcgcagcgcccctgatgcccgcctccccttgaacgacgttgaataggcgcagcgaataaggacaagtagcaaggcagaaaggtgtaccatggaaaagacatgtacatggcggcattcagcttccagtcatcgatggagtcttgtcgccgcggagctggtgcctctcaaggcagtcctgcattgttgcagcaagtatcggcctgtaaacatgtcgaggacgtgcatcgaccagtgccgatcctcctgcggtgcaaggagagggacgtga

SEQ ID NO: 2425 - DNA, 1194 bp, Chlorella protothecoides
atgtccgccacgcccacgcagttccggcgggagttctccaacggcggcatcggcatcgtggagatgctgttccgcagcaacatcctggccctggtggggggcgggcccctgccccgttacccgcccaacaaggtgatgctgtgggacgaccaccaggggcgctgcatcggcgagctctccttccgctcgcgcgtgcgccgcgtggccctgcgccgtgacctgctggccgtggccctggagcacaaggtcctggtctacgccttctccgacctgcgcctgaccgccagcgtggagaccgcggccaacgcgtcgggcctgctggcgctgtccaccggccccgacgccgcgctgctggcctgccccgggctgcacagcgggcaggtgcggctggaggcgtacgcgacgcggcgcacgcgcttcgtccaggcgcactctggcgcgctgggcgcgctgtgcctcacaccctcgggcaagcacctggccaccgcctcggagcgcggcacgctgctccgcgtctggagcaccgccgacggcacgcggctgcaggagctgcgccgcggcaccgacgccgcgcgcatccactccctggccttcagcggggggaggggggcactggccgccgcgcccccggagtggctggcggtcaccagcgaccgcggcaccgcgcacgtcttctccctgcgccgggggcagggcgtggggccggcgggggatcgggccgatggcggcggcggcgcgcagcagcagcagcagccggaggggagggccaaccccacctccaagctcgcctttgtcagcgtgagtcgggggctgggtgaagtgactcaaagtctgggcccggggtcctggtgggacttgcgcatgcaaatgccctgggctgcattcctgtggctcctcatgccggcgcagggctcgacaatgtactcgtacctgcccctcgccgcgggctacttctcctctgagcgctcctttgcccagttccaccttcccgacggagcgccgacagtattccacctccccgacggcgcgccgaccgtagtggggtttgggcaggagccggggaccctgctcctgctctcctcctcgggcctcttctacaacctggtgttcgaccccctagtggggggggcctgcgagcaggtgtcctgcgtgcagttcatggaggaggccccacgccagggtgggggctattga

SEQ ID NO: 2426 - DNA, 1404 bp, Chlorella protothecoides
atggttatcctggggcccaagctgagccagaagacgctcaaccaggtcctgctcaagcacctggccaagctgcaggtggacgaggagccctccatccgggccaacaccacggtcctgctgggcacgctggccactcacctgtccgaggcgacgtgccgcaaggtgctgctcaacgccttcacgcgcgcgctgcgggacgggttcccgcctgcccgtgcggcagggctcagggagtcgggcagggcatgtcagcctgcggatgccctatcacagcgcagccctgacccacccactcctccgcaatccccccaggccatcatcgccacggccaagttccactcgccggaggacgcggccaccaggatcctgcccgccattggccccttgtgcatcgaccccgtggccgaggcgcgtggagggggagggcgaggaaaggcattccaacagccggttcgtgcctcggccctggactgcctggagcacttttctgcggtgctcaaggcccaccagcaggatctgacggcccgagcggaggccagcacggcgaccggcggcggccccaccgcctcctcctccggcgccggcagcgccacggctggcgggggccggatgacttccctgggctgggccgcctccagcctgggcctggccagggccggcgcagcgtcccctgtccccaccgcggcgggtggatcgggccaagtgggaggcccggcggcgggtggatcgggccaagtgggaggcccggcggcgggtggatcgggaagtggggccggggcgcgcgctgcgccggcgggccccacgccatccgagcggccgcgaagctcggcagcgcccccctcgccgcccgacacctcggcctccgcaagatctcagcagccgctgggagcagacgagggctgggacgaggacgacgccgatggcctggcggagcatggtgggtggcgcaaaagtgtgtgtctgttggggagcggaagggggagtttggccgcttctgcgttccaggttggctgcctggcgctcgcatcaccagggactggcgctcaccgccgcgacctgcccggtgcagaggaggagctggcggcccggcgacggctcgccagcgccagcctgcgccccgcgccgcgcgcgcccgtgcaggcaaagccgcggggtccgccgagccacgcaaagccgaggggcccgccgagccacgtggcggccccggccccctccagcggcgacgactggttcgaccagcccgccgcgggggccgcgccccggccgcgcgccgcgcttgcgccccggagggcagcggggacggcggctgcggcgccacgcaggtcgggggcggggggaggcatgaagctgggggtgtccaagctggcctctgacgccaagcccgccgactttgacgagtggtga

SEQ ID NO: 2427 - DNA, 1287 bp, Chlorella protothecoides
atgggagcgctgtgcccaggccgctgccgcgctgagcacgaccaatggccgtctgtgcggcacacttcaactctcatccagtttgccctgacaaatcctaatctcaacctcaccacccccagcaactcgaggctgcccgagctgtatgccgcgttggggcgggacctggatgtcatggagcccaagctgcccgaggacgtgtacaagatgcacctggtggaggggcgcgtgcccacaggtgggcaggggaaagaggggggggctggttgttcctggggctgtgtgggcgacaacgcgggcgggagagaggtcactgcccatttttctacctggtgggaaatcgtggtggagcctgtgccagtcagtttccgtcctggtcctcgccggctgctctatccttgccagtcctccccactacaaggcaagatgcccctcctgaccgccattccacccccacaactccatccccaaggccctgcggtggactcggcacgtgccaacctgtcggccacctttgtgaacgggctggtgaacgccggctttggcaaagacaagctggtcacgcccggggtggaggacgacgcggtccactgggtattcaagaacaaggaccatggcaagctgagcgcggcggcctcgctgggcctggtcatgctgtgggacctggagggcggcctccccgccattgaccgcttcctgtattccaacgacccgcacgtcgtggcgggcgcgctgctgggcatcggcgtgctctcctgcggcgtggccgacgaggttgacccggccctggcaatcctgtcggagtacgtcggcggcgccgaggcctggccacgcatcggcgccgcgctgggccttggcgtcgcctacgcgggacgcggccgcgccgacgtcgccgacctgctggcccccatggtggccgaccccgacacgcccatggaggccacggtggccgcggccctgggtctcggcctggcctttgccggccgcgcgcacggcggcgcggtggaggccgcgctgcaggcgctgatgctgcgcggcgaggcagagctggcgcaccccttcggcaccatgctggccttggccctgggcctgctcttcctgcgcacgggcgaggcggtggaggccacgctggaggtggtgcgcacgctgccccccgcgctggccgagcccacgctggccacgctgcgcgcctgcgcctatgccggcacgggcgacgtgctgcacgtccaggccctgctggccatcgccggcggcgcgggcggcggggcggagggggcggcgggggcc

SEQ ID NO: 2428 - DNA, 849 bp, Chlorella protothecoides
atgacctctgtaccggcgccactcaagttcctggccccgcactacacccccctggaggccatgcacgccgcgctccccgccggccaccccgccgccgcgccgctgtcggacgtgctgtccgcgctggcgatgacctccgcgcccgggggctcccgcgcctgcctgcgctacaagctgacgggcgcggcgggggccgacgtggcggtgtgggggcacgaatacgttcgtcacctgtcgggggagattggggaggaggtgggcgcgcgccgcgcggcgggcgaggccgtggacgacctgctggccctggtggacctcatcgtgccctacgacatgtcccacaacgccggtgcgcagggggagggggcctgcgtgggtgtggctgctttcttatggaggggtgtgttggctgccacggccccccgcctgtcgtcaacctgtccccgcaaccccccctttcacacagagccggacgccattgacctgctgctggaggtggaccgcgtggcggacctgccgcgccacgtggacgcgggcaacgcggagcgcgcggcgcgctacctccaggcctgcgcagcctacctgcccgagccggaggacgaggcggcgctgcgcgctgtgcacgccgtgcacatgcgcgtggggcggcacgcgggcgcgctgcgcgtgggcctggccctgggcgacgcggagctggtgggcgccgcctggcgcgccgccgccgacggcggcgagcgctgccagctggcctacatcatggggcgcgccgggttcgtcccggacctggaggaggggtcgctggcggtggcggacgaggccctgcgcgagcgctacttctcctgctacaggtga

SEQ ID NO: 2429 - DNA, 252 bp, Chlorella protothecoides
atggcggagaaccgtggggagctcgagctctacaaccagtggtttgtgctggcggacaccgacaaggacggtgtcgtttcagggggtgaggccgtcaagttcttctccaagtcgggcctccccaccaacccgaccctcttcaaggtctggcagtacgtcgcgggggaccgaccctcactgaaccgcagggagttttacaccgccatgaaactcgtctccctggcccaggtacccgaggttttctgtttgtga

SEQ ID NO: 2430 - DNA, 423 bp, Chlorella protothecoides
cacagccctccgcctcacccccctccccccccaccaacccccaggctgtacgaagggtacaacctgcgtgccaagttcaaggggcacgccaaccgctccacccagatcaaggcgtccctcagccccagctgtgacaccgtcatctgcggctccgacgacggctgggtgtaccagtgggcggtaccctcccggcctggcgcccggcctgaggacgcggtcgtgaaggagaaggtgttgtcctacgagtgcttcctggctgcgtcagatgttgtgacggtggccatgtttgctccggagcgggcgctggccacatggccgacccagcctggcaagggtggggcggtgggggccaccccccgtgtcatcctggctgcaggctatggaggagagatcaaggtcttcgaggacctccaccagccctga

SEQ ID NO: 2431 - DNA, 1494 bp, Chlorella protothecoides
  modified_base (60)..(69): a, c, t, g, unknown or other
  modified_base (1047)..(1056): a, c, t, g, unknown or other
atgtgtcgctgggcatgcctgtgtgggacccgcgcgagaaccctcgcgaccgctcgcacnnnnnnnnnngcccatcctgctgcgccccatcgagcgcgacgtgtcgctgggcatgccggtgtgggaccctcgcgagaaccctcgcgaccgctcgcatctcatgcccatcatcacccccgcctaccccgccatgaactccagctacaacgtgtcggagtgcacgctgggggccatggtcgacgagttcgcgcgcggcgacgcggtgtgcgacgagatcctggcgggcggcgccggcggcgtgacggactgggcgcgcctgaacgagcccttcccctttttcaccgcgttcaagcactacctccaggcacggccgaaaggctcggctgtggtttgggtggggaatggggtggtgatcgagagctgaaggatggacggagtgacatcctgcagctgaccgagtatgcacacgtggctggaaggggcgccagggtcagagacagcacagaaacatgtcctctctcacccctcctcctcctgacaaaggtggacattgtggcggccagcgaggcggactttgaggtgtgggagggttgggtcacctcccgcctccggctcctcatccgctccgccggcagcattgtggaggtgcggccgtggcccaagcccctccgcccgcccgccgaccccctggcctgctcctacttcctggggctgtccaagaagcgggcggtggcgctgacgggtgcgtatgcgccgcacgcccccgcccccgccgcgcgcgtcgacctcacccagcctgtcaacgactttgcgcatcgggtcaaggactgggcggagcgccggccgggcatggagctcgcagtgaggcacgtcctgcagaagcagctgccggaatgggtgagggcggcggggccgggcggcgcaagtggtttggcggctgggcagggcgccgaggaggccatgcaggacgccgagggggccatgcagggcgcctcggcggcgcccacgccggccaacagcaggaccgcggtggacgcgtcaaagggnnnnnnnnnnggcgccgagagggccgtgcagggcgccgaggaggcgcccacgccggccaacagcgggaccgcggtggacgcgccaaaggcttgtcctgcgcaggcggccagcggcgcaggggaggagctggagagccggcccgcgcatgctccagcgcctcagaatggtgaggggctaccgccgatggcgccgccgcgcagggcgccagacgggtccgcgcgcgtcccggagcctgcccccaagcgcagccggacggaagagacggggggtccggcgccgagcgacgcgccgcggcgcgcggcctccgacctcagcgtcatggacctcggggcggcggctgggaaggctgacaacgtctgctccaccaccgaggcctcctccatggtgggtttttggatggggcggtgtggtagtggagggtcgtgcatgttggtgcattgggaatga

SEQ ID NO: 2432 - DNA, 1221 bp, Chlorella protothecoides
atgcagggcacagagatcctgccctccctgagccggctgcaggccgggaatctgacgctggacgaggcggccgggctcggcagccagggttgtgaggaggaggccaaggtgcggtacggattcctgaaggaggagaaggagggcctgagcgacgaggaggtcatggccgagttcaaggagtccaagcacggcgacgagggcggcgtgtttgccgctgaactgccccgcgctgaggtcccccgtcagcccaagggggtcccagcctctgaaaaggagaatgcctccaacgtcagcgtcggcccgcccaaattcctgacggcggcggaggtccaggagatcctccgttgtgtatgggcggccaatgccgacattatgcagctcatctacccagcagacgtggctcagcggaagaggcgtcagggggcctcagaggctcaggccgctgcggctggcaaggctgctgcacaggtgctggatggggacgactgggctggcaactaccgcgagttcttcatccagacggtggccgtgacacccaacaggttcagacccatcagccatgttggagagatggtgtacgagcacccccagaacacgatgctggtcaaggttctgaatgccaacctggagatccagcgccttggtgagcgtgcttgccagcctgcgacgggcttgtcagctctgatgttactgtcggtgcaggcatggctgctcaagtatgttctttaccgcgcatccctcaacaccttgacaaataaaccccatctctggtctgcagccgccgagacggaccaggatggggagcccctggacatcaccgacggccgcatgctgcgcacctggctggagatgcagaactcggtcaacgccttcatcgactccaccaccgccgagaacgagccaaacgcgatcggcatccgccagcagctggagaagaaggagggcctgttccgcaagaacatgatgggcaagcgcgtcaactttgcagcgcgctccgtcatctccccagatgtttatctgaacggtggggagatcggggtgcccccctacatcgcagcccgcctgaccttccccgagcgcgtcacgccctggaatgtggagcgactgtgcgaggctgtgatggcgggccccgggcgcaacccgggcgcggtggcggtggagaacgagaagggccgcctgctcatgctgcgagacgacgccaaggtacggcggctgacttga

SEQ ID NO: 2433 - DNA, 1026 bp, Chlorella protothecoides
atggtccgcattgtctacgaggccagcggggacgagagcgtgctggagagggccctcccagccctgctagcagagcacgcctactggaccagcgcgcccaagcaggtggaggtgctgagccccgacgggtccaccacctacaatctgagccgctactatgctgactgggatacaccgagacccgagtccttcagggaggatcaggagacggcaaggaaggccggatttgaccccgccgcccccacggcagccacgcggcagctgtaccgcgacctggcctccggcgcggagtccggctgggactactccacgcgctggctggcggagaacagcaccgacctgtccaccatccgcaccacgcgtgtcctgccggccgacctcaacgccttcctgtaccagatggagcgcaacattgcgacctttgccgatgcgctggcctgcgccgacgtcgccgaccgctttgatgccgccgccaaggcgcggcgcgaggcgctggacgccctctcctgggacccggcggcggggcagtggtacgacctcatcatcgacgccgaggacggggatgggcttgccggccccgtgtcggtcgcgcccaacgctgtcgtcttccccagcaactggttcccgttgtacgccggcgtggcggaggccggcagcgtccaggccgccgcggccgtggccgccttcaacgcctcgggcctgctgatggagggcggtgtgcccgcctccctggtggagtctgggcagcagtgggactaccccaacgtctggccccccatccaggggctgctggtgcagggtttccgcaacgcgggcggcgccgaggccgaggccctggcccagaccatcgccgagacctacgtcaaccaggcgctgcgcacctgggaggagacgggggccaacttcgagaagttcaactccacgctcgtcggccgcccggggggcggcggcgagtacgccgtcgtcaccggctttggctggaccaacggcgtggccctgcatctcatccagcagtacgacctatga

SEQ ID NO: 2434 - DNA, 327 bp, Chlorella protothecoides
atggccagcaaggaggtgcagcgatatgttgctcgtctcagcctcctgctggagggccggttggccgaggcccagggcatcaacgtgggggcgtccagctcagcgaggaaggcagctggaaaggagggcatggagctggacgaagggtccggaggggagggctccccaacctccgtcgttaagggcccgctgcccagccgccgcacggtggcaatgactgggcagagtctggaggcggctatcgacaccatgtccgagatcttcaagaagcagcccccgggacgatgtgccaactgcggcgcccacagccccagcatcaagaagtaa

SEQ ID NO: 2435 - DNA, 399 bp, Chlorella protothecoides
gccctgctgcgcgccggggacaagtgcgtggcgcggtacgaggacgggcagtggtaccgcgccagcgtggagcgggtgcacgccgccgaccccaccgccccggagtacgacgtctacttcatcgactttggcaaccgccagcgcgccaagggagcggcggtgcggcccatggacgccgcgcttgccgcggtggctccgcaggccacgccggccaccctggcattcgtcaaggtgggtggcttggtcgcgtgttggtcggagggcggtggcaggaaggggcgagcgtcgaaaccccctcgtcagagagcgtggtgccggagcccatcgtgcgctgactcggacgcagcgggcaggggaggtgtgcacccctggcctctcacgtcggagtgggtggcatga

SEQ ID NO: 2436 - DNA, 336 bp, Chlorella protothecoides
atggaagcatggctccctggtcgacttggcgccagggccagtgctaccaccgacgatgaatcacagtacaacccatcgtcctccccgcagtatttgcgcgcccaaaatctgtatgagtcccgggaggaggccgagcttcgggaggaggtgctgggcgccctggacaccctggttaaggagtggatcaagggggttgccgcacaccacggccagccggtggaggacgccacggccgtgatctacacctttggaagttaccgcctgggggtgcacggaccaggtgtgctgctgctgttggggctgagcgggctgtactgtggggagcaggccttttga

SEQ ID NO: 2437 - DNA, 636 bp, Chlorella protothecoides
gcacgcctcgcagcccgcggcgaccctggcaagggggaggatggcgagcgcgcaacggaggccctggggtcgcgagtcgccgagctggaggcggagctggcttcggcgacggcagccgccgaggccgccgaggccgcgcgcgccgaggccactgccgacgccgcccacgtccgcgcagaggtgggaagggggcaggattggggggctgtgggtcttgagggctgttcatgcaaacgaggctgaagtgccagcacgctctgcgtgttgctggagcagggcctgggaatgcgtgtgggcgtgcttgggagaagacgccaccccttccatcactccctcctggcgtgtgctgcgtgctgccgaatcaggagaccgcgcacagaccgtctccccccctttgcccctcattccccccttgcctcctccgccctcgcagctggccggcgcgcggcaggcgctggccgagtcgcggcacgccgacgtggtcgactaccagcgccgcgcgcgcgaggccacggagctcctcttcgccaagcaggcgcagctggagcgcgcgtcggcggaccgcgccgcgctgcagctggcgctggagcgggagaccgccaacgcgcgcgcggcggcggccgaggcgcggcgccg

SEQ ID NO: 2438 - DNA, 483 bp, Chlorella protothecoides
  modified_base (105)..(114): a, c, t, g, unknown or other
  modified_base (224)..(324): a, c, t, g, unknown or other
atgcgtggaaggggtgcggcgcctgccgcgcgcggcgccccgcctttgtccgcccgcgcgagctgcgctggcggccggaggaggggcggccgcaggccgtgcccnnnnnnnnnnggccgcacctaccgccccagcgccgaggagtttgctgaccccgtggcctacatcgcgcgcatcacgggggaggcctgcgggcagggcgcggcgcacatcatacccccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgggacccgccctttgcactggagcgcgggacgacgggcaccagcatggagtccttccgcttcgccatccgccgccagcccaccgccaagctctgcgtgcgcggcgccggcgtcggcaaggggtccggcggcggcggcggcggcggcgccacgcacg

SEQ ID NO: 2439 - DNA, 1644 bp, Chlorella protothecoides
  modified_base (791)..(800): a, c, t, g, unknown or other
  modified_base (1277)..(1286): a, c, t, g, unknown or other
tacggcggcggcagccgcccccgtggcaattgggagctccgcggcgacgtggagaaggacccctttgcggaggcggaggccaccaacaaggatgctgacgagctgtttgccggcgagaacactggcatcaactttgacgcgtacgaggacatccccgtggaggccacggggtccaacgtgccggagcccatctccaccttccaggacatcgacatgggcaaggagctgatggagaacgtgcgtcggtgcaagtacaccaagcccacccccgtccagcgctactccatccccatcggcatggcggggcgcgacctgatggcctgcgcacagaccggctccggcaagaccgccgccttctgcttccccatcatcgcacacgctctgcatggcgggttccagcccggcgcccgcgggcgcaaggccttccccctggccctggtgctgtcccccacccgcgagctgtcctcccagatctacgacgaggcgcgcaagttctgctaccagaccggggtgcgccccgtggtcgtctacggcggcgcgccgcaggtccagcagctgcgcgagctggaacgtggctgcgacttcctggtggccacccccggccgcctaattgacattatggaccgcggtcgtgtgtccctcgccaaggtgggtgggtgtgggtgtgcttgctctgagaacggtttcctggtggtatgtgtgtgtgtgtgtgaggggtgtgcatgctggaggctgggtgaaggaggtgtgagacttgtcgctgccgcctggagtctccttcatcgcccaannnnnnnnnngcggtttcctggggatacaaacacgcacaccaacatcaccagccccccccccccacgggcgcagatccggtacctggccctggatgaggcggaccgcatgctggatatgggattcgagccccagatccggcgcattgtgcagggtgaggacatgccccctgtgggccgtcgccagaccctgctcttctccgccaccttccccaaggagattcagcgtctggccgccgacttcctgcacgactacgttttcctggcggtgggccgcgtcggctcctccaccgagctcatcgtgcagcacatcgagtttgtccccgggcacgagaagcgccagatggtgctggacctggtgcagtcgctggcggagggcctgaccctggtgtttgtggagaccaagaagggcgctgacgcgctggaggacttcctgcttccgctccggccgcacgcccgtgctggtggccaccgacgtcgcggcgcgcnnnnnnnnnnccacgtcacccatgtcatcaacttcgacctccccgctgacgtagacgactacgtgcaccgcatcgggcgcacagggcgcgctgggaagaaggggctggccaccgccttcttctctgacaaggacgcgggcatggcggggaagctggtggagctgctgcaggagaccaatcaggaggtccccggctggctccagaacaccgccgcgcgcgcgggcagctacggcgggggcggcggcaaggggcgccgcggcggctcgcgcttcggaggccgcgacttccgccaggaccgcggattcgctgaggagcggtatcgcagggggcccggtggcttgggccacgagtcacgagaggcagactga

SEQ ID NO: 2440 - DNA, 1332 bp, Chlorella protothecoides
acactcacatccgcggtcctggcggaagtcgcggcctccgaagcgcgagccgccgcggcgccccttgccgccgcccccgccgtagctgcccgcgcgcgcggcggtgttctggagccagccggggacctcctgattggtctcctgcagcagctccaccagcttccccgccatgcccgcgtccttgtcagagaagaaggcggtggccagccccttcttcccagcgcgccctgtgcgcccgatgcggtgcacgtagtcgtctacgtcagcggggaggtcgaacacgggcgtgcggccggagcggaagctgcgcagcgcggcctcgcgctccgcctgactacggtcgccgtggatggaggtggcggggatgccgttgcgcaccaggaagtcctccagcgcgtcagcgcccttcttggtctccacaaacaccagggtcaggccctccgccagcgactgcaccaggtccagcaccatctggcgcttctcgtgcccggggacaaactcgatgtgctgcacgatgagctcggtggaggagccgacgcggcccaccgccaggaaaacgtagtcgtgcaggaagtcggcggccagacgctgaatctccttggggaaggtggcggagaagagcagggtctggcgacggcccacagggggcatgtcctcaccctgcacaatgcgccggatctggggctcgaatcccatatccagcatgcggtccgcctcatccagggccaggcggccgggggtggccaccaggaagtcgcagccacgttccagctcgcgcagctgctggacctgcggcgcgccgccgtagacgaccacggggcgcaccccggtctggtagcagaacttgcgcgcctcgtcgtagatctgggaggacagctcgcgggtgggggacagcaccagggccagggggaaggccttgcgcccgcgggcgccgggctggaacccgccatgcagagcgtgtgcgatgatggggaagcagaaggcggcggtcttgccggagccggtctgtgcgcaggccatcaggtcgcgccccgccatgccgatggggatggagtagcgctggacgggggtgggcttggtgtacttgcaccgacgcacgttctccatcagctccttgcccatgtcgatgtcctggaaggtggagatgggctccggcacgttggaccccgtggcctccacggggatgtcctcgtacgcgtcaaagttgatgccagtgttctcgccggcaaacagctcgtcagcatccttgttggtggcctccgcctccgcaaaggggtccttctccacgtcgccgcggagctcccaattgccacgggggcggctgccgccgcc

SEQ ID NO: 2441 - DNA, 786 bp, Chlorella protothecoides
atggacagggagtctgtgtggggagggaggacagagcggcgacgagagaacagccgccgcccggcaccgctgcacggtgactggccggcagcgcacagcagacgcgatggctctacctggctccctacagtagggtaccaacaattcccagactctccctccacatcccttccaccactccttccaagaccattccccctccctcgacccctttctctcccttccctccctcaacccccttccctcccttccctccccccccctgaaaaccactccactcaggtggacgacgacggcgtggccacgcagctcacgcagctgctcacgagccagcgcgcggggcgcgcgaccttcatgccgctcaaccgcctgcgcgcgaccgaggcgccgcgccccgaccagtacggcgacgcggtggccccgctgctggacttcctgtccttcgatcccgcgctgcgccccgccatgctgcaggtgttcggcaagacgctggtgtgccgcgacctggccgccgccgcgcgcgtcgcgcgcgagaccgacctggcctgcgtcaccatggacggcgacgtggccgaccgccgcggcgcgctccgcggcgggttcaccgacgtgcgacgctcgcgcgtcgccgccgcgcgcgagaagcggcgcctcggcgccgagctgggcgcgctggacgctgagctggcgggcgtgcgcggccgcctggcgcaggcgcagcaggacatcgcgctggccggcgaggcgctgggcagggaacaggcccagcagtcccacatccagtga

SEQ ID NO: 2442 - DNA, 1077 bp, Chlorella protothecoides
atgcttgccgtccagccaggggcaggggactgtgcatatgaagaactgagagccgttggtgctaggcccagcgttggccatggaaagaatgccgggctcggtgtgctccaacgcaaagttctcgtcctcaaaggttgggccgtagatggaggagccgccagtgccatcccccttctccatgtcacccccttggcacatgaagttgggaatgatgcggtggaacttggaccccttgtagctgaggagcacccccttgggactcacacctcgctccccggtacacaagcacctgagggaaggtgggacacggccaggtttgagcgatcttggagagcaatggtgcccagcaatcccccctactgcaccgtcgtttcaaactgctcctcctcaccggaagttctcggctgtgcgagggaccacatcggcgaacaaggacattgcaatgcgcccgaaagcctcgccatcgacttctatgtcgaagtagacgcgggggttgtcgagactatcagcagagccggccatgagtctgtgtctggtcgggattcctccggcatctggagcgctgtgaaggtgtcgccacgtcggatgcgaccccactccatcgtccatcgatgggagtcgctcggggcaagaaattggcgtgtgatgcagcgatgtagacaggaggaaatgcaggtgtattcgaagacgctgctgctcaaaattgttccctctgatggcagctacacatgcaccctacctcctcccacacccatctctggcgcggagcagatcacggtagacctgaagaatgatctttccatcacgggcaccctccactcagtggaccagtatctgaacatcaagctgaacaacatcaagctggccaaccctgccaaataccctcacatgctgtctgtgcgcaactgcttcatacgaggctctgttgttcgatatgtacaggtgactttctgctggcgtgggcctttgcttgggatgcagttgctgtgcaggcatggacatggggcatggaatggcaggcaaggcatgaaccatctgatgcttgcaccatctttttccgaggagccctcacccccc

SEQ ID NO: 2443 - DNA, 1896 bp, Chlorella protothecoides
atggccggctctgctgatagtctcgacaacccccgcgtctacttcgacatagaagtcgatggcgaggctttcgggcgcattgcaatgtccttgttcgccgatgtggtccctcgcacagccgagaacttccggtgcttgtgtaccggggagcgaggtgtgagtcccaagggggtgctcctcagctacaaggggtccaagttccaccgcatcattcccaacttcatgtgccaagggggtgacatggagaagggggatggcactggcggctcctccatctacggcccaacctttgaggacgagaactttgcgttggagcacaccgagcccggcattctttccatggccaacgctgggcctagcaccaacggctctcagttcttcatatgcacagtcccctgcccctggctggacggcaagcatggtaggtgtgaactggtcacagagggcctctccctggtgaagaagatggaggccatggggtcaaggacgggcaagacctcgcacgtcatcaaaattgcggactgtggggagcttcccagcaggcgccagctgctggccaaggtcagggcagagaaggctgagctggcaagcctgaaagctgagccgcacgccgtggatgccaacgccgagtccctgaagcggctgcaggccctgagggcgccgtccggcggtgggcccgcagcagcgccgtcataccggaccgcccaggatgagctgcgcgagctggaggagcaggaaagggcggtggggggagcggcaaatgaaggtggagatgcaggccccagtcagcctcccggtcagggtgccgacgggccagacgccggtggggctgggccgggcgatgctgcgcagcaggaggaggagggggaggagatcgacctggcttctctgccgccccgcgcccgaaggctgcacgagctgaagctgcgtatgcgccaggtggaggctgtggatggggctggggcggggctctgtgggcacgcgattgggcttgacaggtggccaataggctgcaccataccatcggccccaccgccgcgtgctcctgccccatcgcaggccaggaaagccaacgagggcgccgtgatctcggagaagcgcaaggagctggcggggaaggggaaggcggaggccgtcagcgacccgcagtcctccaagcgcaagtggtatgaggacaaaaagaagcgccaggtgcgagcagcaagggaggggggctggtgcatgtgcctggaagggggttgcagctgggtttgcagcgtgaccacgtgtattgccccgggcatcaggccctccacccatgacctccagaaggaggagttgaaaagtctggggctgggaccagagcacgcgcaccggctggaaaccgcggagaccgcggccgccatctacgagaagacccgcaagaccccggcgcccaagggctgggaggcgttcaaccaggccgcgctgtacggcgcctacgagcggcgaacggccgccattaagccgtcggctgaggagtacgaggccgccaaggcggcggacccggagttctaccgggcgggggacagcctcaagcacggcggacagggggccgtgtcggaggcaggcgtcgcccgcatggtcgcggagctcaacgacaggtgggccggaggggtcaggcgggggagcaagaggaagggggagcctggtggctgcgtgacgcttcctgatcgcctgcacccttccaaaccccgacgcaggcaacgcaaggctgggaactttagccgtcggcgcgcgttcgacgacgccaaggatgtggactacatcaacccccgcaacgcgcacttcaacaagaagatcgaccgcgcgttcggcaagtacaccgcggagatcaaggcgaatctggagagggggaccgccctgccggagcgatga

SEQ ID NO: 2444 - DNA, 1029 bp, Chlorella protothecoides
atgctcaatgcatgcacgatcctcccgctgcaagccattcaaaaactccgctgctaccattcctgtgtctgcacatatcgcaggggactgtggataatcggaggcttcaccatcgtagctgctgtctttggattcattggatctgcgcgtgtgcggtgctgcctgggcctgcacgccgtcctgagcgtcattgcagggttggggcacctgggcctcgtcatctaccttttcgtcgacccagccggggctgtccagaagctgcaggactatgccatcgacaagggccatgcccccaggtcctccctggagaaggcggtgagcatcgggcgctgggtcctgctgggcctgctgtccctgcaggccatcgccgtcatctttgccctggtggtgcggcgggtgctgcgccgccgcgcctacgaggagttcaaggacgtggaggcgccgtcccagcaggaccgccgtgcgcagcgcgaggccgacatgcaagacctgcgggagaaggtgctgggcagccagcacgccctggcgggcggcgcgccgccggccactgccctcgacttcaagatcgccacggtcgcggccgcaaaccgcgccgagctcatgggggccgaggacgggaacctcgccgccgtggacccccgcacctctgccgtggctctgcaggcgggcggtgcccctgccccactctcccggtgcgtagattcgtgctctgggtcaggctggctctggtcatatggggaggcaccagacctcatggccccgcatcttctcagctcaccctcctcgcacttctccacaggcccatatctgcctggacgtcagagcagcatgccgaacctcgtccgcccaacttcaagcccagctggaccaggtcagctgcggctgccgcggcgcagacagagtagcggcacggcttcttccacgagcagcactggaaagtgcctcgtggacatgtgtgctccgcaattggtcgagcagacccccctggatgtcgggctgcttaccagcctgcaaatctatgtgttatag

SEQ ID NO: 2445 - DNA, 495 bp, Chlorella protothecoides
  modified_base (268)..(277): a, c, t, g, unknown or other
atggcggtgtgggcgctgcagcagctgcccggcagcgacggcaccagcggccagatgtgcacgtgcatcatgaccaatccgcagtacatcccgcagctggacacggccatcgtgtcggggaagaagacgctgcagcgctggaagcacggcatgcgctccgcgctcaacgccttcaacatgtttgtcaagacggggtcggtgcgcgaaggcgaggtggtgtggcgcctggacggcgcggcgctggccgcggagaaggaggccaacgccnnnnnnnnnnaaggcgaggtggtgtggcgcctggacggcgaggcgctggccgtggagaaggaggctaacgctgagaaggcggcgcgccagcgcaacaagccgctgtcgggcgcgcagcggcgcaagatgaagaaggcggcggccgccagggaggcggccgtcgccccgggcagcaggcgcaggccgccggctgcagcgcccggaaggcctcgtcaaacgcgcccgcgg

SEQ ID NO: 2446 - DNA, 444 bp, Chlorella protothecoides
accaccgagctgaactgggacttgattgccaagcaccttggtcgaggcaagcggtcggtgcagcggaagcacgacaacctgaagggcacgagcctgcccacgggcagcggctcctccatcttgcccatcaatgacggcaagaagtggagccccgaggaggtgggcgagctgctgcgcctggtggaggacggcgcctaccgcaaggaggtcatgggcatggagaaggtggactggcgcatcctgggccagcgttttgggcggagctacgagtccgtgtcctacaagtactcctacgtcaagaacacggggcgcttgggtgagtgggtcatggggtgcgggggggtgcgggcgctgggaggggggtgctgcggtccagggtgggaggagcacgaggtcccgaggccgccgaggtgggaggagcatgaggtcccggaggccgccgag

SEQ ID NO: 2447 - DNA, 777 bp, Chlorella protothecoides
tgtcggcgcggggcccgcccccgggccgccgcacgctgcggctgcgcggcggcacagacgcgcgcgccgcgccgcccgcggactacctgcgccacgtgctggcgcccgccctgcgcgcccacgccggcgtggacctggaggtggaggtcctgcgccgcggtttcttccccaaggcgagtggcaccggaagcagtggcgagggcgatcctctggggcggcatgcgaagtgcatgggcgtggacttgggaggggccccctgcgttctgcgctgtcaggcacatgaacccatggccaggcaacagctccaggacgtgtggccacattcaaacctggaaccccctctaccccccgacacatacacacgtcaattccctttcccacaaacagggcgggggcgaggtcgcgtgccgcgtggcgccactgtcgccgggctccagccttccccccctgcgcctgacgcagcggggtgaggtgcggggcatcgtcatccgcgccttccaagccggcagggtgccgcgcggtgtcgcggatcgcatggcaagggccgcccgagccgccctgggcgcgaacctcgcgaccctggtcgaggcggaggaggtggaggccctgcccccgtgccaagcggtgggggacgggtgcggggtgctcctcgcggctcacaccagctcgggctgcgtgctgggcgcctcaggtgcggcacaggccgatgcagagggggtttggagggtggtgatctgggtgggacctgagagcccatcatgctgcgtgcggtcatga

SEQ ID NO: 2448 - DNA, 996 bp, Chlorella protothecoides
atgccgcgagcaatggtgggtggatcgggccatggacagcctgggagccgatcactcctcaacgccggcgtgcatgggcttccacctgttcctggcgtggtcagctccaagcagctcatctgcccaccccccgcgcaaacccttccttctccacgaccactgcacaccaggcctcggggagcgtggcgtctcggccgaggcggtggggcggcgtgcaggcgccgagctggcggcgctcctggcgagcggggcctgcgtggacgcccacgccgcagaccagctggtcatcttcgccgccatggctggcggggagagcaggctcctgatgggagagcccacgctgcacaccctggcagccatcgcggtggcagagcagctcaccgcagcgcggttcgacctgcagacggtggagggcctgaccctcatggcctgccatggggcaggactgaccttgaaaccgtggaacggctcggggaaggcttgatgaacgacgatgtcttgggggaaggtgtgggcaggaggaaagcgtgcgcggcgacggggagagacacgcatccctccgacctctcgaacatagcctgggggcattcctggtcctccagcataagttatctaccacttgtagataatccatgcccaattatcccctctcggtgtgccacactttcaatacactgtcgaatcgacttgctgccggattacgggtggcctgcccactcgtatcgcaggggagcagagggccctcggcccgcagctgctcctccaagggtctgcaggcagggcccggtatccccctgccgcctatcccctcagcttcgcactcagcgagtagtatttggaacaggaccagctaccgtatgctcgccagtcccgcaacccatttccggacggtcgcccagggcgaaggagaccagcgggctggtcatacctgcggccagcaggccatgcccctgcagctcaggactttgcaatccgtgtttgacctcgcaagggtga

SEQ ID NO: 2449 - DNA, 681 bp, Chlorella protothecoides
  modified_base (31)..(40): a, c, t, g, unknown or other
atgacgctcgtggacctgcccggcatcacgnnnnnnnnnngggggtgtggggttgtgggttggattggtttgggtggggcatgtcttgtgttggttggtcccagccttgcgcagccatttggttgggccgcctcaacccgacccacggaccacctaaatcaccgatccctccccaggacaatgacgctcgtggacctgcccggcatcacgcgtgtgcccgtgggtgaccagcccaacgacatcgaggcgcgggtgcgtgccatggtgctggactacatcgctgcggagtcgtgcatcatcctggcggtgacccccgccaaccaggacccggccgcctccgacgcgctggagctggcgcggcgcgccgaccccgcaggcgcgcgcaccatcggcgtgctgaccaagctggacctgatggaccgcgggaccgacgcggtggccgcgctgcgcaacgaggtggtccccctgcgcctgggtcacgtgggcgtggtcctgcgcagccaggaggacatcgccagccggcgcggcatggccgaggcgcgcgccgcggagcgcgccttcttcgaggcgcggcccgtttatgcagaagtagcagcggcctgcggcgtgccgcgcctggccgcggggctgaacgcggtgctggcggcgcacgtgcgcgccgcgctgcccgcgctgcgcacc

SEQ ID NO: 2450 - DNA, 651 bp, Chlorella protothecoides
atgttccaggccctctcgcagcccacgcccgcctcccgagtcctacccagcaccacatatcgcgttttatgcatcgcaggtcgggtgcagctcgacgagctgggcctgtccagtgatgcgtgcctccccatagatcgggacacgcctggcgccgcccagcccattcgctacctgcacatctttgaggacggcgaggtgtccctgggcatcttctgcctgcccaagggtgcctgcatcccgctgcacaaccaccccggcatgaccgtcttctcccgggccctgctcggacgcgtgcacgtgctttcctttgactgggcggaagcccacaccgacgccatggcaggcactgcggagggcgctgctgcccccgcacgggaggcgcggcgcgtgctggactgcgtcatgggctccggcgacgacccagccctgctgcagcccacctccggcgggaacatccaccagttcaccgccgtcacagactgcgcggtgctggacctcctgacgcccccctatagcctcgacgacggacgtgactgcacctactaccacgtcgaggggccaggttctggggacggcaccttcctgctgagggaggccgagccgccctcagactttgtcgtgggtgcgctggggatgtatgactggggctga

SEQ ID NO: 2451 - DNA, 1503 bp, Chlorella protothecoides
ccccccctccctcctcgccttgatgctctccgtcctcctcttcagctgcttgtagaaggccggcgcgatgccgcgctgcaccagcaggcgcgaggtggagctgcagatctgtccgttggtccagaacacgccaaacatggcccactccaccgcgcgcgccacgtcggcgtcgtcgaagacgatgagcgccgacttgccacccagctccatgactgccgggcgcaggttccgggcggctgccaggtacaccgcacgccccgtgcccgtggacccggtgaaggccaccttggcgacgcgcgggtcggcggacagcggcgcgccggcgtcagggcccaggcccgtgaccacgttgagcgcgccggggggcaggccggcgcccgcggcgatgcccgccagctccaggctggtcagcgaggcggcctcgctgggtttcagcaccgccgcgttgccggccgccagcgcgggggccaccttccacgtgctcatcagcagcgggtagttccagggcgtgatgagggccaccacgcccagcgggtcgcggcgcagcgcacactcaaacccctcggcgccgaggtccacaggctcgtactgccgcgcgtccagggccgccgccaggtcggcgtagtagtcgaagcaggtggccacgtcgtcctgccacaagggaggtggaggagagaatgggtgatcgtgcattgctctgagctaggaggctaccctggcagccaccctcttaatctttgccccagcacaccagtgcagacagacacaggtcactggaaagcgtccatacaaccccatagcacaccaatgcacaccacccaacgcaccacatcccactccgcctcggccaagggtttgccattgtcgaggctctccagggtggccaggaaggcatacaggcacaaagccctgggcacagaaccaccaccctcctgtcccccaaaccccatccccaatcacacacaccttgtcggcgatggcatgcaggatcttggcgcggtatgcgcccgtggaccgggtccactcgccgctgtccacgcaggcctgggcagccgagacggcggcatcgacatccgccggggtggcagcggggatggtgccaatctcctcctcggtggaggggttgatgacgggcagacgaccacccttgacgggctcaacccatcgaccgccaatgaagagctggcgcttggggatcgcgacggacatccttgggctcgggctggcactagggttggagcgctctttgcgcccttccattaccctagcaccgggtgccgagacggaccgaccggaagctcggccatttcacgcgtagcagcagcatgggggccctccccacgcacacaatgcttctcctttccagcgtcagaactgtggcgcgctgtatatccaagccagcgtatcgatcaacctatcaaagcagggcttccactgttcccagagtggttccttaagaacactgggctgacacagacaggatgctctgccccagggtgttga

SEQ ID NO: 2452 - DNA, 999 bp, Chlorella protothecoides
  modified_base (819)..(891): a, c, t, g, unknown or other
atgcgacgccgccgaggaagcgtgcgaggacgcgctggaggcggaggcgcggcagcgtctgcccgccgcgcgccgcttccggcgccggcacgaggagtgcctggccaggttcgctcgggcctgcgtcgggcccgcgcgcaccgcgcactcaggcgcgtggattgtgttgtgaatttgcacgtgagggagggggtggagtgcagggaaaggctgacgtgtgagtcgggatgtatgcacaacctgttccccgatctccgcctcatgacgcccagtccaccctcgctctcgacaaagtataatgcaaacccacccctccccacagagcgcctggcaaaggcctgggagagggagcacacccgcttcctggcggactacaacgccaggctactcaacggcctgaccctctgcagcatcgccggcatcctcctcttcagattcgtagtccgtgtgcagctgggggagagcgtcgcctggggcgcgtttgtgttcttccaggtgtgctgggcagcggggagtgtttggtggccttgcccgaggggagcgagtaggtgtggtgtcatctgcaaggtgggcgtgtacctcaggacactcctcactgctcccagtggacaactccgaaacagcactagccaccactcagtgccatgcagatcaacccaccctgatgacgcacaccatgacagcgcacccaacccgaatcgagcaggtgtacccgcgctccttcctgggggatgccagcatgtacgaccaggcatggtggcagggcctggtgtcggggtgggaggcagtggcctccaaccctttcctagacctggagcnnnnnnnnnnnnnnnnnnnnnnnnnnnnnnnnnnnnnnnnnnnnnnnnnnnnnnnnnnnnnnnnnnnnnnnnncctcctcctggccaccaggaggtggtggaagccgagggccatgctggcgctgcggcgctggaggcgccggcgacgaggccaggcggccaaggagagcgccgaacgtga

SEQ ID NO: 2453 - DNA, 1278 bp, Chlorella protothecoides
atggtggactacttcctgaccaacaacgtgctggcccactttgcccagatcctgcagcagcgcgccaaccgccgcggcggcgtggcccagcaggtgctgcagacgctgtccatcctgctgcagaacgtgcgcacgcagcagacggtgtactacctgttcagcaacaaccacatcaacgacatcgtgggcatggcctttgacttcgaggacgacgaggtgctggggtactacatcaacctgctgaagaccatcagcctgcgactgaacgaggccactgtccagttcttcttccaggcgggggggcccgggacgcccgcctccctccccctctacagcgaggcggtgaagttcatcaaccaccgcgacggcatggtccgcgccgcggtcaaaaccctgaccctgaacgtgtacgccatccccctccccgccctgcatgcctacctcaccgccccgcccgcggccggctacctggacagcctggccacctacctggcggagcagtgcggggagctggaccggcggctggccgccgcggaggccgccagccccgccgcggctggcgcgctggccgcctgcctggccgagatcgaggacatgctgtcctactgcaacgacatcctggccacgggcgtggagcccctcagcgccctgctcctcgaccgcctctggtcggtgctggtggggccggtgctcttctggcccctcatccaggacgacgtggcggtcgcgcacatcgctaccctggcgcaccaggcggaccaagatcagcagggacaggggacgggcggggtgggtggagcgcatgcgcgtcccgcgccgcccgcgccgctgcagaggggcgtggtcggacccctggcctccctttacgtcctcgagcgcctgctcttcgcggtgctggacacccccttcctgtcggcgctggtgggggcgctgctgggtgccgcgcgcgcgcccggcgcggcgctggcgcagcaccattcggcgccgccggtcggcggccagcagcagccgctgccggcccacctgcgggcgctgctgcagtatgagcccgcggcgtaccgcggcgccctgctgggcatgctgcacggcggcgagccacagctcgcggcggctgccgcgcgcctgctggccgccctgctccgctcccgcaccctggacgagggcctgctagagggcattggtgcgtggtggaggaatcttcttttggggtgtaaagggcacatggcggttggactggcttgtttgctagagtgggagaggggatcgctggatgggtga

SEQ ID NO: 2454 - DNA, 402 bp, Chlorella protothecoides
atggggctggtgggggaggggacgggcacgggatcagcggggctgaagccaggaatttcgccgccgggggcgatgccaccctcgccctcaggctcggtggcggggagagcctcaacggtgggctcggaggcgggggcggcctcggttgtgggctcggaggtaggggcagcctcggttgtgggctccgaggtaggggcagcctcggacacgggggatgaggtctcgcctgcaggggtggcggcctcggtggtgggggaggaggtctcaccggtgggggcggcggcctcggtagtgggggaggaggtctcgccagtgggggcggcaccccctgcgactggcgaagacgtctcggcggtgggagaggaggtggcagcgccaggggaggaggtctcgggggagggg

SEQ ID NO: 2455 - DNA, 1461 bp, Chlorella protothecoides
  modified_base (942)..(951): a, c, t, g, unknown or other
gggcgtgctggggcacgccgccgcgcgcctgctggccgagcaccccgccaccgccgacggggcggccgccgagctcctggcgcggcgcgaacccggggtcaacgacggctcggccctgggcgcgccctccagccacccctccgacaccgcgggcagcgagctggcgcgggccaaggcctcggaggtggacgccatcctgtcgggaggcagcgaggatgtcagcctgggcctggcctcccagttctccccggtcctggccgacaagaacaggcaatcgtcgaggctgggcctgggaggaatctgagccagcctgtccccgggcatccacctggagcctgctcgaatctgagccagcctgtcctcgggcatcctcctggagcctgctggaggtggaggacctgctggcggggagaactgcgccggaggccagcccctggggcaacggcgcgtcggcgggcgccggcagcgacgtcgccgtgttcgagacctttggcaccacgcgggcctctggaggtgcgcgtgcgtgtgtgtgtgtgtaagtgtatgggcagcccattgtcttcctttggggggtccggagggcgaggcggagcaaggtcgggtatttgtgtgcatgcacactggagtgtggtggggcaagcaggagaggggtttgcggcagtgtccaaggggggggaaaggttcatggtgccccagcgccccacaagctcagctgtgtggaaccaggtgcggccacccagccctcccccggccccccttcacaggctcgccggatgccacgccgagggcgaggcggagcagggtcgggtacttgtgtggatgcacactggagtgtggtggggcgaacaggagagggtttgtggcagtgtccaggggggggaggttcatggtgccccggcgccccacaagctcagctatgtggaaccacgtgcggccaccctnnnnnnnnnngagacggaggcgggggagggagggtgggccgccgccggcccgcccgccggcgcgccgcacggcccgcgcatcgccaccgtggcgcacatgttcatcgcagactacagccagcccgacgagctgtcggtgttcgagggcgacgcggtgaggggcgtgggatcctgggggagggtgcagggacggggttcttggggtgctggtagtgtcgatggaggaggaggagagggcggtgggtacgacagcccatgcggaccactccatctcgccgaccccagcctcccccctcgacccatgacacacacacacacccgacacacaaaggtggaggtgctggaggagtcggagggctgggccctggtcaaggacccctccggtgcgcagggcctggtgccgctgtcctacctggcattcccctctgccggcggcgccaacggcggcgcggcccgccccgacgggtccttcggggacgcgggcggcgtgacgcgccgctcgcgctcgctgtcgcgcacg

SEQ ID NO: 2456 - DNA, 822 bp, Chlorella protothecoides
  modified_base (206)..(215): a, c, t, g, unknown or other
  modified_base (419)..(428): a, c, t, g, unknown or other
  modified_base (736)..(745): a, c, t, g, unknown or other
atgggcctcttctacggctacgtgggagtcgtgggcctggcgctgtatgccgcgctgcgatacttccgcgccggcgtgtcccttgcccacgtctggtgcacctacggtgggctgtggtggggcgcgcggcgcgggcgcagacccttccacggccgagcatgccctgcaatgccgtgccggggggggggggttcacgcaccgtccannnnnnnnnnttggtgcacctacggtgggctgtggtgggacgcgcggcgcgggcgcagacccttcaacggccgagcatgccctgcgatgccgtgccgcgggggacgttcacgcaccgtccatggcatctggggtgtcctcgcctacccattccacgagcctgtcaaaacccgatcccctgccccaaaccccgctgctcgacaggctacgcgctnnnnnnnnnnatacctgtcaaaccctgatcccctgcctcaaaccccgctgctcgacaggctacgcgctggcggtgttcatccccatggcctttgtctgtgtgttccctgtggagatcatgcgctgggtggtggtgggcgtggccaccctgaccagcggcatcttcatcctcagcagcttccgggtggcggtggtggaggccgcgggcgccaagtctgtgccgctctttcttgtcatggccgccctgcacgccggcctgggcctggccctcaagctctacttcttccgctacgccagcgtctgaggcccagtggcttgnnnnnnnnnngaagcggtccctttgacggtcttttccccttcttgttcctgtcttgtccgcactccactctgcaagcaccagagtga

SEQ ID NO: 2457 - DNA, 864 bp, Chlorella protothecoides
atgccctccaacccctttccccacacaggcggtgccttccccgagatacacgttgcccagtaccccttggagatgggccgccccaaccagcggcccggcggtgcggggcgcacggaccagaccgtggccctgagcgtgaatgcggagggcgaggtgaactacgacgcggtggtgcggcagggcaaggacgcgcagaagtgggtggccaccacccatgccgcgctggtgcccaagctggagcagctcaactccgacatgccccgccccgacgaggaggaggtggaggcggcagccaaggagaccgcggccgcgctgcaggcagtggtctcgcgcaagcaggcggcggtgaaccccaagacgctgccctcgcagccgggcgcgccgcagtacatcaagtacacccccgcgcagtcggggggcgcacacaactcgggcgcggcaacgcgcatcatcaagatgcaggacatgcccgtggaccccatggagccgcccaagttccggcacatcaaggtgccgcgcgggcctgggtcgcccccggtccccgtcatgcactcccccccccgcgcgctgacggtgcaggaccaggcggactggaagatcccgccctgcatctccaactggaagaacagcaaggggtacaccatcccgctggacaagcgcctggccgccgacgggcgcgggctgcaggaggtccagatcaacgaccagttcgccaagttcaccgaggcgctgtacatcgccgagcagaaggcgcgcgcctcagtggacgcgcgcgccaagatgcagcgcgagctcctggcgcgcgaaaaagaaagcaaggagcaggagctgcgcgatctggccgcccgcgcgcgcatggaccgc

SEQ ID NO: 2458 - DNA, 393 bp, Chlorella protothecoides
atgtccctgctgcgtgggctggagcagcccgccaaggctctgggccggggatgcttttccaccagcaccggactccaggcggctgcccctgccctggcgaagacggcagagaagggtttcctgtccggcctcttcggtggctccaacagggtgaccacccccctcactgaccccctgcccggcgtgcagctgcccacccccgccccagccccctcctcccgccctgagacccacatcaccaccctctccaacggcgtgaaggtcgccagcgagaacaccccgggtgcgacggccacccttggcatctatgtggagtctgggagcgtgaatgagacccccgccaactctggtgaggcgactgggcgtagcagggagcccgtgctctggctgtag

SEQ ID NO: 2459 - DNA, 279 bp, Chlorella protothecoides
atgtcgttgcttgcttccctgcctgcgcctgtgaagacatacaccgctcccgatgctcctgcgccgacgggacccagcggcgaggattcgcggcgaccggtcaaggaggtgcctccctatggccggcgacagggattcgtgcctcgccgggtggacgacttcggcgggggtgagcggaaaggggatggcgagcaccgggctgcacccggacctggcagcgcggcgctgagttcctttcgagatttgaatggatcaattaagacctcatttgatagttga

SEQ ID NO: 2460 - DNA, 225 bp, Chlorella protothecoides
atgcccgcgccggggtacaaagagaaggtgtgggaccacgctgcgggtgcggtgctggtcaccgaggcgggtggctgcatctccgactgccacgggcggccgctggactttggggcggggcggttcctggagggcctgcagggcggcatcatcgccgcggcgcccccgaccctgcacgccgcactggtccgcgcgtacacagaggctgccgctgtcgacgcgtga

SEQ ID NO: 2461 - DNA, 627 bp, Chlorella protothecoides
atgccttgcgcctcacctcgcccggccctctgccccctgacaggcgtctcccacctgctggagtacctggccttcaagtccacggcgcaccgcacccacctgcgcctggtacgcgacgtggaggccctgggcgccaacgtgctggcctccgcctcgcgcgagcagatggcctacaccattgacctgccccgcacgctggtgcccgaagccctggaggtcctggccgacgcggtgctggcgccgcgcctggcgccgcacgaggtgcgggacgccgccgccaagctggaggccgacctgaagggcctggccgacaacccgcagctggcgctgcttgagggcctgcacgccgccgcctactcgggtgacctgggcaagcccctgatcgcggctgagggggccgcggcacgcctcaccccggcagacatcgccgacttcctggcggagaactacaccgcgccgcgcatcgtgctgtccggaggtgagggccggcgccggggaaggtgggggtcaaggcgccatgcctgggccgacagcgctccgcgggtttgccaccgcctgcgaccccgggcggcgtcgttcatgagggcttggccgggcgtcgccggccctgcactggcgcacccgtga

SEQ ID NO: 2462 - DNA, 636 bp, Chlorella protothecoides
atggcccaggagggcggtctcctgacttgccacctggcaggagtgctgcagacgcaagcgggaggctggagcctgctaaactccttgccgagagatggcatccataaactacgcctcctctccctgacaccacatgctgagcagtcgtggacgggggagggcaatgcagccagcatgcctctcaggcagctgacgcgtggcttggctggcagtgtagaggcagagagtggtgcagagagcagatattccatctcgaacgctgccccggagactgaggaggctagtcaacctcatcttcaggcgggggatgaggagcttggtgaggcatcgacctgtgcagggtcaaggaatgagctagggtacatatccctggagccggactcttccagacaccgacccagacaagacaccaagccagacatggtatgggttgagctgtgggctcgcacaccgaaaacaggccttgcgtcaatcttgaactttcggcgtgtggatgtctgtgaggagctgctgcgacaggggatggagtctggtgcggatgcagctctcccccatcgcgtagacacggggaaggataccttctttgacgtttaccttctgacggctgggtgcgtttggcacagggaagcggcgtga

SEQ ID NO: 2463 - DNA, 1116 bp, Chlorella protothecoides
atgtccaatgaccatgcctcaacccatcatccttcccttctttccaaggtggattccggttgcctgcccgacgatgcggccgtgctgcagctgtgccgctccctgcgcagcctgcttgggcgagaggaggccaacggcacgagtaatggcgccgccggccccggcccccacccgcgctccgacttccacgcgctggagcgcggccctgtgctgatgggggagctgggcgacgccgcgccgcacccctccgacctgctgtctggccgcgccctgatccaggggcggtaccaggagggggaggaggaggagttcacggtgatgcggcccaaggacgtgctgaagctgcgcaagcagaatgagcgcgcggagaaggtgcagcgcgcggccttcgcggtgcaccaggcccaggccctggcggccatgaagggcaagcgcgtgacggtgctgcgcaacgcgggcggcaccgccgtccgcgacatccacttggagcgcttctctgtgtccaacggcggcgcggacctgatcgacgacgccacgatcaccctggcccatgcgcacaagtacgggctggtggggcgcaacggcacggggaagaccaccttcctgcgcgcgctggcggagggcgagatcaagggcgtccccgccaactgccaggtcttgcacgtggagcaggaggtgatgggggacgaggtgtccgccctggacgccgtgctgtccaccgacctggagcgcgccgagctgctggccgaggagcaggtgctgctgcaggcgctggaggaggtgggcggcgcggccgacgcgggggagggcgagggcgccgcgcccgcgcgcgacgccacgccggaggaggaggggcgggtggccgagctggcggggcgcctggaggatgtcagcaagcgcctgctggagatcgacgcgtacggcgccgagagtcgggcggccagcatcctgtccggcctgtccttcaccaaggagatgatggtgagtgtcgtgtgttgcgcggggggggtggggggttatgttgaccttggggctggtggacagggggagttggggtacccagtgagttcagggacatggggtgaggcagggagatggaggggcgcacccatctga

SEQ ID NO: 2464 - DNA, 615 bp, Chlorella protothecoides
  modified_base (578)..(587): a, c, t, g, unknown or other
atggggtcggggttgtgtggagtgtggcaggatttcaaagggtgtgtggcccccccccaccctgcctcctcctgtgtgtacggctgctgcaatgaagaggagactgtccaccgcttcctggagcctgcctcctgtgcggctccagtgacgaatcacacccccaaaccttccacccctggtcacctttgccccgcagggcacagcgccgaggtgaacagcctgcggtggggcccctgggacagccgccacctgctggccagcgccggcgccgacggcctggtccagatcttcgaccccgacaccggcacggtggtgcaccgcctggaccgccacggcgccaacgtgccgcacctgcgctggagccccgcgggcgagtatctggccaccggggatgaactgggccaggtcctggtctggtccaccaagtcgggggctgtggtgcgcagcctgcaggtgggcggcgatgcgggcttggggggggtctcatctggaggtgggacttgggagggatgcaactggctgagtgctgaggttgggggaagcaacggaagggagccgcagcgtcaatggcgcgtcannnnnnnnnngggagggatgcaactggctgagtgctga

SEQ ID NO: 2465 - DNA, 1092 bp, Chlorella protothecoides
  modified_base (186)..(195): a, c, t, g, unknown or other
  modified_base (831)..(840): a, c, t, g, unknown or other
atgccgccgaaattcgaccccaactcgattatcgaggtgcggggcggggcggggatgccagggggcggaggggccatcctccgagcgctcgcagggggctggggcggtcgtgaaccttgtggcgcccagtataatcaggtatgtccatcccaccgtgcaggtctacgtccgggcaaccggcggcgnnnnnnnnnncaacctcgtggcgcccagtataatcaggcatgtctatcccaccatgcaggtctacgtccgggcaaccggcggcgaagtcggtgcggcctcgtccctggccccgaagattggacccctgggcctgtcccccaagaaggtgcgaggggggggtggggtctgaggagcgttcgacagggtgtggcgccaagccatccacatgatcctcaagcatcgttgccgacccagcatccgctttcccgcccccagattggtgaggacatcgctaaggagaccgccaaggaatggaagggcttgcgtgtgaccgtcaagctgaccgtgcagaaccggcaggctaaggtgtccgtcatcccgtccgccgcctccctggtcatcaaggccctgaaggagcccgtgcgcgacaggaagaaggagaagaacatcgtgcactccggcaacctggcgctcgaggatgtgtacgagatcgcccgcatcatgcgcgaccgctcctgcgcggccggcttcgcggggaccgtcaaggagatcctgggcacgtgcgtgtcggttggctgccaggtggacaacgaggacccccgcgacatccagcaaaaggtgcgattgaggattgccgtttctgagccgcaacatattactacagcnnnnnnnnnnggcggcggtggagcagggtggcatgattgtgtgagacggggggtgggcgcctgctggggagcagaggtgccgcgagttgagcgcagtggctctctgtgccataccagattgaggattggcgtttctgagccgcaacatattactacagcccttcttaccggcaagtattcccgttactcccttctcagatcgacgatggcgagctcgaggtgccaagtgcatagacttgacgcgatggctctggccttgtaa

SEQ ID NO: 2466 - DNA, 597 bp, Chlorella protothecoides
atgcggcgcgagggcgtcgacgacgactcgcgctacctcgccaacatgggcgtctacgtcttccggcgggaggccctgttccgcctgctcagccccgccaagaagcaggccatcacgcacatcgggcaccatgtggtcccgaatgccctggcccaggagatgaaggtgtacgcctacctccacgacggtgggtgggtggttgaggggctggtgggagggaggaggagcgggaggaaggagtcaaagatgtcatcgagtatggtggggagtttgacgggcgggtgctgtgttgttggcaagctcaagctacaggccaggcaggctaccgcccgaatccgcccccttgcgcatgtccgaccctctccacatctccacaccgcaggttactggcacgacgtgagcagcctgaaagacttttacgagaccaacctggacctgtctgacgaggactcgcccatcaagtccgacatgtcggtggcggcgcgggggtccatgctcccccccgcccagctgcacgacgccgacatcacacgcacaatcgtcggcgacggcgccgtcctggtggtgaggggatgggaggcatggcgctgggtttga

SEQ ID NO: 2467 - DNA, 726 bp, Chlorella protothecoides
atggccctcacctccgaccatgtcaatttcctggtgtaccgctaccttttggaggctggcttcgcccacaccgccttcacctttggcgcggagagctccatcctgaactccggcctgcccggcgccgacgtgcccgtgggcacgctggtcagcatcctgcagaagggcttccagtttgccgagctggaggccaacctgacggaggagtccaccgacgtctttggcgagttcacgccgctgtcggcggaggccatcatgaccggggatgtggaggagctgcgcgccaccgttcgcgagtggcacgagaagcgtgacgccgccgcgctggacgtgctggcctcggggccggaggagctggaccctggtgcctgcctggggctggggggcgcggaggggcccgtgtatgcctgcccctgggccccggccggcccccctcgcctcgcggcggggttcgcggacggcagcctgcgcctgtgggactttcccgagggcactagggagccaccgcccacgccccgtgtctgcgccacggggggagagatcaccgcgatagagtggtcgccggggtcgagcctgctggccgtggcactcatggacggcagcatccagatctgggaggccgacggtgcgtgtgtgctgtacagtgtggggctcccacgcttgccaaggtcgcaggggctgtgtggggctcccacggttgccaaggtcgcagggctggtggcttga

SEQ ID NO: 2468 - DNA, 984 bp, Chlorella protothecoides
  modified_base (610)..(619): a, c, t, g, unknown or other
atggctccgcccaaggcacctgccggcatggctccgccccaggcccccgccggcatggcaccggctaaagcgcctcctggcatggcaccggctaaagcgcctcctggcatggctccgcccagactgcccacgggaatggatactccagaactgcccactgccatggcacccaccagagtacctcctggcatggcgccacccaccctgcctgctggattggcgccgccagttcgccgcgcggggcaacccgcgcaggcagccctcgtcgcaggcgacgggtcccgacctctggatggcgcaacgccaccgggtgcagaaattctccgtcaggggctcgaaatgcctggtgcagcggggaaggagactgcccgtgtcgcgctggaggcgttcgagggcctgctgcgcgcgctgggcatccacgccttctcgcgctgggagaaggaggtgcccaggatgcaggccgaccccagatataaggcgagcaaggatgcgatgtcgggttggagccatgcatgtttcgtgcgcacaaggggctgtttggggcagcatgcttgtgcgtggtgcaggagttcccaccgcatgcagatgagggccactcgtgcgacagttnnnnnnnnnnccttctcgcgctgggagaaggaggtgcccaagatgcaggtcgaccccagatacaaggcgagcaaggatgcgatgtcaggttggagccgtgcatatttcgcgctgcctccgacggagcggagggcggccttcgaagcctactgcgcgaagcaggggagtgcgaagaagcctgcccagagcggcggtaggaggggtcctccggggctgaagccggcgggtgcagatgcaggcgagcaactcggcgaggagcttcctgccgctgacgccgaaaaggccttcatgtgcgtcccaaggccgtgtctgtgggtggggatgaagggttggggtgtcttggcttacgggcaggggcagctttcgtggtgctga

SEQ ID NO: 2469 - DNA, 849 bp, Chlorella protothecoides
  modified_base (54)..(63): a, c, t, g, unknown or other
  modified_base (294)..(303): a, c, t, g, unknown or other
  modified_base (435)..(486): a, c, t, g, unknown or other
  modified_base (621)..(678): a, c, t, g, unknown or other
atgacgtcgcggtgtcctcggcggcccccgcgctggatcactgggtggtggacnnnnnnnnnncgccatcccggggatctacggccgcctgggcgacctgggcgcggtggacgcgcggtacgacgtcgcggcgtcctcggccgcccccgcgctggatcactgggtggtggactccaccgccaccgcgcagcgctgcgtggagctgctgaggtcgcgcggactgggcgtggccacctttctgatcctggaccgccaagcggggctggcggccgcggccggcgcaccgccgcccgnnnnnnnnnngcgccgcgcctgtacgacctggtgcgttgcggcgacgagcgcatgcgccccgccttcttcttcgcgctgcgcgacacgctggtggcggccgacctggaccaggccgcgcgcatcgcctacggcccggacccnnnnnnnnnnnnnnnnnnnnnnnnnnnnnnnnnnnnnnnnnnnnnnnnnnnntggcggcgcgtcgtgacgttggccggcgaggtgatcaacgaggcggggaccctgagcggcggcggcgggcggcccaaggggggccgcatcgcgctgggtaccgccgcgccgcgcgccggcgccgcttccagtggnnnnnnnnnnnnnnnnnnnnnnnnnnnnnnnnnnnnnnnnnnnnnnnnnnnnnnnnnngctgcggagctggcgggcgccgagaaggagttgggagaggcggagggggtgtcgagtcgtgcggcggaggctctgtcgcgcgcagaggcggagttgacggcggcccgcgccgcgctggcgtcgtccgagtcggcgctgccgcgtgcacggctggacgcggaggccgccgcg

SEQ ID NO: 2470 - DNA, 843 bp, Chlorella protothecoides
  modified_base (242)..(251): a, c, t, g, unknown or other
atggcggcggcactggagcgcgccaacgaggagttcaaggagtacgagcgcaaggacatcgcgtaccgcgaggagctcaagcacctgaaggccaagctggccaagactgcggagcgcgagcgccgcgacgccgcgcggctagagagcgcggaggccgaggccgcggcggccgaggccgaggcgccggcgctgctggaggccgcggccaaactgggcgcgcagctgacgcgggaggaggcccnnnnnnnnnnataccgcgaggagctcaagcacctaaaggccaagctggccaagactgcggagcgtgagcgccgcgacgccgcgcggctggagagcacggaggccgaggccgcagcggctgaggccgaggtgccggcgctgctggaggctgcggccaaactgggtgcgcagctgacgcgggaggaggcccggctggaggcggcgctggagggcgtggcgggggagggcgagacgctgcgcacgaagctgcgtgccgcgcgcgcggagctggcgccctgggaggcgcgcggcctcggcgctggaggccgcgcgggacgaactcgaggaggcgctggggcgcgcggcgcgcgagcgcgaggcggctgcggagttggaggccggcgcggggggtctgcgggacagggtgtcgaccgcgcagcgcgccgtgagggaggcagagcaggaagctcagagggcggagtccgccgcgcgaaccttgcgtggctctgtggcccagcgccgggcggagcggacctccgccagctcggcctcggcggtggcccaggccctggcctcggccaaggcgcgcggtgccatcccggggatctacggccgcctgggtga

SEQ ID NO: 2471 - DNA, 327 bp, Chlorella protothecoides
atgcaggtgcgtgtggaggctcggtgccaccccgctctccaccaggaaactctgtccattggcctcttctcatcccccaccgtcgaatgccatgccgacaggatggcggaggccatggcgagccggaatgagggcggcgccgccagcgccaagcccgccgagccggaggcggaggaggagggcgaggaggtggacgagtctggcgtggaggccaaggacatcgaactggtcatgacccaggcgagcgtgtctcgtagcaaggcggtgaaggcgctccgggcggcagacaacgacatcgtgactgccatcatggagttgaccatgtga

SEQ ID NO: 2472 - DNA, 525 bp, Chlorella protothecoides
atggcccagccgcgcaagtacgagagcctgcgcggcgcggtgctggcgcgccgcgccatcgtgctccccgccttcgagcccggggacgctggggacgtgggcgtggaggtggcgcgcggcgcggtgctcgggggcaaggcggcggcggccgccatgtcgcgcgacgggcggctgaagccgttccacacggaccgctaccgcgcagggcaccgcgcgaccgattacgcgcgctggctcactgcgcgcacgccctaccacatccggtacgaggaggggtacgagccctacgtcctggtggcgcgccgcttcgtgccctggtacgacgagcgcttcgtggggtaccgcaagaacaaggtggtgcacctgctgcacctggcgcagcagggcacgctgttcgtggtgcaccccaacgccttcaccgtgcactccccccacccgcgcgcccgcacctggaaggtcacgcgcaagacgggactctgggaccaggtgggcttgggaggtggaaagggggggaggggggggtaa

SEQ ID NO: 2473 - DNA, 393 bp, Chlorella protothecoides
atggagaggccggtgagctcttggcagggcagtctcctgaccggattctatctgctttgcggatctaagggtagcgccgtggctctgacctctccccctcccctgccttccccatgggcaggcgatgatgagtcgggccgcagcaagcagagccgatcggagaagaagagccggaaggccatgcagaagctgggcatgaagcccgtgcctggcattgcccgcgtccagatcaagaagagcaagaacatcctgtttgtgatgaccaagcccgatgtgttcaagaaccccacctccgacacctacgtcatctttggcgaggccaagattgaggatctgtctgcccaggccgccgccggcgcagcagagcagttcaggtgcggagaggcgggttga

SEQ ID NO: 2474 - DNA, 465 bp, Chlorella protothecoides
atggtgggggagagcgatgccaggcctcagcgcctcatcatcaccgagatggtgctggaaaacttcaagtcgtacgccggggaacagcgtgtcggcccttttcacaaggtgggatggagcgcctgggttagcagaggtgcttggacgacatcggtacctatgtgcccgacattctgctcattgccatggcacctccctacatccacgcagtgcttctcctccgtggtgggtcccaacggaagtggcaagtccaacgtcattgacgccatgctcttcgtgttcggcaagcgcgccaagcagctccgcctgaacaaggtgtcggaactgatccacaactctgcggggcgccaaggcatcgagcaggcccaggtctccgtccacttccaagagatcatcgacacggtgaggggtgcagcggccgggcttgtacagtcggcgcagcttcttctctgttgcggagattga

SEQ ID NO: 2475 - DNA, 636 bp, Chlorella protothecoides
atggcaccggggcgctccatcccggggctgcagctgctgagaaccctcatcatagcggtgcgcagctcccgtggcggtatggggcgctccttgatacctgctgctgtttgcagcccccaaccaaccctatgctctgtgcacacacacctgtctctgcgcccctctccccagggcctgctggctgccgcgcatggcgacctcacgaccgacgaccagttcttgtgccccacgccgcacgccatccccaacctgcccatcctgaaaacggaggccagcatcagctcagggaaggagcgggctccaaccgacgtcaccctggttacacagctctccttcgagcgattacaaccaactcccaacaacagactgtacatgctggagggtcagtgcgacgtctggagcgggaccatctccgctgccgtgtacatcgccctggtgggtgggaaggccgtgagcgtggagctgaacagcaaccaagacccacacctcatagccctgagccgggtggtggctgccttccggcagtttcacgagctggcggagcagaaaggtgtggcaatgcgctggctcgcgtgcttggggtgtgcaagggagaggatgagcctggttgagctgagcactaggatcagcacttga

SEQ ID NO: 2476 - DNA, 420 bp, Chlorella protothecoides
atgatgaagcccaaggcccagaccgagcatgagacggggctgctggaatacctggaagacatcatcggcaccaaccgcttcattgagcccctggccgactccgccaagaggctggagacgctgggcgaggcccgggcggggctggtcgcgcggctgaagatcgcggagcgggagcgcgaggcgctggaggcggataagctggctgccgaggcctggctggacaaggaacgggaggcctgcgccgcgcagcggctgctgagccacgtgctggcgcaccaggcgcaaatgaatgtggacaagatccagggcaaccaggcgagcctggaggggaagctggcctacgagcgcgagaagctggggcagtacagtgcggtactggaggagcacgaggccaggtgtgtgtgtgttgggggcgggtga

SEQ ID NO: 2477 - DNA, 348 bp, Chlorella protothecoides
gccgccgccgccaccgcacacctgtcggcgctgggcgcgctgggcgcgcgcgggtcggcggccatcgccgccgcctgcgacctgcggccgcgcctggcggcgcagtgcctgcgcaacctggagcggtacgagggggcgggggcgggggaggagggcgccacgctggccccgctggccaccgccacgctgaccagcctgcgtggcttcgacgacgacgccttccgcgcgcatgtgcacgacctcttcccgcgcctggtggcgctgatcgccgcggagggcgcgccgccggaactgcgccgcgcgctctccgacctgttcctgcaccgtgtgggggccatgctggtctga

SEQ ID NO: 2478 - DNA, 2394 bp, Chlorella protothecoides
  modified_base (789)..(859): a, c, t, g, unknown or other
  modified_base (992)..(1001): a, c, t, g, unknown or other
  modified_base (1093)..(1102): a, c, t, g, unknown or other
atgcccacagaggagcctgccttccagtctgaggcaaagcctggccagcccatcaaacttccagggcaggtgcggaccaggctggggtgggagggtgcacattggcccacccctccatgcaggctgggatggctgcgatctataggacagcgacgccgtagtcaccgtcgcatagcagatgtctgtgggctgcagactgttgtcgccacttccgtgccagagtatgttgagcggggccttttctacgccactcatgtgtcagcctcttgcctcctcgacacagacgcgggtgagggaggaggtcgctctggactggcatgtgtgcttggccactttggcaaatcaagagggctgggcggcgggagcttgcctccgacaaatggtccggaccggcctcccctgccacgcgcagcaaactcaagaaggcatcactttctctgcgccctgtgtaggatcccgggcattgatccttctgactttttcaactacggcctgaatcagaggacgtggaaggattacactgcccgcatagagaagtttcgccaagagttcaccatgcaggtggggtgctcgtgccttgccggcgcagagagaggacgaggatggccctgggacggaccgggcgactcgcgccctgaaccggatccagaccctggatcaggccctgcccggccggcaggaagccactggcggcacgcggtaccccaagtctgccccatcagcagcgagcagcgtcgcagaggcgatgtaccgggcctctgtgaccagcgagaggccggcggtgaggannnnnnnnnnnnnnnnnnnnnnnnnnnnnnnnnnnnnnnnnnnnnnnnnnnnnnnnnnnnnnnnnnnnnnnggacgcctttgccggatggcatccctatctgtggtcttccgcagctcctcggctgtgcagctgcaccacccagctgccctcagccggggctagagctcaacatgcgacctgccgtcccttcccacacgcttcnnnnnnnnnngagggggagcgaggaagcgtggaggggaatatgcaggggtccgatgggagtgcatcgcccagcttccagatgggcgcttggtttaggcattnnnnnnnnnntcctcagccggggctcgaggtccatgtgcgacctgccgtcccttcccacacgcttcaattccctccttgcccccttccctgcagcgtgtcacccatgggcgctccggcagtccctgggaccacatcatcgtgctgacggatggggtgctgcccccagaccccgcacctgtccgcacacaggcggcaggcgcgccacaggggccgagtcccgcccccagcgcaggcgccaagcccaacaggcaaggccaagacgctgccaaggggggcccgagccctgctgcggcgccaggcgtgccgcccgggcccagcgcaccagagccggctgctgccagggcgcccccctcgctgccagggccgccgccgccaggtgcgcccccacccccgacaggtgcccagccccggatcaagccccctccgccccccggctcccccaagcggcagctggacgtccggcacctaccgtcccccagtctgatgcctgcccctgcgcccgtggagggagcgcccgccctccttgccagcatgctgccgcctccattctcgctgccacccaacttcccgcagcccttcctgagctccaacccaggtgggggtacgggggagggaggaggggtgcgcttgggggtacaccaacatcttgtgcgcggtctcgcagggctggcgctctgtctcgtgcgctccagcctctcaagcatcctgagccgcccccgtctccgctggtgcagggaagacggcccaaccgcgcgatgccgccagggagcgcggcagtgaccgccgagacacggggcgagatgaggcacccgccgagggtcggcgcgacggcggccgtcccaggtcacctggagcggaccgacaggaggacaggcgcgaggggggagtgggaaggggaaagggatgtgcgcgcgtgtaccttgcactcatgcttcccacgcgcgagtccttgcacccatgcttcccacgctcgactcgcccgcccccaccctgtgctccccacaggcgcgacttccgattcagggagcgggagagggaggactggcatggtggctggcctgcgcatgccgaggctgcccggggtgcctggtgagacggggctcatcggatgctggtctgtggcctggcaagcgcgaggccagcgaccatgcggcaggtctgggccatcactggggcctgcactgcgcccgcaggcgtgcaccacctcgccacgcgacacccagtccactctgcatcgtccgttgcaggcacagacagcaggatcgaggggcgcgctcgctgcattcgcccgcacgggatag

SEQ ID NO: 2479 - DNA, 627 bp, Chlorella protothecoides
  modified_base (115)..(124): a, c, t, g, unknown or other
  modified_base (185)..(194): a, c, t, g, unknown or other
atgttctgtttgctgccctccgtgcgctggcgccagcaactgcccggccccttctccagacaccacgcctggggcctgctccagcagcgtgcccacttcatgaaacaaatcgacnnnnnnnnnnctcaattgagcttgatgacatgttactcggctaggagggtctatatctccttctttccggnnnnnnnnnnttccgtgcgctggcgccagcaaatgcccggccccttcttcagacaccacgcctggggcctgctccatcagcgtgcccacttcatgaaacaaatcgacaagttcgaattactgggcagctgccgtgcggggcagccgcccgaggtcctcccccagctccagcatttaaacacctggcgcagtgaccggctgcgccagccacatggcatcaccctagtcacccaggcctctgcaggtcgactccacatgctggaaaatcagtgcaccacctactccgacgtcatcgcggcagccgtgtatgtgtctctgttgaatgggcgtttgcacgcaccccaacacagcaccctgcatgggcaaacagtgggcactttacggaaagctgtggccgagttccactccaggatggaagcggaaggtgggttgacgcggctgtag

SEQ ID NO: 2480 - DNA, 771 bp, Chlorella protothecoides
atgggcgcaactttattctcgggggtgcccttcggcgacgttggccaacgccacgccatccgatcctgcgatcaccgacggattggcacgccagctttcacaaccagacggatccggtgcatgcggtgggctacggtctcatgctcgaagggacctgtggtgctgacgcgcgagcacggcaagaatgaggaactggagtcattgctcaagtcaaagaacattgagactcttatattgcccatggtagagactgccaagggccccgacagctgtctgctgcgggaaaagctgcaagatagcgcctttgattgggtctgcctgacatcgccagagtctgcagcagtctatgcaaccgcgtggctggaagcaggaaagccctcgattcccgtcgctgtcgtgggcgatggcacagctcgtgcactggctcgagctacggactccgcttgcgcaccctcttttgttccatctgtggcaaatgcagagcactttggagccgagctaccgcaccaaaccaacacgtctgctcgtgtgctctaccctgccagcgtgcgggcagcaggaacgctgcaatccctccttgaggcgcgaggattctctgtgacccgactcaacacctacgacactctccctgtggaccagttgacggaggagggccttcaccaggctcaacaagcagcactggtggccattgcctcgccatcggcgataaggtacggtgacaatgggagtcccatagaaaggacgctttccaccctctgcatgcgtctgtag

SEQ ID NO: 2481 - DNA, 3141 bp, Chlorella protothecoides
  modified_base (1082)..(1091): a, c, t, g, unknown or other
  modified_base (2699)..(2708): a, c, t, g, unknown or other
atgcacaacccagcggcttgcttgagagaattacaaggactccactgtactatgttcgggatatggctgcgtctggtagattgcctcccccagaacgctactaattgcaattggcagcctgagatgtgtaccatatcatgtcagaatgctaagagtattctctctgttcttcgccaccgcaagcaatccctccgcatgtatcttgcagggatggtctcgagcagtcgcactgtcctgaagaagaatgaatattcaggatcacaaattggcattccagggtggacttgtatgagattttggtgggcagttcctggaagtaggtaccatatcatgccagatgctaagagtattctctctgtttttcgccaccgcaagcaatccctccgcatgtatcttgcagggatggtctcgagcagtcgcactgtcctgaagaagaatgaatattcagggagtattccaagctgtcccatgatctgctacgattactggaaggagggctataagctttcaatgttccattacattgccacctgccctactatagaggagtacgtaagatcagacacgcggttatatctgctctatcgcaccagcgttacccacagcctgctcacatgctcagcgggagatgttaatgctgctcatgtaatttccattgaggatcgtggtgcggttcacgcgacgtctgggtggaaatacgagtcgatctggggagtgttccagtgtaggcatacagggacagtgtacggcatgcccctgttattcttgccatgcagtccgggaagctcttgttcttgcacacaccgaaccccagaagtgacagatgccattaccttgtcgaggataaggagggtcattcagactttacttaccgatggaagagatggtgtctacatcggcattcccgacacttctgagtccactcaccagtattgccaagtcatcgtaattgatcttgcggagactgctggcaacacttctaacagcgtgctacttgacgagaacctgccgtctcacgagttcgggtcgcctagagtgtactcctggagaggcaggaaaagttgtgcctttctgacctcccnnnnnnnnnncatgatctgctacgattactggaaggaggggtataagctttcaatgttccattacagtgccacctgccacactctagaggctctccgtcaaaatcttccacaattacaagaggggaatgagtacgtaggatcagacacgcggttatatctgctctatcgcaccagcgttacccacagcctgctcacatgctcagcgggagatgttaatgctgctcatgtaatttccattgaggatcgtggtgcggttcacgcgacgtctgggtggaaatacgagtcgatctggggagtgttccagtgtaggcatacagggacagtgtacggcatgcccctgttattcttgccatgcagtccgggaagctcttgttcttgcacacaccgaaccccagaagtgacagatgccattaccttgtcgaggataagaagggtcattcagactttacttaccgatggaagagatggtgtctacatcggcattcccgacacttctgagtccactcaccagtattgccaagtcatcgtaattgatcttgcggagactgctggcaacacttctaacagggtgctacttgacgagaccctgccgtctcacgagttcgggtcgcccagaatgtactcctggagaggcagtaaaagttgtgcctttctgacctccacgaccaggcattgctttcctccggatggagcccgggctccgatacgatggctgccggagagccttctacctgcaccactgagcctaagtgaagggacgatggacccatttgccgaactcctcgaggacgtcgagcgggctgtcatcgcccaggagacgtgcagtaaacaggctatggagatcgtgggcaagtgcctggaagaggtgcagcatgctcgtgccatactcggtggtggcagccccgatggcgaggttgtcggagcaacggcgaaggcgttgagcctattgaaggtggacgccaaactggcatctggaaccaagaacctccataaagcagtagggacccttggcaagacaattgacaagaccttcacttcagacatctcgaaagcttggggcggtcagccttcagacacaaatctgctcaaccaggcaattctcgagcatctacaccatgagggccagtttgaggtggcatccaccttggcagccgagacaggcttgtcgcatgcacatgccctgcgacagccatatgaggccatgcatgctgtgctgcagcagatccacagcaagaatctcgatgctgcactggcgtgggtcgagaccaaccgatctcggctagaggaaaccagtgggacactgggctcctttgaatttcatgtcagaaagcaacagacatctgacatcgctgatgttgggcagggtctgcactgggggtgttttctgagatcgtgcaccttcacacccaggatgtggtgccatcccccaggacgtttggcggccttgcagtatgcacgccagcatctacagggctttcagcaaactgagcttaccagcatccagcagctcatgggagcactgtgctttgcacacagcccgaccacccagagtccatacaccaacctcttgggcgatgagggtctgctctgggggtgttttctgagatcgtgcaccgnnnnnnnnnncgcagattttgtgtcgcagtcgtgtgcgcttctggggcaggttagtgggagattgtgcgatggctacttggcgccgtgttactctgtgttgctggggatgcttttgagaccttggcgtggtcgtcgtgtgcgctcctggggcaggttagtgggaggttgtgcgatggctacttggcgccgcgttactctgtgttgctggggatgctttggagaccttggcgtggtcggtgagcagcaaattggcttgtctgatgcgatgtgcactgctttccacgcccccctaatcattgatttctccccctcctcctgccgtcaatcttcgccaggcacaggacagtcccctccttgtaacagtggccgcgggtgcagcttcgctgcccaccattctcaagctcgccaacgtcatgccgatgcagcagggcctcgccgatga

SEQ ID NO: 2482 - DNA, 387 bp, Chlorella protothecoides
atgccctctttcttcctctcagaggaactgcatgagcaggagcagtacaccaggctgcgcgagcggttgcgccagggccgagtgatggtcctccctgccttcgagatgtcccggcaggaggacggcagggaggtggtacacaagcttgcgcaaggcggcaagcctgcactggccaaggcatacaccggcggacaggtggccggattccagatcaagctgtggagccggggtcacatggtcacagattataccaagtggtggaccgccacagagccgtatgccgtcaccttcaaaaaggcaagccgttgttggcgcctgtcgcccaggatgtccatgatgctcaggagaggggaacgaccccctccttgccaatcgggaggggcatga

SEQ ID NO: 2483 - DNA, 933 bp, Chlorella protothecoides
atgacgccgcggcggtgtcagcaggtcggatgtcgccttgctgatcgtcgcttgacgacctgcctcctggtgggtgaagggaatgggtgccgcgccatctcagaagtatgccaaagactcgtgcacagctcgtgcaaagtgctcgtatctgtggaccaccagctgcaatctgcgttgatcgagcgcctggcttcactcggcctgctctgggatgccaatttagaccgccgcctcctgctcccaaccatacccttccccgctgctcagacctcggtggctgtgctttctgtctactactgggcggagctccgacatgtcacctggtcaaaatccaaccaggactcggcagcccagacactctccgaagacttggtgaacgagctgaacgcccagcgtgaggccttcctcgctggagtgcaaaacacgactgtccagagcaattgcaaggcggacaatacctccgagtacctaccccggctcgtcgagcacggaacatggcgcagcgcgcacaggcgcgacgcaccaagtgtcacgctcgtcacccagctctccctggatcggctggacatgctggacgggcagtgcgcgacgtacgctggcgtgattgctgcagcactctacgttcccctggtcaggggagagagggtggtgtcaccagccgccaaggagtatgatggggagccccttgctgcggcctcccgagccctctcggacttccacaaggcgatggagcgtacggcgtccgcctgcactgccccagcccccccccttttgccccgtccacatgcagctgcgtgcaccctggatctgcagctggtgggcgaggagtttgacaccagggcggaggccgggctgtatcccttcaatgccatcaggaacagagctctgatgcttgcccagacggaggcaagccgggtggcggtgcgagtatga

SEQ ID NO: 2484 - DNA, 2481 bp, Chlorella protothecoides
  modified_base (519)..(528): a, c, t, g, unknown or other
  modified_base (1813)..(1822): a, c, t, g, unknown or other
  modified_base (1883)..(1892): a, c, t, g, unknown or other
  modified_base (1944)..(1953): a, c, t, g, unknown or other
  modified_base (2005)..(2014): a, c, t, g, unknown or other
  modified_base (2136)..(2145): a, c, t, g, unknown or other
  modified_base (2221)..(2230): a, c, t, g, unknown or other
atgtcatggcgctcgctgctcttcgcagctctgcttacggtctgtatagtcgcgagcaggagccaggagataggtctgaacgccgactgggaggacgattacctggaggagcggggaacggggccgaatcctcgtcgcctcctggcctcggcctcaaccctgcccacctgcgaggccgacatcttctacaatgtagtggagctcaacccacccagcaacttctcggccgtggtatccatcaccaacaaccgggaggtgtccatgagccactggcagctggtgtggacatatgacaccttcagccatgtcctgctcagcaccaccgatggggcgattgccctgacggcaggctcccccggcggggcgcccgtgcgcctggtagatacctttaccaccgacggcatcgctccagccttgggcatcacacaaaagctgccatgtacatcatggaactccctcgcactgcatcacttcccctcccttgcattctcactccttgtcctggaagggagccaaccnnnnnnnnnnaggtgggctttggggtcagtactaacaaaccaagtgtcgcagccggggctggcatttcaaggtggtccgtgtatgctcattcctagacaaacagccttgggcatcacacaaaaagctgccatgtgcatcatggaactccctcgcactgcatcactccccctcccttgcattctcactcctcgtcctggaagggagccaactcattgcctgccctcccccggcccaggtggcggagcctacgccttcctcaccgttggccagtttgtaccatccggtctctaccccgacgactccttgctggtgaattccgtcaacctaaacggcttggactgcagccgggtgttacccgaccccggcttgaccctgggatgcagtcaggacgacgacggttcctccggcggcactgtggcccagggcggctgccgcgcggtgtactgctgcggctacgtgctgtccacgcccgccgcactgccgcctgccaccgagaatggtggcgcggtgcctgcggcgccgcccatcgccggcacacccaccgcgcccatcgagtcgaccggagacacagggtgcattccccatgcccccactccacggccacctcccaccccctcattcctgccctggcaccaaccccccgctccagacaccgtctatgcagccaatggcccccctgcccctccagaggctgcgccggccccgcccaccgccgcaccggcccccgccaagggcggcgtcagcctcggcatggtggtgggcctggtggtgggcgtggtcctgggcctgtccgcgctggtcggcggcagctggctcttcttcgcgcggcggcgggcgcagcggctggcggcggccgaggccgccgcggcgagcactgcgcgcaaggacaccgcccccgaccgtggacccctcgcccgcacccacgactctctgccctggcagggcgaggggtccggctggcaggactcgcccgggtcagccatgccgctgaccagccacgggacgctgagccaggcgctgtcggtgaacagcggcgccacgctgaccctgcccaacctgcagcccagcggcgggtcgggcagcgtgcccagcgccctggagaggggacccagcaacgccggcgcggcggtggcggagctgggccgcctcaagtctgccgacctggccacgcaggtcaccctgcatgaccagctgggctcgggcgcctttggcgtcgtctaccggggtgagttgtgttggtttttgtgtgtggtggggggggaaatggaatattactgtcaagaaatggtgtgtnnnnnnnnnngtgcccagcgccctggagaggggacccagcgacgccggcgcagtggtggcggagctggggnnnnnnnnnngatctggaggtgcgactttcgagggacacctgcaggaacatgcgcctgtctnnnnnnnnnngatctggaggtgcgactttcgagggacacccgcagggatgtgcgactgtcannnnnnnnnnggggtgagttgtgttggtttttgtgtgtgggggggaaatggaatgttgctgtcaagaaatggtgtggagtatggagtccctggactgcgcatcgaaatgctttgccagggtgcatcagaggnnnnnnnnnnacaatgcaggccagtgcccagaaactcacaggcttggttccaaccagtcaactcatgtcctcccacaccctcaatnnnnnnnnnngacgtgccggactcacagcagtcgcgaactggatagcttcaacccagccagcccttgcaaagtacaatgcaggccagtgcccagaaactcacatgcctggttccacccagtcaactcatgccctcccacaccctcaaaccccatgcagccgagtggaatggtcaccccgtcgccgtgaagggtgtgatgctggctgcctggcgtcactcccacccagcctcaacacacaaactcgcctcgtcgggcgctga

SEQ ID NO: 2485 - DNA, 585 bp, Chlorella protothecoides
atgtgtgtgcgctgtctcggccctcacattacctttcgtggaggtggtgaccactcttccctccccatatccccccttgttcccgccctttcaacccaggtggcaagggaggcgtcgagccgtgtgctgggcctgcgcccctttgacgtccagctgctgggcggcatcctgctgcacaagggcgagatcgccgagatgcggaccggggaggggaagaccctcgtggcggtcctgcccgcctacctcaacgccctagccggtgggatacggggtttgtctatgccagaggagaagatgtatggggaggcaggtatcttgggggtcaaaatcatggctgatgccatgaagttgtgcatggaggggctggatgtgagtctgaggcgatggcaggagtggtggggtgtgcggattggtgggtcctggggagcagtgggttcctggcagccctggtgtggtgtcgcggtccaatctttgaagccgagagtcgcgggactgtgctgcagcgctgaggtgtctggtcgagctgaaaggggtgccctacagacctccctggcaaggtgccagcctggtttccagaccagctga

SEQ ID NO: 2486 - DNA, 1752 bp, Chlorella protothecoides
  modified_base (616)..(625): a, c, t, g, unknown or other
  modified_base (1470)..(1479): a, c, t, g, unknown or other
atgctggacctgacctgggcacaccacctgcaagcgactgaaatccgcgctcaggatggagggagccacctgcagcagtcgggcggagccttggagccctcagtatactggcttccgaccagggcccgccctacgtcaccgagcggaggggagcagcagggcacgcgtatgcactgggagcatgcgagcccgaatctcaccataatatccgatttgctgaagcggtctactcgggcgttggcacggaccgacatccccctgcgacccccgcgcgtggacatctttggggagagggcagccttgaaggcatttgtggccatcagtgtggacatgatggctgatgtatcgattgagtgcctcgtaacaggtaaaatatcgagtaattacgacttcaagcgcttggtctcgggatactccgggcccccccttatcggtggtgctccgtccctgagcagatctcctggattcggagtttgggcgcaagcacgacagttgcatccccaaaggtattcactgggacgatgcaaggattggaaacagcatccaccccaacatgtaaacttggaagattttgaccgagaaccgacagacccctgccgtggtgcgggagggaaannnnnnnnnncaagcacgacagttgcatccccaaaggtatccactgggacgatgcaaaaactggaaacagcatccaccccaacatggaatatggctgcgcagctggtgcacagccaaagtgccccactcgtgccatgcagcccatggggaacatggagatcgcagaaccacaagttcttcattagatcatctgtcgtacatgattctagaagctccactgccccgcgcgctggacggcgaaaactggtgctggtgcctgcctctaggtccccattgggaaggagtgttgctcccaggcggcgggcacccgccctcgcggcagtgcccaaggctcagggcggtcttgatttcataaactccaacgtcacccccctggccctcatttctgccctcttgatcgggtgcgctcagggtagagcagggtccagatcctgcagatccaggcgctgcagggggttgcgcgctccacgcattccagtcctccactcacgctcagacccctcccctcctcctctgacccttacccctcccaggtggcacttcccagcctatggtgccgccgcggcgggtaggaacctggccccgctctccaccgcgggcatgtttttcctttccggcctgctactgaactcgggggaggtgggcgacgcgctgcgctgtcccgcggccctggcctacggcctgacggcggtgctggggctgacctccgccctggcgcccctcgtcctccgcctccccctggcgccgcccgagctggccatcggcttcgccgtcttctgctgcatgcccaccaccctctccacgggtgtggtcctgacgcaggtggggatgagttggagagggaggatgggaagnnnnnnnnnngcgccgcccgagctggccatcggcttcgccatcttctgctgcatgcccaccaccctgtccacgggcgtggtcctgacgcaggtggggatgagtgggagagggaggatgggaaatgggagtcatagagagcccccagtactgtccaagccatggcgcgtactccttggcatggatcatgggcgccggctctggcatgccccatcccaaacacccctgctgatgtgtgtgtgcgcgcctggccatccaggcgccggctgcctgcccaggcggtaa

SEQ ID NO: 2487 - DNA, 1179 bp, Chlorella protothecoides
  modified_base (1074)..(1083): a, c, t, g, unknown or other
atgcatcttgttgcgagggtttctcatcggtctggggctgtgggcagccctgccaggctgggctggcccctcccacctgccctgccagccctcaggttccccctttccattccctgcggcgcgcagatcaaggagctggggtgcaaggcgggcgtggtgctgaaccctgggacgtccctggacaccatcgagtatgtgctggacatcgtcgacttggtgctggtcatgagcgtcaaccctggcttcgggggccagaagttcattgcgtcccaggtgggatgttgttgtcgggcatctgggggggggccccttgttggttggaagactgcaagagcgaggggaggccttggtctcagagcaggggaggagtggtttgaagcatgtgtgggggggtggggcagccagttccggcagcactccccaccttggagctcttcgggccctggtgggagcgtgcagactcgtgctacgcatgcagtacgtccccactcgactgcctcatctgattgctatccttctgcccgtgcacccttgaccacccaggtccggaagatcaaggcgctgaaagccatgtgcgatgagcggggcgtcaacccctggatcgaggtggatggcggcatcgtgccggacaacgcctgggaggtgatcgaggttggggccaacgcactcgtctccggcagcggcgtgttcaaggcccctgactacgccaagggtgagtctcggggactgttcaggagaggggtggcgtgcgtggcagcgtggggccgctgtgttctttgtgcggggttgggagggctgccacgcagtgcatcaggggcgggatgccgattgccgggatcaaggctagcaagagggctggacagaaggagctggcccatgcctgatcccaaactgaatcggctgcatccctttgtcgagcctgcgcagccggcgcctgcgcccgcttgggccggcgcaggtcccctggcgaggctcgccgctgcactgtcgtctagaagtgcccaagggagcacagcttcgcctagtccctgcacctgcaccgactgcgacaagcgcggtggtccactccgagtnnnnnnnnnncaggtcgacctgacgcaggggcagtgcatggccgaggtccatcatgggggccggacaggaataggctgggagggcaatacacagtcactcgaatga

SEQ ID NO: 2488 - DNA, 303 bp, Chlorella protothecoides
atgtcgctcagattcgctgccccagacggcgtcaaggtaggctgcactgtgtctgcatggcgccccctgcgctgcacaccggagccagcaatcgagcgtgaattgctcccgtccaccccacaggtctacacggtagccggtgggaaaaacctacccacatgggtgtcggacaagaagaagcgatccctccgcaaagatgaagactacaaccggagagtgatcttcaagcgcagcatgtatatctggcatccatggcttgaaggcgagctgtcaggggagccccatgccaatgcaatctgctga

SEQ ID NO: 2489 - DNA, 1188 bp, Chlorella protothecoides
  modified_base (271)..(280): a, c, t, g, unknown or other
  modified_base (972)..(981): a, c, t, g, unknown or other
atgccaatgcaatctgctgaggcctctagcagctgtcacccatcgagcccgcccacctcacccattgcagggtggagctggtgcaagactttgaattcccggccgcctgccagcgcatcaaggtctctgcggaccagcagtacatctttgccagcggctaccacccgccaagggtgggtggatgggcaatcgaagggggagtatggcacctgtgcgatccaaagttggttctgccgcccgttcccatcaccgccttccctccaattccagnnnnnnnnnntgaagggggagtatggctgctgtgcgattcaaagttggttctgccgctcattcccatcaccgccttccctccaattccaggtacgagtgtacgatgtcaaccagctgtccctaaagtttgagcgtcacctgaatgcggagatcgtggacttccagatcctgtccgaggactacagcaaggcggtgtttctgtgcgacgaccgctgcctggacttccacgccaagtttggcagctaccacaagacgcgcgtgccgcgcgccggccgctgcctcacctattcccaccccaccgcggagctgttcgtggcggggtcggcacccgagatctggcgcctcagcctggaggaggggcgcttcatggcgcccatgcccgccgccagccccggggtcaatgcgctgggcctgtcccccgcgcatggcctgctggccgccgcgggggaggagggcctgctggagtgctacgacccacgggtcagggccagcgtgggctcgctggaggcggcgcgcgcggtgggggccgacggacagggcctgacagcgctgcgcttcgacgactcgggcatgcacgtcgccgtgggcaccagcggcggcctggtcgccgtgtttgacctcaggtcacaggtgagggggtgggagacgggaggtgggcggcctgggggggtgagcggggggcccgggagttccaccacctgnnnnnnnnnncgacctcaggtcacaggtgaggggatgggagacggggggtgggcggcctgggggccagagcggggggcccgggagttccaccacctgatgccatgctccaaaacatgccttggcctggccagagaacgggtgatctcaggaccttttccagtgtatctatctgcgcatgctgcccgttgcttcccatcgctgagtggctggtcttga

SEQ ID NO: 2490 - DNA, 1062 bp, Chlorella protothecoides
  modified_base (221)..(230): a, c, t, g, unknown or other
  modified_base (673)..(682): a, c, t, g, unknown or other
  modified_base (980)..(989): a, c, t, g, unknown or other
atgcaggttgtacaacaaggccaagaatgcggtggatcccttcgcctacgaagcctatcgggcgaagcgggtcgcccagaagctggaggaggagcgaaaaagccggatctccatcatcaagaagctgcccaaggtgtgtgtgagggagaatgggggttgaggggtgctcttaactgctgctgcttgaggcacagtggcccaggcagcgctgccccggcggnnnnnnnnnntaagaagctgcccaagcgctgccccggcggcctgcaaccacctcatccagtgacgcgccgccgcaccgtcctcgaggtcaacgccaccaccgctgctcgtctgctgggcgaggagggcgaggatggtcccaagaagcgcaaggccgccctgcccaacctcctggaggacacccgcttcaaggccatgtttgaggacaccgagttcaccatcgacgaggcctcacgagactacaagctgctgcaccccaacgccggtgcgagcctcaatgggctggaggcgctgaggggggttctggcccgtctgtgggacctgagcaggggagtggggacggggggaaagcatcccatccacctcttcagccctctctgccctcgacgtcctcacccttgccctcccgccgccaccccagacccggccaaggagaggcggctggtcagggagnnnnnnnnnncagggggaagcatcccgtcgacctgttcaaccctcgctgcccccgacgtcctcacccttgctctcccgccgccaccccagatccggccaaggagaggcggctggtcagggagcactttgaggcggtggagggtgacggcgatgcccagtcggcatcggacactgagagccaggacgacgaccaggctcgcgaccggaagccggccgcccggcacagggtgggtggtgtattttgaggtggggagaccctcgatgaatgggcttacggccatacattctaccccatgccctgttgcttnnnnnnnnnnagagggccaggacgacgaccagactcgcgcccggaagccggccgcccggcacagggtgagtggtgtattctga

SEQ ID NO: 2491 - DNA, 273 bp, Chlorella protothecoides
atggtagtcaaggaccaccagtatgagtcgcccatcctggacatcaagtggccgaccaccgccgccgggcggtcgcgcgcgctcgtggcctccgccgaccggcacatcatcaagttctgggacgcgggcagcggcgaggggttcaccaacatcgagcccaaggacggggacatcaacgacatctgcctctggcccggctcggggctggtcatggccggctgcgacacgccccgcatccaggcaagcgattttacatttggaggggatgcttag

SEQ ID NO: 2492 - DNA, 324 bp, Chlorella protothecoides
atgacggaggagctggaggaaaggacggcgccggcggtgtacgacgactaccgcttcatcactcgtgccgagctggtgggagggggatttcaggggtggatggcaccgttccctgggatgttggacgccctctggcttgcaactggtcgtggggactcgctggggctggccaacctcgtgggcaccaacatgctcaagccctacatgcacggattcttccttgacaacaggtcggactgggagggtgtgaggcgtcgtctgctctgtgccgtccatggttacgcctgcctgtccaggagcagggtggcaagtcgacctgactaa

SEQ ID NO: 2493 - DNA, 495 bp, Chlorella protothecoides
atggaaacttccagaactggagtccttcgtggccgacttcctcttcaccctgtcttccctcccaaacttacacagctgggcaagacgtccaagcaccacaaggccaaggggaacagcaacgggcggacctacaccagcaagttccggggggtgcaccagaccttccccaccaagcgatgggaggcccagttccggcgcaacggcaagcccacctcgctcggctgcttcgacgcggaggaggaggcggcgcgcgcctacgacaagatgatgctgtggtgcgagctgcaccatgccaccggggtcaagggtggcatcaccaactttgaccactcggactacgagcaggacgtgtcgtggctgctcaacatcacccaggacgacctggtccagcttctgaggagcgatgggaggcagcaggcccagaggcgaacgatgcgccagaagcgagaccaggtactgtacagcggcgctggagcctctggcgacgacgactga

SEQ ID NO: 2494 - DNA, 405 bp, Chlorella protothecoides
atggggagtgtcctcaccccgcctgcctgcggttttgaggagcaaggcaggctcggcactcccgatgtcatgcacagtagcggccgacagttttaccccctctatgcaaccccaacgcacaggaactcagaccatgccgtggagcgcgtgagggctgcctgcgtcaagtccctggcggcgctgcgcctgacctacctcgacctctacctcatccactggcccgtcactggcatccccggccccgccctgaccccctccttgcgagacacctgggacgccatggaggggctggtgcgggaggggctagtgcgtgccatcggcatgtccaacttctctgcccggaagatggaggaggtgatgcagcacgccaccatccagccggccgtgtgccaggttggtgaatga

SEQ ID NO: 2495 - DNA, 765 bp, Chlorella protothecoides
atgaatccgctaccccttgatgcgcagcggaggatcctcctgtcaccactgctcagtgcattgcaggcaggcgtcgcggactctgaccttgccgcgatgggtatggtctccgagaaggccgtgggcacatggtgcgactcgccgggaggacacatggtcacgtggggcccaactccattctttctccttgctccacgcaatgcccagcccgatctcaagtccagggatcatgcattgcggggtcgcatggccgtgcatggggtgatgccacaactgggcgcatcaaaaatactccaattaccagatatgtcggccttgtctcggcagatcgtgggctgccctgccgcccaggcctcctcacagctctcgggcctcatatgcccccgtgcgaggttccccaagcccttccagggctccaacaccggccttcagaccaggcggacgggacgaagccatgtgcgtcaacctctgcgcatgcccctggccatgtggaagggcctgggtctgagtttcaccaccgatccggctgagaaagttcgaaagaagtatcaggggtccctggacgccatgaatgccctggagtctggcctgaagtccctcaccgacgagcagctcagggccaagacggaggagttcaagaagcgcctggggcgcggcgagacggtggacgacctgcttgtggaagcctttgcggtgaggactgggggtatggcggtgccgcaagtcatgtgcgggtggtggtgttcccgaattcctgtcagctga

SEQ ID NO: 2496 - DNA, 312 bp, Chlorella protothecoides
atgctcagccccctctccttcaccgctgcccgccaggtcaaggccgtggacgaggcaggcgccgactggatccacgtcgacgtcatggacggccgctttgtgcccaacatcaccattgggcccctggtggtggatgccctgcgcaacatccccgacaagcctctggacacccacctggtgcgtaaggatgggattcggcggaggatttcccgagagggtgtgtgcgtgtggatggcacgcctgcacctggctgctggcagagaggggtatcagatgtgcgagcgccctttccagcccttgacggcatcctga

SEQ ID NO: 2497 - DNA, 564 bp, Chlorella protothecoides
atggcgcgactgaagctgagggaggtcctgatgccccaggtcgtgagccaggtcgaccttgcaggcacggcacccagcgcccgcagcaaagcaaaggtgaagagctgggcggtgtcgcccgagctctaccccaccaaactgaagccagagaccctggcgctcatcgaaaaggctgtggagtctgctgtggcagcctggggatcccgccaggtcagcaggccgggtcgcaaatccagggtggtgcctgagcgccagcttgaagcgctggacgcagaggacaggctggcgtatgcctgcgagaaggcacccactgatgaccctgtcctgaatgagtccgtctacccattcccaccccagacgcatgcgctgcgccatccctacccacacccaccccctgccgtgcgtcccgatttgcagctgcgggctgccttcctggcaacagaggcggagttcaaggcggtgacggagctggagaagcaggaagtggtggcccttggggggctgcatgttgtggggactgagcgccatgaatccaggaggatcgacaaccaggtgagcccctga

SEQ ID NO: 2498 - DNA, 459 bp, Chlorella protothecoides
atgggccaggcgaaccttgccaaatccccctggatcgagtcctaccgcatcgatctgccgggatgccgggggagccgaacgaccgtgctggactttgtggcctcgccagggacaccccgcgatctccctgcccaggcccaggccgcggaggtccgtgagctggccgccaggaagcaggcacgcagagatgctaccaaggcattatatgctcgggtggatgtgccccgcgcgaccctggcctctgggggcagcattcccctggtgggcctgggcacctggaaggcggagaggggccaggtgcggtccgccgtgcacgccgctctgaaggccgggtaccgccacatcgactgcgcctcagtgtatcagaacgaggaggaggtgggggaggccctgcaggccgcactgggcagcggcgccattcctcgggaggagctgttcatctgctccaagctctggtga

SEQ ID NO: 2499 - DNA, 1860 bp, Chlorella protothecoides
atgaaggctaaaatagggggccaaactgtcaagatctgtttgccccagcccagttgcatacaaaccagcggtgctctcgccgacagcagcagggctcgcccggcaatgcaaaaacagggggccaaactgttgagatccgtttgccccggcccagttgcatacacaccagcggtgctcccgccgacagcagcagggctcgccaggcgatgtatatgccacccctacatcttccctacccctgagaactacaaacccaagccctcggcacatgcctgcgttgcctcccagcaggatgtcagtgccacgccctgccatgttggtggcgatggtcaccgcccccctgcgccccgactgcgccacgatctcggcctcgcgctccacgttttccggcttggcgttcagcacgcggtaggggatgccttgttcgcccagcagactcgccaggtgctcgctcttctccaccgaggtggtgcccaccagcacgggccgccccttcttgtgcatgcgctggacctcctgcgtcaccgcccgccacttgccgctctcctggcggaagacgacgtcggagtagtcggtgcgcgccacggagcggttgggcggcaccacggccacgggcagcttgtagatggactcgaactcggaaccctccgtggcggccgtccccgtcatgcccgccagcttcgggccgtcggaccagcgccggcctggcatagtgcgccccgtgaactcgtccacgatcacgatctcgccgccgcgcacgatgtaggagacgtcgcgcaagaagagttcctttgccttgatggcgttgataatgtaggaggcccactgctcccgcgggtcgtagaggataaacttgaggcagtggagggtcaggccgccgggaaccaaagagtcgctgggcgtctggtgtggggctggatgccagccggtatgcaccagagcaggcagaaatttgggtccaggctggtatacagcgccactgtcaactcgccaggaaaccgctccccttctgaaacctgggtctctccagcccgcgatcactccctcccccctcctgacacctccttccaatcctcccacctggagcacgtcctccgctgcctcatacccgtcctcggtcaggaggacagagcgctgcttctcgtccacggtgtagtgcacgcccttgaccagtgcagcggccaggcggcaggccttggagtacttgtccccgggagggtccgcggggccggagatgatgagcggcgtgcgcgcctcgtcgatcaggatggagtctacctcatcgatgatgcagaaggagaagtcacggaggaccagggattcggcctcctgcgccaggttgtcacgcaggtagtcgaagcccagctcagagttggtgacataggtgacgtccgccaggtaggcggcgcggcgctgggcctcctgcggggccgtgaggaagggggatcgaggagggtgggtgaatgtcagctgggctggacaccagccttgcaccttgccagggagggcacccctttcagctcgaccagacacctcagcgctgcagcacagtcccgcgactctcggcttcaaagattggaccgcgacaccacaccagggctgccaggaacccactgctccccaggacccaccaatccgcacaccccaccactcctgccatcgcctcagactcacatccagcccctcctggaccaggccgacctccaggcccaggaacttgaccgccacgagggtcttcccctccccggtccgcatctcggcgatctcgcccttgtgcagcaggatgccgcccagcagctggacgtcaaaggggcgcaggcccagcacacggctcgacgcctcccttgccacctgggttga

SEQ ID NO: 2500 - DNA, 1614 bp, Chlorella protothecoides
  modified_base (291)..(300): a, c, t, g, unknown or other
atgctagactctgcagtagtggcctcgtgggacacaggacatcttttcctttcccccgcacaggtgctcttctgtcaagagggcaccgcgctcgtgacggggctcaacaatgatgccgagcccggcacggctctggacttttcatccggagcccagggaccactcctcccaaagatcgaagttcattctcgattccgcattgcagggtgctgctgtggcggactagcgccggtgcgatttttgcgctggtgctcagggaatcctcccctggggtcaaggccggggatgggnnnnnnnnnnccgattccgccttgcagggtgctgctctggcggactagcgccggtgcgatttttgtgctggtgctcagggactcctcccctggggtcaaggccggggatggggtggtgtgcaggctccgcgccatcctgcaagtcgtggatgatgccgtaggcgccacgaccaagcgcgactacgacgtggtcgacgtgcctggtgaggcgggggctgggagggagggtgtgttctgggagcaacatgtaaaagccgctgacatgtcacgcctggactgggtgaagggaccagggcagggacgcacctggtcccccgaccagcttctggactggaggggccagagcggtcaggccgctgctctcccctccatcaccccgggcccccgggctcccctgctcgcggcccagattcccatggctgaccgggaacagatcgcggaggccctgtacaccggcgtgccctgcgtcgacgtcctgacccccctgggcctgggccagtcggtccagctcagcgggcgtgacgcgggcgagcgcgccgcgctgtgccaggccgtcgcccacggcgcggtggcctccggcctccgcacgctgtatgccgcgaccggccccgccgacggcgccggggtcgggccggccacggtcgaccccggtgtgacgcgcttcgtcgcctcgccggggacaaacgtggcgcagcgcctgtacctcctctgcgcggcggtggcggcgggggaggcagtgcgcgcggcggggggccacgcgctcgtgatcctggacagcctcgcccccatggtaggttggcgcgggggtgggaagagtggggaatggccccattcctgtgtgtggcttggcagtgtgcttgtctcgctggcgcctggttcactcagtgatttgaattctctgatggcccaccctcctcctctaaaaccacaccctctcacaaacacacacaccttcacacacacaactgcattcctaggttcgggcgtggggcatcctgagcgcggccgccgcccagaccccgggggccgcgctttcctcccccgacccggcctcgcgcgtggaggtggagggcatgctggtgtcagtgggcgaggcggagcgccgcgccttcctttccagcctggtccagcgcgccgccaagatggaccacaggctgggcggcggctccttgtccctggtgctggtagtgccggggcttccagccacaggcacccgcttctccccctccccccagctcctggcgtccctgtccccagagcggcggcagcgcctggaggcggcggcccggcagcggagcgccgaggcggcggggggaggggctga

SEQ ID NO: 2501 - DNA, 639 bp, Chlorella protothecoides
ttcgagcgtggtgacgaccgcccgccgcgcccgcgcctgacgcccgaggagctcgaggcgcagcgcgtgcgcaccgtcttcgtcaccggcctggcaccggacgtggcgtggcaggatctgaaggaccacttcaagcccgcggggcaggtggagtttgcgcgtgtggtcatgggccaggacggcctctcccgcggctttggcctcgtgcgcttcgccagcgaggacgacgtgcagcacgccgtcgatacgctaagccagaccgagctgcgcggccagaccatctcggtgcgccccgacgccggctccaacgccctgcgcggcggccaggcgcggcagggcggctacgccgccgaccccgacgtggcggtggtcctcctgggcctgcccctggccttcacctggcaggacatgaaggcgctgtgcgagccctacggcgagctgggccgcgtggagctgcgcacccacgccgacggcaccagccgcggctggggcatggtgcgcttcaaggacgcgggcgaggccgaggctgccatccgcgcgctcaacggcaccgagctggaaggccagacgctgcgcgccaagttcgacgagagggtgcagcggaacccagaccagggctggcacggcgcggaggacaac

SEQ ID NO: 2502 - DNA, 306 bp, Chlorella protothecoides
atggtggtggtaaaggcgcccagcaccgctgcaggagctgggggagcggtgtgctcgggccattacccaccatgccgggggccaagccggccattcacgccctccatgctccctccgaggcgtcccaggagccacggcagctttgcagtgcgacacagcgtggatgaggaggactgggaggcggagatgggggtgttccgacagcgcaccctggcgccaaaccagctggagacgctgcgcaagtacgaggctggagcggtggagctcggaaaggtgcgtcctggaatggaaaatgtggtcttctag

SEQ ID NO: 2503 - DNA, 897 bp, Chlorella protothecoides
  modified_base (328)..(337): a, c, t, g, unknown or other
gggcattcgtggcttgttgcccaatcacttgtggattcaaccaggacgtctcgtgacccttgcatgaaggtcgcggactttgacatcgagagtctggacttcgtgggaacggggagtatcgtccacttgccaagaaacgagcactgcgaggtgagagctgtgatcaaatgcctagaaactgaagttggccgtgcacgagggtcagaggctgaagtatactgcaacgccgagggaattcagtggatcgatgcgtacagagtcattgttgtcagtgacagagcgaaagctacacagccataccactgcgacgagcacgaccagtcggtannnnnnnnnncgaccgagcgaaagccacacagccctaccactgcgacgagcacgaccagtcggtacacatctttggtttgccaggtgccgcatccaaggcatctcctgcgatcgactgggaatgagcgccggccgtttctacccctgcatgccttgagtgcccacctatacgtcttgcaaggctcagtgacattcatcagagatgggaggttaggccagagatcctgcgctaaatccgcagggcgtttccatcaggcgatccgatgcgcgagatgtatcaccttgagattgggccttccctttgacgaggtgctgatcggaagtggctttactggcccgcatcgtgtcaaaagtcgggcttgccccaacttcaaaagacaaaaagctcccactgtagttgacaaggatgaaatccacgtgttcttcctaatcatacttgcgctcgccattgcacatcatttattggactacatattgagtaagattctggttccaattgatgccccatcagccaaactcagccatcttgctggatggagccccacttcttggaggaatgcgtggccttga

SEQ ID NO: 2504 - DNA, 1176 bp, Chlorella protothecoides
atgctgatggacgtgggcaaagtagaaggtcgagctgcggcaacaaacctaatttcaaacggcattggctgctgtgccatgtctgttctgagccagggtacgcagacgcgcacacacttggcctgcaacaccaagctcggaggtcctcgcgtggccacattctgtgctgcacgccccaagtaccttgctcggcgtgtgatggctgtcgctcaggccagtgccgtggcaccagcggggctttccgctgccctgatagacggcaagaagatagccgagaccatccgcggggagctgagggttgaagttgaagaattgaaagcccagaagcacttggcacccggtctggcagtggtgttggtaggacagcggaaggactcccaaacctacgttcggagcaagaagaaggcttgtgaggaggtaggcatcgtctcctacggcgtcgacctcccagaaacggcgaccgaggacgaagtcctggagggttctagaccccatcttacacaggtcgtcgcgaagttcaatgctgatcccaatgtgcatggcatcctggttcagctccccctcccaaagcatatcaacgagaagcgcgtgctggatgcgatttcgctcgagaaggatgttgacggtgaggtggcgaatgacagggtgttggggactggattccatcccaataacattggggagctggccatgaggggccgcagcccaatgtacgtctcctgcaccccaaagggttgcctcgagctgctgaagcgctctggcatcacccttgccggcaagcgggccgcggtcgtcggccgcagcaacattgtgggcctaccagcagccctcctcctgcagcaggaggatgcgactgtgacggtgattcactcgcgcacaccagatgcccagcagctgtgtgccgaggctgacattgttatcgctgcttgtggcaaggcagagatgataaccggtgactggatcaagcctggcgcgaccgtcatcgacgttggaatcaatgcagtggatgatcccaccgcaaagcgtgggtatcggctggtgggcgacgtgaactttgaggaggcaaaggaaaaggctgcatttatcacccctgttcctggaggtgtgggtcctatgaccattgccatgttgctgcgcaatacagtggatggtgcaaagcgctcccttgagaactga

SEQ ID NO: 2505 - DNA, 1917 bp, Chlorella protothecoides
  modified_base (526)..(535): a, c, t, g, unknown or other
  modified_base (935)..(944): a, c, t, g, unknown or other
  modified_base (1055)..(1064): a, c, t, g, unknown or other
  modified_base (1734)..(1743): a, c, t, g, unknown or other
atgacatctcagtcccctctgcttgctagactgacacgaaatgatcccttcgatgagctcgtagcgacctgtgtgttctcttcgtgctgccttgcacccctgggacggcgagcgactcttggtcgcgggatcgctgtgaagagccgagaagcctcttgcagcgctcggagccatgaatattatcgatatcaaggacagagcaggcgagctcgcgagcaagtgagttgctggagggggcggttgttggaggtgcacgccttcgcctgcctccgtgctcatgctgctcactcctcattccaggtgcacgccttcgtctgcctccgtgctcatgctgctcacttcgcattccagaccgcatccaggatctcaccctggtgggtgggtggtcgtcggtggcggggtaagctctctctctgttccattgctggcgcactgcacaccgtccctccttccgtattcgtgcaacagaaagccgaggaggtcgctcaggagaagaatcgagcgctgaaggctgctctcaatgccnnnnnnnnnngacagaaagccgaggaagtcgctctggagaaaaatcgagcgctgaaggctgctctcaatgccgagctccgcaaggacaaagggaacctcttggactctgccatacccaagcttgccaccattgccaaggacatgcgtaaggggtcaacacaggaggcggcccagctacgggagcagcaggtccaggagctggctcaggccgtagacgacatcccagacggcatgggaacgatgcgctcgcctggaagggtaggatcagctgggagtgcaatgctcactccctaccagcccaatcaaatgttcattctcatgttagtgagcttgtggaagcctgctgttatacaccgtcctcctatccaaggactccccaaactgcactctgtatttgcagcccctactcnnnnnnnnnnacctggaagggtaggatcaactgggagtttgaggttaaagaggtggcgagggatgtcctgcccgtctttccttggaaactttggatgccatacaattcatgtgcatgcatnnnnnnnnnncagtgagcttgtggaagcctgccgttattcaccgtcctcctatccaaggactcccccaactgcactctgtatttgcagcccctactcggaggtggcagcgtgtatgcacctgggagcagcatcaccatcaaccctctcaagttggacgggcgtttccagagtgcggagcactaccagcacacagaccagagcaaggctttcatctctgaggctgagcaggcggaacggcggcagaaccaggctcttgaacggatcgagaatgggctgggcacgctcaagggtgagtattttgagctgcgtgggcatctcagaggactggagatcacgcggtctcatcgcttaccatgtgggcagtggttgtgcatgcctgaagctcggtacctcatccacctgcaaccatggccttgcagaattgggcaccgcgatgggcgaggagatccagaggcatgatgtgatcatcgacgaggtcaatgccaagatggacacgatcacaagcgacctgaagacaaacaacatgcgcctcaagggcctaattaccaaggtgcgccgggagcctgcgctgggccaatggtgttccacctggggattgcgcttggctcaagcctgggtttcctcagcaggctcagagaccactcctttaatgcaacaggtccgctcctccagaaacttnnnnnnnnnnggggctaatggtgttccacctaggggttgcgcttggctcaagccagggtttcctcagcagactcagagaccactccttaaatgcaacaggtccgctcctccagaaacttttgcatcgacgtcatcctcatctgcgtcctgctggcacttgggctgtacatctacatcatgctga

SEQ ID NO: 2506 - DNA, 573 bp, Chlorella protothecoides
atgcacccagcatcaggttgctgtggggagccacctttctcccctatagtcacattgcccggtcccaccctccccttgtcaccccctccatcaccagaggagctgtcctacgaaagcgaggcggcggagcgcctccgcggcgaggccgtggccctgacgtcggcgctggccagcgcccggaacgagggtgacgcccagcgcctggccgcgctgagggcagaggaggagaggcgcgaggccgtggcccgagcccaggaggcggaggcggccgccgcggccgccaggagggagaccacggcagccgccgtgcgtctggccgaggcgcagcgcgcatgtgaggccgcggagaggcgcgcggcctcgctgagcgccgacgccggggccagcatagatcggcgcatcgtcgtcaagatgctggtgtcttttttcgagcgaggcgggagcggcgaggtgctggacctcatggccaggtggggtggggtggtggaggccattgagcctcccatcgctgaacctcggcacgattcttcctacacaaatcccccgtgcattctcctttacccctccggctga

SEQ ID NO: 2507 - DNA, 2571 bp, Chlorella protothecoides
  modified_base (1396)..(1405): a, c, t, g, unknown or other
  modified_base (1773)..(1782): a, c, t, g, unknown or other
  modified_base (2386)..(2395): a, c, t, g, unknown or other
atggccgcaccagaagcaggactgcgaaatgaagacctcccagcattgttttgggacgagctgcccaatgacccagagcacccagatgccatggcaatcaaggctataattgacgagtccacaccagaggatcgggctgagagtttcaaggagcaaggcaaccgagcactgaaaacaggcctgcagcagaagaagaaattctacttgcggcaggccattgagcaatacactctgggcctggagctgcaatgcagcaatgccacgctagtagcccagctgtatgggaatcgtgcacatgtcagcctgctgctgggcaactaccggaatgccctggaggacgctcgggccgccctgaaggcggatcccacttttgtgaaggtgcactgcatcgcagcgctgtctccttgccctcggcatacacccatacaacgcgcacgcaagccttggttctcgccctcctgccatcaggcatactggcggggagccaaggctgcggcagggctgcggagatgggaggagtgcagatatctgtgtgaagagggactgaggctcgatgctgacaatgctgacctggcacgcctcaggcagcgttgcagcgatgaggaacggacagatgcccagcgtgcggaggaggagaagcggcgagctgcggagaagcgagctccagcacggcacctcgcaactgcgatgctggagaaggggtggagggtgggacgccctcagttttctgtagggcacgggtgtgcaagtgtcctgtaccttcatgcatggaggttgctaggacatcaacctcctcatgtgcccatctcaggtaaccgtaagcctagcatcgatgctgacggtgccattcactggcccgtcatcttcttctatcccgaggccagcatgcagcaggatgtgatagaggacttctcagtgacggacactttcagatggggctggcgggtgcaggctggcctgctgcctgattgcgacatgctctttccatgcatgcaagccggcttcgtccatgcaagcaccgcagggatcaccttgactgcatgtttgggccagacagtcccccactggactgggatgtggcaggcgactatggcagaagcaagctggaggtgtactacctctcgcacgcaagcaaggccatgccattggaagccctcacagaggtatgtcagcgtgaaatgggaccaggcagtctttgggtcacgttgtctaggatggattctcgggcgtgagtacatgccatcaagaacaaggagtatgctcgctgccatatttctagacaatgctggtggtaaatctgctcagatcacacttttcatgaacggcgaccttggctaccttacttctgtactcactctctttacatctgcaaagcttactccccccccttcccatnnnnnnnnnngctcagatcacacttttcatgaacggcgacgttggctaccttactgctgtactcactctctttacatctgcaaaccttacttccccccactcccaacacaggccctgtatggcgggtggccagaggtccgtgacgagggtcccagccgctatggccccaacgctgccacctggcagagggtggaggagggctggacgctggagcaggcgctggccagggcagaccacgtggtaccagggatccctgtcttcttcatcctctcgtcctccacgccttacaaggccaggttcctgtcgggggacattcccctcctggccgcacgccaagcaagcacagccagggagggggtgacccaggggtgctccgannnnnnnnnnaccctgcacagtctagggccattcccgttctcattgtacaatcaccactgggcagacgtctcgaagcgacagggccgcacgccaagcaagcactgccagggagggagtgacccaggggcgctccagcgccatcgagactgcagcccttgtgcgtgtggggtggtgaccgcagctcctggaatgccgggtgccgcgaagccgctgcagccctcgctgccacgtcagcgccaccctctcccagaaatacatgccacccccggcctccaggggctgcgggcccgtcgccgccttgttcgcggcggcgtgcgcctcctcggcggcctctgccgcgtcgtctgcctcgtcctcccgcacgaacgcgtcctctgctgcgatggccttgatgaaggggtccctcagctcatccaggatgccgccgcgctggtaaatggcgggcccgccctcgatgaacaggcgctggtcggggccggacagggtgggcacatccacagcaatgagcttgaacacgtacttgccctacatgggaaacaggctcgggcgggtgatctgccaggctgcaatgacagaggccctgaacagcccggggggagaaaagtgcggaatnnnnnnnnnngtgatctgccaggctgcaatgacagaggccttgaacagccgggggggggacaaaagcgcggaagtaaggcaacgctgccgccaccagggctgcctcagggcgtgcctctccagctacaagatcgacatgctgtgcatactcgctcagggtcagcctcccaaaaaccgacaaaatag

SEQ ID NO: 2508 - DNA, 1332 bp, Chlorella protothecoides
  modified_base (378)..(387): a, c, t, g, unknown or other
atgctcgccgtccctgctggcgtgcaccgattcgaggagggaggaaaggaggggcacgcagtgcatgtgtacgcgcgcgacgaatgggatgcgcccctcctccacctcccgggccactccaaggtgtgggcgcggcagcatggcgcgggtggccctgcgcagtgccctgatgtatttccgcggggtattctaggtccaaagtcttccctctggccccctctgcccaacagccggtggtggccgtccgcttctgccccgtcctattcaagaaaccagagccttctggcagggaggacgtgggtgggcaagccatcgacctgccctaccgcatgtgcattcatcattgccccccccccacacacatcagtgcatgctcgnnnnnnnnnngttcagtgtccctcctcacagatagtcgctgggagtactggatgcatttggagtgccttcatcattgccccccccccccgcatcagtgcatgctccgcccagctcgtcagccatgcacaccaggagagggttgacgttgaggctggccttctcttcttcacagagcatgctgacccggtggacgtgcaccccatgcaggtggcgacgctggacagcgtggtcgtatatgacaccgcctcgcccaccccgctgtgcctgctgggcgccttgcactacgattccatcaccgacctggcgtggtccggtgatgcgcgctacctggcggtgtcctcgcgcgactgctactgcagcatcgccgtgttcgagccgggcgagctgggcgaggcgctggccggtggcgaggccgagcggtggctgggaggggtgggcaagcccgcgccggggccgcagccagctgatgcagcggtggcgctgccggactcggcggtccagctggaccagctcgacagcgtgttgccgcacggcccggcacccgcccagggccccgagcaggagcacgctcgcccagccgcatgtccgacccctgtactgaagaaagcgcggcgaatcgtccccgaggccgtcccgtgccagccccaacccgcgcccaccgtggcggcggcggatcagtcgagcgcagacgacagcttcaccttccctgccccgccctccgcgccgccgtcggagccgccgaccgcctgcgacccgctccaggctgcgaggtgccccgcccagccagcgaagcgaagactggtccccacgcctgtgcagcctctcaccgggagtgcgcaggcaaggttttcggcagcgtgccaggtcaggctctcatggttctggccacctctggtggaggacattgctttgcaatgcccagtgctgtcgccccaggcgatgtgtgtcttttga

SEQ ID NO: 2509 - DNA, 1296 bp, Chlorella protothecoides
atgacaccgtacctgccagagcttgatctccttgtctgccccggctgttgcgaggcaggcagctcccgagaaatccacagagtagaccggctccttgccatgccacacgatctgcagagtcttcaccttcatactgggagatatagtattcagaggaacgatgctgcccgtccatctgaacacgaaacttgttcgccccggtgtcgagcaatttgtatccgatttgaagcgcgctgcatcggctcaacaagaaaggagtgccatgtcgcagttttcagcaccatccgacacagtctgtgccctgacagattctcaggggcagtaatcaatctgtttcaggagctgcatccgatatcatcttcaatggtgcgctgctggttagacattgacatcggcgatgctgcccaatacgccttggagtcacgtgcatttgccagggcgcaggcactgttcgacacgataaaaagccagtacggctggccagaggagttaagcagcttggatgaggaacagcgtgatctcctcacatcagcatatgatagtgacccttcctggcgagatcagggcaccatgcaagccaccccgcccacccctctgagggcggggcgcctcaccatagagctgttcaccgaagctgcacctcgggcctgtgaaaacttcagatgcttgtgcacaggggagcgagggaaagggaagagcagtggaaagccactgcacttcaaaggcacaaagttccatcgcatcgtcaagggctttgtgtgccaaggtggtgatatcgtcaaaggtaggattggcgttacaccctcattcttggtgtttgtggtttgttcaggaactgacggcggtgctcgcatggtggagtgcttatgggttttagagcaatgtaggttcccagcagcttcctcacgcccgtcctcattgcagcccatctcttcaaaaaccccaacactttgccgtgggactgacggcggtgctcgcatggtcagcttgagtctccctgcaggcgcccactcattgcactcccctcccctcaggcgacggctcaggtggggacagcatctatggcaagcccttcaacgacgagaaggggggcctcaagctcaagcacgatgcagcgggcatcgtatccatggcgaacaaagggtaggtggagtgcttatgggtttcagagcaatggaggttcccagcagcttcctcccgcctgtcctcattgcagcccatctcttcaagaaccccaacactttgccgtggtgtgcaggaagaacagcaacacctcccagttctttcttacgctag

SEQ ID NO: 2510 - DNA, 1200 bp, Chlorella protothecoides
ggcgtctgcgcctggactcgggcgcaggcacacattagggcgtcgcacacctcacccaaggccacacatgtgccgatccttcccctccctctttcttcccctccagctcgagttcccttggttcctgcccacttacctggcctacccatacgtcattcagcgtgtggacgccatccgatacttcatcctgtaccaccacggcggcgtctacatcgacctggacatggggtgtcgcaagcgggtggacccgctgctggcggcgcccttcaccgcgcccctaacccaccctgtgggcatctccaacgacgtcatggccgccgcgccgggggccgccttcatgcacgctgccgtgcacgcgctgcgcggctggaacctgtggctggtcatcaagtacgtgcaggtcatgttcaccaccggtcccatgttcttgacggtcctgctgagccacttcccagacctggccgccgtggccgtcatctccaaggccgactacggcaagtacgacgcctcgggggacgccctgttctaccacctgcacggcagcagctggcacgccggggacgcccccctcatcttctggatggagcggtacgggaaggtggtgctgctcgtcgtggtcgcggcagcggcgctgatcgccgcgctggcctaccgccgccagaggtccgcgcccgggcggccggggcgcaggacgacgctgatggagcggcagtgccagtcaaagtatggcgacaagcaggtggcatactgccccgtctgaaggggggagtcagactgcatctgcccttgtctgggtaccgcagccctgaggaccagatcctcctctgcatgctatacaggggctcccagtgccccattttccatgttcttgtccgcactgaccatcccagcttgtcccttggttcacgctgtgtgtcctgcatgttgcccgcaaatcacctcgcccttttgccacccagtgtaccccaacttgattccccctctccaagccctcgcaatgccgtaaacaataaagcccacatgcttcgatggctgcctatgtaccggcccagatacaaagagtggttgccatggctagacatgccagtttctcctagccatcataaccagagtcggagatgcatacgtccgtcagggggtcaccgtccttgctggccgccagagcatctggcagtgggaatgccaacatgtgggggttga

SEQ ID NO: 2511 - DNA, 339 bp, Chlorella protothecoides
atgtccctgccctctgaatatagggactattttgtgaggaacctgcacgatgcactgtccggacactccagctccagcgtggccgaggccatcagctatagtgagcagagcaagaccaggtgcatcgggatgaccattgagactcgaccagactactgcctcactccacacctcacggccatgctgagctacggctgcacgcgtctcgaggtcggcctgcaatcaacctacgaggatgtggccagggacaccaaccggggtcacaccgtggcggcggtcggcgagtgcttccagctcgccaaggacgctggcttcaaggcaaggcctgggcgcaaatga

SEQ ID NO: 2512 - DNA, 750 bp, Chlorella protothecoides
atggcccggccgggatccgcgatgcattgccacccccgtcacccctcaagcgcgtcgctcccagtccctggcattccatggcactcgcaggcgctgtcggtgtccctggtcatcctgggggcgctctacctgcggcgcaagtacaccatagaccccaacaccgtctaccgcctggccatggtccgcctgaacacacaccccgggctgctggaggtgatgggcgcccccctggtgggctccccggtcagggctacggtgctgacaggtggcaagctgcggttcaagggcctggtgccgcggatccagtcgcggagagcccagatcatcttccccctgcgcggcagcgaacgcaaggggctggcatccctggaggccaagaagcgcaagggcaagtacgtgttcaagctcattgctgtggatgtgcccaccctgtccggccccgaccagcgcctgttcatcgagggcgggcccgccatttaccagcgcggcggcatcctggatgagctgagggaccccttcatcaaggccatcgcagcagaggacgcgttcgtgcgggaggacgaggcagacgacgcggcagaggccgccgaggaggcgcacgccgccgcgaacaaggcggcgacgggcccgcagcccctggaggccgggggtggcatgtatttctgggagagggtggcgctgacgtggcagcgagggctgcagcggcttcgcggcacccctgtcccgcccgcgtcacataagtcggcgtga

SEQ ID NO: 2513 - DNA, 522 bp, Chlorella protothecoides
atggatgtgggctggtcctctgacgggtctgccctggtctccgcttccatcgacaaccgcgccattgtgtgggacatgggcgacaggaagcgcggggccatgctggcgcagctggcgcaccacaagcactttgtgcagggggtcgcttgggaccctgtgcgccagtttgtagtcacccagagcgcggatcggacgggattgtggttggccctttgggaagcaccaccttctggcatggttgatgcacagctccaagggtaccgagcagctggtgtgaagacccaaggccccgagtccggccaggtcacgagggctcctgagcccctcagtcccaccaacccatgcgaggtgggcatggggagtgaccggccctcatgcattcccacgcctcagagtgtatcgcctcaagccgccggcggtggggaagaaggctcgggcaaaagccgcggccgccacggcagctgcaactgccaaggatctttactgctgcgccacgctgagcaagggcgccacccggggtga

SEQ ID NO: 2514 - DNA, 1419 bp, Chlorella protothecoides
atgcgatgccgtcagcataggcctggtgtttgccgcgtgcccgcctcaccaaggggacccctcgcctcctccataccccaacctccagggtgccgcggcgagtatgtgatcaacgcgcggcgggccatgcaccttcaggcggtgtgcaagtcgcggtccctgggcgtgtacacccccccctccggctccgcctcctgggctgccacgggggggtggtactacacatgcaacatcaggccctgggtgctatgcctgcaggccctgctggcggtggccacctcagcgaccatcatctgggcggaggccacgatcgggtcggggcgcagcccagacctgtcccccttctcgctcgcgatacacacgcgcgtcgccaggcgggagttcctggagcagctcatcgtggcggcgccgctggcatacatgtgcgcctgcacctacttctccctcttcaagctggggaactttgggttctatcacatggggcatgcaaggcagccctgcggtgcatttcaatgcacgctccatacgctcctcacccacaaggtccctggcgcgacatggtcgagatcactcctgctgagcggcagcttgctggcgcgctttgcagccccgctctgctacaacttcctgcatgtcatccgtatgaacgagtacctcaaggacggacaggtgggccgcgccatgcctcagcgcgggcagcgcttgcggtcatgggcgctgggtggacacgtgtggctacctggttgcccgggcatactgaagcaggcggccccgtcaagaacagcctttccccctccacacccgcagcaaatggtcttcatcgccaagatgggcagcgctttccaggatgtgcccatccttggccagagcttcaacacctggttcccgctcctcctggtggtctatgtgctgctcctgacctttaacctctgggagcagtgtgcttccaagttcttcatctcagaggccgtccgattcgatgtggagcgagcagatgacgagcacagcagcaaggggcagcggctggtgctggcggagcaggatgcactgctgcggggcggtgccgtgggcgatggcatcgacctctttggcgtgtcaggctccgaaggccatgacccctctgcagcggcgagtgcaggcagcgaccggcagcatgtggcggtgcagatggcgatgacggaaaaacggggtcgatcgtcgccgcacgccgcgcacgctgcgccgcagattgcaagtgcgggacgtaacaaggacgatgtggcgcgccctgcctcggaagcccgaatagatgacctgtttggtgacctgggggggcggcgcgcttttactccggcgggcacagggcccgggaacggcgaacagaggctcctgcccccaggacagacgtccagcagcagcttcagctggaagctgcgctga

SEQ ID NO: 2515 - DNA, 234 bp, Chlorella protothecoides
atggcgagaaataagaagggcaatgtggtcctcgaccctgcagaggcgcggctacgggctatctctgacatcgtgggtcagctgatagctggactgcacaccggaaaggatgtggacttgaaccagatcaagcgaattgcttccaccaagttcagcctggcgcgtgctcccaagctcgtggagatcattgctgccctcccagaggagcaccgggctgccctgctgccgaggtag

SEQ ID NO: 2516 - DNA, 243 bp, Chlorella protothecoides
atgacgcaggtctctcagggtgaggatgggtacgccaccattcagcacacggcctccctcaccggccactccaagacggtgaattgcatccgcttctccccgacaggccgtgacctggtgtccagtggcgatggaggggagatgctgatctggcagccttgcgcagatgcccaggcgccacgaggaaacttgtctgctgaggaggaggagccgtgcatgaagcgggctgcggtcctgcggtag

SEQ ID NO: 2517 - DNA, 591 bp, Chlorella protothecoides
atggcgcttgcgcgcctggctcgcagtctgagccaggcttgccgatgtcctacccagatttcgagagcttaccatgcaacctcccaaggaaccttgaaggcgtgcctcgattcggggccacggaccgacaagggcttcacggccgtgcaaggcctgcataggacgcactcccggctgggcgcgcttggccgcggcctgcgtgccatcagcactgcagagaaggctggaaacgccatcaggaatgcagccgcatccacgggagctgcagccaagggcatggcgggcgcgctggccaaggtccccagcaccgcctactccctgcttcctgcccaggcccgcttgctggccgaggccacctccaagccgggcgtggtccagcgggtcatctcgctgcagctcaactccttctggcagcagcatgggaacaagatgtatgccgtgggcggcatcttcctggcctactgcctctggcgcaccatgtatggggtggcctccaccttcatcaacctgtccgaaaccatggcggccgggggtttcctggtgcgtctgtgtgggcgtggaggggtgccagggaatggatgcaacgattga

SEQ ID NO: 2518 - DNA, 393 bp, Chlorella protothecoides
atgcccatgagcctcctctcggcaagtccggcgcacgcagtcagcgaggttgctcagctcgctgatggccgtgcatccctgctaggactcctgctggtgcctgtcctcggatgggtgcttttcaacatcggccagccagccctcaaccagctcaagcagatcaatgactccaagtctgggaacactccggggcgcaagcgccggtccgtcgttggtgccgctggcatcgggacggcactggcccttgccatggctcagtctgcagatgccgtgtcagagatcggacagctggcggacggccgggggaaccttttcctgctgcctctcttccctgcccttggatgggatagcagtgcggaggatctgattctgtccattgcgctcatcccgtag

SEQ ID NO: 2519 - DNA, 390 bp, Chlorella protothecoides
atggtcgtggcgcatggcacgctcctcatcccctcccttgccggctctgcgcaggtcgtggcgcacatgatgccggacctccccaatgtgggctgggagagggacctggaatcctttagagagtactttgagaaccctgcattccgctctgatggtctcaagctctaccccaccctggtcatccggggaacagggctctacgagctctggaaacagggcctctaccgcaactaccagccagaaaaggtaaatgcgactggatgtttgcatgcgccgactctgacgcatgctcccgcctcccaccccagcatcctgttggctttcgctgcccttgtgcctccagctccttcacaccttcccctctggcctttcgtgcggcgcagcttgtag

SEQ ID NO: 2520 - DNA, 687 bp, Chlorella protothecoides
atggcgccaatgtctggcgctgtgcagcaggcgctttcccagctcggcctcaagtccatccaggctggggactgcaagctcatgtacaaggggtcccccgtggacctcaatgcccccttgcgcttctccaatctaccctctggttccagacttgaacttctcactggcaaagaggttgcgctgggtgtgagggactcccgggagttgaaagccagccctgccgctgctgccccctctgcgagctgcagtgcgccgtctgttgcagttaaggccccagcatttcagcccgacgatgctcagcccacgggaccttcttggcaacctgagtcgaccgcaccagaccatggcaatggtacgagtcgcatgcaggcgcatgcccaggcagagacccacagcgccggcgtggagggcgcttccaacaccaccacgccggccgttcaggcagaggaccttgaggacgacccatcagtggctttgtttggacgcaaggtccatgtctttcacacgcaagacgaggccacgagcgtcgaggccgccaaccaggatcccccagatgacttttacgacttcaatgagagcgactaccggcatgtggtggcggggtacgcagcccagaaggccaagcaggctggtgcggtgctgaagacgcggcaggtgcgctgcatgcatgtgatgggtgggcgctga

SEQ ID NO: 2521 - DNA, 276 bp, Chlorella protothecoides
atgagagtggcacagatcgctgttcaacggcagaagcgacttgaaggatgccctctgcatgcgctcaaccccgagacctctcttcacactatctgcaaggtgtgcatcgaggaccctttcgagctgagccacgacctggggcgcaccgtcgaccgccagaccagtggggtgctgcggaaggagttcctccgggccgccacactcctccgtgactccccaaaccccctgcaccagctgtttgagcgtttcatcgggaagcaccatgcagagacctga

SEQ ID NO: 2522 - DNA, 1695 bp, Chlorella protothecoides
atgtcagcctgcagtcctcatcccctctccttcacgcgtctcttacccacgctccagttgcgggagcgggaggagcaggcgcgcttcgaggcccaggcagacaccccagttcccatccgcctggtcctgcccgatgggcactgcctgcaggccgtgctcaaggcccgggagaccacgggccgcctgtacgacctggtggccgccgccctgctccccggcctctctttccacctgtttgtgacgccgcccaagatgctcctgccccgccaggacggcaccagcctgtggaaggcggagctgctgcccgccgcgagggtccacgtgggagtggagggcgggcctgccccagggaccctgctgcgcccagaggtggaagcgctcgtgcaacgcggcgcgcccgccccgggattcgctcaggccgggcagcaggggatcgggcggggtcctcaggagcgcgaggcgatgccacagctgccggcagcggctcatccgcgcaggcctccgacgggcggggcggcgcgctcgggacggatgttgccgcgctcatcgtcgagacgcacggcacctggtggtggtgcttgttgctcaattgccggggggactgccaggcgcccatcgtctcatgtacaggccactcagccgcaacgcccgtcgtctgaagggttgcaccagcccaccctgcgcccgtcgctctgctccggccacgacgccaactttccttcccagtacacccaccctcaggccccccccgtcgctatccctgtcgcgcagctcctccacggtccagcccttcccgccatccccgccctcaaagtgcacgatgcgcgagtggaagcccttgagcgcggggcggtgcccgatgctgagcacggtgatgcctgcgcggatggcggcgcggtacagcgccagctcgccgtcggccgacaccgcgctggtgcactcgtccagcacggcgtaggccggcgcgtggaagagcaggcgcgccatggccagcctctgcttctcgccgccgctcagggtctcggtccaggcctggacctggtccaggccgcggccgcgcgcggccaggccgtccagctccacggcctccaggcactgcgccaggcgctcgtccagcgcctcgcgcgaggggtaggcggcggaggtggcccagggcgcgacgcgtgcgcgggaggcgggggaggccaccgccagcacatcgcgcggcggctcggggtagagcagctggtcgcgcagcgtgccggagacgaggtaggggcgctgggagaggtagaagagctggcccttggggggcagcgtgatctcgcctgcctgcagcggccacagccccgccgcgacgcggaagagggaggacttgcccgatccgttggggcccatgatcatgacgctgcgcccgggggtcacgtcgaaggtcaggccgcggaccagggtcgtgccgtccggcgaggtcagcgtcacgcggtcgaagcggatggtggggccctcatgccgccgcggctcgggcagcggatccagcccggcggggccgggccccgccgccgggtccaggccggcggggccgggccccgccgcatgcgtcagcgacccggaggaggagacgttgcgcaggtagagctgtgtgtgcacgcgctcggggttgtcgctgctcaggttcttgacctgtgggcagggtccggggcggatggaggctggtga

SEQ ID NO: 2523 - DNA, 231 bp, Chlorella protothecoides
atgcgccccgtagctcgccccagcaagccctctccatgcccgagatgtgaagccgctggcctgccttacatcgcctgcagggtgggtcgctccgccgagaagctggcagatgcttcgacggagctggaaaaggtgctggccatcgcgctggccaccacacagcagatccctcggtcggacgcacacctgcgccccctgtcagatgcagtggtcaagtgcgcggccgcttga

SEQ ID NO: 2524 - DNA, 441 bp, Chlorella protothecoides
atgccgctggtctcctctggcgtcgagaaggggaacctccgtgagctggcgctggcgaggtctgcggagctgggactcaagtgcagggatgttcggactcgagaggtcggcatccaagacatccataataaggtgtccggccctgagcgccaaccagagctgcgagggcgctgttctgtggtgcgggagctgcatgtgtacggcacggcggtggcggtgcatgcccgggatgcctccaagtaccagcatcaggggtatggcgctctgctcatggccgaggccgaacgcattgctgcctgcgagcatggctccacgcgcatggccgtcatatcgggcgtcggcacacggcactactaccgaaggctggggtacgaactcgacggaccgtacatggccaaagatctaaaacccctgggaccagcacccccctgctgggactga

SEQ ID NO: 2525 - DNA, 1464 bp, Chlorella protothecoides
  modified_base (613)..(622): a, c, t, g, unknown or other
  modified_base (1393)..(1402): a, c, t, g, unknown or other
atgccaggcactaagctacattctccaccgatcagcaacatacctcgagatgaagttgaggaatgtatacaacgcgctcagcaaagaaagctcttggatgcaagagttcgggacggcgaagtcggggagtgtctggtgtcctcccaggctgatgcggcagacgagtgcgcggggttggaatttggcgaagcaatgagcacacagggcgtgcgtggtacaccgtgtgaggcctgcgcggtgttgggagcagctggccgaggctttgtgggctccgcctctactcctggtcccggtgggcagggtgacgtgatcctatcgagagaacttcaaaaagggttgtaccgctctagctgcttctcccccctgactagccggctctcgggccaccacgaccgcacgcgccatgaacctcgcccgtgctggacactcccagcctgcattagccaggcaccagcccagctctgtttggcctgtcaccgttcgaacctctcactttatgcaacctgctcccctcccccgcccatcgggcggtcgcgcccgtgcagcagtgaatcttcacagtcctcagcctgccgtggaggcagcgccagccgcacctcctgtcctgcccttnnnnnnnnnnttcccctcccccgccgatcgggcggtcgcgcccgtgcagcagtggatcttcacagtcctcagcctgccgtggaggtagcgccagccgcacctcctgtcctgcccttccgtgtgggccatggctgggacctgcaccgactggagccgggataccccctgatcatcggcggcatcgacatccctcacgacaggggctgcgtcgcccactccgatggtggggtgtattggtgtcggtgtgcagggcatggcatttggaatcagcatccaggaggcacctttgagagccgcatgcacctttcccatacattacaccttcccacaccacccgtcccacaggcgatgtgctgcttcacacggcgcgcgcagcgacatctttctgcgggagagcgtgcggctgatgggcgagcacggctactccctggggaacatcgactgcaccatcgtggcgcagcgccccaagctctcgccgcacaaggagtccatccgggccgcgctctgctcgctcctgggggcgcacccctcagtcgtcaacatcaagggccacgtgcactgaggtgcgaggggaggagggtcatggcgcagtgcaggggagagcagcagagcacagatgcgggacgggttgcagactgttgctttccaccccatcaccccctctccacaatcctcgcccctgcacaggccaaaacgcacgagaaggtggatagtttgggcgagaaccggagcatcgcctgccatgctgtggtcatgctgtaccgacgagacgatgccaagnnnnnnnnnntaaaacgcacgagaaggtggatagtctgggtgagaatcggagcatcgcctgccatgctgtag

SEQ ID NO: 2526 - DNA, 615 bp, Chlorella protothecoides
  modified_base (98)..(107): a, c, t, g, unknown or other
  modified_base (360)..(369): a, c, t, g, unknown or other
atggctccccagaaagcctcggaactgctggaggggcttggcaagcgcctagaatcagaggaggaactgaggaagagcctgtgtgcttctatcaaggnnnnnnnnnntcagcatggctccccagaaagcttcggaactgctggagggccttggcaagcgcctagaatcagaggaggaattgaggaagagcctgtgtgcttctatcaaggtaggcatgctgccgaaggaggagccacgatctgccagggagtcgccctgttgctaaacctgggagttcaaagaatccttctacccttgtgcttggcccccatcacctccgaattacgcacgccgcgcagtctgttgtcgtgttcgtcattnnnnnnnnnntggagcctcgatctgccagtgagtcgccctgttgctaaacctgggagtccaaagagtccttctacccttggcccccatcacctccgaatcacgcatgccgcgcagtctgttgtcgtgttcgtcattgacaaggaggagtggactctggacctgcggcctgggcagggctccctgtccaagggcagccccgctgagaaggcggacctgacactgaccatcaacggagccaactttgtgcaattgtga

SEQ ID NO: 2527 - DNA, 354 bp, Chlorella protothecoides
atgcatgcactgagctttgcgtgtcgcgccctttgcgtcataggagtacgccctccttcccggcgtgtggttgtcggaccagggagggcattccttggagcgcgcctggcaccctcggggcgtagcggcggagtcaggcctctgaagataccccttgccgcatcgttgcaaagtcgtcaggaggctatcacccgggagatgagcctgctccccaaggaggcctgtttgatccgactcttcaatgcagctggatgccaccagtgggaccgcctcgctcccttggcacgggagttctatgatctgggtgggagcctggaggagctcgtcgcgacgacccgtttcctcgtcacgtga

SEQ ID NO: 2528 - DNA, 96 bp, Chlorella protothecoides
cctggtgctgcgcttgcgcggcggcatgcagatcttcgtcaagacgctgacgggcaagaccattacgctcgaagtggagtcctccgacaccattga

SEQ ID NO: 2529 - DNA, 609 bp, Chlorella protothecoides
gcgtggcggctctgcaaccagagccacatcaaccctacccgctcaacaagccccattccccttccatcgcaccccagtcctggtgggcatgtctgggcagctggcatcctttggcatcatctcccactttgccggggcggttggggagaggctggtggccgccaacctcagctggcccgtcgtcttcggcctgctcaacgccgcgtactttgcgctgcactacatgtttgcctcccagaccgcgcatgtgggcgcgctgtatgccgccttcctgggcatgatgcaggtggcgggggtgcccgccgtcctcggggcgctgtccctgggcttcatgagcaacctctttggctccatcacccactttgggtcgggccaggcagccgtgtactacggagcaggtgtgtgggattggtgggggggacctggagagcgactgacaggcttgtgttgtggggcaggggcacagctcctagagctcgagagcattctaatgggaacctgacgatgaaccacgccgtgcgaatgctcctggcgtcctccatccagtccgatggacctgtctcactctctgttcctgcacatcaacatcacaaggctatctggagctga

SEQ ID NO: 2530 - DNA, 2175 bp, Chlorella protothecoides
atggggctcatcctcccgcgcctggcgggtccgaaccctagcctgcggcccgctgctgtgccctgcagccggaggtcacgaggcaccgcggagggcgcgcggcaggtcggctgctgcccagtccgagacactggatggctggcattgtgccttcctaatggtagtaatgagcacgatatacagctacagacctgggatcggaagagactggcccaaagtccgcatggtggagctaaggccatcgggttaagtggtcgccccacgcaggcgcagcagggatggactggattctggatgcagctgatcaacccctgccaacaagcaccgatgtttttcgatgaccttccagtatggtttagactggaggccgcgcgatcgagccgaaatagcaaagtcttcgaggacggcgagcaaggtgcccagttccgcaaccttggtgacagggccgcaggcaatctaccgggcctgacggtccgtctaagcacctgtttcacagcacgccaagctccccccgctcgtgcccgcaacaccctcgtccccagggttggcaggaggcctttccgcaggactgcaaaagcctttgctgcggccggggccgcgcccagtgcatcatccgacgaccctgccgaggagaaggtatccttggaaactgcgctgcgagaagcccaggaagccctgactttcgttgaggagttccagggtcaggttacctccctccccagcgcacgcctgcccacgacggtgaggagaaagggactggggatctgtgtgagaaaccctgctcacggctttctttctgcatgcagctgtgtggtagaggtaggtgcaatgcggtcagcacgccaggctggcatggcacggcagctgtcttcacagcacatcagctctccctgcatctccccgcacacacctttggataagaaacccccacccacccacctctgctgcccccagctagacatggttttagccaagctgaagcccgtgtttcaggtcgccggcctggtggcgctgtgcgccgccatccacgctctgggcatccccggtcgcctggtcggcggcctgaccctggcgctgtcggccgcctcctggggcctgtcccggggttccctggaccgctccggcgcggcagctgcggtggtggtgggctggatcaccatcgccacctccatgaccggcggcctgctcctcctcaccttcttcgtggcctcctccaagctcaccgcgctgtgcgaccacgagaaggagctggacgacgaccacaagcccggcggcaaccgcgactggacccaggtcctgtccaactccgccgtgcccaccgcgctgctggcggccgccgcggcgctgggcaccgctcccacgctgggcccgcgccacctggcggcgctgcatgcggccgtgctgggctactacgcctgctgctgcggcgacacctgggcctcggagatcggccagttgtccgacgcgcagccgcgcctgccctggggccggcccgtgcgcccggggacaaacgggggcgtcacgctgctgggcaccgccgccagcgccgcgggtgggctcttcatgggcgccatggccgccgtcggctgcctggtcaggccgggcagggcctggggctgggccgcgcccacggggcccctgtggggcgtgctcctgatgggtgagtgggtcagacagaaatgtgtgttgtttgggtggggtggaggggggacctgggggagaagggtcggcggaggcggttgcagtggggaggcagctggtctgtgctgccgcatcccttgggcgccggagttgccggcgtctgtgctccaggtgcaccccggccagcaccaccagatgaactctcaatcctgtaccctgcgcatcccctcaatctaccccaccccaaccctcgccgtccctgcatcgcgctccaggcctcgtggcaggcgtcgggggctccttcctggactccatcctgggcgccaccgtgcagttcacggggtacaaccgggacacacacaaggtgacgagccagacgggggagcacatctccttcattgccggccggccctggctgagcaacagcggggtcaatgtagcctcggcctgcggcaccgcgctggcctgcgcagcagccacgctggtctgggcagtgtgagggctgtgggggcgaggacgtgcacattggcatga

SEQ ID NO: 2531 - DNA, 1173 bp, Chlorella protothecoides
  modified_base (316)..(325): a, c, t, g, unknown or other
atgtccgcggcggcggtatccctgagcaccaaaccattcgcactccacaccaaacacgcacaggagctcctccccgaaaaacggttcttgttcttccccgagctcccctccgtgtctgggtcggatgccctgcaggctcgcgtgacggctctccgccccgacatccacatctttgggcacacccactttgcgtgggatgctaccctggatggtgagcggtggggcccggccaccgcacatgtctcctcctctcaaggaaaccatgagcctcccttgcggggcgcacaggccacggtctgcatcagtgcgtctacgnnnnnnnnnnaaggaaaccatgagcctcccttgcggggcgtacaggccacgctctgcatcagtgcgtctgcatcagtggatgatgttttgtggggcatgcggcaatccttcagggtcgccaccacccccacgtctgcttgccacacaggcacacggtacatccaggcccccctttgctcgttccgggaacggagccggcgcctgcagactctgcggctgggtctgaaggacctgaaatccgtggatccagcgacctggctgccagccctcatctacgagttccctctggatgccaccggcgcccagcgagcagcatgtgcgataagaaaaagggctgtcgagcaagggattgcttttgtgggaccgggtcatgctcatggactggacggcgtggcagggagttgtcctctcccgaccacatgcgggcggcgcgagaatccgggacaggcaggtgggatccgtcgcctcacaccactgcgtcaagcggctctgcccgcctccacgcagggcgcgagtccagggcaggccagggctggtccttcctcaagggtggggccatgccacccacctacacggctgcctggagcgagtactaccgacgctgcgagcgggaccctaccaataccgagccggcgccgtgggtggccaaagcccaggagaggaggaaacagcgagcggcccgcagccgggcgaccaactctgcggccacgggtgctgagtcctgagttccacgtggaaggcgtccagccttctctggcaggacgctcgggtggctcgtgctgggatcaagattgctcctggtcgccaagccatctcagcagccagattcttggcatgcaggtgacccttcggctctga

SEQ ID NO: 2532 - DNA, 966 bp, Chlorella protothecoides
atgatcgttgaacaatgtccaaccattccagcccccagctgggagtcgctcagtgccatgatgtcgtgtccagcggagggtttatcggcaggcacgctctctcgatgcagggatgatgttctcctctttgccggcgatgcctctgacaagctggagaacgtggaatgggccttccagaccctggcctccgcctttgggatggtcgtctacgtccccggcaaccacggtgcgctggtgtggccaggctcacatctgcatgctgatacgggttgcatgcttcctggcacactgcaggaaggaattggaggtggggaagaattgtcaccgaccctcagtgttgcgtccttacctgatctgcaagatgagctgtgggtccggcccgtggatcgagccaggggcctgcacgactcggcggcaaagctggaccagatccagggcctgtgccgggagtacgacgtccgcacccggcccttcctcctgcacggcacggcctgggtggtgccgctgctgagctggcaccacgcctcctgggaccgggagcccggcatggggggcaagcgccacgcgtgggccttctccgattactccgcctgtgtctggcccgacagcatcccgggcgccggcagcgtcggcgggccgggcctggcgcgctggtttgacgcgaagaacgagggggagggctgggcagcggcgctggccggggtccgcgagcatgacgtcatctccatgtcccacttcctgcctcgggaggtggggcgtgggtggggcctcggcggaagtggagtggagggcgaggtctgctggtcagggacacctgctcatgctcaggagcaaggggaggcctccctgatggggccaggcatgcaagggtcgcacagagtggacgatgccgcgaccatggactgccatctggggccctggtcccctctgaccctccatccatgtccgtggcggctgtatccctga

SEQ ID NO: 2533 - DNA, 1044 bp, Chlorella protothecoides
atggtatgccggccgacaacacgcccgtcacccacccgcttgcagagcctcgtgatggcgctgctcatcgtctctcagtcgatagcaattgcagtcccatgcccctggttcaagcaaagcgtctccctgctgtccttcatccgatggacgctcacgaactctgtgagcaacggtgctgttgggcccactggaactggggtggatgctgcgactcggtcgagtgcagcgcaaacaaccatgtgccaaatacacacgcttgttccacggtgttgctgctgctcatgtgatccagcctctgcgcctctgcatctcgtcgtgccacttcaccgcgctggcctgtcttccaggcctcgatgcggtggcaccatcctgacctcattcttcggcctccagcacacactgatctgtcttcagcccacccacctgcccgaccccatatccattcagatcctggcgtggatgtgcgtgatgatgcgcggcatgtgctggtaccgcggcagtgtgcagctcccggaccccgaccgccagctcaccatcgatgcgccatggcggaggcaggcctgggccaatctgcccaccctcctgatcttcctcagcacggagacggtggtggtcgccaagctggcgtaccgctggatcgacgtgcaggaggcagtgggcgtgccggcctgccgcacctacccctatgactgcaccccctccacgggcgagtttgtgatcaacattatcaccaccgtctgcctcctcgtgtacgcggtgtactacatctacctggtggtccaggcgcgggccgaccacgccaaggtgcccttcacacgctaccgcgtcacctacctctacgtccagatgcacgtgagtgcgcgcgggggaagaaggggggggggaacaggggttgggggaggagagattacggtggcgttaacggtgtgggttaggagtgcggcaccctcggcgtcttcaccttgtgctcggggccacaatggaacctgggcgtgcgatagaacacctgtgccccccctctccagcgtgcactgtcctgcatga

SEQ ID NO: 2534 - DNA, 2193 bp, Chlorella protothecoides
  modified_base (1946)..(1955): a, c, t, g, unknown or other
  modified_base (2107)..(2122): a, c, t, g, unknown or other
atgcctggattcgatcagtcatggccccagaccggggccagacctgaagacctctttctccacatcgacactgagcagccctcaaagcgcactctccatatatccgcgatgaagtctggaacaacaagggcacccgcagattcaggcattttcaagagcctcggcgtcgtgcctgctttcttggggtttgaggctcccggtgtcacaacgatgtctgagatacaggaaccggcgacgggagcgatcttcccgagtaccctgagaccttgggatggaggtgtctacaagaacttgggcgcgggtccaaggatcatgaaagtcgctttcatcagcatcaaggtttatgcggtctcgctatacgtacccatcgagcgtctaccactagcatccggaacagctctctctgaagctggatctccacgagtgattcaggtgtgctgctccacccctgcatgtccgacgtttgaacagcaggtttattatacaaccgtgagacaagattcagcaaattcccctgctctcctgccccagatgcaactggccaggaatattgcaggcagtcagtttagtgacacgatgagaaagtccatgggtccatcgatgagtgctcctcgacccgttcccatccatggcagccaggacctcgcaagtctgaccaagttctgcgactttataacacagcagcagctgcagacggggacggtaatcaccctcctgctgggccctgccagcgaagtcgacgtcaatgtggaccaagtttctgcagtgtcaggaggatccaatcctgctatcttgaaaggagttgccagctcttgtgccaatgctggcatgggaaagcttaccctttcacccctcttcatacaggccaagccacagctcagcctccagagtgaagcattctgtgcttccctgctccagatctatctcggtcccaagtccgtcattccagaggccaaaaaggcctggcttgccaatgctgggcgggcggcgcggactggggtttgtgacaacaacaacaacaacaacaacaacagtctcgcgtcttgcacagcaattatagacggccaccccccaatgctgtgttacggaggtctaaacagaaatgttctcgcatccgttccgtcgacagggtgctggggtcggaaggcgaccgcagcccaagccaggcagtcggttgacgaccatccgactgcccgaggccgagctgctgttggccctccatcaaggtgtgtattgggtgagctgtttgggttggtgaggatccctggcgtcgcgtgtcgtgcgaagctgtggataagaccgatgttgtttcggaaactccgcccaccctggccacaccccttgtccaatgcagcgacaaaagtgggccagcacagcaaggccagagtacgcaacagaacccttacccaatggacactaacgttgtggcgaccagacgatgctttcccgacctcgagacctcttgcttccgcgggtcaggtgaatgtggtgattggagtggattgtttcgttgatccgtattcaacaggcttagatgcgatcgaggttcagcataaggaggctagttcaaagtatacaacaggcttagatgcgatggaggttaagcatatggaggccagttcaaaggtggcaattgcaactcagaggcggaaacatacatcccaccctggccctcgaatgcccccggtgcaactcgtctcagtcaacgagctggcgggtgatgagaacgagaattgtcaggcgcggtggagtgcggcggtgaacgagtggcggacggagctcggcgaggcgggcatgacaggcagatatgggaaggtgatcgatgactacgcgacaacctccgtcaagacgacgtggaacggcttccggggtcttccgaagaagacgaagaagacgatgcagcagcaggagcgtgtttgtaatgccctgcgaccgaccgtggacannnnnnnnnnaaagaagaagacgatgcagcagcatgagcgtatttgtaatgccctgcgaccgaccgtggacaacatcgtcgccgtcatcacagaatcgcgtacagtcggcgacctgttcgccaacttccacgccatccggatggtggaggagttcgagcggnnnnnnnnnnnnnnnnattacatgttttttccaggtgggcctcgtgtgttgacgatcagaggggtttgggaaatgagtgatttgtag

SEQ ID NO: 2535 - DNA, 414 bp, Chlorella protothecoides
atgctggcatccatcggcctcggcctggccgtccgcttcctggtgcccatcccccctgagatctctctgcaagcctggacgctgctgtccatctttgtcagcaccattgcaggtcgttatgctggggcgggtgcagcggagtgtggcacggacatgcgtgcaattcccagaatctggtgcattgcgcagctgctgcacttaggcctcgtcctggagccgctccctgttggggcctgggctttcctgggcgtgacgaccgcggtggccaccaagacgctcacctttgcacaggccttcaccgcattcaccaacgacgtcatctggctcatcgtggtgtctttcttctttgccaaggtgcgaaagttctgctccagaactgcctcgtgtgcgggaccgtcggcagagcagggatga

SEQ ID NO: 2536 - DNA, 486 bp, Chlorella protothecoides
atgccgaccttgcacatgcatgtgtgctgccccgttgaggtcttcgaagtagggtacctgagcaaggagctgaccgacatggcgtatctcgcggcgtgcacgtctctgcagggcttgcagtcccaccgaaacgcacggtatcggagcgcggaggttattctgttcaagtcctgcaccccacacttcccatgcagtgctcgctaccgcggcaagggcactgacctgagcagggtccctgccttccagaggagtcccaccgacagtgggtcgtctgaggtccagatcgcccgcctgaccgcgagggtcgcccagctgaccgtccatctgcaggagcacaagaaggactacgcctcgcggagaggcttgatgcaggtcctgtcgcgccgcaagcagctcctcctctacctgcagtctaccgaccgaccaaagtatgagcatgtgctgcagtccttgggaatcagggcacccaagtctggcagcatctga

SEQ ID NO: 2537 - DNA, 939 bp, Chlorella protothecoides
  modified_base (685)..(694): a, c, t, g, unknown or other
atgtccgccgaggagcgcccctccgagtcggtgctgttcaacgtccagcactcgcccgtggcgctgcaggaggtctgcgacttccggtatgacgtgcacgtcgaggcgttgggcgtgtcgcgcgacctcaagcacaagctggcctgtggctccctggtggtggccttccgcatggagtactgggagttctggacgcgcgggctgcagcccgggcgcgactacgtgcagctgaccaacgaggaggaccacgtgtgcaacgagacggccgccgcggtgcgcgacatgaacactctcttctccacggtgggccagagcgcgctgcgtgggcccaagcaggagacgcccagcctggcccgcgcgctggcggagctgcggcgcagcccaggcgccgcagcgctgctggccggcgccagcgaggacgacgtgcccgcccctgacgccaacggtacctactcctggggcagcgcggccacgccctgggagatcgcctgggcgggctacgacttcctgcacgggaatgtgcggctggaagacgcggtggtgtacacgcgcgacctgctggcggcctacgccgcgttgcaggacttcaaggtcaagccgcaggcgggggcggcctgcttcaacgggccgcgcctcctcgagcgcctgggcggggcagggagcgcgcggggcaagcgcgtcgcgnnnnnnnnnncaagccgcaggcgggggcggcctgcttcaatgggccgcgcctgctcgagcgcctgggcggggtggggagtgcgcggggcaagcgcgtcgctgctgcacacccctggctcgccgactacgacggcaactgccacgccgccgaaaagtactgggatgacatcaagtaggcggcgatgcttggatggccttgcagggaaggggtgcctgggtcggagtgtggcgcggcccagcctcgtacgcatgtga

SEQ ID NO: 2538 - DNA, 390 bp, Chlorella protothecoides
atggacgcgctcagcgtctttggggcccaggactacaccaggctaccaccgacggtggcgtcaccgttctctatgactttgcatcccagggtgccccactccaatgctcgtcaccctcacttcacctcccccaccttgaaaccacagatccctgacgtggatgcggtggtccacgcgggcgacgtgccctgcatgcgcaagaagtggatgcatggcggcccgccccaggtcctgctgggcgtccagggctcggtacgccattttgacgtcccgctgcctgactacacgctgtgggtggacgagctccagctcatccaggtgctgaggtgtcgcagtggggagcaagggaagggggcgggtgtggggagttggtgtggatgggatgcgtga

SEQ ID NO: 2539 - DNA, 183 bp, Chlorella protothecoides
atgcagggtgtggacggcgaggaggtagtgagctggcaggaggcctcccacctgatgcaggaaaagtactccaacacctcgctgctggttcgggtgccccaggccatgtggcgcggcgacgttctggacgccaagcatcccgagcgcggccagctcaggtactggctgctggatgggggatga

SEQ ID NO: 2540 - DNA, 1314 bp, Chlorella protothecoides
gcctttttgctggagtcgggaccctgggacctggagggcggctgggtcacgggcatggacgcgggcgcgctgaaggccacgctgcccatcgccttctccaccgcggtcatggcctggggctacgagtcctacacggccgccttctcggacgtgggtgcggccgacgacctgctgtccaacatccgctggggcagcgactacctgctgaagacggtgcaggccgtgggcgggtcgacctacatcctgtcgcgcatcggcagcgtggcggatgaggagctgctctggcgccggctggaggacatcaccgccccccgccccgcctacgtggtggacatggccaagggcgcctcggatctgggcgggtcggtggccgcggcgctggccgcctcctcggtcgtcttctccgggacgggggacacggcctacgcggccacgctgctggccaaggccaagtcggtgtacgcggcctccaccgccaacctgggctactactcggtccaggactggaacatctcggccgtgtacaacagctccaccttctacgacgacctggcctggggcgcggcctggctgttcaaggccaccgccgacgacgcctacctgtcggacgtctacgactactacgtcaagcacctcgagtttgaggccgcggtgtccgacttcaagttcgccttcgactgggacaacgtcttctggcccgccaacgtgctgctggcgcaggagacggggggcgccaccttcctcacccagtccgagctgtacctcaagtcctggatctgctccaacatggccgccaactacacggagaaggggcgcgcctacaacgccttctccgcctccctgggcagcaccatgaacaccgcctttgccgcgctggccctggccgacgtgctgggcgacgaccaggccgacaccgtgttcacctaccgctgctggggcctggcccaggtccgctacgtcctgggtgactcgggccgctcgctgacggtgggcgtgggcaagaacccacccacgcgcactcaggatcgtgacgccgcctgcccggaggcgccacagcctggagagctggcaccatgttgcatcgccgaggaccgattcccggcgccctcctcccaaatcctgcctcccaaactccgcctcccaacacaggtgtgcaatcgcgtgacggggctcctatcgcccgaggaggacacgcatgtgctggagggctcgcttgtgtatggctccggcaggagcgacgactttgccgacgtgcgcgacagcaccgccacccgcgtcggcatcgagagcaacgccggatacataggtgtgtga

SEQ ID NO: 2541 - DNA, 486 bp, Chlorella protothecoides
  modified_base (238)..(247): a, c, t, g, unknown or other
atgatgctggccatgggcacctttgtgtacgccacgcgcgccatcgccggcttcggggcagctgccgtggcggggcacgagatcctgaggacgctctgggtcaccgccacccaggccttttcatcgctggacattgccacccagcactccctcgctacgtcgccaggccccttggcccggggtggtgcctgcctttctattcgagcatcattcgatcacgctcctgcacgcacgcagnnnnnnnnnnaggatgtccctcacctgcaaccatcccgtacgaccagaggcggacgcgctccgccacatggagcacagcaggacctgcgagtggacggcgacacgcggtattggaacaatgcactgaggtctccgcaagccatgctaccgcaatggccagccgaccaggcgcacggggcacacgggagggcgccgagcacgaagccgctcacctcaaggctgcgcgtcttggacaaagggatgcagtaa

SEQ ID NO: 2542 - DNA, 687 bp, Chlorella protothecoides
  modified_base (179)..(188): a, c, t, g, unknown or other
atggttgtgcaagcgttcaaacgctggtcgctagatgcacatcagcgccaggtatgccctgcctgtctcagggtgccgtggagccgaaaacactccatcccttgcacaaatcaccaagctccacacactccacccctctgcaacccaatacactctccagcccctcgattctccccccnnnnnnnnnnctcgcacagatcaccaagctccacacactcaccccctctgcaacctaatacactctccagcccctcgattccccccaaacccctcgcaccaccaacccaccgtgctcatggactcggcggtgctgtgggcggcggcctcccccccccgcgcctgctccggcttcatggcggggaagaggagcacctccttgatgttgttggtgtcggtgaagagcatggtgagtcggtcgatgcccaggccccagccgccggtgggcggcaacccgtactccagcgcggtgcagaagttctcgtccacaaacatggcctcgtcgtcgcccgccgccttggccgcggcctgctgctcgaacagctcgcgctggcgcagcgggtcgttcagctcggtgtaggcgttgcacacctcgcggcagttgacaaacagctcgaagcgctcggtcatgccgggcagggagcggtgcctttggtttgtggttggggtgtttggggggagatgtcgtga

SEQ ID NO: 2543 - DNA, 1908 bp, Chlorella protothecoides
atgcttccccagccgctaggatgcaacactccccacctcggtcttcagaaggtccaccgtggggccggtggggcccacgctgacggagactgtcagcacagggtgaacctcgaagctgaagaaggtgaggcccgccacatggcagaggaaggtgtcgtcgtccaggcgctccacagtttcggcatccagcacggagtattggctggcaggcagggccatgtagtccgctgtgggaggggtggtgggctcgtggctcgaggcacgggcggcagccagagggacggcagggcctggctgcccctggacactcacgaacacaaacacgagtcacagcatcagctcgtcccatggacaatgaacaaagcaatgcacggtacccaccaagggggcgagaggactcttggaggccatgcgttgccacctttgctgccttcaggatggctgtgcgttgttccggaggaggagcggctgaactttggtcctgattctccccatgctgagccgcaggcgcatcctcttccacattccaagtgtgtcgaatggcggcagccaactggtggcgacctgggccgttgcacaccctggtcggccaagtgcggggtctctgtatcaggggaaggcttgctctgggccaaggggacaccttcgtggtccccgcaccgccatgcattgctcgagagccggccaggccggctagtggagcatggatatcgatctactgagaaaccatttctctgtcgacctggatgaagccccttgccacaagcaaacacctccacaattgcaatacattctcctagcagactacaacaagctcttcacgggctgcattgtcgagtattggtggcggtgtacgagacagctccgcctctgcgacctagggtcatgtggctcacccagcgagcccccaatccctggcctggggcggtgctcctccccagaatctcccggaccccatctgggaaatgcagggcgagggatgaccccggtggcgacgaacttaggtccaagctctccaaatggaccggcctgtcccgtgtacggcgtcaggccccggaatcaggggcccctgcgccgcctgaggccagcgtggagcaggggggcccagcggtgccctcccagtggagtgattgggcaggtgcggggccctggtccctcgcatgggtacattttgagcatgcagcttggcaaacggcgcacttgatagccagccatgaccaggactgggacgagtggaagggcgaggctgagccagacctggacgacgccgaggacattgcagcgctgcgcagcgccgtgatcaagaagcggcgggcgaggaaagggcggcgcagcgtcacgcgagacgagtggctgcgccccatcgtcgatttccagggcatccgcgacaggtgggtgggtgctggtgtggaggtgggtgggggtagggggctggcctttgatgagcaggacagtgaggagagggtgttcatcgaggccgctaccaaccagtttgagtcgcgggaggccgtcaatgccggacagaatgtcactaccctgatcccatgggcccctctcccccccttcaattcccgctcagggctcatctttggggtgtcgatcgtcgccggctttgcggtgagccggctgctggcagagccgctgtggacctacgctgcgggcgtcaaccccgcggcgtttgccatgtcggaccagcagaagttcgaggcggttgaggagattcacgccgaggagctgcgcctccagatggaggccacggtgggccaggcgcccccgctgtccgatgccggggtcctggagcacctgcgggcggaggccaagcgcatccaaggtgcagagaggggggccgggtgggggaatgggggtccgggttttggaatctcggatggagtaggcagcctacagtag

SEQ ID NO: 2544 - DNA, 306 bp, Chlorella protothecoides
atgcatcgcaagggatctcttcgttggaggactggtggtgaaccctgtgcaaacccgtcagtgaggagaggcggagtcgtggaggcgtgggagcctgtccatgtcagcaagcaccaagacccaccctcgagaccctattcaggcaaaatcacctacgcctggcggcccctggccacggccgcgtgtgcgggtgacgacagctccccctgcttgcatgctggctcctccctggtactgccggggtacggcgtcgagctggccatcaagaacatggagtacaatgccgcagacgacaaggcaggttga

SEQ ID NO: 2545 - DNA, 549 bp, Chlorella protothecoides
atggggggagtccttgaagatctgcctaggcaccagcagcccgatgcttgcccatcacagccttgctcactcatcaccctcagggtcaaggctgtgatggcagccaaggctcgcggggagaacccctacccccacaagtttgcgaccaccatccagctgccagcgtacgtggccaagtacaaggacctggaagccggcgagcagctgactgacactgaggtccggctcgcaggtaggcagcttcgcgggagagcggcggcgatgtcgtctggtcttgtgcgcatgcctgtgcccttggggatcatcgctgcaaccgcatgcacacgaccccacccgcttccccgcttctccctcccaggccgagtggagcgcaaggcggcatctggggcgaagctggtgttcatcgacctccggtcggccggcagcaaggtgcaggtcatgtgcgacgccaggtgcgcccggggactcatggggtgctcaatggagtgtgagtcgagacttgctggccggcagtgtggtgacaaggagcaccttggacgctcgagatga

SEQ ID NO: 2546 - DNA, 639 bp, Chlorella protothecoides
atgggggttgggcagtgtgcacttgcgtgcgtcctcctgaccaccctggtgctgctgcatccaagtctggctgatgtggggaggggtgcagacatccagctgcgagccaaatggaattccagcacctttgcccacgaggcagcggagttcctggctgcgcaggacaccgccgcgttctggagctttgcaggggctttcaccctgccgcaggacagcaccgactgccttgaacacgtgctgcggcaggccaggtccttgctccacgacgagcccagcaggaggttgctgggggtcgaggtggctgcgcgcctgcacagccccagggccgagctcttccacgccgcagcggcccgtgagctgggggacgccagccccagcatgccctgctgctgggccagtgtgggcggcgcccccttcctgtccctgtcagcgctccgagccgcgctggcggcgcctgcgacgggccgcgcgagcgagggcccaagggcgtttgatcacgtgcaccccgggccgccagagggggcgccagaggttccctttgtggccctgtatgcgccgctggggaacgcgtgcggagccgccttccatgcagagctgcgggcgctggccagcgcaggtgggcatggcttggggtcgtga

SEQ ID NO: 2547 - DNA, 378 bp, Chlorella protothecoides
atgtcctggcttcctcgcccctccccggcccctgatgtaagcaagcatggtcaaacccccttctccaaatccccacctgcaggcgggacgtaccgctggggcagcaacctgacccccacccagatcgcggcggcggggcaggccttcgtgcgcgacaaggtgcgcatgcaggacctgctgctctacacgcgcgacatgctgcaggcgtacgccgccgcgcagcgcttcacgcccgcgccgcggcgcaaggcgcgctgcgtcgacggcgcggccatgctggaggagtttggcacgccatatgcgcaggacgcggaggaggtggcatacgcctacccctggctcaaggactttgacggtgggtgcgcgaatgaagcgtga

SEQ ID NO: 2548 - DNA, 231 bp, Chlorella protothecoides
atgccttccccggcgaccccactgcagctgcggggttcccgcactgtgcgcgccgccaacgagaggttcactgcccggatgaggaaccgggtcagttggaaaccgggcgaggaggagggggctcgtgtcctcgtcagcgacgtcgacctcacggtcacgctggagctcccaggctggttcccgctaccccgaggcgccgtccaggcgacaggcgagtggtgcggtgtctga

SEQ ID NO: 2549 - DNA, 939 bp, Chlorella protothecoides
atgctggaggaggccgaaaacatgtacgacatctgcgatggcgacatgttccgtttccagatcatctccggcaagctctatgtctaccacgttaccgcccggggctttggttggtaccccgcccagctggggcctggccacgtggcggccaaggggcgggtgccctacgccatgctcctcctcctggacgtcctgcgcctcttcccagggcagatcccggacctggacgcggtgatgcagctgggcgacttcacctgcatcgcgcaggagcctggggcggggcgcacgccggtgcccatgttcggctacaccaccagcgaggggtacgctgaccttgtcctccccgacttcacctactacgggcacgagtacgactacctgatggacccctggggcaaccccgcccacggctggccggcccaggcctcggtgctgctcacaaagtacgccaacgtctcgctggcgtcgcggctgccgcaggccatgtggcgtgggcgcaccatggacagcaactacccgcaccgcgacgcgctgcgccgcgccttcctggactgcgtgcgcgcgctgcgcgcctcggggcgcgaggatgacgccgcgctgctcaacgtggaccgggagcccatcgtgatgcaggactttgacgactaccgctaccaggtgcacatcgaacccttggcctgggtgtccaacatccggcacaagctggcgggggggtcggtggtcatggccacgggcatcaagtactacgagtggtttgcgcgggccctggtcccgggaacccactacgtggagatccccgcgcgcgtgccggagatgtgcgcgcaggccgtcgacgtggtgaggggcctggtggtgtggatgcgcagagttcgtggcagggatgggggggccgggaaatctgttctcacagggggcaaacgtgcaggcccaggtggctga

SEQ ID NO: 2550 - DNA, 450 bp, Chlorella protothecoides
atgacggaggagctgctgtcggggctggcactgcggctgacggggtcctacgtgatcggctaccaccccgacggccccgaggggcccgaggtacagatcgactttaccccccccttccgccgcatctccatggtgtccgggctggaggaggtgctgggcgtgaagatgccggcggacctggagagcgaggaggcgcgtctcttcctcctggaccagtgccggcggcgcggcgtggagtgcccgcccccgcagtccaccgcccgcctgctggacaagctggtgggggagttcctggagacggggtgcaccaaccccaccttcatctgtgaccacccccagatcatgagccccctggccaagtggtgggtggcgggcgttgttggtttcattgaggtgggggtccgatgggtgtcagggccctggggagtccgagtgggtggggagggctga

SEQ ID NO: 2551 - DNA, 324 bp, Chlorella protothecoides
atggcctccaagagtcctctcgcccccttggtgggtaccgggcagccaggccctgccgtccctctggctgccgcccgtgcctcgagccacgagcccaccacccctcccacagcggactacatggccctgcctgccagccaatactccgtgctggatgccgaaactgtggagcgcctggacgacgacaccttcctctgccatgtggcgggcctcaccttcttcagcttcgaggttcaccctgtgctgacagtctccgtcagcgtgggccccaccggccccacggtggaccttctgaagaccgaggtggggagtgttgcatcctag

SEQ ID NO: 2552 - DNA, 240 bp, Chlorella protothecoides
atgagcagcgagtggaagcgtcgcgtgactcaggcttccaaggagaagaagctggcagagaagaaggtgggcagcgcagtgtgctccatcggtgtgcgggcccggcaggccgccgctgccgctgctgccgctgctgccaaggctgacaagccggcagtggccgctctggatgacgacgccacagaggaaaccgatcccaccaagtactttgagaatcggtgcgtgggtgttgctgaatga

SEQ ID NO: 2553 - DNA, 594 bp, Chlorella protothecoides
atgaacgccgtcaagcgcggcgacattgtcggcatcgtgggcttccctggcaagtccaagcgcggcgagctgtccatctttcccacctccctccgagtcctcacgccctgcctgcatatggcacctggcacccgcaccggcctcaaggaccaggtgggggagctcgaggggttgggcgagggttctggtgggggccagggacatgtctccccgggaaagggacatgtctccccgggaaaggtcccccgagcaccccccccctccctcagagatcactcctggcagcgtgctgtgggctggcgcgtcgtcacctgcctggcctccaacccacgccaacatcacgctttcctcccaacctgcccccgcgctgcgcaggagacgcggtaccgccagcgctacctggacctgatcgccaaccccgccgtgtcagacatcttccgcacgcgttcgcacatcatcagctacattcgccgtttctttgacgaccgcgacttcctggaggtggagacgcccatgatggacaagctggcgggcggcgccaccgcccggcccttcatcacgcaccacaacgatctcaacatgcaggtgcggtga

SEQ ID NO: 2554 - DNA, 381 bp, Chlorella protothecoides
atgaccgagcgcttcgagctgtttgtcaactgccgcgaggtgtgcaacgcctacaccgagctgaacgacccgctgcgccagcgcgagctgttcgagcagcaggccgcggccaaggcggcgggcgacgacgaggccatgtttgtggacgagaacttctgcaccgcgctggagtacgggttgccgcccaccggcggctggggcctgggcatcgaccgactcaccatgctcttcaccgacaccaacaacatcaaggaggtgctcctcttccccgccatgaagccggagcaggcgcgggggggggaggccgccgcccacagcaccgccgagtccatgagcacgggcatacctggcgctgatgtgcatctagcgaccagcgtttga

SEQ ID NO: 2555 - DNA, 735 bp, Chlorella protothecoides
atggcggtggtcctgggcgtgggcatgagcctgctgctctggacccagggcggcgccgccctgcgcgccatgggcgccggcccggaggtcatggccgtgggcatgccctacttccgagcgcgctgcctggccacgccctccgtcctcatgttctacgtgctggccggcgtcttcaggggcctcaaggacacaaggacccccctcatcgccggtctgctgagcaacatcgtgcatgtcgccctggactttgggctggtgtactgggcggggtggggcgtgctgggtgcgggactggccacttccctgtcccactgggtgacggtggcggtgctcggggccctggtcatccgcaagggccacctgaggtgcgaggcctgccaggcctttggtatcactggcctcgtggtggagggtggggaggtgggaagggtgttggtcgatgcatgtcgagtgcggcagggtgcatgcatgctgcggcatgccctgcatggtcgagcatctgccaagccgctcttgtggcccctggcatcacctcagcgatcggcatgctcggttccccatctgaggagatcccccaaaccctgccacgccccgccctgttcatcccccccgcccctgcctgagcgccagagccctcctcccccccctgcaggccgcgcgacctgctgcgcccccccgacctggccgaggtcctgcccctcctgcgggcgggtgtcttgctctccacccgcatga

SEQ ID NO: 2556 - DNA, 1131 bp, Chlorella protothecoides
  modified_base (858)..(867): a, c, t, g, unknown or other
atgcagtctgcggaagacgaggacgtcaaggcggtggcgagagccggagagctggcgaccctgggccaagcactggaggaggcggaggactggctgtatggtgagggcgatgccgctggctctgaggagtacgtcgccaagctagaagccctgaaggcgctgggtgacgggctgaggacgcgaggcagggagcgctccgccaggcctcaggtgggtgggagtggggtttggtgtggggcaaacgtgggagggggggtgcatggacgctcacagcgcgttgattctgttggtggagaccgcaccgccccttcattcaaccctggcggtctcatcaatcatccccctacaacccctttgccaccccttcttccctcgacaggctgtggcagaggccaggaatatgctggaggggtgcatgggcgctcacagcgcgttgaagctgttggtggacaccgcaccgccccttcattcaaccctggcggtctcatgaatcgcccccctacaacccctctgccaccccttcctccctcgacaggctgtggccgaggccaggaaaatgctggaggtgctgagccccatcgtggaggggtgggcagccgccaagccatggctgccagagtacgaagtgggcttggccaaagaaaagcttgcggagctgcagaagtggctgacccaggtggaggccgtccaggccaagaagaaggcgacagacgagccggctttcacctcggcggagtgcgtccaggatgtagctcgcacatcggcgggtcgcagtcaggaagcttggcaagctcagtactcatcccaaagtcttccactccccaactctccaatgcagtcggtcagcatgctagatannnnnnnnnnaaagctcagtactcaacccaaaatcttccactccccaaccctccaatgcagtcggtcagcatgctagataggcggccggcgccgcccacgccaaagccgacgacggatgccactgccgatggggcaaagaaaaaggcagcaaagaagggaacggggacaaacggcaaagcgaagccatctcagggccctggggagccggaggcggaggtgcaagcgccggaggagccagcagagggcatggaaaccgtgaaaaccgaactgtga

SEQ ID NO: 2557 - DNA, 1566 bp, Chlorella protothecoides
atggctgcgcgaatactggggcgcgacctcccagcctcccgcatccattgcctgtaccattacccatgccatgatggcgtttttgcagcactagcactgcagcagtactattccaagtgcaatgtaccggtggtgtgggtgccacacaccacctttaagcctctcgcgccctcgagcctgggcatcaagtctgacgacctcgtgtacctgctcgacttctccggaccaccgggtttcgtcgacgccctggccgctcagcaccccaagcgggtgatcgtgctggaccatcacaagaccgccgccgcggacctggcgcgacccgagatccgggggctggagggcgttgagatcctgtttgacatgcaccgcagcggcgccatgatctcccacgactacttccagccgctggtatgcagcgcctggtgtggagaggaggccatgtcccccatgcttcctgctttgcagattgcacaagccagccccttccccgacaatcttcccagcaatctcgccattgaagcattcgccctgacccccttattacccccatgcactccccatgcactgcaggacctgccacctagggtgactgccgtgtacgagtttgtccaggacgcagacctgtggacgtggaagctgcccggcagtcgcgtcttccacgccggcctcgcggcggcgggcatggagtacgacccaaacctcaaccggggcctgtggtccgacctgctggcactcgacccggaggaggtgcgccgcgccggcgaggcacgcctggcggcgcaagaggaaagggtgcaggccgcgctggcgggggccatccccgtgcggctgggccccgcagatgggccgctgggcgctgcccagggcctggccaccgtgctggacgacggggacggtgaggggcgcagcgtgcgcagcgtgctgggcaacgccctggccgccgcggcagggagccgcgccgcgcccttcctgcccgtgggcgtggtggcgtaccgcgaagagggcatggcgggacacagcctgaagctgagcctgcgatcgcggggaggtgtggacgtgagcgggctggcggccgccctgggtggaggtgggcatgcggcggccgcctcggccgtcgtgcccgccgccgacttccaggcgcactctgttgtctcacatactttcaagccattcaccccgccaaacgcagggcggcatgacgacacagaggacgaccagcgcagcgaattgtccatggcgctccagcgccctgtgaggttgtactggaactacagcccgaggcctgatctctggccatgtcaagagcctccgcctcattccttctccagtgtgcctccaactgccaggcgcacccaggccgccacctcccggcgcattgcctgcgcccctgcagctcgctggagacatcgcaggggcgggcgccaatcggccactgggcagcgccagagcgcctgcgctgctgacacagtgcatgctccgcagtcgtacccattggtctgctgcggcgcggccggcgcaggatgcagggcaaggtgcctgagccgggaagcatggcgcatggggtaa

SEQ ID NO: 2558 - DNA, 2079 bp, Chlorella protothecoides
  modified_base (659)..(668): a, c, t, g, unknown or other
  modified_base (1439)..(1448): a, c, t, g, unknown or other
atggccaccctgaccgccgtggatgtcagcagcaatggcctggccgcagttgctgccctcctgacggtcctggccggcctaatattccttttgtacaggcagaaggggcctgtcaggcctgcagcttctgtggcggccccccctcccgcagccaacggagtgaagacggggagccacgttgaggaggagctgcccgccgaccgggtgctcatcctgtacggcacccagaccggcaccgcggagcgcttcgccaagtcccttcgcttccagttggaggcccggtacggcggatcgggcaagaagttcgtggcccttgacactgaggggtaccctgccgccaagcacctccaccatgagtcctgcgtgctcctgctcatggccacctacggcgacggcgagcccaccgactctgccgccgagttctatgactgggctgtggagaccgcggagtctggcgacgaccctgagctcctcaaggtggggctggtatgtgaggaggcttggaatgtgtgtggtggagattgctggagtgtctgggctctgggtgtggcagcgtacaaaggctctgggaagtgtgtttcccgggggttggaggtggggtgtgggtgtgttaaacgttggagtcaggatcggtcaggatgctggaaactgcaaaacannnnnnnnnngggctctgggaagtgtgtttccccaggggtgggggtggggtgtgggtgtggaaaatgttggggtcagaatcggtcaggatgctggaaactgcaaaacagagagctacttggtggatctccttccgctgttagtatgacgggattcctgctgcgcaaacatcggcggccgcccatcactcagcgccaccccccccactatcaagtcccagccgaggaaccagtccctcagcgccgcacccacgccctcctccatccaccacctccgcagtccgtgacctacggcgtcttcggcctgggcaaccggcagtacgagcacttttgcgcggtggggcagcgcctgcatggcgtcatggcggacctgggggccacgcccctgctggaccccggcctgggcgacgacgacgacgacatcgacgacgacttcgacgagtggaccctggccctctttgccgcactggacgcgcgcggcgacctgggtgccggggccgcgggcggcgcgggcggcgccgacgccatccccgcctttgccgtcgagacggcgccggccggtgcagcgcccgccgacgccgacgcccagcgctgccggcagggccggggcacggcggcgcacgaccccttcctcgcctccgtgctggaggtgcgcgagctgcacgccgcgctttccacccgctcctgcgtccacgtcgagctggacctggccgggtcgggcatcatgtatgcgccaggggaccacgtcgccgtctttccacgcaacgacgacgccgtcgtggnnnnnnnnnnaccgcgctttccacacgctcctgcgtccatgtcgagctggacctggccgggtcgggcatcgcctacgcgccaggggaccacgtcgccatctttccacgcaacgacgacgccgtcgtggccgaggccgcgcggctgttgggtgctgagcccgactcctgcttcacgctcggcgccgcgccgggcggccccgtccctcccttcactggtgcggccgagggcgggttggcaaggagtgctttcttctgggcaagcgctgggacgaagagtggccgtgtgcgccggaggattccaggccattggccatggatgcccgctgggcgggctgtttcaaggtggtgtggccggcacccaaacccctcttaaacctctaaaccctcatcgcccccctcatcccagggcccatcacgctgcgggaggcgctggccgcccacgtggacctgctgggcctgcccagcaaggccgcgctttccaccctggcggcgtttgccaaggacaagacggaggccgcgcgcctggcgcgcctggcggcgccggagggccgggacgagtaccacgccgaggtggtggccccccggcgcagcctgctggaggtcatgcgggagcacgcctctgcccagcccagcctgggtga

SEQ ID NO: 2559 - DNA, 2577 bp, Chlorella protothecoides
atggagaactcgggcgtcacgcaccagtacggcgcaatctccttggcccagaggggaggagcggtgagcgggctttggcctgggagcatgaatgttgcgtccacaggaagagcaacatgcgattcattctctttgaaccctcctttacgtggatctccactccttccacacaaacacacaggcatctggcgccctgaaggcctccagcgctgggctgtcgtggaagcggtccagtggagggaaggcggtggacgtccctctcgctgggtgggaacctttcacccccctgccaaggatcagctccccacactcacaccgcctccccacacaacacccagatatcaagaccctggcctggtcccggggccagaagcacagcatgctcagcgtgcagcgcgtggacggctcgttcctgggcttcactggcttccgcgacggcgacgccgcgaccctggcctccgcactttcccggcccgtgcccgagcaggcgcaggccacgctggggcacaactggggcgacgcggcggccgacggcgcgggcctgaccttcagcgtcgggggcgggccggccttccgcctgcccctcaccgacgtggtccaggcccaagctgtgcgcgaggaggtgatgctggagttccccgccgacgacgcggcggcgggggagcacgtggacgcgctgaccgaggtctccttctacctgcccaaggcgccggcgccggcggccgccgaggctggggaagcaggcggggacgaagtcacagaggccccctccgccgcgcgagcgctgctccaggcggtgctgccctacaccgacgcgggggcggccacgggcgacgccattacctccttcgaccaggtggcggtcatcgtgccgcgcggccgcttcgacgtggagatgtacgcctcctccctcaagctgctgggccaggcccaggacttccgcgtggcctacgacaccatcctccgcatcttcgtcctgcccaagaccaacgtgccccagaccctggtggtcatctccctagacccgcccatcaggcaagaggggcttggggtgtgggtgtgagagggggaaggtggagagggtttgcggggggtaccggggctgctggtgggaagggggcaggagaatcctctgcatggctcctcaccaccctaaaactctccccccctccccaccccaccaccctgtacaggaagggtcagaccttttacccgcacatcctgtgccagttccccagcgacgagcaggccaccctggagctggacatcaccgacgaggcgctggcggccaagaacgaaaagaacggcgggaagctgcagcgaagctattcgggccctgccaccgacgtctttgcgcgcgtgctgcgggggctgtcgggctccaagctcacgcgcccgggcgccttccgcgacgcggagggctcgggctttgccgtcaagtgctcgtacaaggtgggtcgtgggttgggtatgcggcacaggggttgcagtggcaaaaggctgtgcatggggcttctggtgtgcaccgtgcggcggcgacgatccgccatgaccaagcgcgccctggtcagggcagacctgcgagcacatactcacccgccccaccccatgctgcacgcaggcggacgacggatacctgtacccgctggagcgcgccttcttctacgtccagaaaccgcccctgctcctcgtcttcgacgacgtggacgccgtcgagttcctgcgccccgcccagggtgggcaggccgtggcgtggcgccgtatgcggctgatggggcatgctcgctgtctctgcgaagggttgtatgctgggcacctcccagcacgccgcgcatcccctgccccacacttcattcaaacgcaggcgtgacggcggccaagacctttgacctgagcgtccggctgcgcaacagccaggactacctgttccggggcatcccgcgcggcgagtggaccaacctcttcgagtttatccaggccaagcagctgcgcatcgagaacttcaaggaggcgcagcaggggcctggagccaccgcggtgtcctatgccgccctgggcggtggtgagctgcgcgtgtggtggcgggccagcttgccctgtagcaatactatgtggggcaacacagctccacgcgaagcttggaagggcaggtgggccaattttttctggtcccaacatgttacccctccctcacaatttcccctaacaacgcacgcaatgccaggtctgggggaggaaggcggtgatctggaggaggacgaggacgaagaggacgaggactttgaggctggggtggagagcgagagctcggatggggaggacgaggacgaggagggccagccgattgtggtcccggaagacgacgaggaggtgcgcgggcgccggtgtgagggggcgagactgggcgtgatatacgatcatggccatcggcgtggtgatcgggtgtggatcagggcgaatagtgggttccggggcgggtttgtgtcgcggatgcaatcccgcgcgggggccgatcgccccgggacggtccagctgcccctcagcgcctgcacagcaacggagggcatgtgcccgtga

SEQ ID NO: 2560 - DNA, 489 bp, Chlorella protothecoides
atgaccacactgcgcccgtgcaccgcgcgtggcgaggtgcgccgtttccggcgcggcatggactacacggtggcccaccacggcgtgctggcggcggcgccctgcctggacgccgtgctgtgcatgctgggctccggccccggggccggcgaggcctgggaggggggcgaggtgggcggctacgaggcctacatgctggccgacgatgagggggagggcggcgccggcgccgcggagacggccgaggtgtaccgctcgccgggggatgcggcgggggagtcggagtcgggcgtgctcaacatctcccccgccgccaattgcctgagcctggtgctgcgcgatgaggagacggagctcctcaagtttgtcaagtacgtgtcggccgccgcgccaggcagtcggtgggacgtcgccatggtgagtgggcatgagcggagtggggtacaaggtggctggagtgcagagtgtgcattgcagccagtggattga

SEQ ID NO: 2561 - DNA, 1317 bp, Chlorella protothecoides
atggggagggcgatcctcccgtccctgatcctgctggggtgcctggcctgcctcgtacccggcgcgcggtccagcatcatggccgtggacctggggtcggagttcatgaaggtggccctggtgcagcccggccgcacccccatcagcatcgtgatcaacgagatcagcaagcgcaagacccccgcactggtgggattcgtgggccgggacaggctggtgggcgaggaggcggcggggctggccacgcgccaccccaccgcctttgtcgccaacctgccggccctgttgggccgctcccccgacgacctggcgctggccgcgctggcggcccagggcctccccctcccccgcctggtccctgccgccaaccgcaccggcgccctggccctggacttcggcgaggcggggcatgtcacgcccgaggagctggccgcttcgctgctgcagtatgcggccggcatcgcgcgcgcggcctccgccacgggcaccgcgccgcgcgacctggtgctccttgcccccgctcactacggcccgcgtcggcgccaggccctgctggacgccgcggcagcggccggtctcaacgtcctgggcctggtcagccccgccgcggccgccgcgctgcagtacggcatcgaccgcaccgccaccttcgcctcgggcgggccgcagcacgtcctgctctatgacctagggtctggggggctggaggtggctctggtcaggttctccacctaccctgaccgcaagatgtgccttcagcagtgccatgccagagcggaacccaggcctcggacccctcccagcaccactgcccgtccctctgttcatcccggctacttcatgcaccgacagggcgcccccgccagccaggtggagatcatggacatggcctgggacgagggcgccggcacccagctgctggagtccctcctgctgcgccacttcatggcgcaggcgggcgaggcgctgggcgaggcgggcaccgacctcgccgcctcgccccgagccgttgccaagctgcgcgccggggtcaagcgcgcgctgcgcgtgctgagcgccaatctggaggccccgctgtccgtggaggagctgcacgccggccgcgacttcaggtcctcgatctcccgcgaggccctggaacggctggcgggcgactactgggctcgcgtcacgcgcccagcgctggacctgctggcccgcaacggcgtggcggccgccgacctggcggctgtggagctgctgggcggcggctcccgcatccccagggtcaaggccgagctgtcccaggccctgggcgggcgcgcgctggacgtgtga

SEQ ID NO: 2562 - DNA, 288 bp, Chlorella protothecoides
atgcaggtgggtctgagcaaccattgcctgagcacgtcgttccttgacgcgcacgtacttccaggtcaatcccagccagggcccaagcttgatctccatgcctcgggcctgctgctggcggtcaacgacagcccaagcctagaaagcgcgggcgggggcacccactggtccctgttggcggtggcgctggaccaggggtccgcctggcacgtcgattcgctgggcggggccaacaggcgagtcgcccaggccctcacccggaaactggccgcaggactggacaggtga

SEQ ID NO: 2563 - DNA, 825 bp, Chlorella protothecoides
atgagtctggaggagggcgtcggcgcggggcagggggacgaccacagcagcagcagcactaccaggccccgggaggagcccaggaacgcccgcacccgaccaagctgcacaccggagcgggactctcagaaacggctgagggtgtctgtcgacgagcccttacgggatcttctgagtcgggatgagggagcaccctccgcctcgtcggtaggagatgatcagcatggagccatagctcccgagcagggccctgcagcgcccacacgcgcgctctcccccattcagcaggaatcgcttgtggttcctgtgacccgatccaaggccttccccatcacagacacccctccacatctcttcagaaacatattgcccgacaaatcacactggctgactggtgcgaccgacccctcgtccttcccgacctcctcgaagaggatgaaatacctgcaaagtgagctggggaagctggagcgtggtttcagggagccagtagtgcccggctctggggttcaccccatcccctgcccgttccctgcatcatcccgataccctctcattccttcccccccacccaccaccaaatgcaggttcaactacatccccggcatccccctggtcgcctgcgccagtgaaggtcagtcggcgctgctgcgccacctgctgcgccaggagggggtggaccccggcgtgcgggacctcaacggcaacacagcgctgggcctggccaccgccaacgggcggtccgaggcggccggcctcctgcgcaccgcccaggccgccggcgcacgggaggatggcgtcgccgcgcagggcgcgcccgcctga

SEQ ID NO: 2564 - DNA, 927 bp, Chlorella protothecoides
atgacgtctggtgagctcctgtcgatttggtcgatggcgacgacctggcctgtgagaaggttgcatgcccctctatggaaagcaaccgcatgcacttcctttattatttatttattcaatgacacacatgactccacagactcggagccagtgcccaagaaggccaagacagcaggccatgccgtcgacatcatccgacccagtgtcacggggacggagtcgcgggaggcgctggcagcagcgtacaaggcagcccagccatacccacactgcgtcatcaccgacatctgcgagcacgatgccctggcagcggtgcgcgaggagatcatctccaacgtccaggcgacgtacaaggagacggacctgttcaacatgttccagacaggccagttgggaatcgcttgccttcaccttgctccagcgcgtttgcatcacggccgtggggattggggcatggatacctgggtccacacgctcatccccctccctcctcaacctccagcaggcgacctcgccaacctggacggcctggacgcggaaagcgcggccaagctccccacggtgcgggctctgcgcgacgcgctctacagccccgacttccgcgcctttgtctccgcggtgacggggtgcggggagctgtcggaccgcaccgactgcgcctgcaatgtgcacgcccggggcggccacctgctctgccacgacgatgtcatcggcactcgggcggtgtccttcatcatctacctcacagacccggagcggccctggaaggcagagaatggcggcctgctggagctctacccccaggacccaggtagggctgcaatgcttcgtgtgtgtgcgcagtggggtgcacaccttggcggggtggtcatcgccgggtgctctgagggattggggtcagtctcgaggttggcatccgtggagtaa

SEQ ID NO: 2565 - DNA, 717 bp, Chlorella protothecoides
atggccatgtttgcggtgcagccaggcgtcagtttccactccatccaggagaactttactgtggaccagccccggatgagcatccaggtttgtcggcggggtggctggtgtgaagcaatgccctcccccgctcccgcccagggctggttccaccgggacactccccccgagggcgccgactcggcgacgctgcgccagttgcagctgcagtcagacccccggacccgggacttccagctcatgcccggcgcccagcctgggggcagcgacgcagcagccacagcggggcccctgcccgaggcggagctcgaggtgctggcccgctacgtcaaccccgtctacctggcggaggccacctggcccaaggtggccgctcgcttccgggaggaggggtcggtgcagctgcaggccttcctcaaaccggagctggcgcgggcggcgatggcagcctgccaggcggcggatgaacgggacgggctgggggagggccccccgccggcatcctacacggtgggcctgggcccaagctgggaggccgtggggccggccttcaagcagcggtacctgcggtacagtggcgagccaacctgcacgccggaggccggctcggacccggggcccatactggagcgggtgcgggaggagctcctcaccagctccgcttttgcgcacctcgtcgaaaaggtgtggaactggcctggagagctcgacccttga

SEQ ID NO: 2566 - DNA, 1251 bp, Chlorella protothecoides
  modified_base (149)..(158): a, c, t, g, unknown or other
  modified_base (453)..(462): a, c, t, g, unknown or other
  modified_base (933)..(942): a, c, t, g, unknown or other
  modified_base (1016)..(1025): a, c, t, g, unknown or other
  modified_base (1078)..(1087): a, c, t, g, unknown or other
atgggcttgtatgctgcctcgccctccccctttcctcccccgtgctccgacagtccagccgcaccctccatcccccacttcccaccagatccccgcctgctaccagcacaacccgttgaggctgtcccaggcctacttctccaagtttnnnnnnnnnnacaccctcatccccccccttcccaccagacccccgcttgctaccagcacaacccattaaggctgtcccaggcctacttctccaagtttcagccggacacgctgttctacgtgttctatggcatgccgggcgaggacgcccaggtcctggccgcggaggagctgaccaacaggtgcctggtctttggctgtgatggtgttttgtgtgttggaaggggggaaaggggtggagcagtgggcctcgacgggcctgggcctctgcgggggaggaccagtggccatcctcgccggtcgcannnnnnnnnncaaggggggataggggtggagcagtgggcctcgatgggcctgggcctctgggggagaggaccagtggccatcctcgccggtcgcacctgcccctgtgtttgcaggtgtcttgggccacctggccccctcaggctcgccgcgcctcaacaaagccgtaccctcgtcacgctccccgctccctccaccgttcccaggggctggtacttccacaaggagctccaggcctggctgacgatggtccctggcactgatcccacccagaaaacggaccggtgtgttgctgggtcggggaaaggagctttgttgccgggatgtccacggcagggcttgcgggccgataaaccggcgaggggtacggtggatccaggcccagaggtggatgctctgagaggcgctcgggcgtcccctccgcccatcagacccacggcgttgacaggggaaccactcccatcactctccctgacacccacnnnnnnnnnnggaacccacccagaagacggaccggtgtgttgctgggttgggaaaaggagctttgttgccgggatgtccacggnnnnnnnnnnccgcagcccggcctgcaggccagggcttgaccgctgcgcgctcgcaggctgcnnnnnnnnnngcggggcgccttcttcgtcttcgagcctgccacctgggagcccggcttgcagacccgggcttgaccgctgcgcgctcgcaggctgcgagcgccgggcacctacgcgtgcccgggaccatgcgagtgcctcctgcatgactgggaagtgcatggaggtggtctga

SEQ ID NO: 2567 - DNA, 3528 bp, Chlorella protothecoides
  modified_base (577)..(586): a, c, t, g, unknown or other
  modified_base (1991)..(2000): a, c, t, g, unknown or other
  modified_base (3150)..(3220): a, c, t, g, unknown or other
atgctcaccggcaggggatcgggccggggccccagctcggtgtcgtcaaggagttctggcgtggcagcggtcatcgcagcagccccggtcctggccctcttcacggccggcgccgcgccgcttccctccctgcgccgctccgcactgagcatgctgaggcccttggcggtgggattcttggccaacagctccgacacagattcgaagccggccgtgcgggccacggaggccaagatcccggtggcctccagcccttgcttctgcggggtgtgtcatggtatgtgcttggagcatgttggggaacagcctgggctggtaccgccttccaaacagatcctgtctaggggttctggcctgccagcaccgacaaacatgccagctgtgctgcgcactgacaaagagttccctggcgcattcaggatcgtgtgctgccctggtgcctccccctgttacgctggggattacactgcccttaccttgcggcagttgctgcagttgcagatgctggtgcagcgtgggcactgccagtctcccagagcattgacctggagttctgctggggaatgtggggcatgcnnnnnnnnnntcctgatggaggatgcactgccgagagtcaatcgccttggtcattgctgttctagttctgctggggaatgtggggcatgcgggttgtcccaggccaaggggcaagcatccctcatcctcccaccaagacctcacctcagccacaaactgcttgtatcgattctccaagcaccgaggacagaagtagagggtgcatttcgtgcactttgccttcacctccaccgtcttctgccggcactgcagcggaaagttacggttgcaggtttggggtccgcgaacaccatcatctcaccagaggcaccttccccaagcgaagatgcccgtcacagcctccgggccagagtccatctctgttcagacttagatgcacaattcagaagcagagcatatcctcccagccaccagatcacagtacctggtggcaagtcgtgccgttctcgctgtcatagattcgtccgccctggtgcctcacccctgggttggccgttctctgcttctttgccacaggggcctctgcaagtagggacagagaggaaccactcggaggctcgatttcatcctcttggtgtgcaaggtcttctgagcctgctcgcttgccagcttccagggctgcaccgccctcagcacacagcttggcaagccagccaggctatagcagcacttaccaggaggaggagcagctgcttcaaccacagctgctgcaggtgccacccttggcattgttgggtatcgaagcggccgaggcgctcccagtcacgccctgtgcttcgtgaggatttgactggcagctgtcgctgggtggcgcccactcgggcagtcgaatgtcagccaatgaaactcaagcgcacaagaaatagcccattgaacacccgatctcaaggtggcataacatgcactttgagctgggagtcaccatcgcgagatccgtgcggcctgtcccgatcactcgagcgcagtttgtatgtctcccgccagtcgattctgggcgcaggctcgtcccatgcggcactgacaagcgatggcgacatcgggcctgctgcagcgctgtggcactttgaaacaaagcatgcattacatttgaaggtattaagatcttcgcgatttcgactgcattgggtcctaggcaccactcggtcatccacgctcgctcaggtcatttgtcgactgtacactgaccatcgaccagtgcctgatcgccagcgccctgtgcgcagctggctccatttgcgcccgatgcagctgcgggctcatgcatgtctggtggcgtgcctcctcatctcggctgtggttggggctgtggcggtgaccagcgaaacccctgtcgccaagaccaggcaattgtcacagtttcgccttgccaagacagatggaaaagcaccccattcattcactctcccactctgcannnnnnnnnncgtcgccaagaccaggcctctggcctttccgttcagcgtcaatttcaagcctcaggacacttgggctcccgaggcggtctttggcgtgtttgttttccttttcctgattaacatttggcgtgggaggcagagcaatgagcgccgagcaatcttctgggccacccagagccagctgcctgacaactttgccctgatcggtcccggcaactctggcgagggcgaggtgctggtccgtgagagcatgaacatatactgcgtgcatgtctccggccgccgctactgcaaggtgtgcatgggtcatgctctcatgtgcctggatctggcgtggccactctctgggcgcggcctgcagcggtcaggggggcaggtttgcctggtcaactggcagccacgccgaccatgcgtcaacaccccctccccacttggacgcaccgcagagtggccgcctgaccttcttcttccggaagcgacaggacctgctggcctgggcggtgagcggcattacccggtccccagatgtcctggacatccaaatcgacctcagcccagggtctatcccgcctctggtcctgctgatcgcaagggctggccatgccaagacactggccaaggagcaggccgatgtcaaatgtctgtatgcagaagcccctcgacagtctggtgtgcccacgatgacatcttgagccaccaagcctggctgatgtcgggatcttctgtgacaatccggcacattctcctgctggctgtcgcccagctagtttcacgctctacgaccccacccaatggacagacgttcaccaagttgctggaggtgaagaaggaccgcctggcggcatggccatccatcgacctggcagtctacgccgagcaggcatccgccttctacgacctcatgacgccctacctcctgagccactcctttgggcaaggagcctgggaggagttggggacctgcttccgccacctccacatcaccagcgagggccagggtgacgataccaagcaggcgagacgggccaatgctggatcatctgctgtgccaccctggaccctgcttccctcttcacattatgttgctctcacccccagctttggaaacccagaccacatccacccttgcgacgaacagttcatcaatttgtcgctggannnnnnnnnnnnnnnnnnnnnnnnnnnnnnnnnnnnnnnnnnnnnnnnnnnnnnnnnnnnnnnnnnnnnnnagtggctgagggctgtcatcatcctgatcgattccttaggcacattcaagttcacaccaggtacctctcgctgcattgttctggggaggggaaggaactcggtgggacagaggagagtcagagtggcaattctatgcacgtttaccctgcatgcacatccatgcgcagagcaagcaaagcgtgcggcagagaacagagcgaaaaaggaggttctggccctgaaagctgctgagcagaagcgacaggaagagctgatggcacggcgagagaagaaggctgagcaggatcaggtgggatctctcgggggg

SEQ ID NO: 2568 - DNA, 711 bp, Chlorella protothecoides
  modified_base (216)..(225): a, c, t, g, unknown or other
atgacaccagcatcagccagctctgtcgctgctcagcccaaatgtccaactccatggcaccctgtgacccagctcgtgaattcctcattcgagggtagtggggcgctcacgagtcatgtacgacttcaacagggtgtgtttgccgagcctcctgccaaggggcagagctggcgctccggaccccatcaagtgagcagagctcgtgtacagggagcnnnnnnnnnngccaaggggcagagctggcgctccggacccgatcaagtgagcggagctcgtgtacagggaggtgaaggccctgtggcgagaacggcacacgatggggatgccaggagcatggtggaagggtgcaaggcggaggaacgctcaggaggggcgcatggccgagtcactgcacaaaactgggggcgcccctgccatctgtctggacacggggatcacggatgttctagccagccctcacagccggaccccgaaccgcagcatgagctcgtccgcgttggcggcgttgtagcccgcgaagaaagcgcggcccaggcgcccgcccatcccctcctccgcgttccagtcctcggccgacccggcgtcggcccagcgccctgcgagcgcggcggccgccgcctcggccgcgcccacctcgccgtcgcccccgccctcctcccagcaggccaggcagcggcccgaggcggcgcagacggggagctcgccctcccc

SEQ ID NO: 2569 - DNA, 2370 bp, Chlorella protothecoides
  modified_base (1048)..(1057): a, c, t, g, unknown or other
  modified_base (2177)..(2186): a, c, t, g, unknown or other
atgcctgctagttcgaatccgggtgctcacgtggagggggagggtgtatcccgtggaatccctgcgactccgatgcgactcaggcaggaagcccgagaagacgcgtccacaagcgctcatacactctccagacacgtgggccaatcgagcagggaccagcacattccgcggtcccgtcgatcagtgggtgtgtgggagcgatgcaggcccgcgtggccggcttcattggctctgtgcagctgcagatcaagatcgcagaggccacctcctccagtgatgaggtcacgccgggtgcgaggggtgcaggcatgctgcctatggcggatgtgtcggtgtcggaggacaccttggggagggagaattacccgatctctgacttgcatcccggccaccatgcaccggcccccctcccacccagtctacatcctggatgaggtcttgtcgctcgtgggcagcaaccgcgatgccatcgacaccgccaccaatgccatcgtgcagcgactcaaggctcgcagcgccaccgtgaagcaaaagggtcaaaaggttactcccacctcgccctgctcctggactgacagctccagtggtccagcagtgtccggctctgcactcccccgtcgagctaccacccgccgcatcatgcaggcgctgcgcctgacacggcacgcctgcctgaagggcgatgccgcgctgcgcagccgcctgacccacctggcctctcccgccgtgcgagacctgctcagctaccggtgcgaccctgaccccttcaagggcgacatcccctggaagagggtgcaggagctggccaaggacaccctcactgccatgcacgccgggcccgaggccgccgtgggcggcgcctcgcacgcgctgcaggtaattatttgcgtgtgtgtcgggagaggaacgcacgtgtcgccggtgaggactcgctgtgctgcacctggcagtgcccggcagtcgcgggggcacgccacgagcgcaggtgtttggggcgtcaggcaccgaccactgacaccttcaggaacccgcacgcccctccccaccnnnnnnnnnnggtgcccggcagtcgcgggggcacgccatgggcgcaggtgttgtggcgtcaggcaccgacaactgacgccttcaggaacccgcacgcccctccccacccccagggccgcatccagggcatgggcagcggcgatgctggcggcggcggggcggccttcagcgcctcctccagcaggatggttggctttggcagcggggcggcggggccccagggcacaggccccaccagcggcggcgcaggtctctgggcgggcggcggcagcgagcttggcggcgccccgacgcacgccggtgccccaccccagcgagccccgggcggcgggggcctgctgcagcagggcgccatgggcggcggtgggcccacggcggcgctgccacactcgccgtccccggccagcgcggaggagagggtcgtggcccggctggcggggccggggggcgtgcgcgccacgccgagcgccgaggacctgcgcagcttcctcacggccgccatggggctggacggcgccagggtggcggcggcgctgtggggccacctggaggtgcgacaggcgccggggcggtgtggggaaggctgtcgtctcgcttgggccgtggggaatcgcgcgcccgcgcgcccagcggcgccggggagagaccccgcgcgtcgagggctggggctcagcgtgcggagcgctcgtctgggggactcggcatggaatagcgccgctccgcgaccctcgccaaccggtgccacgggcgtctccagcccctcagggcccaccgaaatccccacccccgagcccatgtgacacccctctcacagaaccccgcgctgacctggcagtcgcggctgcgcgtgctgtgtggcatcgaggcggcgctggaggagcgggccggcacgcccctggcggcggccgtttgcacccagtttcagtcccgcgccagcggcctgcgtgcggcggcggcccagccgcaggccagcgtgcgcgagagggcggcccacgtcttgaccctggtgggcgccggcccggcgcgggtggcggagggtggacgcgctgggagaggggccgacgggcccggcggcgcggcgccaggtcgggggagagcgccggaggtcttgggtgggagggggtggaggnnnnnnnnnnctggcggagggcggacgcgctgggagaggggccgacgggggcggcgacgcggcgccaggtccgggaagagcaccggaggtcttgggtgggagggggtggaggatcaggccggctgcggctcatcgatgcaggggcgtcgacagtgctttgggagaggcagcgcgcagcggcgacgcggcgatga

SEQ ID NO: 2570 - DNA, 2676 bp, Chlorella protothecoides
  modified_base (222)..(231): a, c, t, g, unknown or other
  modified_base (807)..(816): a, c, t, g, unknown or other
  modified_base (1256)..(1265): a, c, t, g, unknown or other
  modified_base (1604)..(1613): a, c, t, g, unknown or other
  modified_base (1763)..(1772): a, c, t, g, unknown or other
  modified_base (2103)..(2112): a, c, t, g, unknown or other
  modified_base (2293)..(2302): a, c, t, g, unknown or other
atgcccgttccccctcgtgccctgcgcaggcagggtggaggcagtgggggcacgcaaggacggcgccttcgattttgtatcgtcgctgttgacccaacgctgaaactggggcgtctggagcaaggattgcatcgatcctgtgctctgacacatcgagcatcatggcctctgtcctgtgtgctcagatgggcaacctatctctcgctaggaacttgacccaannnnnnnnnnaaggcaaggcggagggccacacctgagaaaactatcattctgatacatattatgtaccaacgctccatgtccgcagacccaacgtcacagccaggcattccgtggtgccgcgcccttcaccccatccctacgcccgtgccgaccactgtccccaatgtgttcgtttcgctcgatggctggtgccgcgtcggtgtccacctcggggtacacctcacagcctgcacccttgtgggtgcctctctcctggtgagctcacgggatccccgccccgcttccccccgcccagacgctgacgcagcctcgccgggaggtcatccgtgcggctcgtatcgctggggtggaggtccccaaccagaagtacatcgagtactcgctgcagtacgtgtatggcatcggccacaccaccgccaaggccatcctcgcctccaccgtgagccgtgttgggggatctcacccgtgcctgccatgaccagggggcttggctggggtctacccgactgggcattgtgccacccccggtcgaccactgggcctcgggtgacggtgcccgccccgccgccccgccgcaggaggtcnnnnnnnnnntgccatgaccagggtgcatggctggggtctgcgcgactgggcattgtgccacccccggccgaccaccgggcctcgggcgacggcgcccgccccgccgccccgccgcaggaggtcccgaacaagcgcacccgggagctgacggaggaggagctgaccattctgcgcgacgaggtggagaagtacatgacggagggggacctgcgccgcttcaacgcgctcaacatcaagcggctgaaggacatcggctgctaccgaggccggcgacacatcgcggtgggtggggtggggtcgctaccctgtgccctctgcctggaggccctggctgcgatcgtgatgctagcccaggcaggttgctgtctgagaccctgtagagcggacaccccagcctcgcccgtggcctcatcttgccctcgcagggtctgcctgtgcgaggccagagnnnnnnnnnntgatcgggacgctagcccaggcagggtctgcctgtgcgaggccagaggacccgcaccaacgcgcgcacccgcaagggcaagcgggcggggcccatcaccgggaagaaggtggcgaaaaagtaggggctctcctggcctggcccggggtgtcgccggctgcatcgaaggccagcggggggggcaggaaaaggtggctgagcatccccacagcccccttgccatcccccggacctcactcaagctggctctccttgccccagcagccgatgtcctgggtctcccagagccctctcagcccactgtcagggtctctgcccactcattcccttggcgatgtannnnnnnnnntcgtcatctcatgtttgccgcgagcccgccccctcgccacacctcgagccagaattgcagtggcaccgtggccccatgccattgtctctactacacagctgcggagggggtgggggaaaagggcgtggccgctgtggagccacttaccannnnnnnnnnacgtcatctcatgtttgccgcgggccggccccctcgcccacacctcgagccagaattgcagtggcaccgtgtccccatgccattgcctctactgcacagctgcggagggggtggaggggagggcgtggccgctgtggagccacttaccatggtgcgcgcgtggcctggtcgccacagcgccatgccctcaccacccgatgatgggcaccagactgcaggtggctgcagccagcattgggtggcggctgggcctggaccggccatgcatctgcatgcggcggcgacgggacatcctggcagggccgacagggcacccgccagcctgcaaacnnnnnnnnnncctgctatgcatgctgtgggggcgggtgcccatggtccgggtccgctgcgaggcgtttggccgcccaggccagcctcatgggtcgcacaccatctcagaggcacgcgactgagatgggggaccgactcggcctcgctctgcttcagaccgctctgggctacagagcctatgcaatgctcgnnnnnnnnnnaatgggggaccgacttcgcctcgctctgcttcagactactctgggctacagagcctatgcaatgctcgatgacagggtggcacacacatcgtttcgggggaggcatacatcaggggtgccaagcggggagggtcatgccgagtggcgcccaggcaccgtcttaccacccggcaagccagggagcaggtgttcctggacgcagggctttggacgcagccgagcttcccagccgggcgtggatgggccgatgggctcctggccgcaggcggcgcgacgaggaggggtcgggcccggcttggggctggctcatggcgtctcagcctgcacagagcctgcgccggcactgcactggctggtggtgttgggggatgtag

SEQ ID NO: 2571 - DNA, 1365 bp, Chlorella protothecoides
atggggcgcgtgccgctggcatcggacggggccctctgctgccctgggacgatcggcgcgcaggctccctgccggcattgcccacgtgcccacctcccccccgccgtggggcgcgtcggcgccatcggacccggtgcacgacgcacatgcagcaccacagcccacggcgcccccacctccccacgcgcccatggcaggaagaagaaggccaagaagtacgtgatcacggcggtggcgcggcgcgccaccgccgccgccatcgcggaggcctacttcctgcgccagccggcgcgcatcgggcacctgcgactggacgcgctggccctgctgctcagcctggcgggcctctccgcccacgcccggcccctggtccttgatgcctgcggcggcctggtgctgggggcggccgcggagcgactggccggcttcggcacggtcaccggggtctacctgggcggcgcaccgcccttgcgcgaggccctggcccagttcgacgcgggccgggtgcagagcggcgtgaggcatgccagcctggcgtcgctccttcgccgggtcgcggcaggcggggagcaggccacgccgattggtgtgcctggggcgctcgagccggcggggggcggggcgggggccacgccgatttgtgtgcctggggtggtcgagccggcggggggcggagcgggggtgggcgatgctggcaaggcggggactggaacgactggcgagccagagactggagcgacgggcgaggcaggattcggtgcagccggcgatgcgggcaccagcgcagccggcgaggcggaggccagcgggccatcgagatgcggggacgcaacaaccgccgcgcctcccccgccacagcggccgttcaacgcgtgcatcgtggccgcgccggggcttgaacccggcgcggcgctgcgggccctgctgccgctcttggccccctccaccccctttgcggtgtactcgccgtggatgcagccgctggccgaagccatgcacgccctgcgcgctgagcacgccgccgtgggcctggcgctgcaggagtcatggtggcgcgagcagcaggtgcggggccggcagggccgtgcatggagtccgacgggtgggcccctgcacctgtcttcgtcctccccctctagttgtgggccccctgtgggaggtgctctgcgcctggtcgccgacacaagcatgctgccatgtgtccgcatgcacgcgcatggacctcctctccccaccgccccgcatctccaggtgctgccgagcaggacgcaccccaagatgcagatgaaccatggcggcggcttcgtgctcagcggcacgacggtcgccccgccgacgcggaacgcaggtgccacgctggcgtga

SEQ ID NO: 2572 - DNA, 282 bp, Chlorella protothecoides
atgcaggccaccatcatttcccctttcccccaacccacccctttcccccacatcccccctccccgcccccgcaggtcgctgcgccggctcatccgccgctgctgcatggcggggaccgcctttggggcggccacgggggcgacgtacctcctcttccaccggcccctcatccgcctgttcaccggggatgcggaggtcgcagccctgctggggggcagcacctggatcctggtggccgccatgcagccctgcaacggcctggtctttgttctggacgggtga

SEQ ID NO: 2573 - DNA, 771 bp, Chlorella protothecoides
atgggctgggcctcgctgctgacccaggccgcgcagctggtcgcctgcctcatcgctgtgcacgctgcgctgccgcaccagcacggcagcctgcgcggggcctgggcgggggagaccgggccacgacagccgctgttggaggaggaggcgggggaagatgagcccgcgcttcggcccccctgcgccgacttcctccccgccagcaccgcgccactgctgaccgggccacgacggccgctgctggaggaggaggcgggggaagacgagcccgcgctttggcccgcctgcgccgacttcctccccgccagcaccgcgccaccgctgttgtcggacgcaggcggatcgggcacgctcccgcccgacgctgccgcagacggcacagacgcccacgccagcgcgccctcccccgccaaccaccagcaaccgcccaccgcccccgcatcagcgtcccgcgcgttcctggacgacggcgtcaacatgctgctgcgctccatcacgctgcaggccaccttcttcgcagccctggtcgccgcctcgcggctcggcaccgccgccctggcagcgcactccgtcgtcgcccagctctggatgctcagcgcctacgccgtggacggcttcgccgccgcgggcatcgtgctggggtcacgcctggcgggcgccgcagacgactccgaccaagggggcgacgccgcgctcaagtgggtggcgggggagctgggtggcgcggggtgttgcccactgcgtatgtgctcaggcctgagggcgtggtga

SEQ ID NO: 2574 - DNA, 273 bp, Chlorella protothecoides
atggaggagagcgtggccaaggcgctggccatctcgggcgcggggccaggggacttgacctccagcgcggtggacgacgtcttcttcgtgcttgccaaggccggcgagcgcgcgctgggcacggggcgtgcgcctagcgcagtggccgtgctcaacggcctgcacggcgcgctgacctcgcgcttctgcgccgcggtgcaggaggcgctggtgggcgccgcgccgcgcctgctggcggcggcgggggcgggggaggccggcggcgcgtggcag

SEQ ID NO: 2575 - DNA, 2511 bp, Chlorella protothecoides
cgcctcgcacagcgcgcgcagcgccgcggccagcgcgccgggggacccgcccgcgtagcgcgtgcgcagcacgcgcgcgcccagcgcggtgtcgcccagcagcccgtccagctcgggctcggtgagcacgggggagcgcaggaccacttgctggtaggagtccgggccggggctgagcaggttcccgcgccgccccagccgcatctccaggctcatcaccaacccctcgcgcagcgggtcgatgggcgggttggtcacctgcgcgaagcgctgcttgaagtagtcgtagagcaggtggggcgagcgcgccagcgccggcagcggcacgtcgtcgcccatgcagtaggtcggctccgcgcccgaccccgccatgccctcgatcaccatcgccgtgtcctccagcccgtaccccgaggccgccatcaggcgcagcgcgtcccccgccgccatggcggggccctccagcaccgtgcgcggcggcacgatgtccgccaggcggtgcgtgcacgccgccagccagtcggcgtaggggtggcgcgacgccacgtccctggcgatgtccacgtgcccctggaactcgcccgtctccaggtcggcgcacagcatctggcctgggcccagccgccccttggccacgatgttgggcgcggaggagaagacgtcgcccagcacgccgacctcgctggccacgtagaccaccccgtcggcggtgcgccagaagcgggcggggcgcaggccgttgcggtccaggcgcgcgccgaccttcttcccgtcggtgaagacgaggagggcggggccgtcccagccctcctgcaggccctcgtagtagcggtagaagtcggccaccgccgcgtactcggcggccaggtcggggtggttgcgataggcttcgggcaccagcaccatcagcgcctcgcgcgcatccgtccccgaccgcaccagcagctcggccaggtggtccaggttggccgagtccgactcgcgcgcgtcgcagagcgggagcagctcgcgctcgcgcccgccccaagcctcggcgcggagcgcgccctggcgcgaggccacccagttcaggttgccctgcagcgtgttgatctcgccgttgtgccccagcaggcgcatgggctgcgccagcggccagcgcggcgtcgtgttggtcgagtagcggcggtgatacaccgcgaagcacgtgacgtagcgcgggtcggtgaggtcgcggaagaagcgcgccaccgcgcccgagttcagcatgcccttgtacacgatggtgcggcaggacagggagcagaagtagaagtcgggcgcgagctccggccccagctcgcgctcgctgcgccgctcgatcagcttgcgcacgatgaagagctcgcgctccaggtcgtcgccggccaggccggcgcgcgaccgcagcaccacctgcgcgatacggggcatggtggcgcgcgccacctcgcccaccgcggccacgtccacgggcacgtcgcgccagcccagcaggtcaaagccctccgcctcggccacggccgccacgatgccacgcgcggtgcccgccgcggcctcgtcgtcgggcaggaagaccatgcccacccccgtggagccctgggccgtgccggggacctcctccgccagcaggtcccaggggatctccagcatcagccccgcgccgtcgccggagacgttgtccgaggagcaggcgccgcggtgttccatgcagccgagggccgtgagggcctggaatgggggaacgatcgtgcccgagaatgcgctcactgcacgcataatggccagtggccgttgcaggaaaccgtacccagacacaggatcttcctcacggatgcctcccagacacctccccacccccccaatccccgcatctcaacagggaatcctgaccttggtgacgatgtcatgggtgcgctcagccttcaggttggcgatgaatccgacgccacatgcatccttctcccgcagcaggtcctcgttgtccaccgccacgccgacgtagggctcggtgtcgggggccgggccgggccccagcaccggtccggcctggccgacgggaacatgggcagggcgggcgggggtggcgatgtgctcggaagccactgccctggtttccgctccgcgacgagtctgcagggaggggtggggggggcgcgacctggaggggactgggcatcgtcacgtgcgggcaccaaaccccaagcccagaccaccggaacccgcccgcgatccagaggcccaaggagacgtaccctgcgccggtgcagccgcggcttatttcctgtcacccccaagacagagacagggggcgctgcatgttgccagggtgcgcagggtgtgacttgcgctgccgtgtgggttgcccgagcttccatgagtcagggccccgtgcggcccttggaggggatgtggtgtgtgctagtgtgtcggctggaagggcgccgagatgtccgatgtgtgctgggagggtgtggtggactagggctatctacccttaacgcttcgccttaa

SEQ ID NO: 2576 - DNA, 1398 bp, Chlorella protothecoides
atgacacataattatcgtgtttgggaggttgagtgcgggcgtggctccttaaggccggtgcacgatgatcgcatcggttcaaatcgctccatgtcatgtctcgaggtcaccaccctcgcgccctccggcatcatcccaaggcgccagaaaacggcgcgcccccgaccagcaggcgagcgagggtacatgtcgtgcaaaccagcaggcaagactctcacgcaagctaacacgggtatacatgtcctagcaaacatatctactcccaaacatatctacgccgtaacgcgccgacaagctatccctcgccgactctctgccctcccagtccaccgccatgccgaaagtcacacgcaaggatgccgcagaaccgctgcaggaggtcggaccctcgggtatggacacagagggcactccattgcccacgagtggaggtgctcctggcgaaaagcccaactttccccccttgtcggcgtacgagctgaacggcaaggtggtccaattccgtcgggtcccggtgcctcagcaccgcatgacccccttgaagacaagctggctagcgctatacaaacctgtgacggagaacctgaagctggacatgcgcatgaacctcaagagcaagaaggtgatggggcacagagtgaggtggagctgaagaccactgagaagacaggggagcttgccaacctccaaagagcagctgactttgttcaggcctttatcctggccgactttgtacaggccttcatcctgggtgagcattggtatatgggaatggcatccctcttcaaaggatcacagcatgccagggagcatgctgaagctcatcagcatggctcactagtttacatgtatgccaaggggtcgggactttgtcacagcgatcatgctgcgtccatggcaagccaggatgctgacgcccttggctcacttcgaccccaacccatcgttcaatcaggctttgatgtgaatgatgcgatagctctcctacgattggacgacctttacatagagtcctttgaagtgaaggatgtgaaggtcaacctcgcttgtgtgagactcccaatgcctcagcccccttgccggcacaagctgcagcctgctgccacgtggctctgcaaaacagctcacacgcccattacctcacagaccttgagaggcgagcatctggctcgctgcattggccgtctggctgggaagagcgggaagacgaagttcacaattgagaatgcgacgcgcacgcgtatctgcctggcagacacaaagatacacatcctgggatcgacgcagaacatccgagtggcacgggatgccatctgtgccctgattatgggctcacccgccgggaaagtagccactcgtctacgcacagtctgtgcgcgcttgaacgatagctactga

SEQ ID NO: 2577 - DNA, 1164 bp, Chlorella protothecoides
  modified_base (18)..(27): a, c, t, g, unknown or other
atgttcccgctggacctnnnnnnnnnntcagaagtatggcgacatccgagaggcggtgagtgctacttgcgagtccgccaaatgttcccgctggaccttaaagtgcccactcacgacctactgcccgtccacgcactcccgcaggtggtcatgcgtgatcgacaaacttcccgccctcgtgggtttggtttcgtgacctttgagaagtcggaggtcgcagatgctgtcgtccaggagacccacgtcgtggatgggcgacagatcgatgccaagaagtcggtacccttggagcagaagcccaaggcacgcaagatctttgtcggtgggcttgcaccagagaccactgaaggtgatctgggctttttgagtggagatctgggctgtgcagctggcaattgcatcacaagagggacctggctgctttgtctcaatcctgtgtatgggatacatcctggcaagccgaaggccttcaagatctactttgagcagtttggggaggtcgtggaagcccagatcatgcaagatcacatgagtggacggtcacgcggcttcggtcagatccctgccgctgtccattcctgtgcatcatgcgctctcacctggagcccatctcacattccccgtctcagcttcgtgacgttcgcggaggatgtctccgccgagcgagtttttgcggccggcgccatgcacgagctgcgaggaaagcgcgtggaggtgaagccggccacgccgaagggctcgggcgtcgccacgcccgccgcccccgcccccgcccgcatccctcgccccatcatctaccccagccaccagggcccctttccctttgtcaccggccaccccactgcctcatacgcgtatggagtgtacggctatccgcccccgggcacgccccacatgctgccagcaggcagcgcctacggcatgcagtaccaccccaacccttatgtcatgatgcagcaggtgccgtacggcgccgcgccggcgccggccggtgcctacacgccgcccgttccggggtcgccctacggcgggccctccccctccctgcgcatcgccaagcccccgtccgtcgctgcgccggcggcagggggtgcggagtctgccgccaccgccaccccgacctcccaggccatttcggacctgcgaaagctgaacctggactga

SEQ ID NO: 2578 - DNA, 1074 bp, Chlorella protothecoides
atgtgcaaaggttgggcgagtgctcagaacgaccatttaaaccgcgaaatacacccttctcctcgaatcccagggggcgtgcacctccacgttctacccactgccgtcgattatgtgagtttgtggacgagagttgcacatttgagagccgaccctcgtcgatgccgagccgccgccgtcgcccgtggggcctgctcagccagggaagggggtccggatattccgtcgtctcctcacgatgccctcacatcacacatcgtgcacagctacgggcctcatgtttatctgctggacatcgagagtacgaacgatttctgcagggccaaaggtcacagcaaagctggctccctccgcgacaccactttggagacattgggactggctgttgatgccatcaacgccggtactctgaaggtgaagacggcccgctctacaaagatcatcgtggccgtggagtgtctgaagactggacagaaggcatgcacggcagacaaggccggcaacatcggcaccggcaacaggggacacaacaactatggggactacaacgcgggcaacaacaacataggtgtccttaataagggtgacagaaactggggattcaacaacgcggggaccggccttttttgcaataactccaaggggacgagggcgggtggcaacgattgtagcctgcaggaactccaggtaaatgcgtacaagagaataacttacccatcaccggcaaccagaaagccctctccacctcccccaaggaagtcaccgcctccccaccaagaatcgccgcctccccaaaagaagtcgccacctcccgcaaagaagtcgccgcctcccaaaaagaagtccccacctcccgcaaagaagtcgccacctcccgaccaagaatcgccgcctccaaaaaagaagtcgccacctcccgcaaggaattcaccgcccccccccttccactctcccctctgccctctcctcttccctccccacattctccctcacatccgacttccccaccgccttcgtggccgcccccgtctcccccgccctcgccgccacctccctccccaccgccctcgccgc

SEQ ID NO: 2579 - DNA, 273 bp, Chlorella protothecoides
atgtggggagggaagaggagagggcagaggggagagtggaagggggggggcggtgaattccttgcgggaggtggcgacttcttttttggaggcggcgattcttggtcgggaggtggcgacttctttgcgggaggtggggacttctttttgggaggcggcgacttctttgcgggaggtggcgacttcttttggggaggcggcgattcttggtggggaggcggtgacttccttgggggaggtggagagggctttctggttgccggtgatgggtaa

SEQ ID NO: 2580 - DNA, 2721 bp, Chlorella protothecoides
  modified_base (22)..(31): a, c, t, g, unknown or other
  modified_base (589)..(598): a, c, t, g, unknown or other
  modified_base (820)..(829): a, c, t, g, unknown or other
  modified_base (2659)..(2668): a, c, t, g, unknown or other
atgctgaagctggccagcctgnnnnnnnnnnttcagggattgagattcgcaaggccacccctgcacagagtaatctcggagtcccatgacccctcaacctccccacaaacgaatcttcatccccccttcacaggcatgctgaagctggccagcctggtgcagtacgtgccgctgccggtgatcggggggtacctggccttcgtgggctacttctgcctggcggcgggggtgtcgctggcctccggcgtgcacatcgacgaagacccaatgacctgggcggggttggccagcgccgacgcgctcctgcatctggtccccgccctcctcctcctcctgctcatcacggcggtgcagcgcaggtttagccacccgctggccctgcccctgttgctggcggccgcgcctgtggtgttttacgtcgtgctcgccgccggcggctggacgctggcagaagcacagcaggacggctgggttacaaagccgaccgtgagcaggaccattgcttgggggtcggatggcgtctgtcacctttgggggggcatctcctcacacatcacgactgggaaggggatggcctgccatgaaatcnnnnnnnnnngcctggtccccgccctcctcctcctgctgctcatcacggcggcgtggggactcatagctgcaccgggaagtgatgcgaagtcagcgcaggctgttgcaaagtcaggatgtgccctgcgtggatgcgccccaccctgtaccagcagcccaagaacgctgtgggagccctgctgtccacggaacgccgcaccaccgcccccgaagagcacgcccgtgctgtggnnnnnnnnnnggatgcgaagtcagcgcaggctgttgcaaggtcaggatgtgcccagcgtggttgcgccccgccctgtgccagcagcccacgaacgctgtgggagccctgctgtccacggagcgccgcaccgccgcccccgaagagcacgcccgtgctgtggcgccacggccatctcaactcgatcctgtgctccacccttcccgcagccgggcgagaaaccctggaagttctgggaggcctggtcgctgttcggcttcgacgccttcccccccaccaccatccactggcgcttcgtgcccaagcaggcgggcaagatcctggccctctactttgtggtggcctttgggtccagcatggacgttgccgccatccaggccgacgtggcgacgcccctggactacaacaaggagctggtcaccgtgggtgagacggaggcggggtcctcattgtcggtctgttggggatggtggcggggggggtggcatcttgtgcatgtccttgccttgccaacccaaggcgcagcgcttcagcgcatcagccaccttgacattcgatgggctgagcgtgggggtggtatcttgtgcatgtccttgccttgccaacccaaggcgcaggatgagcaacctggtgacgggtatggcgggcgtcggctacaccggctcctacatcttctcccagaccctgttcaacctgaaaatgggcgtggactcgcccgtcatgggcatcattgtcgtcggtgggttctgtggatgtggggtgcggtagaacggtgtgagatgggagcaaaggccaggagaggccgttcctggcgcatcgtggggcctgccgatcatgctcacacctgcactccgacatcccacccctccacacacacagtttcggaggccaggacatcctcaaggcgggtgtcggggaggagcgggggagggggagctggtgagcattgcacgcttttctttgcgtgcctgccagggccacatgtagagtcggtatcggcaccctccatctccaatgacacccctccatgccaagttcatgctcctgaagtctcctcctcacatctgccaactcatctctctggacccttccttatgttggacatctttgaactcacctgcccttatagaatctccctacttccctcctcaatgcacaggactggctgttcatcgcctacaagcgtgtgtcgcacgtggagtatgcgctcctgctggccacgtttggggccatcacgctgtgggggctggagctgggcatcgccgctggcatcgcggctgccgccctccacttcacctactcgtgcgtcgatgctggggcgggatggaaggaaagggaggtttgcgatggcggggctgccggagggacgctcctctcctgtagcttctttgggcccacaccagttctgtgggccccaacccacttgtctgcgctgccgtcgcacgctcctcccgctcgccgatcgcccggcaacaaatcatctccaatccatcccgcgccccctttcctccttcatccgcccttccagccgacatcaaccccccacacacatgcaggtatgcgcgggtgacgctgcgcaccttcagcgtggtgccgtcgcggtcgggcgcggtgcgcacctgggaccatcgccgggtgctggagcactttgtgccgcgtgttcgcgcctgcagcctgcagggctacctcttcttcggctcctccgtcctggtgtccaccaaggtcctggccgtggcacaggacctggtggccagcctgggccagctggcaaggcaggagagccgtggccggccgcgcacgcagcgcgagagcgagaagctgcagggcgccctgattcgggcnnnnnnnnnnttgggccagctggaaaggcaggagagccggggaaggccgcgcacacagcgtga

SEQ ID NO: 2581 - DNA, 798 bp, Chlorella protothecoides
  modified_base (767)..(776): a, c, t, g, unknown or other
atgagctacagcgattacgtcaccaccccgtcaggactgcagtaccttgatgtcaaggtgggcagcggtcccacccccaagccgggtcagcgggtgaccatcgactgggcgggcgtcaccatcgggtactatgggcgcccctttgaggcccgcaacaagccgccctcgcctccctgctctcaccctggcctcctctgggcacaccatgcctctgcacagaccaaggggggcgccttcacaggggacgacaaggagttttaccactttaatctgggctccggctcggtcattccggcggtggaggagggggtggcgggcatggcggtgggcggcatccgccgactcatcgtcccagaagagctgggctaccccaatggggacatgacggccctgggacccagccccaccaccttttccggtgcatgggggatggtttctgtgcgtttgcgagagcatgcaccaccggagcaggggcgtccggctcttggggaatgttcccagggcattggcgcccccacccctgcacgccccctctccctcaatcacccctcccacgccccctcccctgcgcaggtcagcgggccctggactttgtgctgcgcaaccagggcttcatcgacaagaccctgctcatcgacgtggagctgctggacgtgcgctgacgcgccatcgcggccctggcgcctcacgcgcagcctactcacactctggtcgatgaacactcggaccggcggcctgaagggcgcactgccaaccaaaattgcaannnnnnnnnnagagctgctggatgtgcgctga

SEQ ID NO: 2582 - DNA, 2115 bp, Chlorella protothecoides
  modified_base (914)..(923): a, c, t, g, unknown or other
  modified_base (1555)..(1564): a, c, t, g, unknown or other
  modified_base (1866)..(1875): a, c, t, g, unknown or other
  modified_base (2056)..(2065): a, c, t, g, unknown or other
atgccagcatgggccgtgccccgacctggcccccctctccctgaggtctcgcatcttatccctgcctgtggagctaagaccccccccctcccccaccccccccctccgcagcaaggcctgtccttctgcggcgaccgcgaggaccccgtgtcaatgggcctgacggtgttccaccagctgctgcgccggcacggcgtgtcgccctccgaggtggggcacctgcaggtgggcaccgagtccggcgtggacggcagcaagtcgctgaagacctacctgatgcccatcctggaggcgacggggaacacggacgtggagggcgtggactgcgtgcaggcctgctacggcggcaccgcggcgctgctggccgccgcggcctgggtcgagtcccgcgcctgggacggccgcctggcggtggtggtctgctccgacatcgcgctctacgcgcccggccccgcgcgccccacctccggcgcgggcgcggtggcgctgctggtcggccccgacgcgccgctggcgctggagcgccgcctgcaggccagccacatggcgcacgcctacgacttctacaagcccacgacggggtaccctgccgtggacggcccgctgtccgtctactgctacctgcacaccctggacgtgtgctgggcgcggtacgcggagcgcttcgagcgcgcgctgcacgcgccctgcacgctggacgcggtggaccacgtgctcttccacgcgccctacaacaagctggtgcagaaggcgtatgcgcgcctgtggtacctggacggctgccggtcgggcgcgctggcggggcagctggagggggcctcggcgctgctgggcgccacgcgcggcggcgccgcgcccgacggcgtgagcaacggcggggccgacccgtcccccgcccactcccacgcacccgnnnnnnnnnncggcgctgctgggcgccacgcgcggcggcggcgcggccgacggcgtgagcaacggccgggccgacccgtcccccgcccactcccacacacccatcgcccacccctgcccgcccaccgccatgccgccggggctggagaagtatctgctgggcgcgacgcacgccagctacgacgccaaggtgcggccggggacatgcgtgcagcgccagtgcggcaacatgtacaccgccagcgtctggtccggcgtggcccagctgctggagaccacgggcgccgcgctggagggccggcgcgtcctgctctacagctacggctcgggcatctcggccacgctcctgtcgctgcgcggccgcgccgtggccccagggtcgcggttctccctggcccgcctgcaggccgggtcggacctggcggtgcgcctggcgcgccgccccgccgcgccgcccgccgacttcttggccgccgtggcgcgggcggaggcgctgcgcggggccaaggcttacgccacgctctggccccgtgtggaggacctggcgccgggcacctactacctcaaggaggtggacgagcgccaccgccgcgtgtacgggcgccgcgacgaatagccgttgcgatggggggcgctgggcgannnnnnnnnncctcaaggaggtggacgagcgccaccgccgtgtgtacgggcggcgcgacgaatagccgtcgcgatgggcggggcggtgtggccgggcgcgtgggtgctcatgttggaaggggcgaggcgaggcgggagtctgcgcaggggaacaggctcgtgccagagcgcagcgcctcgccccacccccccatgcctggagccggctgcctgccatccgcggcgaggagcggggagcgagcaggtcgaccaaccccggcggcggcggccgctcgcgacacaaggcagcggcagccgccgccgggaaacaannnnnnnnnnggagtctgcgcaggggaacaggctcgtgccggagcgcagcgcctcgccccaccccccccccatgcctggagccggccgcctgccatccgcggcgaggagcggggagcgagcaggtcgaccgaccccggcggcggcggccgctcgcgacgcaaggcagcggccgccgccgccgggaaacagnnnnnnnnnngccgcctcccacctcccacggcgcccttcctccccctgtaccgggcttga

SEQ ID NO: 2583 - DNA, 660 bp, Chlorella protothecoides
atgcatgcgacttcagtgatgcacgcgcgcccttttggtgccgtactcttccgagtctgtgcagggcctccactccggcacgtccccgccttcaaggccacacatcgcgtgcatggccccaggaatacgaagagacgcttgtcctggactcatcatgcgggccctccccgcgccatcccatcccagggcctcggggtggcggatgtggtggccctcgatgaactgatcgaccacctgaccgccgcgcgcgcctcgggctcctttcccgaggccgtggccaaaaacctgctgagcttcgaccgtgggttctggctgcgcctggccgcccgcagggacactgccagcagcgaggcagaggccgagagtctgacccagctggcctcggacgtgatgctgctggtggacgagatggtgaaggaaagcgagagccaggtgcagcgctcatcccggctcctgcaacgggtcctggaggcgggggcggacggcgactcggggcagtggcagctgccgttgagtaccgacaagagacgggccatgcggggggtgatggcggcgcactctacccaactggacgaggcattcgtcacctcggccatggcctggatccggaagtctgagtctgacagcatagagggtaagggtttgaggcagaggcagtga

SEQ ID NO: 2584 - DNA, 1062 bp, Chlorella protothecoides
atggccggtccaggcccatcgtcgatgagccaagcgcggtgggagctggagaacgccgtccaaactgtgcaggactccgatgttgatgccgtgtatcactggaacccggccgagcagcgggaaatgcagcaggcccgcccctggctccaagaccccacatactttaaaaggtgtctggccgggcgcggagattcgggtcaggggtgccgacttcaatgcatgcaagacctgacctgtgctgacccacacgcccgtacccaccacagggtccgcatctccgccctggccctcctgaagatggccatgcatgcccggtctgggggcgatctggaggttatgggagtgatgcagggcaaggtcctgggcgacacctttgtggtcatggacgccttcccgctgcctgtggagggcacggagacgcgcgtgaatgcccaggcggaggcctacgagtacatggtcgagttcctggagaccaacaaggtggtggtcggcgggggttggcgggacaagagggtgggggtgtacaggtggcttgcaggaggctggagtcttgggaagatggggtgcgactgtctgggagataaagctcaggaccacccggggtacggctgctggctgtccggcatcgatgtcgggacgcagctcaccaatcaaaagtatcaagagccattcctggcggtggtggtcgacccacacaggacggaagccgcagggaaagtggagctgggggcgttcaggacctaccccgaggtgggtgggaggctggtggctgctggcgacaggatcgcagccttgggtgcagggaggtctatcctggccgcgccagggcgtgcagtgctctgtgctccccgcacctcgcttccgagggcatggactgcttcgtccgtgccgattctgatcccgctgtggcacctccccgctgtgcctgcatcccagcaggggtacaaggcgccggatgcaggtccctccgagtaccagaccatccccatggagaagatcgaggactttggggtgcacgccaaccaggtccgtgctgatgtggaagcaggggtggaggagtga

SEQ ID NO: 2585 - DNA, 666 bp, Chlorella protothecoides
atggaggcgggcctgcacttctgcgaggagcagttcctggacgtggccattgagtccggcctctgctcgccgcggcgctcggatgtgaccctggccgaggcgctgctggcacaccgctccctgtcggacgcgcaggccgagcccggggggcccgcgaggtttgaggccgccgccgcgctgttgggccgatacgtgcgccagaggaagctgcgggctgctgaggccagggtgccgactcctttcaaccacccacccacccgcccctccgtcagagagggcgaggccctgtttgagagcggggacgagccagactgcttcttcatcatcaagtctggcaccatcattgtggaagtcagctttgcagagaacgagcaccaggggaagccgggggtggagggagcccccaccctcacacgggcccaaaacaggacctttcaccacgacccaggggcggtggtgggcgacttcgacttcttcgccgggcggagaaggaccttccgggccctagcccttacccccgccgcggtctgggtcatctcgcgggcagtgctccaggcggtggcagacgagagcccgtccaccgtggtcctgctccagtccatcatcctgcgcgcggcctccctcacggcggtgcacgccttcgaggtgctggagaagctgacctga

SEQ ID NO: 2586 - DNA, 1359 bp, Chlorella protothecoides
atgagcacccacgcgcccggccacaccgccccgcccatcgcgacggctattcgtcgcgccgcccgtacacacggcggtggcgctcgtgcccggcgccaggtcctccacacggggccagagcgtggcgtaagccttggccccgcgcagcgcctccgcccgcgccacggcggccaagaagtcggcgggcggcgcggcggggcggcgcgccaggcgcaccgccaggtccgacccggcctgcaggcgggccagggagaaccgcgaccctggggccacggcgcggccgcgcagcgacaggagcgtggccgagatgcccgagccgtagctgtagagcaggacgcgccggccctccagcgcggcgcccgtggtctccagcagctgggccacgccggaccagacgctggcggtgtacatgttgccgcactggcgctgcacgcatgtccccggccgcaccttggcgtcgtagctggcgtgcgtcgcgcccagcagatacttctccagccccggcggcatggcggtgggcgggcaggggtgggcgatgggtgtgtgggagtgggcgggggacgggtcggcccggccgttgctcacgccgtcggccgcgccgccgccgcgctgggcgggggacgggtcggccccgccgttgctcacgccgtcgggcgcggcgccgccgcgcgtggcgcccagcagcgccgaggccccctccagctgccccgccagcgcgcccgaccggcagccgtccaggtaccacaggcgcgcatacgccttctgcaccagcttgttgtagggcgcgtggaagagcacgtggtccaccgcgtccagcgtgcagggcgcgtgcagcgcgcgctcgaagcgctccgcgtaccgcgcccagcacacgtccagggtgtgcaggtagcagtagacggacagcgggccgtccacggcagggtaccccgtcgtgggcttgtagaagtcgtaggcgtgcgccatgtggctggcctgcaggcggcgctccagcgccagcggcgcgtcggggccgaccagcagcgccaccgcgcccgcgccggaggtggggcgcgcggggccgggcgcgtagagcgcgatgtcggagcagaccaccaccgccaggcggccgtcccaggcgcgggactcgacccaggccgcggcggccagcagcgccgcggtgccgccgtagcaggcctgcacgcagtccacgccctccacgtccgtgttccccgtcgcctccaggatgggcatcaggtaggtcttcagcgacttgctgccgtccacgccggactcggtgcccacctgcaggtgccccacctcggagggcgacacgccgtgccggcgcagcagctggtggaacaccgtcaggcccattga

SEQ ID NO: 2587 - DNA, 375 bp, Chlorella protothecoides
atggcgctgctgctgcgcaaggtcctgcaaatgtttgctggctgctccctgctggacattcagcctggcggccagggccggccaggcgtgatggatgccttccttgaagcagatgaggagcagtggacaagcatgctgcaggacatggctgggaagcagggatcgaggcatcacccacagcattccatatcctcccaccacagcggtgcagagctgctccaaggcatccaggtgatgatggagcatgtggctctgcagggcgcggccggctctcaggcacagcgggtccagattgaatacctcaacgaactgaagacgcgtgctctcaatgcattcagcaatgctcagggtacagacgatgccggagcaacatga

SEQ ID NO: 2588 - DNA, 1305 bp, Chlorella protothecoides
  modified_base (184)..(193): a, c, t, g, unknown or other
  modified_base (293)..(302): a, c, t, g, unknown or other
  modified_base (439)..(493): a, c, t, g, unknown or other
  modified_base (643)..(652): a, c, t, g, unknown or other
  modified_base (898)..(907): a, c, t, g, unknown or other
  modified_base (1223)..(1232): a, c, t, g, unknown or other
atgcgtctgctaggcaccgcccgaggcgatgccgcaccccttgtgcacgcgtgtcaaagtgctctgcccttgtccttgctaatcacccaggaggatctgccagtccacccccccaccccccctcccgctgacgtgcagctccttataaccctccctgcagatcgtgagcgggctggtgaaattnnnnnnnnnntccctatttcgaggagtgctccatgcgtctgcgaggcaccgcccgaggcgatgccgcacccttgtgcatgcgtgtcaaagtgctctgcccttgtccttgnnnnnnnnnntgtgcccattgaggccatgcaggggcgaacagtggtggtcgtcaccaacctcaagccagccaagatgagggacgtgatgagctacggcatgctccttacaaccctgcctgcagatcgtgagcgggctggtgaaattnnnnnnnnnnnnnnnnnnnnnnnnnnnnnnnnnnnnnnnnnnnnnnnnnnnnnnnggcacctgggttcagaagggatggtaggaggacatggtatcagggcctctggtgtgtcggtggcgtggccctcgagtgccgcacctcctggcaatgctgcccaccatgaccactgcgtacgccctcaaccctaccaaccacaggtgctcnnnnnnnnnnttgccgcacctcctggcaacgctgccaccatgaccactgcatccgccctcaaccctaccaaccacaggtgctctgtgcatccaacgatgcgcatgacaatgtggaccccatcatcgtgcctgagggggtgccggtgggcgaacgcatcacctttgagggggaagtattgcatcggcgtcgcgtatggcatggccaactatcaacattcttccaaatttcaactcaggtacacgcgtgagccggagnnnnnnnnnncatcatgtgattccatcatgcttactgatgccaaagggaagtaccgcatcggcgtcgtgtatggcatgaccaactatcaacattcttccaactttcaactcaggtacacgcgtgagccggaggcgcagctcaacccacgaaagaagcagtttgagaagattgcgcccagcctgattgtgcttccaggtgaggctcctgggattgtgacgagccggggctgtcaccatgatgcacggcagtggtcagggagaagtgtcacgaaatgctggcagatagggagggctgttcagccagggcagcaggctggcaagacaannnnnnnnnntgaaatgctggcagaatgggaggggctattcagccagggcagcaggctggcaagacaaacgtggaaagactga

SEQ ID NO: 2589 - DNA, 1455 bp, Chlorella protothecoides
  modified_base (102)..(111): a, c, t, g, unknown or other
  modified_base (1015)..(1024): a, c, t, g, unknown or other
atgtcgccagcagtgctctgggcgcgagttgggcttggtcctgacagcgtggcactgcaatcgttgtccttacagatgtggacttctggtagcaattcggannnnnnnnnnaaatgtcgccagcagtgctctgggcgcgaggtgggcttggtcctgacagcgtggcattgccatcgttgtccttgcggatgtggacttctgcgctctgcccatttgccacccaagaaaccagtgtccgggaagtccgggatggccaccctcgtggcatccatggccctgcgcgtgcagattccccgatcccagattttccgacacggagttctgcacccgtacgcccgacgctcgcagttctgtgtccgcagcgcgttgcctctgtccagacaggccttcaccagcaccctccacccatctgacatccggccaaatgtgtccggggagctcgaccgcccaccggccaataagccggcacatggaggtattgaactcatcatggggcctatgtttgccggaaagtccagcgagctgctaagacgcgtggagaggctggaggcggcagggttgacggtggcgctggtcaagagcagcaaagatagtcgctactcggactcgcatgttgtcacccacgacggcgtgaagaagtgtcttcctgtgagggtggtggatgttgaattgcatcttgacctccaatttgtgggacccatggcttcaccatgggccagcactcgcgccatctcattgttcagtgtcgaccttctgcaggcctgttatgctgtgccctcgctggaggtgttccgcagcatggcaggggatcgctgggccaagtaccaagttgtcgccgtggatgaggcacagttcttccccgacctcttccacatctgcagctcgacggctgatggggagggcaaactctgggtgctggcaggcctggacggcgacttcatgcggcagcgcttcggacaggtaggttttgggatggagggagcggattcatccttgggggaggcgtggggatctnnnnnnnnnncaggtaggttttgggatggagggagcggatacatccttgggggagaagatctagaggatgccagcgaccaaaacgagcatgtgttggtctccaagaggcactgtctgaggctgtttctgagcaatgtgagtatgcaagacatgccccaatcagttcaccctccccacccacaaaacgtgcgacagatgctggatttggttccgcacgcagactccgtgaccaagctgactgcacggtgccagtactgcgcccagtccggggtcacgacagccgcgcccttcactgtccgattctcagttgccgaccagcggcaggaggtggtgggcggtgccgagcggtacgcggctgtgtgccgccagcacttcggccggatgctgggccacgatgcggcggcgcccgagggtgacgccgatgcccaggcggccacatga

SEQ ID NO: 2590 - DNA, 837 bp, Chlorella protothecoides
  modified_base (736)..(745): a, c, t, g, unknown or other
atgctgacgagattcagggtgggcaggctaggcatgcgcggtgtcattatcccaccccattatcccatgcctcgtacccgccacggtctccaggaacagaatgcggcgcagccacctctcctccgtcatctgatggccgtacccggtggccacgtcgaagagggagcgcatggcctgcaccccgtagtagcccgccttctcgaagaaggcctcgggtacctggtggtggggctccacgctctccacatactccttgctgtagatgggctgcatgagccagtagctcttgtccttgccacccgcctcgggggaggaggcggtggcacgcaggccggggtggggcatcacgttgtccgccgcattgtaggtggagtggtccttggggtccggggtgctcagcttttccgcagacgccggctgcgcgcatggggtgggtgtgcgaggaacccttgttgcgagggggggaatctggatgacatgatcccatgcgggatgcatgcaaagttcagcggcccatctctacccaaccggcctgcacgatcctctccttgcctgagccgagaagctacgagtccgggagatggctcgcagcatactgtgtgtgttcaaaggcctgggtgtcgatggaatctggtgcgcacacgggcgtgcttcaaagcagtcgatctacgacgcggaaccccccagggcgctgtgaggaggtgtttgaaaaggatgtatagtcaaaacaatatannnnnnnnnntcaaaggcctgggtgtcgatggaatctggtacgcacacgggcgtgcttcaaagcactcgatctacggcgccgaaccccccagggtgctgtga

SEQ ID NO: 2591 - DNA, 1218 bp, Chlorella protothecoides
  modified_base (337)..(346): a, c, t, g, unknown or other
  modified_base (754)..(763): a, c, t, g, unknown or other
atgctgcgccacatgcgctccctgcgctccatgaagcgcgaccggggctggatccacacgctgctggaagaagcagagaatgaggtgcgggcggctgctcggctggcttgctggggatttagggcagagtcgggcaccttgggtgtcaggaacaatgggtcacccttctggcggtccagtaggccgacatcgtcccccggcactgctattcaaggcacctgcaagtgtgtgccatcccagggaagtttgaccggccatcccagaacatgtccccgaatctcccccccctcccaccccccctttcccgtgcagcgcatgcacctcctgaccttcctgnnnnnnnnnntggcactgctcttcaaggcacatgcatgtgtgtgccatcccagggagtttgaccggccatcccgtaacatgtccccgaatctccctcccaacccccccccttcctgtgcagcgcatgcacctcctgaccttcctgcagttcagggagcctgggcccttgatgaggggcaccgtgctcctcggccagggtgcgtggcggatgggccaggcgctgggttggagctgcatcagttgcacaggcagcggccagcgtatgccttgagtgtgggaattctacctgctagaagagttggcgatgccatgtcttggaagacaccctaccaactcgtgatgtggggatgcttcgtctcgtcacttcactgctacttacaaactgctcccctgggcttgtacgaacaggtatctggannnnnnnnnncatgctgcaggcgtgttcctcaacttttacctccttgcctacaccatctcaccccgcacctgccacagctttgtcgggtgagtgcactgcacagactgtctgatgggaagagggtggttgggggttgtacgcgctggtgtgcattttcactcatgcaggaagagaacctaccaactcgtgatgtgggggatgcttcgtctcgtcacttcgctgctacttacaaactgcgcccctgggcttgtacgaacaggtatctggaggaagaggcagtcaagacctacactcgctgcatcaaggtgcggtacggaggatggtacaggctgccggtatgcgcccatgccacgtggccgagagggggatgcctggactcgtcgcagggaagtgctccctctgcgccccttgtccataccgggaaaccccatccgttcgtcccctttcccctgccaggaccttga

SEQ ID NO: 2592 - DNA, 282 bp, Chlorella protothecoides
atgccacatggccgagcgggggatgcctggactcgtcgcagggcagtgctccctctgcgccccttgttcatgccgggaaaccccatccggtcgtcccctttcccctgccaggaccttgatgctggcttaatcccgcaatgggagaaaaaggccttgcctgaaatcgccatcaagtactggcagctgagccctgatgccaccatgagggacctcctgctggctgtcagggccgatgaggtgggctggatgctgaatgaggggaggacgcggttcctgcagtga

SEQ ID NO: 2593 - DNA, 1140 bp, Chlorella protothecoides
  modified_base (55)..(64): a, c, t, g, unknown or other
atgtttgggcctcccaggttcaggctcccagaccgcatcaggcagcccatcttgnnnnnnnnnnccctgcaggagggaaatgtttctcaagccatgctcaggccggtgcggtatgtttgggcctcccaggttcagtctcccagaccgcatcaggcagcccatcttgctgggccgtgcttcgcacccccgcctccctttctggtgatgcgtgcctcatgcgggtgtcacactccccctctcacaggcctgccacagccatgtgaaccacgccttctcccacatgaagccgtcagaggagaatcccttccttccagggacggtgcacgtgccctaaaggactcggcaaggatagcttggctctggccccactatccggcttactcaccacccactcaggacgtgaggaagaatgagatgacgtgtggaagaatgagatgtgttctcctatcatgcatggaatttgagcgcaaattgttcatctggccctctccatcacccctcgacagcgcgcataatgcgtcagggggtgaggggcccaccgttgggctgcggctcgtgcctctccctcttcacggcctggcctcgatcacggcggagcccatctggcccggcatggacccgctcgagcttcccatacgccgatttgccactccgattgccgaggccgtgagggacaatgccgtcgtggtggtcattggcgaaacagggtctgggaagaccacccagatctcgcagattctgctggatgccggactgggggcgggcgggatggtgggcgtcacccaaccacggagagtggaggtgggatatgcggtgcggttcgaggagtgctgctcgcgcaggacctcgatcaagtacctgacaggtgggtttgaagaagggaggggaagggacggccgtgctcgctcaccccatgctggccttgggacgctgccaggcaggcaatggcagcgggacacaacctgcctgggtggcccagtctgcgctcaaccgttgagtgcccgtggatgctcttcggggacttgcgggtatcgccatcaaccagggcacgccctccccgaccgtgacagatggcacgctgctccgcgagctcctgcacgacccttccctctcgcggtacggtgtgatcgtgctggatga

SEQ ID NO: 2594 - DNA, 405 bp, Chlorella protothecoides
atgatgatgaggcgcacggcgcagtggccggcggcgccctccccttgcccagggcccgtcccgctggcgcctgaatcccccccctcccgccctccagcgcaggccagggtgttccgccccgccccgcccggcacccggcgctgcattgtggccacaaacatcgcagagacctccgtcaccgtggagggggtggtgtacgtgattgaccccggcatgtccaagcagaaggacttcaatcccgccacggggttggaccgcctggaggtcggacccatctccaggtgggaaggaggggttggggcaggggtgagcaggcttggtgcagggtcggatggacgagaagtcgttgtgttcaagcgcatgcatgccaaagggagtacacatgacgaaggagggaaagtgtga

SEQ ID NO: 2595 - DNA, 522 bp, Chlorella protothecoides
atgacactgctccagacccatgccctgaaaactggcatgggcgccccctctcccgggccggtgtgccctctctgcctgggcagcctgcaggaagaaccccatgcagacggggaggcaagcctgccaagcgccagcctccagcctgccgtgcaggcggtggtggacaagtacgaggtcccggtcggccagggcttctccctggacgtcagcctgccggcggccgcagccgtccgcgctcgggcgctggccgtccgccaccccggcgcctgcgccggcgcctgcgtggacctgaaggaggcgctgcgcctcagattcacgccgcccctggaggccgtgctggggacgagctgtgcgcccggggcggggctgcgcttgaccctggcgctcagcgcaccgggcgttgcgggcgagggcgcctggctggcgcagggcatccagcagcaggtggaccagagccggcggcggcgccacaccggaaagcggcggcacggcaagcaggacatcgtccccgccggtgggtga

SEQ ID NO: 2596 - DNA, 186 bp, Chlorella protothecoides
atgcgcgtgaggttggtgccgtcctcctcgtgcttcctgctgggcctgcgcacccaatcggggacgtatgtcaaggagtttgtgcacggcgacctggggcgcacggtcccttgcctgggagacctgctgggcatgcctgtgaccatcctgcagctggacgtcatggacattcacatggatttctga

SEQ ID NO: 2597 - DNA, 201 bp, Chlorella protothecoides
atgcatctccagtcacaggctgcgggcactctgggtgaatccctcgttccacctcgacacccccaggctgagatcgacaaggcggtgtgccagctgaatgcggcagtgcgcgcgctgccggccgatgcggcgggggacctgctggtgctccccatctacgctgcgctgcctccagacatgcaggcaagggtcggtgcttga

SEQ ID NO: 2598 - DNA, 2814 bp, Chlorella protothecoides
  modified_base (857)..(866): a, c, t, g, unknown or other
  modified_base (1237)..(1246): a, c, t, g, unknown or other
  modified_base (1558)..(1567): a, c, t, g, unknown or other
  modified_base (1648)..(1657): a, c, t, g, unknown or other
  modified_base (2723)..(2732): a, c, t, g, unknown or other
atgacaaggtgcctgacgtcatcactttacacaaggagacagaggctttcctcgacggcgatgcaacacaacagcactccaatggccacggaagtgcccatccctctgtgtgagctccaggcctgccacgagactagcgcagagggtgtacaagccctttttaaagaactcgctgcggctacgatggaggcagcaacactgaagcgcttggatggcaatgatgcacccagtcttgaagacctgcagacagaactgggctggctattcctggatgcatgttgccttgaggatgccgtcagcagggactggcaggcaatcggccggcatgagctcagctggctgcagggtgaaggtcccatgcctttgcacttgctaccctggaggctccgggccagcgtcgacgagctgggtcagcatgccccatgctggcatggaagcattgggcgagcccctccctcaagcccagccatgggctccgcagatcctctctcactcgcctcctcccaactttgcaaacatgctgccgcagccgcgctgtggacccgccgcctgcaggagcgcacccccctgcagtacctgacgcacaccgcgcactggcgtgacgtggtcttggccgtcggccccagcgtcctcatcccccgcccggagaccgagttgctgatcgactttgccgagtcggcgctgcgccgcgacgcccgcctcgccgcgcggccctgggtcgacctgggcaccggcagcggggccctggcctgcgggctggcgaggctcaaaggtgggccgggctccgtccacgccgtggacttgagccccacagcggcggcgacggcacggaccaacgcgcggcgcctgggactggnnnnnnnnnnggacttgagccccacagcggcggcgacggcgcggaccaacgtgcgccgcctgggactgcagcacagcgtgcacgtcgtgcaggggtcctgggcgcagccagtgctgccggacctggccggggcgtgtgggggggtggtgagcaacccgccctacattcccagccactgcctgccggagctccaggccgaggtcgccaggtgtgtgttggttgggagggggggaggtggaggggttacggagtggggtgtggtcctcgccatgcctgacagaggtactctctactgggagcgtactctttgtttaagacatgccccttgtgcaaacccctggccgcaggcacgagccctggctggccctggacggcggagcnnnnnnnnnnagaggtactctctactgggagcgtactcttcgtccaagccatgccccttgtgcaccccacacccccctggccacaggcacgagccctggctggctctggacggcggagtgggtgccgccctggactgctttgagcccattgtccagggtgcctccgccctcctcgcccccgggggcttcctggccctggagtccggggggggcgagcaggcagcgagcgtggcgtcgctgctggagcgcactggagcgttctctgaccaaggggcatcgtctcagccactaaaggaaaattctgagggactagggcactcannnnnnnnnnggggcttcctggccctggagtccgggggggctgagcaggcggcgagcgtggcgtcgctgctggagcgcaccggagcgtttnnnnnnnnnntcccgggcctggccccacccatttcactccccctcgccaggcccgcccgtcagtcagagggcacatactcctccgattcggcctcagaagcagactcggcctcgctgcgcgggcaaggtttaaccatcactttctggagccatggatccaacgcggatagtggaaatccaccctcccagcctgatgtcgctctgtgtggctgcataccatgccatgtcagcgatcaccaccctgctccagcacgagcaactcatacctgctgtcgtcatccacggtgtactttgcctgcgtcgccttggcggcggcctggcgccggggggcagcgaccctcgggcccaggggcgcggcggccggggagtcgcccacctccacgccgtcctcgctctccgcctcggactcgctgttcgcctgcgagcgggggtgcggagtcgcggaattgcatgcctgagggaggagcgctggacacatccctcacccgccgtgatgaggggcgcgggccctgtgttccaccaacggagaaatggccaccaaacagtcatctccatcgcacctgcttcttcttggcggcgggcttgcccttggccaagggggagggccccgcgctgctcttgcccaatcctgatcccttgtggaaggggctgggccgcatgcgtgcgacctggcggggggaaagggttggagggcgtcacaggggggcaggtccctcatctcgacatgagacgcataccttcccattcagcatgccctccaggctcaacacccgagacacgatacccaatcacacacactctcaccttgggcttgaccacgggggagggcgcctcctctgcctccggcacggccagcttcctggcggctgcgggcccgggcttgcgcttggcccccaggttggaggccgccccgcccgcgcgccgcgcgggcggggcctgcttccgcggcgcgggggagttgacctcctcgtcgccgctggacgcgccaaactccccgtcctccacgaccaccacgctggcgctgggggccctggccggggcgagcgcgctgccctggccccgcttggaggccgggnnnnnnnnnngcgcttggcccccaggttggaggccgccccacccgcgcggcgcacgggcggcgcctgcttccgcggcgcgggggagttgacc

SEQ ID NO: 2599 - DNA, 288 bp, Chlorella protothecoides
atgggcgctgcctcgtccgtgccctctgctgcggagccagcatggccctccgactccacaggcgggccggtgtacgtctccgaccgccccggcgcccacgactttgacctcctgcggcgcatcgtcctgcgggacggcagcacgctgcgcacgctgagccccggccggcccacccccgactcgctcttcgcggacgtgtgccgggacggcaagtcgctgctcaaggtcggtggtgtgggtgtttccttcgagggttggggcattgcacaagctggtttgactctgtga

SEQ ID NO: 2600 - DNA, 1611 bp, Chlorella protothecoides
  modified_base (1259)..(1336): a, c, t, g, unknown or other
caagacgctgctggccaaggcgacggcgggggaggcgggcgtgcccttcctctccatctcaggctccgacttcatggagatgtttgtgggggtgggccccgcgcgcgtgcgcgacctgtttgcgcaggcccgtgcccaggccccctccatcatcttcatcgacgagatcgacgcgatcgggcgcgcacgcgggcgcggcggctttgccggcggcaacgacgagcgcgagaacacgctgaaccagctgctggtggagatggacggcttttccaccaccgccaacgtggtggtgctggcggggaccaaccgccccgacatcctggaccgggcgctgatgcggccggggcgcttcgaccgccagatcagcctggaccggcccgacatcgcggggcgggagcagatcttccgcgtgcacctggcgcgcatcacactagacaaggaggttgggtactactcggagcgcctggcggcgctgacccccggcttcgccggcgccgacatcgccaacgtggtgaacgaggcggcgctggtggccgcgcgccgcgacctgcgcgcggtgggcatgcccgagttcgaggcggcggtggaccgcgtgattgggggcctggagaagaagaacaaggtgatcagcggggaggagcggcgcaccgtggcctaccacgaggccgggcacgctgtggtgggctggttcctgcgacacgcggagccgctgctcaaggtgtccatcgtgccgcgcgggtcggcggccctgggctttgcccagtacctgcccaacgagaacctgctggccacgggggaacagatggcagacatgatggccatggccctgggcgggcgcgccgcagagcaagtcatgctgggccgcatctccaccggggcccagaacgacctggagcgcgtgaccaagatggcctacgcccaggtggcggtgtacggcatgaacgacgcggtgggcctggtgtccttcccgcaggaggagggcgccttcaacaagccatacagcgacgacaccgcgcgcctgatcgacggcgaggtgcgcgcgctggtggcgggggcctaccgacgcaccctggccctgctggaggagaagcgcggcgccgtggaggccatggcccaggccctgctggagcgcgaggtgctgggcaccgaggagctggaggcgctgctgggcgagcggccctaccgctccgcggagctgcgcaacatcgacaagttcagggacgggttcgccagggaggcgcccgccggcgaggcgcccnnnnnnnnnnnnnnnnnnnnnnnnnnnnnnnnnnnnnnnnnnnnnnnnnnnnnnnnnnnnnnnnnnnnnnnnnnnnnngggagccgctggagccgccgacgccgcccccgccgccgcccagcgacgggcccgggggagggctgcgtcccgcgctggctgctgaagggtccagcagccggggaggtggacggaatgctggtcacctcttcagcgtcggatacccactcccctcgtcctgctggcgttcaccacactccacatccccccctgtgcattatttccctcatcttggagtgtatgctgctgccccaagactgcctggtggagcgcacagcaaagatgctctgcgctaa

SEQ ID NO: 2601 - DNA, 195 bp, Chlorella protothecoides
atgcctgccatcgtcatccggcaacgcaaggcctggaggcgcaaggacggcacgttcatctactttgaggataacgcgggcgtgatcgtgaacaccaagggcgagatgaagggctccgccatcaccggccccgtggccaaggagtgcgccgacctctggccccgcgtggccgccgccgccaacaccatcgtctga

SEQ ID NO: 2602 - DNA, 846 bp, Chlorella protothecoides
  modified_base (215)..(224): a, c, t, g, unknown or other
  modified_base (480)..(489): a, c, t, g, unknown or other
atggcacgggtacgtcaagcagaggtggtgcggcatacatgcatgcgttcgagatggccatcgctggtggcgtgggggcggccgccgcctactggtcgcagaggcagaacctctcggagatctgcaactggcaggcacacagggccatacgttcccgagcctgcccgacaggaaccagtggcaagctgcagaccatccagggcaagggctacagnnnnnnnnnngagcagaggtggtgcggcatacgtgcatgtgttcgggatggccatcgctggtggcgttggggcggccgccgcctaccggtcgcagaggcagaacctcttcgagatctgcaactggcaggcacacgggccatgcatgcccaggcacgcccgacaggaaccagtggcaggctgcagaccatccagggcaagggctacagatagctcattccggcctatcagtgatgacagcgccaatctccacccacatctgccctcnnnnnnnnnnactcattccggcctgtccgtgatgtcagcgccaatctccacccacatctgccctccacagtacccacggcagccagggcctccctcgcgcactctcacccttcttgcggaggtcgggctttcccttcttgcaggtggccatgatcatgtcgccgggcgcggcagcgggcagcctgttcaggcgtgctccccagccgtgcacggaaatgacgtacaggttcttgcctccgctgttgtccgcgcagttcatggtcgcagccacggggagacccagggccctgctccgtcagtggtgcaggcgcggggagagacggcgcgagctccagcacctggtcaatcgcgcaagtctcctgactga

SEQ ID NO: 2603 - DNA, 645 bp, Chlorella protothecoides
atgcaggcggtgtaccgcgggcacaagacgggccccttccgcatcctggtgggcatcgcggcccagatgcccgtggccatcggcgtgttctccaccctgcgctgcctggccgcggcgcaggtgccctcctacgtccagggcggcgcgctctggttcccggacctctccgcccccgatccgctctacctgctgccgctggcggtgtccgcctccttcgccgccgcgctgcgcttcggcatggacggcatgcagcagcccgacggcagcgggcagacggagaccatcaagaccatgatgcggtggatgccctgggtcatgggccccgccaccgccttcctctcctccggcatgcagctctccttcctggtcagcaacgtcatcggcctggcgcagtccatcgtcctgcgcagcgcccccgcccgcgccgccatgggcctggacccgctgccgccacggggcggcgccgcgcccggcgcggcgcccgtggccgcccgagacgccacctggacgctggaccccaggggcagcgtccagcaggtcgtggtgggggggccggggcagagcgcgagggccgccaggcccgcgggcgtggcctttgctccgccgcgaaggaaggcggggaggaaaggggggagcaaggcgtag

SEQ ID NO: 2604 - DNA, 465 bp, Chlorella protothecoides
atgtccggcgagacgggggcggggcgtgcgctccagccccagcccgtcctcatgccctcacccttcttcgtccccggctcgctcccctcgcacgcggcaggagggcccggcgcgcgcctcgcccgccacatgtccaacgtggaggccagcctggcgggggccgacgcggcctcggccctgaccctgggcacctccatgcccatctccatccccatgatgccgcggccggccaagcccgctgcgcgcggcgagggcccgcgattcgtccccccccacctcctggccgacggcgaggggctgggccccgagaccgacgtcgcggagctgctgggcagcagccggctgagccccaccacctccttccgccgcgacaagctcactacgcgcaacgccatcatgcgcgccaccggcttcctcgaagtgccaggtgggggggcatggcgcgggcgcggggccggagggtag

SEQ ID NO: 2605 - DNA, 492 bp, Chlorella protothecoides
atgcgtcgatcgaccaaggggtcccgtcggctcgtagaggctcgctacattccccaccgaggccaccaccaggccctctttgggcaatcagaaggtgctggagctcgcgccgtctctccccgcgcctgcaccactgacggagcagggcctgccacctcactccccacaggtgattccacaaatttagacgtcatggcgaccaagcgtaagggaggagtgggtggcaacaagttccgcctcaccctgggtctccccgtggctgcgaccatgaactgcgcggacaacagcggaggcaagaacctgtacgtcatttccgtgcacggctggggagcacgcctgaacaggctgcccgctgccgcgcccggcgacatgatcatggccacctgcaagaagggaaagcccgacctccgcaagaagggtgagagtgcgcgagggaggccctggctgccgtgggtactgtggagggcagatgtgggtggagattggcgctga

SEQ ID NO: 2606 - DNA, 2364 bp, Chlorella protothecoides
  modified_base (415)..(424): a, c, t, g, unknown or other
  modified_base (873)..(882): a, c, t, g, unknown or other
  modified_base (2232)..(2241): a, c, t, g, unknown or other
atgccatgctggacatcgcgggggtgccccccgagaagttcaggtgagcggggcgggggtgtgctcccttgtccagggagcgggtgggagcctgccggaggtgctttgggccccagggggatcctctacgcttcaccgggcaaaaagcgcgtccctgctgggctcctctcagagcagtcctgcctgctgacccctttccatgttgtcctgccacctcccaggcccatctgctctgccatcgacaagctggacaaggagccatgggactttgtgcggcgggagatggtggtggacaagggcctggaggagggcgtggccgatgccatcaggccctttgtcgagctgaggggccagccccaggcactgctcgccaagctgctggacaagggtacatggattcagggtgggatgtgcnnnnnnnnnnggagcgggtgggagcctgccggaggttgccagggtggcggcgctggtagagagccccaccaagcggctcccacgattctccaacacccaaaccaacccccaggccacgcgtttgccggccacgcgggcgcccgcgccgcgctggaggagctgcgcacgctgtttgggtacctggagggcatgggcgcgctcgccaacatcgtcttcgacctgtccctggcgcggggcctggactactacaccggcgtcatctacgaggcggtgctgaagggggcttcagtcggcagcgtggcggcggggggcaggtgggtgcacgtgtgtgtgtgtgaaaggggggtaatccggtcttgcaagcgagtggatgtggtggcgagggagggcagctccgcgacctgcggcactgcatgctgtgcacttgtaccacctgttggggaggctacaaaccagttnnnnnnnnnnagcgtggcggcggggggcaggtgggtgcacacgtgtgtgtgtgtaagaggggtaaatctggtcttgcaagcgagtggatgtgcaggcgagggagggcagctccgcaatctgcggtgcgcaccggccggccgtttgccttggcgcagacttggtgaccaaaccaccctacatccccggctgggaccgaggagtctgctgcaaccacctccacctcaccatcgcaggtttgacacgctggtcggcatgttcagcggcaaggacgtgcccgcggtgggcgtctccatcggcatcgagcgcatctacaacatcatggaggagcaggcacgagcgcaagccaaggaggtgagcaggcggcccacagggcagggtgtgcgggtgcacactttgtgtgcagcggagcttggagggcctgaggcagagtctgtggtgcagacactgcatactgttgcacttgtaccacccgttgggggaggctacaaaccggtgggtatcaggaggatgcatccctgcccaactgtggctgctccttcccaccaaggagacagggacaccagcgcatgcccatcacccactctcaaaccctcctcggattgcgcaggaggggtgcagcatacgagagaccgagacggaggtgctggtggcctccattggcaatggctaccagggacggagaatgagcatcgcctcacggttgtgggcccggggcatcaaggtgtgccgggggcccaggattgtggcgagtctggggatgcgatttgccattggttccgggaaggcgccatgcatctgcatgcctgcaatgtgaagttcacgagcctgctgtctgagtgggcgcgatcagaccaacctgccgactgcgtgggcgcgatcagaccaatcatccccatccctgctcccatcaaggctgagttcggcttcaaggccaaccccaagatgagcgactcgttagccatcagggcgcctcatcccgatgccctcccctgcccgaacgcatccccttccggatccgtcttccccgcagggagttttcaagatcaaaaacctggtggcccagacggaggtgacggtgtcctcgcaaggattggaggaggaggtgctgaagagcttggcggcattgccaaagcgacgggccatcttcacgtacaactccgtcaacaaggcgaccgcggacgtggagagcaagctgaaggtgaatgcctgatcaatgccacgaggttgccgttcagattcgtctcacggaccactccaacgacccggcaaggaattgcttccgtacgaaggaggcacagggatgcggatgagatggcgaatgtggatgagttaggatcgactccagcacagcaggttgannnnnnnnnnacgacccggcaaggaattgcttccgtacgatggatgcacagggatgcgaatgagatggcgaatgtggatgagataggatcgactccagcacagcaggttgcattggatcaatggccgtgctga

SEQ ID NO: 2607 - DNA, 807 bp, Chlorella protothecoides
  modified_base (173)..(182): a, c, t, g, unknown or other
atgttcgacagggagaccttgactggaaagtatggagaggactccaagctgatctatgatctggctgatcaggggggtgaactgctgtccctcaggtgcagacccgctcttatgaacatgttggatgctgcttgcagactcatgctatcgacgcaacccccagggcagacgtnnnnnnnnnnctgtccctcagggcagacgagggcagaactcgcatcctgttcatcccggggacgccacacactggagctacatggtgctcacccacctccatcacaacatcatcacgtacaataccccaggtacgacctcaccgtgccctttgcgcgctacgtggcgctgaacggcatcaccaacatcaagcgctaccacattgccaaggtgggccggcgctgcctgctgggctctgaatgggcaatgtgcaagtcagctccatctggggcgggtgccggaggctctttgggcacctgcgtcaccgccgcccacctgcacatagcgcaggtctaccgccgcgacaaccccgccatgaaccggggtcgcttcagggagttcaaccagtgtgacttcgacatcgccggcgtctacccctccatggtgccggacgcggaggtgctcaaggtgagtcaggcattatgtgatgggggggttgggtttgggcgggacaggcctggcgcctcctgcagggcacagccgcactggaccacgcgctccagcctgaacgccttggctggaccgactccgccactcaccgtcgtggccgcctttccttccccgtcgaccccaggtgctgacagagatcctggatga

SEQ ID NO: 2608 - DNA, 258 bp, Chlorella protothecoides
atggcccccaaagccagagtggccaagccaaagattcccaagggcacccgagatttcaagcctgaccaaatgacgataaagcaggaagctttcgaaaagatcaccgccgtgttcaagcgccacggcgctgtgtccatcgacacccccgttttcgagctcaggtgctcggcatgcagcggcgtcgcgcgagagcgtcatgcaggggtgcaggccttctcgtttgcaggggaggtgaagatcatgcagcgcggacagtag

SEQ ID NO: 2609 - DNA, 852 bp, Chlorella protothecoides
  modified_base (176)..(185): a, c, t, g, unknown or other
  modified_base (400)..(409): a, c, t, g, unknown or other
atggatcatccacttgagtcattctgcaacgataaatggtgcaccggcaccacgaatgcgtgtattttccactcaaatacgtttgtttccgtctctcagaccctgccccggtgttttcaccgactcagaataggtgcagcttggccgccgggcacccgtgcacggacctccttgtnnnnnnnnnngtttccgtctctcagaccctgccccggtgtggtcaccgactcagaacagctgcagcttggccgccgggcacccgagcacggacctccttgcggcttgcatctagtcccgggaggcgcgaaatcccatacatctgcctccaacccacaagggacccccatgcctccggatgagcacaccaggaagatcatcggggccatggggggaacgctgctgnnnnnnnnnntcttcctcctggcgtacatcttgggcctcttcctcaccttcctctacctgttctggaagagggctctcatcacctggatttgcatcctcatccaactaggtcatgtggatgctgttggtgtgggagaaactgtagatctgctgctggaggatatatcagagggcatggacatgcgctggctctgggtcaagtttctggttcgaatcactttcttgccaacactcctgcgcgctgcatcgattggttacaagacttccccatgcagggtcgggagtggtggtcctcctgggcaaggtatacctggaggtgctgtcctccagcgcacggaaggccagaagggaagcccgggagcagcggagcctggcaaggcaggcgcaggctggcataccagggtcccaggtcttccttgtggagctgagcacttcacatgcggaatagggtag

SEQ ID NO: 2610 - DNA, 1638 bp, Chlorella protothecoides
  modified_base (544)..(553): a, c, t, g, unknown or other
  modified_base (1354)..(1363): a, c, t, g, unknown or other
  modified_base (1457)..(1467): a, c, t, g, unknown or other
  modified_base (1588)..(1597): a, c, t, g, unknown or other
atgaagccggagcgccgcggcggcccgctctggacactgttcgccgcgctcagctccacgcgccacgcgcgcctgcatttcgactgccgcggctactccaccgccttccgcgtgcggggcgacgccgccgcgctggcagagattgcggggtcgctgccggggtcactggcctgtgcccggaacctgggcgcactggacgtctaccccgccaccagcggcaaggtcagcgccgcgcgccacctggcggcgcgctggggcgccgacctctcccgcgccctcttcctctgcgacgacgataatgacctggagctggcagcggcggtgggccgcgccttcctcccctccatcacctcggagagcatgggcagcgcggcacgcaccggcggcgacgccttctacgtggcccgcatgccggtgccctggagcacggaggaggtgctggaggcggtggaggccgagctggcgcaggcagatgatcatgggtcgtcctccatgggagccgagccggggccagtggaggcagggtcggggccggtggaggcannnnnnnnnnaccggcagatgatcatgggccatcgtccatgggagccgagccggtgccggtggaggcagggtcggggctggtggaggcagggtcggggccggtggaggcaggatcggggccggcgggcgcggaggccgagccacaaggcgcgggtgtctagacacatggtcgcaggcaggagcccctcttgtgtagtacagcggcagacgggcgggcccctgcagtcccggtgcatgtccctccgcctggcagtcggcgtggggccgcccagggatgcagcgccactcttcctgaaaacgattcccctttgttattctcattcttcttatgacactgtaacattggagcatggaatttgctccgtcaagatttgcaacgtcccgagcaagcagcatgccccaccgcatgccagtggatcatgccgctgcgacggcatctgccgcgacggtcgccttcatgttgtgatagtgctgcctcaccacagcctcgtcaaagggcaagcccatctccgccgtgaacctggcgggagggacgatcaagggggtgggcctgggaaggggggatggttgagtccaaggggctcgtccgccccaaagccggccacccaggagaatggggtggcgccgcatccatggcctgacttgtggatcgcccggcaacctcctgcaataccctcttccaaaccgtcatcacccagcgcaaggcaagacccactttctgcagtgctccaggtaatcctcctcgctcatcagctgtgccgactgcacagccttaggcttctcggctgcaaccagggggaggggccagggnnnnnnnnnntgcatccatggcctgacatgttgatcgcccggcaacctcctgcaatagcctcttccaaaccgacatcacccagcgcaaggcaagacccactttnnnnnnnnnnngcccagaacggtctcgccaatgcgagggacccaggggctgctgtgccagctcctgtgcttgccctcattcaacaagcagtggatctccttgcccacacactgccgatcatgccccaccccnnnnnnnnnntggaaggatggtgtggagtgtctgggcgtatgcacgcctga

SEQ ID NO: 2611 - DNA, 498 bp, Chlorella protothecoides
atgcccgaccagacgactatcaatgtcattggggcggtgggcggtgtcgttctgtctgcctgccttcttccccagctgtaccggctgtatcgcaccaggagtgcccgtgacctggcctacccctacctcttcgcctactgcatcggcctcttcctcacgttcctgtacctcttctgggagggcgccatagtagcctggatctgtgagctggtggagctgggtggagccctgctggtgctgagcgccaagtactacctggacttttatggtccctactccaagcgggccaaggagagggaggagggcgagaccggcgacgcgacctctgacggcggcaatcccaggtccctccccggccccgcccggctgtccttgacgtcctgcaatggcgacttggagaggggagcctccccccgtgccccgaccgatgtcgacgggctgggactgggcggcgtgacacacaagcgcgacattggtttgacaaagcacgagacgtga

SEQ ID NO: 2612 - DNA, 471 bp, Chlorella protothecoides
atgctggcatcgacctctactagcaggggggggaccatgcggtccttccagcccttcgtggcgtccagcccagccgtgcctcgccctcgggcgttcggccactgcctcccccaaccgcggccccgcagtctggtgtccagggccctggacttcgagcagctcaccctggaggatctgactcaggaggatcccccactcgcgcccccgcccccgccagccccccgttcggggcggaagatgtcccgtcgattcgctgctgagacggccaaggtcccgggcaagcacgtggccctcaaacccagcgaggccctggagctggtgaaggccaccgcctccaccaagttcagggagacggtggagctgcacgcgcggctgaacatcgaccccaagtacaccaaccagcagctgcgtgccacggtctccctccccaagggcacaggtgaggggctgggagccttttggggggggtga

SEQ ID NO: 2613 - DNA, 705 bp, Chlorella protothecoides
atgctgccgcatggagtccaaggaagagcggctgacctcgcagtgctgggtgcatgggcggacagcgcctggctgcttcagccggcttccagtatagggtctcaatgcggttgcagccctcgcacctccgctactagccacgcagccacgaccccaacacatccctccccccatcgactcccgccccctctgccccgccgcccaggcaaggagctgcgggtggccgtcatctgccagggcgacaacgagaaggtggcccgggaggcgggggccgaccacgtcggctccgccgacctgatcgccgagatcgcggggggcatgatggactttgacaagctggtggccacccccgacatgatgccgcgcctggccaagctggggcgccagctgggcccgcggggcctcatgcccaatcccaaggcgggcacggtggtcaccgacgtggcgacggcggtccgcgagttcaagggcggcaaggtggagtaccgcgcggacaaggccggcaacgtgcacgtcggcatcggcaaggccgacttcgacccggcggcgctgctggagaacctcaaggcggtgcaggagtccatcgacgccaaccgcccgccaggggccaagggcatctactggaagacgctcactctctgctccagcatggggcccgccgtgcgcgtcaaccacgccgcgctgcgggagatcaagctgcagtga

SEQ ID NO: 2614 - DNA, 1107 bp, Chlorella protothecoides
atgctcctcagcgggtcaccattggggttccctggaaactcgcatcacgtccccaaaccatggccatgtgtgatcaacacttggcgcatcatactctcagaaggcgcgctcgattacatgtccaatgcaatgccagcgcctgtccacgcccacatcgatgcgcacccgggggcttggcaggcgcagggctggccgctgctgcctgggcctggatgcgcacgcatggcccagcgccgagcacaggacggatgtggcatggctttggtttgcttgcaatcaagtgtgggagggcggggcagcctcgatgtccaaggccgggaaccctggtgggtgcgaaaccgtgccgagcagcggcacactgcaaggggggacgctgtagacaaagcatggtgtgctttgaatcgggtcgttcggctcacgccggatgagaaaaagtgcgctccgagtttcggcgcgtgggtctctgttgtcaagcatcacgtcacgggccacagccgtagcggtgggatcccagggtcgcccgagtctagctgtgaaaatcagagtcctgctgggatcgagcatgtcgcgtgtgttgccaccctgacctctttgaaccggccaagcgggttggaggtgagatcgagtgggtatggactaggctgtcagccccgggtcgctccacggatcgaggtcggtggcagcgtcttgagccacggatccatcccttgtaccattctcgcagataattcaacacctccgacattactcggagccagtcttccaggtgggcacctgggaagtgtgggagcgtcccctgatcaatcccagtgcgtgtgtgtcacccggccccgctcacgagctccatcactctacccacctcctcagcgctacatcgtgcgcatcatcttcctggtccctgtctacgccatggcctcctggccttccctaatagcccctggcagcgccgtttacctggcagccgctcgtgactggtgcgcagaagggtgccagggtgggaccctcctaccccacctgcagcatgtacagggagtgtatggtgctcgtgggaaagttgttcctggtgagaggatcccatattctcccacccctcccttctttccgtga

SEQ ID NO: 2615 - DNA, 1818 bp, Chlorella protothecoides
  modified_base (1696)..(1705): a, c, t, g, unknown or other
atgcatcaccatccctgcttccccccctttcacagccaagaaggcgaagcaggcggacctgaagaagctggccatctgcgtcggcctgggcgccgccatctgggccatccccgcccccgccggcgtgggcttgccggcctggcgcctgctgggcatcttcctgggcaccattgccgggatcatcacgcagcccctccccctcggcgcggtggccatgatgggcctgggcgccgcccagctcacgggcatcctcaccttccaggccgccttcagcgcctttgccaacgagatcccctggctcatcgccatcgccttctggctgtcgggcggcttcatccgctccggcctgggcgcgcgcatcgcctactccatcgtgtcggtgttcggcaagaccacgctgggcctgacttactcactgaccctggccgaggccctgctggcgccggccatcccctccgtggcggctcgcgccgggggtctcttcctgcccctggccaaggcgctgtgcctggcatgcgtatggtccatcagcatgggatcccaaccatctcactccccactccccacccttttaccccaaacttacaggcgccatgttcatcacggccatggcggccaaccctctcgccgtcaacctggcggcggagacgttgggatacaccatctcctggggtgagctggggagaagggctgcgttgtgctgggatggaaggaggagcagggcggcgggctctcgagaaccatcacatgtcctgccatgaagcgccggctctggacagttcccaaagccgcgccggccctgcgggccccgctggagctgcatgggagcactggtactccatgcaccttgaatctcacctcccccctcacccttgcccacccatgcacgtcctcgcaggaacctgggcgctatcggccctcgcccctggcctcgtgtgtctgctgctcacccccgccctcatgtacgttctgtaccctccccaggtcaaggacacgcctgacgcccccgccaaggtgtgcagggaaggctcatggggtggggggcacaccagactacggcttgattctcaaacggggcaggctcatggggtgggggccacaccagacaacggcttgattctcaaacaggttcctttgaatgagtttctgggaccctgtggcaggagcgctgaagttcgctcatgcttccagtctcctccagccacaagacttcttacgcaagccctggacctgccctggaacccagcacacacccttcacgtccccttctcaaccctccaacccccttttccacacacacacacacatgctcaggccaaggaggagctcaagcgcctgggcccaatgagccgcgacgagaagatcacggcctttgcgctgggcctgacggtgtgcctgtggattggcgggcagtccctggggatcaacgccgtggcggccgccctcgccggcctctccatcctgctcgtcaccagtgagtcttgttttgtgggaggggaaacagctgctggcagcgaggatgccgggatccactcttggtttccccatcacccatgcgcatgctggttatatcaacaaacgcaggcggggaggccgccccctgacactccgcacacctgcttgtactcaagagtgctcctcccatgcacccgcccatccccatccccctcaagatgtggtgacctgggagcagtgnnnnnnnnnngtatcaacaaacgcaggcggggaggccgccctctgacactccgcacacctgctcgtactcaagagtgcccctcccatgcaccacccatccccacctccctcaagatgtggtga

SEQ ID NO: 2616 - DNA, 912 bp, Chlorella protothecoides
atgccgccccttcttccctccaaacagctgaacccctacgtgacggagctggcgctgtacgatattgcgggcacgcccggcgtggcggccgacatctcgcacatcaactccaagggtcgcgtgaaggggtacgcaggcgaggaccagctgggcgaggcgctgaagggcgcggacgtgatcgtcatccccgccggcgtgccgcgcaagcccggcatgacccgcgacgacctgttcaagatcaacgccggcatcgtccgcgccctggtggaggcggcggcgcgccacgcccccggcgccatcctgaacatcatctccaaccccgtcaactccaccgtccccatcgctgcggaggtgctgaaggccgcgggcgtgtacgacaagcgcaaggtgctgggcgtgaccacgctggacgtggtccgcgccaagaccttctacgccgagaaggcgggcgtcgacgtgggcaaggtggacgtgcccgtggtgggcgggcacgcgggcatcaccatcctccccctcttctcccagactgtgcccacgcccaacgtggatctgtcccccgccgacatcgacgcgctgaccaagcgcacgcaggagggcggcaccgaggtggtccaggccaaggcggggaagggctccgcgacgctgtccatggcttacgctggcgcgctcatggccgatgcatgcctgcgcggccttaacggcgactccgatgtcgtggagtgtgcgtatgtggagtccactgtcaccgacctgcccttctttgcgtccaaggtccgcctgggccgcgccggcgtggaggaggtttatggtctgggggagctcaacgactatgagcgcgcggggctgaagtccctggtgccggagctccaggcctccatcgacaagggcgtgaagttcgtgcaggaggcgtga

SEQ ID NO: 2617 - DNA, 621 bp, Chlorella protothecoides
atggtacaggccggccagcatgccgacgagctccaggagctcatagagttcctcagcgacaagcgcgcaccggtcgactcgaggattcctgtcctgcccccggcctgcaccaagtccctcactggcctctcccaggttcggacgcatgccgcggagctggtggagggcctgacgggctccccggaaggcatgtccacgctttccaatcgtgcggacaccctactgccaccccttttgcgcctcatcgccgacaccacggaagcctcccggcccgccctgacggccctcgtgaacctggcccaggagcccggcgtgcagtcggcgctgctggcgctccacgccccggctcgggccatggactacctccgtgagaacgcgtgcgcccacccgggcctgctcatctccctgctggccaacctgactgccagcgaggatgggagcgaggccctgctccagctcggccagagcagcgtggagggcctgcacaccgccacgctcctcaagctgttcctgcagcctgtgagtggttgttatggagatggggttgtggagagggaagcgggaatgacgttattgtgcgatgatcttgtgtggtgtggctgccagcgcatttgcccctaa

SEQ ID NO: 2618 - DNA, 675 bp, Chlorella protothecoides
atgctcgcgcaggtggtcggctctgaggacacctacgagcacgtggcaaccatcctgcccaacgtcactcgcctggcagccgggcgacagctgctgctgcagccggggcggggcctgctcaccgccctcagcagccagctgcggtccaagagcgaactgcggcgccgcggttccgcgcgcgccatcaagaactgcttcttcgcggccgaggaggacggcacgctcgaggacatcctggcagaggaggcggccctcaccaccatgctggacgtgatctcgggcggcgaagcggagggcgaggcggacggcgaggcgcgcgaggcgctgagcgaggccctgctctgcctggtgcgcgttccgaccgcgcgcaaggtgctctggcggctggacgcgcccaagctcatcggcaagggctacgaactggaagaacaccgcggagtctgcgcggccatggaggccattgctgagttcttcctggaggacgggttcggagaggaggggggcaaggagggccccgtcgaggacggccctgccggctttgtcatgccggagccggggttcctgccccccggcgtggcgcaggggctgtccccttccgcccggcggcacagctccggggagaccagcctgccttccaacccccaccgccttgcccacattgaggagatcgagtga

SEQ ID NO: 2619 - DNA, 636 bp, Chlorella protothecoides
atgagcgacgtgagcacggtgaagcaccacctgctgcagcacctgcctgtgtaccaggtctcccccgccgacttctccggcgacgcggagctggtgaaccaggtgtacctggacaacagctcgcttgagctgtaccactgccgcctggacaagcggcccaacgccatggcgctgcgcctgcgctggcagggcggcgcggggccgacgctggtgcacgtcgaccgcaagacgcacaaggagagctggcagggggaggagagcgaggcggccagcatcgtgctgccggaggaacgcgtggtcggcttcctggagggcgagtactccgtggaggaggcggcggcggagtgggcggcgcgccaggccccgccgccgggcgaggccgcggtggaggccttccgcgccgtcttcaccgacgtgcagcgggtggtggacgccaagcagctgaagcccacgatgcgcacccagtacatgcgcacccgcttccaggcgagctcgtgggggggggcgggcccgaaccgagctgggtggatggctcgggtgcccgagggtgggagcgtcacgatgcccgagggcgcgccgcgatgcccgagggcgcgccacgtgtcgagccaggcgtccgcgccaggcgccctctga

SEQ ID NO: 2620 - DNA, 417 bp, Chlorella protothecoides
atgaaggtttggtatatggattttctccggcatgccgtcaccgagcgtgtcctcaggcacaggttcggcaaatacctgctggagaagtcccgggcggagtgggctggtgagtacgtggactacaaggccttgaaggacctcatcaagatcagcgccgcggactatgagtcgaacaccctgcccagcttctcccctcgcaccacctcgctcactgtccagcgggtccagaaccggcgcgactctgcggaggaggacttcttcaagtgcctggacagcgaggtggagaaggtgggccgcttcaccgcccagctggtggccaagctgcgggagaggctggagcatgtgaggctcgcggccgccgatgtcaagccggaggacgccgaagcgttgctggaggtgaggggcctggcatggtag

SEQ ID NO: 2621 - DNA, 831 bp, Chlorella protothecoides
atgctgtacgagcagggctacagaccctgctgctccatgcccccaccctcccccatgccactgcagggtactggcgctgtggacctcgcacatggcggccctgctggcggtgcgcctgaccgagggcttccgcgggctcgactccggggcccaccgcggcccagttcgctgggagatctgctacaacatgaccctcctgcgcatgctctcctactcactggacctgcactggaggaggagcagggctgcagtcctggctgcttccgagaaggtactgtggggatatctccagggattgccttcatgtgcaagtcactgacatttacagagcgactaccgcccttgaggtctgacccccacaccgcacagggctccactctcttaacctccacccctttgcccactcaggccgctcccgaggtttccccccggacagccaggcagcgcgccgcaacctccctgcccagcgctaaagactacggactctggccctacctgacataccttttctacccgccactctacctagccggcccaataatcacctaccaggactttggctggcagcgcaggcgcacagcaacgagtgtgcctccgcttcaggtgggcacaggaaagcgtagagcaccatccaatatctgcggcactgtatgcgctgcgttttgccggcgacctgctgtgtctggagctgctgacacacctgctctacttcaactcgctggccaagcatcgcgtcggcgccaggctggggcctcatggactgacgcacggcgccttcccggtggcgctgacggggtggtgggtcctcaccttcatgtggctgaagtttga

SEQ ID NO: 2622 - DNA, 3954 bp, Chlorella protothecoides
atgcaacataggggactgctgcgcccccgcaccgccaggtcggcgtccacactcctgcctttgaagctgtctcgcgctccagcccccggggtccccaaccaacaccacacaccgttcaatccctccaggcaagaaggacggcggcggctccgcggtgaacgtgcgcaccaatttcgacgactacgggctcccccagccggtgggcctcctgcgcgcggacctgcaccgcctgcccctccgccctggcctggaggaggtgctggacgcgatcgtgtgcgacccgccctacggcgtgcgggcggggggcaggaagacggcggcgcgggactacacgccccgcaaccgcgacacccacatccccgccaccgatccctaccagctgggggagtgcttgagggacttgctggacgccgccgcccgcctcctcaggatcggtgcgtggacagaggccgcgggctgcctggaggagtctgcggccgcctggtctacttcctgcctgccatcccgggctactacagccccgaggaggtgccggcccaccctgccttgactctggtggcaaactgcgagcaggtcctcagcacacggtacagcaggcgcctgatcaccatggagaagactgcgggctacgacacatcggcggctgaggcctaccacaccgcatctggtcctcccagggcctgccttgcatacgcacggcgccgcagtttgccaacacctgtttccttttgcccgccgagcagcatggcggtggacaagctgcatgagcacgtaaggcttgcgcaagaggacaacatcacggctggtcctggccacacatgcagtacttttacgttcccctgctgctcaaggcctcggctctggaacccggtcagcgaggcaagaccgcggggtccgcttcccctgacacgacagggacgcgtcccagaatcagctgcccggcaattgtattcaaggatctcaggttgggaggcactggaacagggtgcttgtagagttgccaaggtccaagccctaggtcatgtcgagggttacgctgcggcgaccccttcccccttcgcggaacaccctctccgacaccatgcgcttccagatcgcgcggcctttgcgatccgccatggtagaaggaattcagaaagggacggtcctgacctcataccgtcacttgacggctgctaccgacagcctgcagggcattctggagaggaacagaggctgtcttttccagtgcacatgactatgtccaaagggtattcaaagcttatatgcactcccgtcggcaggaaatggtctgaggagcagaagaaggctgagccaaccttcttcagcaagcttgccaacatccagaccccacaatggctgtggattggttgctccgacagccgcgtgccaccgctggggcggggacatgtttggagccaccctcgcctgcccagtggctgcacccccatgccaccaaccgcggccctccgctcgggacccaccacaccccaccaggccaaccagctgatgggcctgggtcctggcgaggttttcgtgcagcgcaatgtgggcaacctggtcacccacaaggacatgaatgccatgtcctgtctggagtacgcggtgacggccctgaaggtcaagcacatcatcgtgtgcgggcaccacaactgcggcgcggtcaagggcgccctcaccatgcccaaccgccagcagggtaccggatcgaggactgtttgtttaggacctcggggaacagaccagatcacccctgggattgtggggccccaaccagaggggatgagtcgcagttcattgccgccatgggctgcccctggcctcattcacgccaccaggcagctctgcttcagcactaccaccatgagtgttgccccctccacactcaccgatgtcctcctgcgactcacctgcccaggactggtcaatttgtggatccaggacattcgcgacacccgtgaccggcacgcgctcatcctgaaacagttcaagggagacgagcaggtgccagggggagcgggtggacacaaaggggtcaacaagctggccgagctgaatgttctgcgacaggtgagagggaacgcctggtgttccttctgtggcccaggcttggatgaagaagcccagtggctcgcagactttgctgccaacccatggaccctgcaagcagcccagccatgcttctttcagcctaccctgagaagcggagccctccaacctgcacaggtgttcaacatctgctccagtcccattgtccaagcggcctgggaagatgggcagcacctatcagtgcatggagtcatctatgcgctgaacgacggcctgctccaggtgaagggggcgcccgggagtatgggcaagagggccaatgtccggggtggtgcagggccctctggaaagtggaggcatgtgtgcaccagaatgcgcacagcatccaaatcatggcgtccatcgaccattccaacttcggctcgggtggcacctggaggagtattcacgcaccaagctcggcgatctgcagagcctgagctcaaccctgctggaacacctgaacttcaagccggaacaggaagcgtgcgtcgggtggggggtgggggggcggggaggtgcgccatgcccagaagcttgtcaggagcaagagcccgcatggtatcgatggcttcttcagaccggacccataccccctgcattgatgagttgtcagaccatgtacttgcagggctctgcgggagaaccttgagagggcgtcagggggcttcaccgggcaatgacgcccctcggcagtcgatggatgatattacatcttgtcagatgcgaccacctttggccgcagtcatatcacacacctcctgtattgtacgccttgcgagtcgtcataacgttagccattcatggcacagctttgaggagggaggaagggtgtacacatccagtatgtccacaagggaggatgcggtcacagatcttgaatgccacacgccgggacagccttctcccagttctggccatccacctttctcaccacaagcgtctggatggagccagggtcgatgcaggctatcgtcactggacacatcgctgtcacacccaggacccacctgcatagtggaaggggttgctgcgcggccggtagaagggggttactccacaccgcttgcagaacagtcagcctcagggatgatggcatgcacgtttctcttcatggcacagatggagcctagggttggggaggagactggttgggtctgggatgttcgtgatgattcagcagagccccttccctcatcagaggagccctctacctggggctcacaattgcagtcccagccaatgagttcgccgaaaccacggcggacgcatgtgcttctacctgacatctccacagtggcagcttcccgtgtggaggaccgtcggttccgccatggcgttgaaaggtgccctatgggcttgacactcactcatggacgcacttcgccgggccaatacctcagggcgtgtcctacctccctcccacccaccgtctcggaaagcgaaggcgcgctcagggaaccatacgaccccgcaccaaaacccaccttgcgtcgcacatccctggaagagctgccggagatttggttggcccgacaactgagtagggcacggggaagttgggtccccgacacggcactagcgcgtgtcgttcaccgtggagcacggcccactccccctcagaagaataacttatcggttgcagctcgccgacgagctccctgccatggacggactgggcgtgctggagcgcgccctcgcacccccggaggtctggctggcctccctcggcagccagtggagctccctgccctcctttatactcttcttcggagtcctgtttgcattcgcgctggtcgcatggaaatttggggccagcctgtcatgggatcaagcggccctgcttggctcctgtacaatgagtag

SEQ ID NO: 2623 - DNA, 402 bp, Chlorella protothecoides
atgcatgctctttcagcattcgccctgcacacggcccccggggcacgcaggaccggctatcggaagaggtatccaccatgcctcacatccatgcaaacaggagaactcaagcccttcaccctccgcatctacactaagcccagctgcccgttgtgctcttcattggagaagaagcttctcggcatctttgacagatctgccttccttgccagccctattagtgctggcagtcttgaagcagtagacatcaccagcaggcctggtttgcaggagagactggagctccaggtcccggtgctgacctaccgtgcagcagagggagaggaagccgaagaggtgagagctgagcgtcgtctgttgaaattggattacgaccagggagcgacagggcctggtcactga

SEQ ID NO: 2624 - DNA, 417 bp, Chlorella protothecoides
atgattggagtgtcagtgcggcctcaggtgtgctcttgcccaatcccctcccacagggcacaaggaaagatatgctgggacagaggctgtggtctttctagacagtcaaatggcactgctttccccgcccgccattgtcgttgtcacagcatcgcaaggtcccccccgctgctgagccatgcttctctgtctcagtgcaggtctcaggtggacaaggtgatccagacaattgccagcaccacgtacactggggagatcggggacggcaagatttttgtgcaccctgtggccgatgtgatccgagtgacttgtgtttcttgtgggagttcctcctatgctccaccccacaggaggacgggggagacgggggcaatcgcagagcggatggaggggggcatgtcggacaggacttcgtga

SEQ ID NO: 2625 - DNA, 900 bp, Chlorella protothecoides
atgtttggagtagcctcgggacgtcggcattgccagctgctgcatcccgaccgcctccggccgcaggcttcacgcggtcccaagcgctcggcgaccgcctttgccgtactggcaggaatgttcgttatgttctctccagcccacctcgcacaggccacctgcgacccaagcatcaaattcgttggtttgcccactgcggaacgtgtctgctcgtggtcgtggtcccagcaatcgaacccatgcgtccatgcccacccacaggttgcacaacaagactctattgatcagcgcatccagtccagatgcctactgccggtaagcgtttgcgagactccaagggtaacacgaggcatgttgcacacggtatcgatagtttgcctatgtggtgccctccctgtgggcaatcacaccgaggctctgtaccctagcaatcaagccatggtttctgcgtgtcccttgcatcgcagggcgaggggctttgcagcagctggagcctctgcaaatctcaccgtgacgccgacccaacccttcgaatggtattcgatctccaccatcaacccagaaacgctggagttctgcgtgccctcgaagtccgccttctgccaggctcttgccgcagttgaatgcctgcctgaaggcgtggatcagtgcacggcggacgctgatgggaacattggcagcgggaatgtggggagcaacaacctggggaacgacaacatcggtgactacaacaaaggaaacggcaaccatggcactggaaatactggaagctacaactggggactggacatcgtctgcaacaacatgcgtgccggtcaggagcgaatgtgcagtgtgtttgcgctgaggacgaatgatactattgtcctcgacgctgcttcagccgcccccctgccatga

SEQ ID NO: 2626 - DNA, 495 bp, Chlorella protothecoides
atggagcggccggccctgctgcacctggcgttccaggcgctggacgcctttgcggtccggcatgggcgtctgccagccccggggtcgagggaggacggcgacgccttgctggccgcagtgcacgagttggccgcctccgcgcccggcccccaggtggaggtggaggagcaggtggtccgctggctcgccagcaccgcctcgggccagctgaaccccatggcggccatgattgggggctttgtgggccaggaggtggtcaaagccgcctccggcaagttccatcccctgcaccagtggctctactttgacagcatcgagtccctgcccgccgaaatcccggaggccagtcagctggcgccgagggtgaggcggcgtgggtcgatgcggacgggcacacactcgaccgttccagccgcggagcgctgggagggcgagcgggtctgggcttctcgtgaaccgttcttctccgttcgccctgcagcagcccccatgtga

SEQ ID NO: 2627 - DNA, 585 bp, Chlorella protothecoides
atggcgattgccggtccagctgtcatcacacggctggatccaggggttgtgaatcgcatcgcggcaggcgagatcatccagaaaccctccagcgcccttaaggagctgctggagaacgccttggacgctggggccacctccatcacggtcatatccaaggacggtggatccaagatcctgcagatccaagacaatggacatggcatcaggcgttctcagatactgcttttccgacctcaccaccttggtcatatggtcccaccgcaggaggaggacatgcctatcctctgcgagcgtcacaccacctccaagctgcgccagtttgaggatttgcagacccttcaggcatggggagagagtgggttctcagcatgcagttcctgcaatgctggccagatggtgcagtctttcgtccatcgcgtgagccaggctgcaaccctctcatacctcccctctccgccacaccttcccttagacgcttggattccgaggggaggcgctggccagcatcagctttgtgtcccacgtgaccatcacgactcagccagccacggctacccacgccctgcgtgcaacctaccatga

SEQ ID NO: 2628 - DNA, 363 bp, Chlorella protothecoides
atgcagatgatggccgccaagcttggggtggccacggggcgccacctggcagagcacgcccgcgagaactaccccatcttcccgcgcatggtgctctgggtgctggtggagctaggcgtcatcgcctgcgacatgatcgaggtgatcggcggcgcggtggcgctcaacacgctgagcaatggcgcggtgccgctgtgggcgggggtgctcatcaccgcatgctccgcctttggcgtgctgctgctagaacgtgccggcatgcgcgtgctggaggcggtgctggtggccctcatcatgaccatgggcggcaccttcttttatatgttcttctccaccgacgtggactacgtggaggccctcaag

SEQ ID NO: 2629 - DNA, 1173 bp, Chlorella protothecoides
atgccccggtgcagcgttgcccaggccgccgaccaggagctggaagccgcggggaagccagccacgcgactgggggactgcggcgaccaactacgcaagtgcttcgccgtggccctgcaggcccccgggaaccagggcaagcggctggcggcgctggatgtggtcaatgtctcgatcaagacctacttcaagctgaacacgctgcgactgtgcaagaacctgacacgcacgctttgcgatggagctggggaggcatgcggcatggtaccatgcatcctgcggcgccagcgtgggctggcatttcggccctggatgctcccttgtgcagccactgtgtctgtattgcgcccggagcccactgacttcacccaatcgcacatgcaggtcgtgtcgcgtcagtttgcgccctttgagctcttccccgtgtctcagagggtgacctataagttttacgtcgggcgcctggctgttttcgacgagaactttgtgagtgggccggggaagtggatcggcgtgggaaatcgatggagacccctgccgcagccagaaccgttggcccggacatatcactcacacatccatcttgccgacgctagcccgccctccttcaccttcccctctcatcagcaagaggcacgggaaagcctggagtatgcactgcagcactgccaccgaggcgcggtcagaaacaaggctaagatcctgaagtatctcgtgccggtgaggctgcgctgtgccgccccggtgcagctgctgctgggcaggttcccttccgcagccctggtccagcagtaccagttgcagcagtaccagccgctcatgcaggccatgcggacaggggacatgcgcctgtttgacacgaccatggatgtgcaacagttcaccttcatccaggagggcacgtatctgctgctggaaaagttgcgcctggccgtcctgcgacgtctgctcaagcagatgcatgctttcatgattgcccctgaccatgatcacggccctcaacccctcgagcgagcaggtgcatgctgtgcatgctgtagcggagccgggaaaggcaacccagatccccttggactgggtcctggcggccctgaggtgtcagacagctgccgcaccgcagcaggtgcgcatgttgtgctccttgccgcagtcactggaggggtggggccatga

SEQ ID NO: 2630 - DNA, 873 bp, Chlorella protothecoides
atgactcacaggcgaatgctcccagcaggtctggtggaggtcctgaagaactacacctacgttggcatggccgaccccacctgtgtcctgctgcagcatgggaccaggctgtacgctgccaatgtgcctgtgctgctccaagacctcgcctatcagcaggcaagcatgctggggcgcagggatcttgggttggggctgctggcagtgctcttggttatgtggactcgtggttctggccatgacactaggctgctccatggtccaaggccatgtgaactgtgcgatctgtgcttcacaaccactggagcacacattcgacccgcacatcctcctgcagacgggtgcctggccagcctgccagctcttctggacacgagcatgcccagtccccttggcctcccatctttcatcctggccctggcttgcactgtggactggttccacgagcgaccctgcttccgagcagtcgccgaggtgggcccctggcctgagggatgcagggtgtgcggactgttgtgtcccttctgccgggcctgggctgcgagcagcctgggcacaggtctgcatgagctgttgccgagaggcaaccctgctttaaacctacttgtcaccgcgctcccttgctcctcaccacaggcgctggccgcgctgtttgggcaacacaccatgctggaggaggaaggaacccccgcccccacgcagaacctgcccacccagggctcgccattcgcgtcgcacgactggcagatgcagcaccagctcctgcccctcctgcgagctcgcctcgtgccagacaagctgcgggcgcgggacggcaccgtgcaggagctgacgcggctggaacagctgtatcgtgtgtttgagcgctgctga

SEQ ID NO: 2631 - DNA, 258 bp, Chlorella protothecoides
atgctgggatgcatcaggttgatggcgctggtggatggcctggatccacccgagaacatgccgcagttctttgccaacaactttgatgtggaggtcagaggggtcggcgggggaaagtacctgtacattcccctgggaggcgcacgggcgcggctcctgatcatctggccgatcttcatgtttgtggccgtctggcacgatctggaggtagggcgctgggagtcgggaatgcaggagcggaaaactctacactgttga

SEQ ID NO: 2632 - DNA, 303 bp, Chlorella protothecoides
atgcagcgtgcacgccgtctggtgctgcgtcgcggcctggccagagcttgcaaagctgcggcatgtgcagctggatgcggtcaacacgccatcccaggtggagaggcgcttgccaaaggacatggcattcactgcttgatgtccccgccgccttccctctccccgcctgtgcagtcgcagctggcgcagttctcccttgcctacatggtggctgacgtgctgttctacctggtcccattcacccccggggactttatgttcctcgtccaccactgtatctccggcttctacgtgctggggtga

SEQ ID NO: 2633 - DNA, 1347 bp, Chlorella protothecoides
atgtcgcatgctcaccggagtagccatcgtcctgctcccaagccgcgcgtcttcacaaagcccttgcatacatccaggtctgagtttgagggcctcctggagaagaccccagcagaggccaacgcattcttggccgaccccgagaagtacatcgccagcgtgcggtctgccagcgatgcggccgcccgcgagcagctggagcgagtgacggaggtgctcgtctcggagcactgcaccacctttgaggagtgcattgcctgggcaaggcgtaaattccagcaacaattccatgatcgcattgcccagctcatcttcaccttcccagaggacgccaagacatctacaggtgccctcttctggtcggcgcccaagaggtgggcagcagaccggttccccaagcccctggagttcagtgcgagcgacccggcgcacgcccagctggcccaggccgctgcgatcctgaaggcccaggtccacggcatccccatccccgcctgggcgacagacgtcggcagggtggcggccatcgcggcggcaacacccatcgagccctttgtggccaaggagggtgtcaagatcgagaccgatcccaaggcctcttccgtggcgcacgccatgggcagcgatgaggcggtgagcgggcctggcacaggaggaggggtcggggccgcgccggctggcgcgatgttgagggttttgtgtgtgctgcagccagcgtgcagggttgcacaccgacaacctgagcacgccaggcgcgcccttccgttccctccaccccctccctcccccaccgcccacgtgtgtatccaggcgatcgaggccaacatcgccaagctgcaggcctccatccggcccggcacggccctgcagcccatcgtgtttgagaaggacaacgacgccaacttccacatgcagttcatcgcgggggtggccaacatgcgtgcccgcaactacgacatccccgaggtggacaagctgcaggccaagctgatcgcggggcgcatcatccccgcaatcgccaccaccaccgccatggccacgggactggtgtgcctggagctgtacaaggtgttccggggcgcgccgctggaggcgtaccgcaacacctttgccaacctggcgctgcccctcttcgccgccgcggagcccatcccgcccaagcactgcgccttccgtgacatgcgctggagtctgtgggaccggtgggtgctggagggcgacctcaccgtgcagcaggtcctggactggttcagggagaaggggctggaggcgtacagcatctcctgcggccagtctctcctctacaacaacctcttccccaagcacaaggtgggatggctcgtgtga

SEQ ID NO: 2634 - DNA, 1140 bp, Chlorella protothecoides
atgccaggtcaatggatacctcctgtgagccgtatccctgttgaagcctgcgggcctcatgcctgggagctcaagtacggtgcgtgttgcaagcttggaagcacatctgaaaagtggggcaccaccactctcctcaacttcaactcgaggaagatctcaaacatgttgacgagccttaattccgctttcgcggggttgagcctgcggccaccggcccaggcacggagaccacagccctttctgagctcccgatccaaggagacgacggtcatgaagagcaggcacactttccaagtggagctagaacgggatgacccagaccccgatccgggcccgatgcagattgtcgtcggcagcgaggagccgcaggatatcgcactcaagcgattcaagcgggaagtcatgaacacgggactcgtgcaggaggtagggatgtctcgatggaagggggtttttggggattccatcaggtgcggcgcaggcgtcgcttcgagaacaaggtggaggccaagaagcggaagaacagggagaaccagctgcgggcaaagcggtgaggtgatggactgtgttgaagtgcacgcatcaggggtggcattgctgtgcttgctatcatgcatacccctgcacaaagtgcggcagtatggaagcagggcgcagaagcctatggctggccttcaaggcccctcagtcttcactgacctgttcggcagcctggacgacatcttcgctgacgactttgacaatggggcaacccagcagccgcggcagtacaacaacaactacaagggcaatggatcgggtggaagcgggaagccttacaatggtgccaccaaggctccaggaagcttcacgccgagccacacagtcaacaagcctgcttcagtctccactaagccacagttaactggactcggaggactgggcggcggtaaacctaaacttcctcctgcaacgtctactcatccaactaagccgccaaaagaggatgcatctttactggggagggcgcgtcaatcgcctagcttaaaccccttggcgagaagcttgcgaggcacaaacctgatcgccgctcgtaatactcctcgatccaggcacgactacatttcagtggaattcgcgttgacattcacccgtgcataa

SEQ ID NO: 2635 - DNA, 483 bp, Chlorella protothecoides
atggccggcaaggagcgattcgaggttgccgtcaaggggctgcccaaggatggggcgaagagctcattcgagggcaaactcggcgactgtgagttgagcgaggcccatcctgagaagaaggttcctgctgtaaaggacctgaactccaataaatggattgcagattcagcagccattgtggactacatcgaggatgagatccctgagccccctcttggaaagaccggcgacagcaagaacagccacaagccctacattcatggcaagtcggtaggacccaacgaccttgagctggctccaaaactccaccatgtccagctggtcaccaagcagttcaaggactgggatgtgtacactgccttccccgcgattggcgaatacgctggggccatgcagaatcgccagagctggaagaacacaaagtatgaggacggactggtgattcaggagtggggcgacaaagtgaagagcttcaagggctaa

SEQ ID NO: 2636 - DNA, 189 bp, Chlorella protothecoides
atgctgtgctcatcgcagcccttccccaccagcatcccaggcactcaccccaaaccccatgcacgcacgcacgcacgcaggtatgagaagctgcagcgctgggatgaagcgttgagggcctaccgcaagcgcctggagacgactaagccggggtcgccggagaacatcgaggcgctgctgggggagtgc

SEQ ID NO: 2637 - DNA, 600 bp, Chlorella protothecoides
atggcgcgggagctgtttgcggcgggctttgtctcctgctggtcggagctggaggagagcctgcaggaccagctggtgcggtcgctggaggcggccctggccagccccaccattccccccgacatcgtgaccacgctgctcaacctcgcagagttcatggagcacgatgagaaggcgctgcccctggacacgcgggagtccatgttcttttcatttatgggagtgaccgcgcggggtggcgccttggtgaatggtgctgtgctgctccgggaaggcttgacagacggctgtgagcggtcggtggcgtgcggtcgtcgagagcaatcaagccccggctcgaccgtgtcaaacgcccaccaccgccccccctccaccctcacccacaggacactgggcgccctggccgagaagtgccacgcctacgccaaggcgctgcactacaaggagctggagtacaacacctccccctccacggccatcgaggcgctcatcagcatcaataaccacctgcgccagccggacgcggcggtgggcattctcacagcggcgcagaagaccaaggaaatgaccctcaaggagtcctggtgggataccgtctaa

SEQ ID NO: 2638 - DNA, 240 bp, Chlorella protothecoides
atcaaaccggcgctggaggccatccgctcgctgggcacggtgctggagagcagcctgcagctgctgctgccagtgctggtccgcctcatcacgcccggcgcctcggccgcgcccctggccgtgcaggaggagacgttggtgaccatgcaggaggtcctgcccaagatgcagcttgcaggtgggtgggtgggtgccatattcattggggagaggtggccttgggggtggcgggaagcgtga

SEQ ID NO: 2639 - DNA, 711 bp, Chlorella protothecoides
atgacgcaggcgagcacccgatacctgagtgctcgtgcgatgcgcatggcctctgcgcggctgcggcgccctcggggtcacttgtgccccgccgttggaaggaagcccattcagtcgaacaccagccctcctcgccttcaaatctcaacagggtacagctcggccattctgcacccgctgacgcgactgctggactccagctccgaagagctgcgagagcgggcgctggacaccatctgcgccgtggccctggccgtcggccccgactttgcggtcttcgtccccgtcatcaagaaggtgcagggaggtttggggggggcctggagctcgacgccgctgcgcgtgggtgcccaggatgcgcagcggcaacccccagacgctctccagccccagggactgtaccagagcggccagcccaggcatgggcttgcgagcaggcatcagcacatgcatgctcgtcccctcacccccaaacaaccacccgcaggcggtggcgcggcaccggatgccgccccacgccgccttcctgcgcatcgccggcaagctgcagcagcaggacccgccctgcatgtcggatgcggaggactgggagcacagcagcggcttcctggccgaggagcacctggcgcggtacctgaacacgcccgggcggtacgcctacgaggccgcccccgtctcccagacctctgccgacgaggggctgtacggtga

SEQ ID NO: 2640 - DNA, 1359 bp, Chlorella protothecoides
atgccagtggcgactgtgccgtcaggcatgtggcagccgcagggtctgctgcagcacctcctcccccaccatgtctcacagcaatggcggagttggtgcatgcacggcatatctcgttgtctgtgcctctgcactattgtgtgcttcatcccatgcgtgctttcggagaatcctctgcaacaagtaccaccaaacactttcgatcacctcggccaaatgaaacgtaaagtggaggcggcaagtgatctggaagcccagatccctgatgccgccttatctcccaagaagggccctagatcaagcggaaagaaggctgatgtggctgagaccagggcagtagaggacaagccagcgcccagcagcaaaggcaagaaactgaaggagggtgactctctgcccagtttcaagctgctcagggaggatgatgtcaaggtggacgtccaggtaggctcaggatgggggctggatcacagtcaccgaggtgttctggccctcccatccgctacgcaggcaaataccgggggctgcaccaagcaggcactggggttcaaggagaaccacaagaccctccaggatgcagggtttgaggtttacgggctcagcttcgacaagcccaagtcccagacgacctggaagaccaaggttggctgtctgtgtctacacccgggatcagctttgcctgaccctgagtggctctccacggcgatcgcccctcacgcccaagcgtctcctcacacgcctgcagttcatcaaggccctgggcgcattcaagcccccgcgcaacgtgattcggtcccacatcgtcgttgccaagggcgggaagatcgtgagctcccacatccagatcagcccgggggacagctttgccaaggccgtcgccacggtggcagacgtggccaagtcggcctgagtgtgagtatccctggaggcgacagggctggtttcaacactgtggaattctcatccatcagcaccgatcgctggggggccgggctcctgagcatcccccttccatcgagacttggtgccgttccggtgagagtttacgcccttcaatgttcagtcagacaggcagcagggagtgggggttgggagtcaggtgcaggggtgtggggtgcacgtcggctggtggtccatcgcaaaagtcaccgcatgcggtgcaccagccgccgctctcgccgatactcaaagtcgccgttgctctgcagtgcgtgccacccacctgcgacgccctgggcaccgagcatgcttcagcagcgcaccccacagcggggagcggtgcactgcatggctgatttcctggaacccccccctgcgttaccaggccccgcacagcctcccccgggcgtactcgtctga

SEQ ID NO: 2641 - DNA, 201 bp, Chlorella protothecoides
atggacgctgccgcccttaaatccatcaaggtcaagaccggcaccctacgtcggttgcgcaaggagctggacatgtacatccaggagcaggtgaaggagtcggcaaacgtcgagaaattgaaagcggatggcgcggacatccatgatgtcaagtatgcggtgagtggcaatgtacttggatggtgggattcatccatctga

SEQ ID NO: 2642 - DNA, 201 bp, Chlorella protothecoides
atgacggaggctatcgatgcccatgtcctcaagaagtacgaaattcagcagaagctcggcaaaggggcctacgggatcgtgtggcgcgccgtggacaagcgtacgggtgacgtggtggccctgaaaaagatcttcgacgcctttcagaacgccacggatgcacaggtgcctgggcgaggttacattggcgtcctgcggtga

SEQ ID NO: 2643 - DNA, 450 bp, Chlorella protothecoides
atgtctcggacggtggacgctcgcacgaaagcgctggtggagcccgtcgcccgcgagatccgggccgcaacttccgatcccaaggctgatgcagtcgcagagcgtgaacaggcgtccttcgacgccaacgagctggcagtgtacatgcaggggggccagagcgttctggaccgcaatgtcaaggccatccagatgctcaagcagttcccctggggcgacaagtccaagcgccccttcctcacccgcaccgaagaatatgtgcagggcctggaggcctccgtgaccatctggaagatggccaacgagggcaagatcaccaacgaggaggccatggccatgcgcaagcagctcaactggcccgcaggcctagagctccacctgggggtgcgcagcgcggggacttggcggtcctcctgtgttcatggggggctggcgttgatgatgggttga

SEQ ID NO: 2644 - DNA, 540 bp, Chlorella protothecoides
atgacccggaccacaccgtccttgcccctcccgcagccaagcaatgtcctgctgaactcggagtgcctggtgaagatggctgactttgggctggcccgctccgtcgcgcagctggcagccgaggaggggaaccccgtgctgacagactacgtggcgacgcgatggtaccgcgccccggagatcctgctgtcctccatgcgatacacctacggcgtggacatgtgggcctgcggggtggcgcagggctggggtcctgtctggacaggctctggcctgctctgctgcgtcccaggactctcctgcgcatgcatgggtccacccacccacccatcccgacccagcctcagcctggcacgtaactcagccttcatcaaccactgtccagggtgcatcctgggcgaactgctgaatgggaagccggtcttccccggcacctccaccatgaaccagctggacaggatcctggagatcacgggtcggccctgcgccgaggacgtcgaggcggtgcagtcgccgtttgcgggtgaggccggaggctga

SEQ ID NO: 2645 - DNA, 570 bp, Chlorella protothecoides
cccgtgcgcctcgcaccgggcgactacgccgcggtgcgcgtcgtggccgccacgggcggcgcgctgcgggccgtggcgctggcgcgcacgacgctgaccgagttcgtcgctgtgcacgggtccgcgctgcccctggcgcgcgcggagctgacccccgccgagctggcggcggcggcggagctgctggcggcggggcggggcgaagaggagccgggggccctgcaggccagcgcggggccagcgcggggtaggggaggtagtagccctgaaagccctggatcccagcggcctgtgagagtccccgcggcctgccacgaaggggaatggcagcggggtgaaccgtcaaacaagcatccttcaaagcctggggcagccaacatgtcaggcgcgccgcatcatcctgtgcgtcagccggttcagcctcacgtccgccagcgccttctccatggcctcctcggccgacctgcttgcggtggcgaccaccagggagcggatggcgaccgccctctcgcggtccgacaggggatgggagcccgcagcctgtgggggtgggtatgtgtggagggttga

SEQ ID NO: 2646 - DNA, 189 bp, Chlorella protothecoides
atgctgtctcccaccacattcatcggcggtcgtcctgacccttccccctccggccccgcagctcctgagcgaccagctgtgcttgagcacgagacagaccctcaccgcctggcccagcggcagaagcaggtggactttgggaagaacacccttggctaccagcggtacagggaggcgatccccaggtaa

SEQ ID NO: 2647 - DNA, 609 bp, Chlorella protothecoides
atgagtgagctgcgatccatatcttgccactcgcatgacgccccccgccccggcccacacaggtctcagcgccggcgtaacaaggaccccagcacccccgacgtgcacaaggcctgcagcaagagggcctttgacggccagatcaagaagtggcggcgccagctgcacgagtgggacccgccgacgcaggaggctggggcggcggacgacgtggctctggccactggcgccgtcatgtccttggaggccgccggtccggcggggcgcgaggagcccgcccccggcggtgacgcggtgaggggctcggcgcaggaaggcgctgcatgcgcttggtgcacgggatcgtgcccctgcaccccggtttcccacgctcctcacgccctgcgccgagtccctgcaggatggccaggtcatccccgggtcaaaaaaaggacgggagctgcgtgggagcgggaggctcctcccccgtctcttcggacgcagcgggacgaacaagaggcggcccgacctggggagccaggaggggtctggcgggcagccagacccccgggcgacaaagcgagggtggttcaccgccaccagggcgccaagagaagccgtgcaggctga

SEQ ID NO: 2648 - DNA, 216 bp, Chlorella protothecoides
atggctgcagcagcgatggaagccggcacaccacatgcttggggccgccatccacgtgtgtctccgctctatttccctcccaccccactttcctccaaacaccgcctgcagggcatcgtgctgaagctgcggtacaaccgtgcggggcacatgtttgagttcccgatcctgctcagcccgttgctggactggaacatcctggccgccggtgagtga

SEQ ID NO: 2649 - DNA, 354 bp, Chlorella protothecoides
atggcggcagcaagcagccatactgaggaccagagcttgtatgcagccctgggggtaggccccacagcctctgaggatgacatccgacgcgcctaccgagccttggccacctcgctacaccctgacaagacccaggatccggagagaagggacgatgctgcccagcttttcaccattatccaagaagcctatgaggtgctgagcaaccctgataagcgtgacatctacgatgtgtacggcaaagagggcctggctgcagggctggagcttggggaaagggaaacggcccgcattgactcgcaagtcaactaccggggcgcatacatctttcgtgctgatgcttcaggtgtgtga

SEQ ID NO: 2650 - DNA, 909 bp, Chlorella protothecoides
atggacaacgacaccgggcagctgatggcggtgaagcaggtgcacgtctccaaggccggctccagcaaggtgagcgagcatgtgacggcgctggaggcggaggtcaggctgctgcagcagctggaccaccccaacattgtgcgctacctgagcacggagaccaccaacgacgcgctgcacatcttcctggagtttgtccctggtggcagcatcgcctccctcctcgccaagttcggccatttccgggagacggtggtcaaggtgtacacccgccagatcctgctgggcctggagtacctgcacgcccacggcatcatccaccgtgacatcaagggcgccaacatcctggtggacaacacgggtttggtgaaactggcggactttggggcatccaagaagatcgaggacctagtgaccatcgactcggggttcaagtccatgaagggcaccccttactggatggcccccgagatcatcaagcagtcggggcacggccgccaggccgacatttggtcggtggcctgcaccgtgatcgagatggccacgggacgccctccctggagcgggctgggcagccaggtggcagccatgttccacatcgcgtcctccaaggggccgccccccatcccggagcacctctccgccgagtgcaaggacttcctgtacctctgcttcaacaggtgggggtggggggttgctgggtggggtccttgctctgcgcattggatggatgggtgcagaccgggaggggggtgggttggctggaggggtgccatcacatgccactccccgacgagcaggatgtcgggcgcagcatggcgggggaggctggcaccccacccacgcgccgcatggccgtcggtcgtcgacgtcgacggctctctgtcgcactctccctgcggcctatga

SEQ ID NO: 2651 - DNA, 315 bp, Chlorella protothecoides
atgaccagcggggtcgacattccagtggacacccgagattggggcgtcctggctgcagaccaagacattgtgcacctgggaggcctagtgaatgtccggaagaacgtagggggtggcagcttcctggcggggtacaagcgcgtctactcggactacacgacgctcgatgtgaatgccgcggtgggcctgaagagcctcttctcggtttcctctggcgtccagctgtcgccccatgcccaggccaacctcaccgccacgtggcagccagacgaaggtgtcggtctccaggtgagctgcggctggctttgtgggtga

SEQ ID NO: 2652 - DNA, 1383 bp, Chlorella protothecoides
atggacgtcgggagcgcggttctggatgtagcagctctgcggcagctcaccaatccggcagacatcccccgcctgctcagtgccgctctagttcgggagcgtgccattgataccgaactggaggggatgctgggaaggcgtgaggccatccaggccgagatgctggagatgactgcctccaccagcgaggtgaacatttgtggcaggcagagcacatcacgggcgctggagacttttgcagccatgcaggaagccagggaatgcgaggtacctttttacagtccatcctggagcctcacactccccatcgtctgccctttccctctccatttctcgcaggcgctgcagatgctggccgtggaggccgaggccctggaagaaagcaccgccggctccgcaaacctggcccagcgcgtcagctctcaggtgcgggccctggacgccacccagacccgggtccagggcgcgctctcccacatcgccggccttctgggccgggcggcggcggtggagggcgtcgcgcgggctttggcccgcgaggattacgaggccgcagtgcactgcgtggacgagtacttgaccctggaggaacagaccctggccgcgctggggggtagtggggcgtcgccgacggccgtcgccggctcaaaggccggcggggcgggggtggcgcctccggccgagcatggcgtcaacagcgtggcctgcctcgccggcgtctctgccgagcaggcggctgcctttgcgcagcatcggcgcagcgtggaggaggcagtgtcggcgtgcctgacggcggccgtggcagccggcgaccacgccgccgtgctgcgcttcgccgcgctgcacccgccgctgcgccaggcgcagcgtggcctggacgcgctgctgcgccacctggcgggcatgatatcctcccgcgccgccgccgaccacgacgcgctggtgggcgcggtggagggcacccagcccgactacgtaggcgcgctgaccaacctgttcaaggacgtggcgtcggccgtcgatgagcacctggacctcttcatcaacagcttcggccttggttgctgggcctttggttcagaggaaggcacttccaggccggcagggtgcccttctatcacactccgcacagatccccccacctccccccctttaaatccccgtctcctttcctttagacctggccacgacggcggtgctgacgctgcacggcgaggtggatctgcacggcagccgcatcctacagcgctacgcggaccaccgccgtctggcgcggctggcgggccaggtggcctcgcaccgcgccggccccgccggctcggcgggcgcgccgcccgtggagccgcgcgctgtagaggcctgtctggaggagctgctggcgct

SEQ ID NO: 2653 - DNA, 960 bp, Chlorella protothecoides
atgttcaggatcgcctgggtgaccctggggatgtgggcatgcaccacggtcatgtgcattgccaggctccgcgccgcccaccgcgccccacctcctttccctgacccaccctcccaaaccgcagagctggagaggctggcggtgtgggagtcgcccctggacaccaaggctcatgcagcagtcgcgtgcgactggcccaccgtggcgcagtgggagacgctggccgcggcggcctggatcgcctcgcctcgcctggcgctggcgctcaaggtgtggtcggagccgtgcgacggaggtcggtgtgcagggcagggcacggggtgtgctgcacgctgcatgcagtttgtctctgcaaaggatcgcttccctggatttcccgccctgcgcctggaactcgagcgctttgtgctggtgaacgccgctgcaaagtcgctgcagctcctgcctcaagccggcgcgctgctcgcggagatggctggggagcccgcggccgcagacaagctggtgcacctgcagagctgggcgccgctgcccctgttgcaagcactggctgtcgtcaattccgcgggtggaaagaagcccgaggtgctggagtacctctcgcgctccctgcacgagtgcaaccccgaggaggtggcctttttcttgccccagctggtgcagatgctgcgcaccgaccacgacggcgtggtggcccgcttcctcctcgatgccgcggccgtctctgtgcactttgccgtggtcctggcctgccagctgcgctccgaaggcacgccccccgacgaggcctttgacccacaggttgccgacaagctgcggaccaggctaatgtcaggactcccggaggacgtggcaaatctgctgaaggacgagctggcatactttgatgacatcactgaggtgtcagggaagctgtacccggttctcaaggtgaggattgtggtgtgtggagttgggtaa

SEQ ID NO: 2654 - DNA, 480 bp, Chlorella protothecoides
atgcaggacaagcgaaagtcggctgcagtcgagttcctaaaagctgtggagctccccaggggcgacctcttcctgccaaccaaccccgactgcaccgtgctggcgcacatcccagagtccgccgctcccatgcagtctgccgccaagtgccccatcctggtggccttcaaggtacatgtgcgccaggacgtccaccccgggtttgcagacggcgaggtcgaggaggcgggcagccaggggtcgggcaaggaggatgaggagccagagacccgcgcctgcatcttcaaagtcggggacgactgcaggcaagacatcctggcactgcagggcgagctcaccgacggtggactggctgaggtatttgcccgtgagcatggccctcccgggacagagcggcatgaagctgctcggaagaacttcattcgctcctgtgccgggtgcggtggtgggagtatgtgccttgggcttcgaggggcttga

SEQ ID NO: 2655 - DNA, 618 bp, Chlorella protothecoides
atgtacacggacctggcgaccatctacgagcgcgcggggcggatcgaagggcggcgcgggtccatcacccagctgcccatcctgtccatgcccaacgacgacattacacaccccatccccgacctgacgggctacatcacggagggccaggtgtacgtggaccgccagctgcacaaccgccaggtctacccgcccatcaacgtgctgcccagcctgagtcggctgatgaagagcgcgatcggggagggcatgacccgtgccgaccactcggaggtcagcaaccagctgtacgccaactacgccatcggcaaggacgtgcagggcatgaaggcggtggtgggggaggaggcgctgtcctccgaggacctcctctacctccagttcctggacaagttcgaagccaagtcgaggatgctccctcaatgcctcaacaactcctcccctacaaaacgccatcaaacacaggggctgtacgagaatcgcagcatccacgaatccctggacctggcctggacgctgctgcgtctgttcccacgggagctgcttcgccgcgtcaccgccaagaccctggacatctactacgacagggagaagccggcgggcagcagtagcgcctag

SEQ ID NO: 2656 - DNA, 756 bp, Chlorella protothecoides
atgtatgccgagatcgtgaacatccggctgggtgatgggtccgctcggcgtgggcaggtgctggaggtcgacggcaacagagccgtggttcaggtgttcgagggcaccaccggcatcgacaaccagaggacgaccctggagttcactggagatgtacgtgcaagacgagggtgtttgggtgttgggaggatggtgcagctggccgcaccaagcctgagcccgttcaggaatccctgccctggtttccactgctcctcccaccaacgcccgactccctcatctctgcccagcccgccggtgctggcggagcacttcctggacatcaacggcgcgtccatcaaccccgcggagcgcacctaccccgaggagatgatccagaccggcatctccaccatcgacgtgatgaacagcatcgcgcgcgggcagaagatccccctcttttccgccgcgggcctgccccacaacgacattgccgcccagatctgccgccaggcgggcttggtctcgcatggcgagggggaggattctgcgcgcgagccctttgccatcgtctttgcggccatgggcgtgaacatggagaccgcgcacttcttcaagcaggactttgaggagaatgggtccatggaccgcaccgtgctcttcctcaacctggcaaacgaccccaccatcgagcgcatcatcaccccccgcatcgccctcaccaccggtggggggagttgtggaggaagagaggcggggggggggagggggggttga

SEQ ID NO: 2657 - DNA, 321 bp, Chlorella protothecoides
atgaccgagatcatcgacccggcgcgcagcaagacctctcccagctatctccacttcaaggagctctgcatcaagggcttcctcacggctcgcagctcggcagaaagcatcgtggccactgtggcaatgatggcttcctcgcaccttccctgcttcaggggccccaagacggccgtcgagctgcggcaccgcttccggctggacctgggggagaaggaggccgccgcccacatggacggtctggtggaggccgcctacggcaggtggaccaccggcttctacgactggatccagtacctgcagaataacattcccaagtag

SEQ ID NO: 2658 - DNA, 978 bp, Chlorella protothecoides
atgggtgccccggcccggcgctggcgcatgcttgcccctgtgcctctcctcaccaggtctccgcctgctactgcccccgtcttctccaatcacccgcccccaccctgcccctcacaggcatacgcggggcgcatggtgttttggcaatggcgtggcatcctcagctctaccccatgcagctgctcacactcggaggcagcggcagcatcttcatctggaccaaggtggcgtttggcatgcgagcttgtgcttccttgttacagtcatgtggttgccacgggtaccccaggcatccctctcgctgaaccaaaacaccagtcccacccgacgcagatcttgagtgacaagtggacagcctttgccccagacttccgggaactcgaggagaacgaggagtacatagagcgtgaggacgagtttgacgtggtgcagcgtgcagctactcccgccacttcctgcaaagctgcctcactcttgaggattgcattgccccacctgtccccagatcaatccctgcctgcaaatgtggatgctgacttggacatcgtcacccgggggcccagcaacacacccacccctgcatcctcggacctgctattcctccccgtggtcatccaagcagagtcagaccagggccaggaagatcctgatgctgacgcagcaggcactgtgccaaacggcggtgccactccaatggacgaggacgactccgacggcggcccagacctgactgtgcagaaacgagcacgcccaggatgtcgaaacatcgataccctttcaccctgctggcgaccacaacccccgactgccccttccctgcgctggtgtgcggtgcctgcgccacttcgtgtcttgcaagaggatcatcagcatcagttcaatacaggctgcagggaagacgagtcactgagacttgtacacggagtccatttgcttgctgccctggaagttctgggcgccgcccctgttccagaatga

SEQ ID NO: 2659 - DNA, 1755 bp, Chlorella protothecoides
  modified_base (889)..(898): a, c, t, g, unknown or other
  modified_base (1204)..(1213): a, c, t, g, unknown or other
atgcaaggtcatgctacaggcacaccggttgcgcagtatatctcaacgacccaagcaccctcccattgcactcacagtggcgccgtgcggtgcctggtgtggagcccggatggccatagtatcatgtctgggggcgcagacggcagcatcgtcacctgggacgtcctctccggccgccccacggcgagccagcccctcggccgcggcgccgtggtctccctgtgccccggtcccggtcccggccagctgctgctcaccttccgcgccgccccgcccgccgtgctgactgtgggcggcgggggcatccagcacctgcccctggccggctggagcgcgtgcgacccacctgaggcgcccgagccggcccctgcagaggccatgagcgccggggccgaagctggcaaggatggcaggggcggcgcgagcctggccgagcaggccgcgagcagcgggtacccggccgccaccgcccccggcagcgccctcatctacgccgccatgcgaggggccctgctggtcgtccgggcctcggacctggccatcatcgacgccatcaggaggagtgagagcctggcccaagggcccgtcctattcctgctcaagatgatgctctgcgtggacaatcactcagggccagcaccttgcagctcagacagggcgtcgacttttttgccatgtgcacatgatcttccacactcctggtcattctttcttcctgcacaccgtggacagtctcatcactcggcacgctgcccctccttactctccccgcgtcccccctcccaggtccaggcagcgctgcgtgtgagcagccttgagctcgaccccggcgggacgcggctcatcgtcctcgccaacgaccgggcggtgcgggtgtacgccttgcacnnnnnnnnnnccggcgggacgcggctcatcgtcctcgccaccgatcgggcggtgcgggtgtacgccatgcaggcaccggcccaggggctggaggccctgccggcacgcgatcctggcgaggtggaggccctggtggccgccaaggtgcgcgggagtggggaatggagttccgacgggagggggcagggacgctgtggggtgggtcagcagcatgcatggccaggcagcagggcgaggggggaacccaggaggccggcatgcgccgggcccggcagccgcccctcccctgcgcggaccccgcacgagcctctgcatnnnnnnnnnncgggcccggcagccgcccctcccctgcgcgaatcccgcacgagcgtctgcacgcacatcgtgcagacgcggcggccgtccggcagcatcttctacgaggagcggggagctcttctgcggccctcccgtcgctttgagcagcagatcgagcgcaacacgtggagtgccgccactttctctggaggtgggtcttctgagggagcgccgttgccttgggctggctccctggctgtgtctgttcgagctcctgtgtgcgatgcgggctgggattctgcccctgggcgtgtaccgacgcacccgcgacatgatgtgccttttcatcccaaattcaatgcagatggggagtatgtgctggcggccgtggccggccagaccgagcacgtcatctacgcatggaactcccactacgggcacaccgaccgggtgttggagtgtgagtcgggtgggacaggaaaaaggagtggggtgctaggcggcaagtggaggaggcatcttagcaaacaaagtgcgtgttcacgtcgaacctcatctgacgctgtctga

SEQ ID NO: 2660 - DNA, 1353 bp, Chlorella protothecoides
atgcgcgcgcgcggagtgagggttgagaaagtgatcaaccctgccccaccccgcagtgacgaccctcccctattcccctggcaagtctgcgaccccagtctgccgggaatggccgcttacaccctggagagcgcggctgtgaggtgcagcgacaccctcagcctgctggtctcacccgaggtggcggagttctgcaggtcaaagtcggaaaagtacgggccaggactgagtggcgccctctttggcattggtgtctggttctggctggatgctgttgccatcagccccatcaaggtgcccttctctcaggcacgtcgggggtcggtgaggggtggagcttgcaaaccccttgaggggctggcagcaggagtgagaccagaccctccccaccgcctacactccccgacctcactgcagtatctccctggactggtggcggtcctcgccttgctcatgatcacggctgtcaggagcgtccagctctgccatgccgttgcctccagggacgagataagttacgatcccttcagcgatgacggcgtgtactgtcggtcgcgatcgtggctgttggcggcctacctcgtctcctctggagctgtcacaggctcagtgtttgtcatgctgcaccactttggcagcagtgctcaaggtgatgggtggactctagggatggggcctgggtcgacgtccaaatctggctcggcccagatcctcacgggttttcttcctggctgccctgccgcccgggcagctgcagacgcttgcccgtggcggtgcagggcttcccagtctcagcattgcccacagcaagcgcctcccggactgaaggggggcatgttccttgccacgatctatctgcacgcttggatgccttcccagatggtccttctatccccgtgtgcgccaccgtcacaccaccagcccccatgggctggtcttcaaagcggaatctgggtctccacagcccccctccccctcattcctctggcagacacccgatgggttggcatagcgagcgtgctggaggtggcatgcatccttggcagtgccctcctcttcttcatgtcgaggtcgcctggtgacgagggtggctatgacgccagtcgagctatgggtgcagggacacagggcgactccttgcatgcaggcgctcgtgtgcgcagggccctgctgcctcgagtgactccccagctcagactgtcaatggcctccgccctggtggtcatcggcgccctcgccccgttcctgccttgcaacctctttgaacagcgtgttcagcttgaggtactgcacaatcgtgttgtaaggatttgcattggggtgctgtcgatctggcaactaccacttgcctag

SEQ ID NO: 2661 - DNA, 447 bp, Chlorella protothecoides
atgcgcctcacgtgcatgccagccctcgcacgggaactttccgccgatctacaaggctggtgtgctggcaggacggtcgccactcgaatcccgagtcccatgggccagaacgagtcttcgggggtggagatggcgtcggaggaggcggcaccccggccctgcgccttggtggtggtcggcccctccggcgtgggcaaggggacgctcatctccaagctcatgcagagcagctccaagtacggattctcctgcagccacaccacccgtgccccccggcctggagagaaggtgagggactgctggtgcggtgtgggtgtgcatggctttcaggcccctgggcgccctgctctactttgtggcaggcttcacgcatactgccttggaatcgcgactgcacgtccctttctcggcaccagcgccccccacccgccctacccaccccaccca

SEQ ID NO: 2662 - DNA, 381 bp, Chlorella protothecoides
atgagaggcccggccaaagacgtggcgcccgtgagcagtattctgcccaccgacgcagaggccatcagcgaggatgaagacgtggaagaggaggtgcatgagtggttgttgggattcgtggagaccccactgagtcccgagtccctcctgcgccaccgcttccccagcaagctgggtgggcgacccgcctggctggaccccttgcgactgccctcccccgcccagctcgcgggtcccgatgaagggtcaccgctcagcttcctgctccaagtctatgctcccgtcgactccaacgcggcagccttccacaggaccgtctttgtcttcatacacacagacgtgagtagcactggcagggctgtggggcggcgggaacggtag

SEQ ID NO: 2663 - DNA, 2148 bp, Chlorella protothecoides
atgtctgcccgcgatgtccagagccaccccgtgggcgagaacaagtctggtggcgtcttcggcgccattcgcaatacatttggcctcggtgagaacaccaccagcgccgagaaggttgtgagcgagcgtgtcgagaccgtgaccacctccaccagcgccagcgccgcgagcaaggagaccaccgacgagtggcgcaaggccgaggccgagaccgtgcgtgccgagcaggccgctgccaaggccgaggtcctcgcctccaaggtcgacaccatcaatgcccaggcagccgaggccgccaagctcaaggctgaggcggagcgcaagctgcgcgacacccagggtcgcatgtccgacctggatggccaggccgagagcaagcaggctgaggctgccgacctggagaggcagctgcaggcagcccgcgccgcagccgcccaggccgagcgccgccgcgcggtgatcctggaggaggcttccaagtcctccgcccccgccgccgacctgaaggctgaggctgacaagctggacgccgagtccgaggctgcgcacaagaaggccatcgacctgcagaagcgtatcgacgcgctgcgcacctccaagcccgcgcagcaggctgcggagcgtgaggaggaggctgcgcgcctgcgcgctcaggtgggctccctccagcgcgagctgacggctgaggagcgtgtggctgcggagaagcagcaggcggccgacaccgcgatgcgcgccgcatccgacaagatccgtgaggctgacgagatcgccaaggtgtactgggccgcccgcgatctgtccaaggagctggaggcgcatgccaaggagttggctaaggaggccgctgaggccgccaaggaggcggagcgcaagcgtgcggctgagttggccaaggaggctgctgaggctgccaaggaggcggagcgcaagcgcgcggctgtcgacaagctggacggccgtgcagatggcgcggagcgtgcggctgaggaggctctgcagcgcaaggccgagctggagcgcgaggcccaggccctgctgggctccaaggccagcgccgaggaccgtgccgcgcagctggagcgcgaggccgccgcgcgccgcgcgcaggcgggcaagcacgaggagattgctgtgtccaagcgcaccgaggccgagcgcgtggtcatccccgtccgcaccgaggccgagcgtgtggtcatccccgtcgtccctgactccgacctggcgcgccgcgctgaggaggcgcggcgcgccgctgacgccgccgccgccaagaaggatggactggagtcggatgtcgagcgtctgcagaagctgaagctggaggcggaggcagccagccaggataagctgtccagtgtgaccacgtaccgcgatgaggccctggcccttaagcagaaggaggaggagcactgggcgcgcgccaaggagcatggtgatgcggcgcgcgagatctccaacgaggagactaagcgcaggctgcaagccgtcggcagcgggggcaccaccgcccagcacagcgaggtggagcatcagaaagtgactaccaccagcaaccgcggccgtgtggagagcagcgagtcggggcagagggaggagattaccaccaccaacctggctgacaccgtgcccagcaagcccaagggcacctctgccgggcgggaattccctcctgcacctgatgccacgaccagcccacccatcagcaggccttccattggtcaccagggaagacacttcctccgacgacgctcctctgtcgactctcaagcacaccacccgctccccctggctcacctggaactcgaagcgtcggggggcaccacaccgggagcagggtgggatgtcctgctccccaggcgtctgcttcctgcaaggccacaggggccgtgcgcccggttcaaagcagtagcgcaggcactgcgccggctcacttgcaatctgcaagggaaaatcaaggagcggggtgaagcgagtgagtggcaggaacgacagcgagtgggagggtctctcgtaagctgctcacatgaagccaatgccgcacccgtgctccaacaagccgccatcccatcccgccagccaaccgcagcgcagcatcgcacccacccacccaccctggcagagaaggcagcaaagtccctctga

SEQ ID NO: 2664 - DNA, 492 bp, Chlorella protothecoides
  modified_base (411)..(420): a, c, t, g, unknown or other
atgccgggggcgcgccgaaaacgcccgattcttcccgggcgcgatgttgccgagcaggtgcttttacgacaacaaagcgcatcgatgcatcccgcgatgctcattacaccgcacgcacaacgcatgcagctgtccgcatcggccgccgcagcgtcattcctgcccatctggcaggggtgccgcatgcgccctgcgctcattctcaggaggagtgtgcggacattctcgggcatggccggtggaccgatcgagatctccatcaaggatccgtcggaaaagcaaagcccttgccgtgccccgtgcaggaagctcacggctggactccagcccgtcaccctcaagctgaccaacgagagccacaagcatgcgggccacacaggaaaccccacaggcgcccctgatgcagaaacnnnnnnnnnngagggtcctgcaatgatacgctctgcatcttgtggatcctgtctcgcgccggtgatggtcatgcatgaatag

SEQ ID NO: 2665 - DNA, 468 bp, Chlorella protothecoides
atgtggcctgacgaggacagcgatgaatatcggcggcatgccatcaatgtcaggatgagtcagggtcacgagcccttcaccatcttaaacaacctcccgtcctcactgcagcccccccagttcgagttccacgaccccaagggccccatctacacatcgccgcgcttcctcccccccgcaaagatcatccgatcccgcgtgacggatgcggtggtgagccacggctcgctcctcagggactgctttgtggacacttccatcatcggcatccggtctcgcatcgacaagggcgtggagatgaaggtgcgcgcaggggatgcgtggctgggtggtgtcttgctgccgcctgggcagaggttccgcacgcgcagagtagcttgctggaaagcagcaccgcccatcactcagccggtggacgcctcgctcccatgcgcaggaggtcctcatgatggggcaggactactttga

SEQ ID NO: 2666 - DNA, 375 bp, Chlorella protothecoides
atggactacatgaagttcgtggaggcgcaccgcgccagcaatgccgacatcagcatcggctgccttcccgtggaccacactcgcgcctccgactttggtctcatgaagatagatggcgagggccgcatcgtggactttgcggagaagccgcgcggcgcggcgttggaggccatggcggtggacacgaccgtgctggggctggatgcagaggcggcggccgccaaccccttcatcgcctccatgggcatctacgtcttccgcaaggatgtcatgatcaagctgctgaaggacgaccccagccgcaacgactttgggggggagatcataccgcagtcggccaaggacaacaaggtgccttgttgggattgtttttga

SEQ ID NO: 2667 - DNA, 303 bp, Chlorella protothecoides
atgctgccgttgttcccaacggagcgcgggctgggctggggcgggtggggccatgccaaggctccggggttgccactgaagaagccactctccaagttggtgtgcctgctgggttctggtgggcgtgcatggcttccaagccccatgcaagcctcaaacttaccacccctcctccggacaccgtcacacccacacagggagggggtccaggaggcttcgcgggaggaggagggctacttcatccgctctggcatcgtggtggtggcccgcaacgccaccatcaaggcaggcacccgcatttga

SEQ ID NO: 2668 - DNA, 324 bp, Chlorella protothecoides
atggggtgtgtacctgaagatcttgcccaagcctggaatgctagatggacaacccccctcccacccctgcagcacacggaggaagagtatggcgagaatgtcgacagcgaggggcgacacagcggtggccctttcttgctggaagtcagccctgccatgcggatcgaggacctgcggaaactcatcaagtacggtggcttgaggaagggcggtgtgatttggcatgcacagtcagcattggaccctgcaagagcatgtggtcatccactttcagcctgtccgaccattcattccaatgcagctatggagtggcatactggcatg

SEQ ID NO: 2669 - DNA, 546 bp, Chlorella protothecoides
atgactgagatcacgagccccccagccgtctgggatgagtcggccatgtctgcactcagggccgattaccccgacctcgcggtgctcagcacggatgccgtgaccaagcacaaccccaccccaggtaccggccggaccggctacatggcggtccccccgaacaactacccgttctacagcgaggacgagaagtacgttcccatcatgcaagcagatggtggacagctctcaggtacagatccgtcatccctgggtggcagagataggagcatcccttggatgctcactggggccccactggtgcagcaaatcctgaggggtgctgcagagctcaactttgtacagtcaaaatgctgtccgggggttcaatcgccacgcactcccatgaaacagagtggaagccaatgtacaaccccactgcggagcaagcggagaaggatcgcaaagcggcatacgagtctggagtgccccacggcttcgttgcggcgggagacaagtatgcaggccttcccaccatcaccataccgctcatcagcgagctggtga

SEQ ID NO: 2670 - DNA, 315 bp, Chlorella protothecoides
atgctgcctggtatttcaaatttcacctgtgaaatagcccgaccaccaaggcatttcccctcttcccaaagattcctcgctgacctggcggccgtggaccacagctcccccgacgcggaggacagcagccgctcccgcgtccggcagctggccctggcatggcgcgctgaggccggctcgcgggcactcgccgacggccatggcgagggagatgcggtgcccgctcagctcggcgcgaggaagggcggcggcggcgcgcggcacctgggcctcctcttccgccgctccctccgacaggtgtgggagagggagtga

SEQ ID NO: 2671 - DNA, 291 bp, Chlorella protothecoides
atggaattcttggccggcgccctcttgataactcttccacgtgacaaatccattcctttgggtgccggagctgtgctggctaaggcggtggatggcgctgtccgggcggtgaccaagcctcgctccgcgcacgctgcagcgagcatcgagcaggctggcgcccaggcagtgacgctggtctgggatcgcctgacttgcatcttgaagacgaagaatgggcaggtcagagccctgctgcgtgacatccagggcacggcaaggcccgggaggtgggcttggattggggaatga

SEQ ID NO: 2672 - DNA, 1362 bp, Chlorella protothecoides
cccaccccccaccccaccccccctcttcccacaggaggagtacatcaaggaggagcagcgcagcctcaagaacgagctgctgcgcgcgcaggaggaggtgaagcgcatccaggccgtccccctggtcatcggccagttcctggagatggtggacccagtgacgggcattgtgggcagcaccaccggctccaactattacgtgcgcatcctgtccacgctgaaccgcgagctgctcaagcccagcgcctcggtggccatgcaccggcactccaacgcgctggtggacgtgctgccgcccgaggcggacagcaccatctcggtgatgagcgcggcggagcggcccgacgtcacctatgccgacatcgggggcatggacgtgcagaagcaggagatccgggaggcggtggagctgcccctgacccagggcgggctgtacgagcagatcggcatcgacccgccccgcggcgtcctgctctacggcccccccggcacgggcaagaccatgctggccaaggcggtggcgcaccacaccaccgccgccttcatccgcgtcgtcggctccgagtttgtgcaaaagtacctgggagaggggccgcgcatggttcgcgacgtcttccgcctggccaaggagaatgcgccctccatcatcttcgtggacgaggtggacgccatcgccaccgcgcgcttcgacgcgcagacgggcgcggaccgcgaggtccagcgcatcctcatggagctcctcacccagatggacggcttcgagcaggccacacacgtcaaggccgagagtgggctcccctaggcagccggaggcgggggaccgggcaggatacttccctccaggccccagagcaacaaggcccacatcgtcgcagaccggcgccagaagcgcctggttttccagtcctgcacctccaagatgaatctcagcccggaggtggacctggaggactacgtggcacgccccgacaagatcaacaacgccgagatctcctccatctgccaggtgcgtgcacctgcgtggttgggcggtcccccggcgacgcatgccagggcgtggatgcgtgggtttcaggctggcacggggtgttgaatcccggggtgtacggcggcatcatctgctgcaaggagcactccatcgtgggatcgctgtcgatctgggttggcaatgctcccctcccattcgccgagtcagccaacaaatctgcccctacaccgagcctacccaccgccctcctggtgcaggaggcggggatgctggcggtgcggaaaaatcgctacgtcatcctccccaaggactttgagaaggcgtacaaggtggtggtcaggaagtcatccgactcctttgagttttacaagtag

SEQ ID NO: 2673 - DNA, 468 bp, Chlorella protothecoides
atgacagccgcctacacctggcctgagccggagccggcggaggtgctgacagggacggagggtgcctaccagccctactgcaaccagatcatcaacgacgagctcaacttcaccgcccagcggctgctgtcccggctcaaggagctcaccagcctggaacagggcatggcccccggctttagccccccccgccgcttcttctgctccctcaaggaggtgtccaaggtggttcccaatgcggcgttgctcatcgtggcccccgacgtccgcccctccgccaccgccgccatcaagccggtcaagatcctgactgcgctgctgagcgccgccgcgcgtcacggcgtccccgtcgtgtttgcgctctcccgccgcggcatcggccaggtgtttggccgggagaagtccatgagcatcgtcgcggtgagtgtgcggggcttggatactgggaaggggttggacagagggtag

SEQ ID NO: 2674 - DNA, 1311 bp, Chlorella protothecoides
  modified_base (1039)..(1048): a, c, t, g, unknown or other
atgatgcccgccgctgcgtcccgtgccgcggcgccctgcgggcctgggtcggtggtcggggccgggcctcgggcgcccgggcatgccggcccccccgtgcgaccgcgcggcgcatgcgcggctgccgcgggcccccatgccggccctgagctgcaggtcgaggcatgcgggcgccgagcggtgctgatcggtgcggcgctcgcggccggcagtgcggccctggttccccccggggcctgggcagcgccagagccgcggagccgggccatccgccccgagctgacgcccgaccccagcagctacccaccctccgctcggcagggcctgcaggaggccacaaacatggtgcagaagggcctgaacgcccccaccctggagcaggagatcgctgcctggagcgaggagattgctgcctggagtgaggtggtggaccgctactcgctgtccaacgagccctgggccgcagaggtggccggccgggcgctgggcaaccgcggcaacgcccgcgcgcgccagggcgacatggagggcgcgctggccgacctggacgccgcggcggacaagtgcccttgggccgtagaccccgtgctgaaccgcggcgtggttctggaggcgctggggcgctgggacgacgccatcgccgacttcaccgaggtgctggccgtggcgccgcgcgaccccgccgcctggaacaacatgggcaatgcgcacgcaggcgcggggcggtatgccgaggcgctggcctactacgacggcgcggtgcagctggcgcctgccttctcctttgccgcggccaacaaggcgctggccctgtatcagctggaacaggacgagctgagcctgcacgagatgcggtccctgctgcgccgctacccgtcctttgtggatgtgcgtgcggcgctgacggcggcgctctggcgtgccggacaggaggcggaggcggaggaccagtggctgcgggtagacgacccccggtacagctcctgcagcaagccagcacgtgatggaagggagtatgcatcacccccaggcagaggcnnnnnnnnnngcagcaagccagcacgtgatggaagggagtgtgcattaaccccaggcagagaaagacagcgactgcgtttgtgctgccaggagtgtcggcgccctgcactgtctgacggagcgcgactggctggtgaccaagcggcgatggcccccgcgcctggtgggagacctgctggccttcctgtcgctgcagagcaccgtggtgcccgccgcctgacccgtgccctcaccttcacctcaagggcatgcagtcgtgacggtatggcctga

SEQ ID NO: 2675 - DNA, 1629 bp, Chlorella protothecoides
  modified_base (293)..(302): a, c, t, g, unknown or other
atggccaacaaggtggggatggggacccggggtctgggggggcaaggggccggggtggctccgagagccccacgcatggagcagggcacgggagcgcggcgcaggcgcacggtgctgcatgctgcgccgcgtgagcggcatcctgctcccgcgagacctcatcgctcaccctcgcactcaccccccgtcccactcggcccactcccacgttcagttcggatggtctgcccagatggagcgcctgtccatgacccaggtgggtcttcggccggggatcgcggcggtggtggggnnnnnnnnnntcacgcatggagcagggcacgggagcgcggtgcaggcgtgaggcgcacggtgctgcatgctgcgacgcatgagcggcatcctgctcccgtgagacctcaccgctcatcctcacactcaccccccggccctctcggcccactcccacgttcagttcggctggtctgcccagatggagcgcctgtccatgacccaggtgggtgttcgaccggggatcgcggcggttgtgggtgccgagcggcgcgccaggcggcgacccggcggccccgaatcgccctggcaaccccgcaccctggcaccgaaacccccctccccctgcgcccgacgcaggccctgggcgccgacccgtcgcaagccaagtggcagcgcgggctgcgcacgctggagatcaaccccacccacccgctggtgcgtgagctgaaggcgcgcgtggcggccgcgcccgacgccgccgagaccaagaaccgcgccatggtgctgtacgagacctgcctcatggagtcgggtgggtctgggtttgggtctgggtctgggtctgggtctgggcttgggcttgggtggacagggtccacagggtacggggagtgcagggcagggggagtgcagggcagggggtgggagggcaactgcgatggggaggatgcgtgcatggcgcctggcagcctcgcctacgctgatgtggcgggcctcctcaggcacgcgccccacctttgcctctctgtggaccacgcgcgcagggtacctggtggaggacgtgacggggttcaactcccgtgtcctgcacctcctgggcgccagcctgggtctggaggacctggtggagccgacgccgcccaagtccaaggtgatgaagaggaggggtgctgggaggggaggagagggggggtcccccagatctggcaggggggtgagtgcgcaccacgagccgcccgcccgtgggacggtgcgccccgtcgcgcgagcctcatcgccccctttcatgctttccagctggacgagcccaaggcagacaaggaggaggaggaggacgacgacggcgagcccaagacgcacaccttcacctccacggtgaagcttggggtggacgacctgaatggccccatcaccatccccgtcggcacgcaggacgaggtcgcggccgagggagtgaaggagaaggcagcgggggatgccgaggcaaaggatggcgaggcgtcgggggtcggcgaggcggcaaaggatggcgaggcggcggcgagtgacgccgccgcggcgccggctgccgacgtcgacgcggcgccggcatctgacgacgtcgacgcggcggcggaggtcaaggacgagctctga

SEQ ID NO: 2676 - DNA, 2001 bp, Chlorella protothecoides
  modified_base (342)..(351): a, c, t, g, unknown or other
  modified_base (907)..(916): a, c, t, g, unknown or other
  modified_base (1435)..(1444): a, c, t, g, unknown or other
  modified_base (1539)..(1548): a, c, t, g, unknown or other
atgatacaggagaatggaaaaaactcttccaaggtttggcctgaggctgaggaccgatctgctcccccgagtggaggggaaccatgggtctcggcattgggaagggctcccagctgtcggatggaacgggccccggggtcgacgaggcacaaacgatcgtgcgtgcgaagtgtcaatcggccgcgatcgatcttccttcactcgtgtaagtcgactatcgccgccaggcatcgcctgacgtcaataaccttgcatgccgcggtcccagtaggatacgcgcagcagccgcagcttcttgaaaccctaactagtgattccgtggtttccagacacgttcatgtnnnnnnnnnngacgcgcagcagccgcagctgcttgaaaccctaaggcctgccccagcggctctgaccccccgtccggaccctccgtgcatggctgtcgagtctgaaagcagagctcgctcgtatggcctgcgcaagcgtcgatcctcccctgagtgcgtcatgctgctgcagagcccccatgacgacaagtctacgctggagcaggtgcttgccaccgcccgcaaagtggtcatattcactggctcgggcctgtcggccagttcaggtgccttgacagggcgtgctcagggtgtggggccctgtgcgcagggtgtgctgcacacggcagtggtgtctgcacagggcagtggtggctgcatcggcgggcaaggggcctgtggaaccacttgtggagtgcgtaggttcttgaggtctgcagggcttggtgttcatgtggcctcctgtggcattgttacccctgtggcaccatcgcctgggaccgcatggtgcgatgtgcctccagccatcccacccgcccctttccctggctcttcgtgcaggcatgtccaccttcagcaccaagggnnnnnnnnnntatctgcagggcttggtgttcatgtggtctcctgtagcattgttaccctgtggcaccatcgcctgggaccgcatggtgcgatttgcctccagccatcacacccgcccctttccctcgctcttcatgcaggcatgtccaccttcagcaccaagggagggctgtatgagcgagcgcagaagcgtttccgggtggtagacggcaagtccctcttcacctacgccttctacgccaagcacccccgccccgctcaggccttcctggcagaggtgcatggggaggcggtgcgcgccacgccggcccccggccactacgcgctggcgctgctgtgcagcctgggccgcctctcgcggcactacaccctgaacatcgacggcctgagccagcgcgcctcctccgccttctcctacagcaaggcctgcgcctggcacccagacgacaacccgggaggtgcgtggtgtacttgcatgagcaggtgtgttgatagtcgagctcccgcgggttccctcctgtgcagagtgnnnnnnnnnncgagcgagcgcagaagcgtttccgggtggtggacggcaagtccctcttcacctatgccttctatgccaagcacccccgccccgctcaggccttcnnnnnnnnnnccaaggcctgcgcctggcacccggacgacaacccgggagcaagcgtggcgtcatcccctcatcacccacccccctcacatccccaggcctcctggtggagctgcacggcagcatccaccagttggtgtgcggcgcctgcggcgcgacccggcaggccgcccctgcccaggtgtccacgctgagggcggagggccgcgtcgcctgcccctgcggcgacccggcgggcatgcgcttccgggtcatgctgtacgacgacgcggagggcgagcgcatcacgcccgacgccgtgctggacgtgatggagggcgacgtgaaggccgcggacgtggtgctctgggtgggcatctccttccagcaatcagcctccacgcactacttccgctgtgtgcggcgctggctggccgaggcggggcgcacgcaggcctgcccccaggccgtggtcaaccccagtga

SEQ ID NO: 2677 - DNA, 648 bp, Chlorella protothecoides
atgagcgatgaagattttgctctgctcatgcagcagcaagagctagtcaggggctttggaggcgttcccgtgggggagccgggcggctacacatctgcaacagagtctgcagagaacgagggcgactaccatgacgaggagtacacatacgaggagctctccgctctgggggaggttgcagggaccatcagcaagggcctgagtgcggaggccttggcggccctgcccagaatgtcatgggcggaggcggcagattcgcgaagtggagccctggacaccatgtgcacgatttgccagctcgaccttgaggcagaggaggaagtgtgcctgttgccgtgtggccatacttttcacagcgagtgtgtggagcagtggctcagcttgaacaaggcgagcaggaagagggaagtggaaagattgatgcttgtccgttgtgcagcaaggaaatcgagtgtccatctgccggctgaggttcgatggaagaagctttgtcatgcggcgctggagcggctggctatctgtggccacgatcagaccgcacggaagatgaagggcaggtggcccattcaaacagagaaaagccatgcagacccgcgcgccctccaacaaatccctgagcgatcagctacgtttatcatgcggtgttga

SEQ ID NO: 2678 - DNA, 1857 bp, Chlorella protothecoides
  modified_base (1628)..(1637): a, c, t, g, unknown or other
atgcccgccatgggaacgtccgatggggacaatgagtacgagaggcagcgccaagagcgtgtgaagcgcaacagggagcgcctgagtgccttggagatcccagtattggcggctcgagtggctcccaaacctgccagaccgaggcctgctgttaggccagccaagaggagaccaactgtggagagtgcgggtcccaagcgacgatcggcccgggtggccaagctggaagcagatggcaatcagatagagtcagaggagcgagggcgaatcgtgacctccatcatgcttcccaaaccagatcccgtaccagcagaacgtcaccccaaacgtgagcttggattaggaagtattacatttgctgaggatcctgctgacaagtatctcccgggtctctccccaggggacctcgccatgcaggagatcgacggcctggcggccacagatgcggcatacatcagcgcatggagctctcggttgggcacaggacctggggttggcatggagaagccagagcccagcctgccctggctagcctccctgcagctggatgccgttgatgtggccaaggtcacacgaagcgccaccacgcacctcgccttccaccccaccagtgagaccctgctgctggcagcgggggacaaggagggcaacctctccctctggtactgcgccgaagcggcgcaggccctcgacagagcgtcgtcgcgaggggatgcagggtcaagcgagggtgagctcagagtctgggcgaaagagggagccgagcttgcacgggagggcgggtcgagcgaggcagcgacgtcaggcacagcggagagcgaggcggagtttgacggtctggtgagcctggggtaccaccggcagtacatctccggcctgcgatgggcaggagggccagggcacggcgccggcctgttctctgcctcgtacgacggctcgctgcgtcggtttgaccctggcgcgggggcggccatcctgctgacctcctctgaagacctgggtttctctgccatggacatcaccctggatggcaggtgggggctgtgggctggctcttcagcagacagagatggggaggggagggaatcatggtgggaaaggagcgaggatttggtaggcatacccggtctcctgatcggaccggtggcacatgctctcacaaaaggcctgccttctcggtcacagcccccactcaccacccggcctactttctcgctccacagaaccgctgtgctgggcaccaacaggggcgacctcctggtggtcgactgcagggccaaagggcctggggtattgagcgaggatggccacgccaagaagataaataccgtgcactttgaccctggcgacgagcatgtgcgtggaggggcaggggggccatgttttgtgccttgccatggggaggtgctgtgcggaggcgtcggcccctcacaccgagagccctcaactaattatcctctgcgacccctgccagccccccttctctccaccccgggtgcaggtctttgccacatcctccaccgacacctgtgtcagagtgtgggacgtgcggcgcctgggcccgaccccaaaacccgtcgcggagggcgcacaccgttccagctgccaggcagcgcactttgcgcccnnnnnnnnnngttttcctctgcgacccctgccagcccctcttcttgcctccccgggtgcaggtctttgccacatcctccacagacacctgtgtcagagtgtgggatgtgcggcgcctgggcccgaccccgaaacccatcgcggagggcgcacaccgctccagctgccaggcagcgcactttgcgcccgacggtgcggagggactggggtggaggtcgtgggtgcatgtga

SEQ ID NO: 2679 - DNA, 1623 bp, Chlorella protothecoides
  modified_base (63)..(72): a, c, t, g, unknown or other
  modified_base (1340)..(1349): a, c, t, g, unknown or other
atgcgcacgatgcggacctgtttattttggggagaggagaacgccggtggacgatccagcgcnnnnnnnnnngttgaagatgcgcacgatgcggacctgtttgttttggggggaaaggagcacgccggtggacgatccagcgtgcctcaggggcggagggcggggtctgcccgctgcacacgctcaaatctgtggcgccaggtgttagggcagattccttcaacacccctcccactcctctgccaatcgctgatcccctgtgtggcgtctcacaagcaaggcccgacgacgccaatccatccaatcgccccctccctcatcgtcttcctcttccctcccctcctcccctccccccccgcccaacccccactattcgcgccacctcacctccaggttatgctcgcggtggtagtccatcgtcagcgtctccgcggcgcgcttgccctcgtcgtagcaggagcgctcgccgatggggttcacgttgccccagtaggcctcggtctgggggtgctccagggggtcgccgtagacctcggaggtggaggtgatgaggaagcgcgcgcggcagcgcttggccaggcccagcatgttcagcgtgccgatgaagctggtcttcagcgtcttgatggggttatacttgtagtgcacgggcgaggcggggcaggccaggtggtagatctggtccacctccagcagcagccgctccaccacgtcatgcctgggcggggagaagggtgggagaggggaccgtggtcaggccccgagctcatcacacgcagccggccagccccgaacaaacactcgacgctctgcgtctcctcacctcagcagctcaaagttgggcttgtccaggaggtgggcgatgttgtccttgctccccgtgaagaagttgtccacgcagatgacctgggcaggcccaggagcaggtgcatggtgaggacatgtccaggtggttggccgggggccacgagcatagtgcgatgcgctggggcaccagctgcgatgctggccacccttggacgacacatcacccacttcatctcactaaagcgaatgtcatgctcacatgatcgccccgggccacgagggggcagtggcaaacggcacctcatcggttacgcccgcattcgcggttgcgcatcacacaagtctcctgtgacacttaatttgagcatgcacacgcacctggcgtttgggaggggtgtcggtggccatcgcaagttctggagtgcacgaggtgggaggcatgtctacttgcaccatttgggaacatgcacgcgctgggggggatgtcgcgagggggggacgttcacatcacatgacaccgcctgtcacaggtnnnnnnnnnngcatgtctacttgcaccatttgggaacatgtacgcgctgggggggatgtcgcgaggggggatgttcacatcacatgacaccgcctgtcataggacacattttcaaaccttcgaaggacaccgagacggcattcccaaccatcatcgtcgccttgaatggcatgtgtggtctgcctagacagctcttggtggtcaagcctggctatcagaagggagggcagtcgcccagccgcacaccgatcagatggcacatcaagccgactgttcaacgatag

SEQ ID NO: 2680 - DNA, 990 bp, Chlorella protothecoides
  modified_base (589)..(598): a, c, t, g, unknown or other
atgtgccggtgtgggagggcaccccgggcggagtatctccgcacgctgcctttcccaggccgcgcttccatcaccttctgagaggaggtgtataggatccgcgatgaggtcggccttgctcttcggagccgctctggcgctcatcctgctgataccaactcaagtcaccagcgcacaaggcgtacgccgcacaacgccatttccgtcgacatacccctttccatagacgcgttgtcgtgggagaccctggaggagctgtgcggcacaaactactcgagttacgagccagccttggaattatatggccccatgcaattcttggagatcccggatgtggtgatagcctattaccgtttcggaaatgcatcaaccgagctcccccctattgtccttgtcgtgggtttctccggcacaatgaaggactggcccatcaccatcctatctgatctggcagaggacagggaggtcatcatcttcgacaaccgtgggcagggctcctccagggcgttcggcgcacaacgctatttccgtcgacttacccctttccatagacgcgttgccgtgggagaccctggaggagctaggacannnnnnnnnnggaacggggatggggggtctcatgcccctgcaccaacaccaccacctcgattgcccacaacctccacgggtgcattgagttgcctggggcgccccacccctcatcctgcacgcctcgccacctccctgtccaccttcgccactgccaaaccccaggccctggacctggccaggccgccccacctcttcggctggtccatggggggcatgatcaccctgaaggccgccgcgatgtttgccgactcctttgaccgctttgccgtcttctctggtggtcctgggtccctccgctcccagctgccctcccttgagatcctggagaagttcctcctcgaagacaccatgactgaggtgtacaggctcggcacgctgtttcccctgaatacgacatcc

SEQ ID NO: 2681 - DNA, 387 bp, Chlorella protothecoides
atgcctaccccaaaccccgccgcccacgccttcctgggtgggttgcagtacttggagatccccaatgccgacatagcctactaccgcttcggcaacaacgagaccggacgccccgccctcatgttggtgaacggcctaaactccgtcatgggcggttggcccttgcgcctcctccgtgccctggccgaggagcaggaggttttgatcttcgacaacagggggcagggcctgtccgtggtgagtaggggtttctatgcgcgaccggagcaggttcggcgaaaggatcgcctggcccatgattccggagccgagtactctatgtgcagcaaacgcccaggcccctcattttccctccctcacaggacaccaactccgccgcgccgctga

SEQ ID NO: 2682 - DNA, 720 bp, Chlorella protothecoides
atgggcggcatgatcacgatcaccgccgctgcgttgcacggcgacaccttcaaccgtttcatccccatctccggcagcgccggcggcaactcctccctgggcttcagtgaaaagatgatgcactccctcacccacctcgcccagatggacctgtacgacctgatggacatgtacttccccatgccccacccactgggtgagcagtcgagggaggggggaggggggccaggcatgtggccggcggggcatgggttcctctattgcggagatcttgtgccggcattgcagtgcaccagtcttgtggctggggctcgagtaccccactccaacgacagcccacaagaatcgctccccctccctttcccgccttccccgccaggcctgctgaccgcctgctggtacaccatggaggccttcgaccgccccatgatcccgaccaacgccaccaccaccgcacgccagatggaggccatcctggacttcttccaggacgaccaggtgtacgacctgctgcccagcatcaacagccgcgtgctggtggtgggcggcgccctggaccctgtcatccggccccagaaccagaagctgatggccaagcgcctgccggcggcctggatgaccatgttccctgagggtgggcatgccacctacgtcgagtactggtccacactggtggacgtgctgaatgtgttcctggggcgggacgcagacgagctttaa

SEQ ID NO: 2683 - DNA, 729 bp, Chlorella protothecoides
atgcggtccgcggtgttcttttgtgcggcactggcgctggccatgctttgcccgtctcaagccaccagcgccccaggtgaggacaaaagcatggctgccatgccagatggtttgcatggatattccacgtgtgaaaatgatggcttgtggactgggcgtatgttgtgggcgtttgtcgctgattgccggcagcgccacacctcaacgtccaccgaagcacccctccccgcagaggtgtggccgggggagaccctggaggagctgtgcggctccaactacacagactacgacactgccaccgagttctacggccccctgcagtacctggagatccctgatgtgatcgtggcctactaccgcttcggcaatgcctcctcagagctggcccctgtcgtcatggtcatggggttctccggaaccatgaagggctggcccatcagcggctggcccatcagcgtccttgctgacctggcagaggacagggaagttatcatcttcgacaaccgcgggcagggcttctccacggtgagaaggctgggtggcgtggggggtctgtgctctgttccggtgtcttccttgccccaggggcgacatgatgtgtcggaggccaactggctgtacttcaggcctgctcaatcctggaccatccccaactatgacgcaggacaccagccccgacgtgcccctgagcatcctctcaatggccaacgacaccaagaactttgttga

SEQ ID NO: 2684 - DNA, 234 bp, Chlorella protothecoides
atgcagtactttgacgactccaccatagacgcgctggtcgacaccgagcgtcacatcctggtcattggtgggctgttggacatcgtggtccccgcccagaaccagaagcttgttggccaggtcctgccttccgcctggatggccatcttccaggatagctcccacgccaccttcttccagcactggggcacgatccgcgagctgctcgaggtcttcctgcagagggaggagtag

SEQ ID NO: 2685 - DNA, 291 bp, Chlorella protothecoides
atggtgacggtgatggacaacgacgagcacaaggggcccttcaatgtgggcaacccgggggagttcaccatggtggagctggccgagatggtgaaggaggtcatcaacccccaggccgaggtgggctcgatgtgtgtggccttgttttggcgggtggggtacacaggcttggtgcactgggcgagggcgcgtctcgagagggcaggtgccgaggcgacagcctcggagctgggcctggtgcgggggcagactgctcgaccatgtggccgcacgccggcaggacctccttga

SEQ ID NO: 2686 - DNA, 360 bp, Chlorella protothecoides
atggccctggacgacgggcgcgtcgtctcaaattttgtggcccaggccttgaagaacgagccgttgacgctgtacggcgatgggcagcagacgcggtccttccagtatgtcgaggacctgcagacgcggtccttccagtacgtcgaggacctggtcaggggtgagcggggttgtgcatgtggcggggggtgtggttggggaagtagcgtctggtgggtgtggggcgtggtgcatctgccgggcgggggagtacgagggggtggggtgaggagagaggaagtgggatgcagctacgagctgtaccccgcctcctcgggtgcgtgtgcgaatcgcatcccagaggcgatgcacgaggcttga

SEQ ID NO: 2687 - DNA, 2991 bp, Chlorella protothecoides
  modified_base (147)..(156): a, c, t, g, unknown or other
  modified_base (1194)..(1203): a, c, t, g, unknown or other
  modified_base (2663)..(2672): a, c, t, g, unknown or other
atgagaaaggtcacgtgcatggccttggttggagactcgagtcacgccaccccacaaagcgagcgtctcgcggaaagacgggcgcatgcaggggatgagtttttgcagggcaggcgtactgtgtcgagtttggcatggcaaggcagnnnnnnnnnngaggtcacgtgcatggccttgctcccagggttatcgaaaatggaaaatggaaatgttcgattatgagatactcatggtgaaagagctcactcaagcgccaagttctgtctatggcatgcagaaagcgggagttggcacagatgtataccagatccattgcacgtccaatgtaaagcctacactgtaacgtgctgtgaacgtaacggtaccaactccacttgcattttgcgcaggctgcgcttggttccacacttgctcagcccgcccacaccattctcactgtgcgctgggtgtgcctggccccgatgggctactgccatgtcagctcgaaatttcggagtcgaatttcggaaatgtgattttcccgagtatttcgcgccgttttcctcgaaacccgcaatttcggtgccctgcttgctcccactccctgcgggggcacgccaccccacaaagcgaggctcgacagcatggggaaggaaggagacagacgcatgcagggatgagtttgcaggggagcatactgtgtcgagtttggcatggcaaggcaggggcgggggtggcgccctgcctgcacggaggggcttgctagtagggggggtcagtgcgcctcgactcgtaccgctcagaacaagagacaagggcacacacaggcggttcaactgggagcatgggtcgagtccatttttcaaatctcatgcgctggcgggaggggcggaaggggatgggggtggggcgatgacatgccactccagccagacccaagccatcgtccggccaggcaggaagaaggggaaggatcctcaccggtcgcgcttggaaaatcataaaaccgtcccagcccgtgctggcagcagcgcgccggcttcaggctcagggaaggatcctgccctctccgccgcgacgcgacagagtgtcgctgcgccgctcagatggcggtgccgcccatggggccgtccttggccttctcccctgcgtcggcgtcgcgcgcagccttggtggcggcgcgcgaggcggtgcgcgtcgcgtcgcggtcgatgnnnnnnnnnnatagcgcgccggcttcaggctcagggaagaatcctgccctctctgccgcgacgcgacagaatgccgctgcgccgctcagatggcggcggtgcgcgtcgcgtcgcggtcgatgatctgctgcgccacctcagcgctcatgatggggcgccaggccatgtgccgcgcaaaggtgatgggcacgcgctccacggggatgcccttggtctcgggcatcatgaagaagatgaagacggtcatgatggccacgaaggaggcaaagaagataaacacgccccacttcatggcgcagagcatggagaggaaggcctggccgatgacaaaggagaagaggaagttggtggtgacggccaccgacatccccgccgcgcgcgtctccaggttgtggatctccgagggcaccagccagcccagtgggccccaggaccaggcaaaggcggagacaaagacgcagaccacgatgagcacgccgatggcggtggcggtgggcaggtcgccgtcctcgtacttgccaaactgcacggccagcacgacgccggtcacgatctgggccaggaacatctgcacaccgccctccaggaaccagaagcggcgacccaggcggtccacggtcaggatggagaggaaagtggccacaaagttgacggcgttgatgatgatggtgttcagcagcgacgcgcggcgcccactccccagggagttgaagatgacggggacgtagaacatgatggcgttgatacctggatgagtgtggggcgaagggggaacacttcagcgagggagtgtgacggggcctggcttgggcttcctggcttacggtgcagagctagatgcccagagggggtgcggcaggccccttccattgcacccttcatcccacacgctggacgctctacccaccgccccgttccatcgcacccttcatcccacacgctggccgctctacccaccggtgaactgctggaagaaggggatcaggcaggacaggatgagctgggggcggtaggccttggtcagcagcatggtgtaggactggcgcagggagacgaggctggccagctccgtggcctccaggatgtcctccatctccgcctccacgtccttggtgccacgcaggcgctccagcacggcacgccccttctccacctgcccacgctcgatgagcgagttgggggattcgggcagcacgatggagccgaccaggaggccgagggcaaacgcggcggccaggcccagggacaggcgccagcctgcccaccagtcctggaccccataattgaccaggccggcgatgaggatgccaatggtggtgaacagctggaacagcatgttcaggccaccgcggaagttgaagggcgcgacctcggacaggtacagggggaccacggtgttggcgaagccgatgccaaagcccaggaaggtgcggcccacgaagagcatggccaggttctgggcgccggccnnnnnnnnnngatggtggtgaaaagctggaacagcatgttcaggccgccacggaagttgaagggcgcgacctcggagaggtacagggggaccacggtgttggcgaagccgatgccgaatcccaggaaggcgcggcccacaaagagcatggccaggttctgggcgccggcctgcaggcccgcgcccaggatgaacaggcaggcggaggtgaacatggtggccttgcgccccagcttgcggcacatggtgcccgcaaagaaggaggagaacatgccagccaggaacatggtggaggtgaaggtctgcaggacctggttgtcgtacctgtag

SEQ ID NO: 2688 - DNA, 909 bp, Chlorella protothecoides
  modified_base (441)..(450): a, c, t, g, unknown or other
atgcagagacaaactcacactccatctcactcggtgatgtctaggatgcccccctggatctttcaatgtaccgtctgcctgcccccgtcgccccacccccgacccatttccctttcccgctcgcagatgggcgcggggctgcgcttcctggacgtcggcggtgggctggccgtggactacgacggctccttcaccgactctgcggcctccatggcctacagcctgcaaagctacgccaacgacatcgtatcggccatgcaggcgggtggaagcagagaaatggggttggcagggggttccataacacatgctctagaggtccctggtcgccggcgtcgccgtgggcggcctggtcttgcccccgcctgcatctcctgcttcctccccatcccttccggacattatcacctgagccacctcccccttccttgccccaaacannnnnnnnnncgtatcggccatgcaggcgggtggaagcagggaatgggagtggcggggggtaccacaacacatgctcgggaggtccctggtcgccggcgtcgtcgtgggcggcctggtcttgcccctgcctgcatctcctgcttcctccccaacccttccggacattactacccaagccacctccccccttccttggcccaaacgcaagcaggaggtgtgcgtgcaccgcggcatcccgccccccaccctgatctccgagtcgggccgggcggtggcctcccacgccacggtggtggtgttcgacgtggtcaaccaccctgtccgctgcgaggagctgcgggaggaggaggaggaggtggtggacagcgtggagttcagcctagacaggccgctgaccaagcagctgaaggccgccgccagccggggcaaggggcggtacctactgaccaccttcaaggaggtgtttga

SEQ ID NO: 2689 - DNA, 2499 bp, Chlorella protothecoides
  modified_base (582)..(595): a, c, t, g, unknown or other
  modified_base (808)..(817): a, c, t, g, unknown or other
  modified_base (907)..(916): a, c, t, g, unknown or other
  modified_base (1148)..(1199): a, c, t, g, unknown or other
  modified_base (1420)..(1429): a, c, t, g, unknown or other
  modified_base (1906)..(1915): a, c, t, g, unknown or other
  modified_base (2349)..(2358): a, c, t, g, unknown or other
atgctcatgggaccgctgccctggactaaaatcagcaccctaactcatcccaaccctctcaatctatcaacagaatggaacggtgaagagcgtgaaggctctggtcgagagcctgaacagcttcaaggtgcccggccccgagagccaaagtctgtgtcccaacccaggcatcccctacccccacccccctctgaaagatgtcgtggtggcacccaccttcctgcacatccccgccgtcgtggatgccctccgccccgagttcaaggtggctgcccagaactcctgggtcaagggcaatggcgcctacaccggcgagatcacggccgaccagatcgccgacctggggctggagtgggtcatcctggggcactccgagcgccggcacatcgtgaaggagtcggacgagctcaccgccgacaaggtggcctatgcgctgtccaagggcctctccgtcatcttctgcatcggcgagaagctggaggagcgcgaggccaaccagacgcaggaggtgaacgcccggcagctgcaggtgagggataccggggtcctgctggtatgggcagactggcaggtgtcagggtnnnnnnnnnnnnnngagcataccagaggctgcagtcgatgctcatcccccccacacacacttgtcaaaggaggtttgtccaccgctcatctccctactcatggacccccatccacacccaccatccgccatccacatccctgacccccactcctcgccaggccctggccgacaagatctccgactggagcaagattgtggtggcctacgagccggtgtgggccatcnnnnnnnnnnccgtctgtccatgggcgtgtggaatgctgtgggccatagcggctggcactccgggcatgcatgggatgatcactggcgcacagtgcatcnnnnnnnnnnaggaaatttggcattgctaccaatgtctgtctatgggcgtgtggaatgctgtaggccatagcggctggcacttcgggcatacatgggatgatcactggcgcacagtgcatcgggcctcaaacatcccagaggctgcagtcgatgctcatcccccacacacacacttctcaaaggaggtttgtccaacgataatctccctaatcatggacccccatccacacccaccatccgnnnnnnnnnnnnnnnnnnnnnnnnnnnnnnnnnnnnnnnnnnnnnnnnnnnncaggctcacgccgagattcgcgcctggctggccgagaaggtgggcaaggacgcggcggaggccacgcgcatcatctatggcggctccgtcaccgccagcaactccaaggacctggcgggcgcggccgacattgacggcttcctggtggggttggagtgtgttgtttgtgtgtgtgttgcggggagggggtgggagcaaagggaatttgattggatgtgctnnnnnnnnnncgttgtttatgtgtgtgttgtggggagggggcgggagcaaagggaatttgattggatgtgctgtgggtgggggagtgctcccagacgcatcatccagacggcgcactaaccgggtcgctgtccccgtgctggcaggtgggtggagcgtccctgaagcccgagttcgaggacatcatcaaggcggctgccaagtgagctgcctttacaatacccacttggcccatatcctgagcggttgttgtcaaagttttccgtcctgtggatcttcgtttctcgatacatgcgtgggagttcagggacgtatgcaaatcgatcgacatgcgtgggagtttggggaggtgtgcaaatcgaacggtcaggtcggggtgcagtcggttggtcggtcaaatggttgtcactcagtgcatgtatgtgtgaggtatcggcaagacagcaagcaggcgcttcgtgcctcgcggtcgtcacacttgctcggtnnnnnnnnnntaaatggtcgtcagtcagtgcatgtatgtgtgagggtatcggcaagacagcaagcaggcgctgcgtgcctcgcggtcgtcacacttgctcggttgatggtagatggggtcaggaaagggtggccaaagcatgagatggagctagggtcgggaaagggtggccaaagcatgagatggaggggtgctgcagtgcctgttggtttgacagaaaccggctcctgggctcccggggagctggctgcaacatcccgtcactcctcgtgcccgtggagcgtgcagccacattgcgcctggccacccagaagcaagggcttcgtgtcgtcgtcgaccgcacgcgcctcggcgctcctggcgctggaactcacgggagcacaccgccctggcggcgcacccccgcccgcccggcggcccggcgccgccgccgcggcgacccgnnnnnnnnnncagcaagggcttcgtgtcgtcgtccaccgcgcgcgcctcggcgcccctggcgctggaactcacgggagcacagcagcccggcggcgcacccccgcccgcccagtgccccggcgccgccgccgcggccacccgggcccgcac

SEQ ID NO: 2690 - DNA, 723 bp, Chlorella protothecoides
atgttctacgtccccgtcatcttcaactccctggggagtgggcgccgcgcgtcgctgctgaacaccatcatcatcaacgccgtcaactttgtggccactttcctctccatcctgaccgtggaccgcctgggtcgccgcttctggttcctggagggcggtgtgcagatgttcctggcccagatcgtgaccggcgtcgtgctggccgtgcagtttggcaagtacgaggacggcgacctgcccaccgccaccgccatcggcgtgctcatcgtggtctgcgtctttgtctccgcctttgcctggtcctggggcccactgggctggctggtgccctcggagatccacaacctggagacgcgcgcggcggggatgtcggtggccgtcaccaccaacttcctcttctcctttgtcatcggccaggccttcctctccatgctctgcgccatgaagtggggcgtgtttatcttctttgcctccttcgtggccatcatgaccgtcttcatcttcttcatgatgcccgagaccaagggcatccccgtggagcgcgtgcccatcacctttgcgcggcacatggcctggcgccccatcatgagcgctgaggtggcgcagcagatcatcgaccgcgacgcgacgcgcaccgcctcacgcgccgccaccaaggctgctcgcgacgcagacgcaggggagaaggccaaggaggggcccatgggcggtaccgccatctga

SEQ ID NO: 2691 - DNA, 243 bp, Chlorella protothecoides
atgaaaggggacggcgccaagtttggcctgcgcgcccgcgagatcgtggccgctgtcggggagctggccacggcgggcatgctggactgcctggtgctcctccacttccacgtgggctcccagatcaccaacatccgcatggtcaaagaggtcatgcgggaggcgtctttcctctacgctgagctggtcaaggcacgtgcgggaaatgaggtggagggggaaggctggtgcgcatgtgggtga

SEQ ID NO: 2692 - DNA, 381 bp, Chlorella protothecoides
atggactgtgctgcaggggtcgagcggaagttacagtccacgggttgtggctacccctcacgagccagccagctctatgacctggacaccacctcggccgcgtccagtggagacctgctcctggacttcaagccggtgaccagtgaggctgatcttcagagcagtcgcagcccctcccaggctcgccagctagggctttcgccggcgctgggccgggagggatccacctggagcaccgaggcctcccgggcgctttacaacgtcgatggatggggttgtggctatgtcgacattgccgaggaggggaacctggccatccgccctttgggaggtgggcgtggagggcagccctacggccagggggaacatgaatttgtgtga

SEQ ID NO: 2693 - DNA, 2007 bp, Chlorella protothecoides
  modified_base (192)..(201): a, c, t, g, unknown or other
  modified_base (1058)..(1067): a, c, t, g, unknown or other
  modified_base (1987)..(1996): a, c, t, g, unknown or other
atgagctaccggcgtggaaggacaacggctcgatcgtttcggacgtccgtagaagcactttatgccgaatacttagagcgttgtagcatgtcgatatcctacgggcggttgctcatcgtgggacgggagggcgctccggaagtcgagttccctcttgacaagaagctcgtgctcattggaagggatcagtcnnnnnnnnnntgctccggaagtcgagttccctctggacaagaaactcgttctcattggaaggtacgctgctcgtccgtgtggtggaacacgtcctccgttgtcaatgtagtaagaaacaacagtaatttacccctttcggtgacgcgcagggatcagtcctgtgatatctggattcggaaccgcaccatctcgaggaagcatgccgaggtctttgtagacgatgccggggcgtggcactcactggctcccttgggccgggagcggtggagggtcccacccagcagcacagccttcctttcaaggctgcgaaccgacagagtaaaccccctgcccctccaccccttgccgcaggtgttcatcaacagcctggggcaggacccggtgtgcctgaactcccagccggtgaccagccctcaggagctgttctccggcgataggattgaggtgcggctggatgaccgcacccgcaccttcttcttccagggcgacgaagagaccatcaaggtgcaggcacccacgcgggccctgcagcaggccaaccgcgccgtgccccaagccgcccgggccagtcccaagcccgcgtcagcccgcaagcgcacccgcgcctctttggccccgtcaggaaaggaggacgtggcgccggcctccccaggcaggggcccaggccccgccaagcgaaggggtgccggggcgccgcccccgcctccaccccccctcccatccagccgcacactgggcagagcggccctgggtctgacggcgcctagcactctgaccgggccagcctccagcgacgcgccggcacctgtccctggtgctggccaacccccagcgtcgaggccagccccgggccctgcacgcttcgnnnnnnnnnncccccggcgctggccaacccccagcgccgaggccagccccgggccctgcacgcttcgttcccagcgccgcagacctggtcgcactcaaggccgctgctcggcgggtggtgggaggggggaaagggggggcctctggttgggtgtctgccgggcatttggcagcctcttgactcgcaagcagcacgaggacatgaggctgaggaaagctgctgggtccgcacaggcagacgtccaggcagcgagcgacgccgtcccgccggcgctcttgccagagacggtgcctggcgcggagcccgccgtgccagctcaaggtgcccgagatgtggggctgaagtcgccgcgccagcccggcgccgccagttccccgctcacgacgctgaatacggggaggaagacgcccaagtccacggtccggcgcaagagcgtgcgcttccaggcggaggccggagggacgccggagggcgcccctgccgacgtcaccatcacgctgcacctgcgccgggggggcctggttcgggccgtggatgtggacggcgccctcgacaccctggcgttctccgagtggggcctgggcagcatgccggccgaggggcgcggcgcgggggctggccgctcggtggccgaggcgggcgctgctggaggtgatggctctgaggagggcctgcctgccttcgaggacggccagcctgaagctggtgagggtcgggttccacctgacgccctgaccgccgccgtcaatcagccgggcgaggccctgctggcccttaccttcccggcctcggccagctcagacaacaaagaaaccggcacggtcgccgatccggcgtccgtactccctccgagagacccgatctggaccccagggggaccctcacagacccccgcgacacagctccggcgcttgctccccggcaccctgnnnnnnnnnncggcgccctga

SEQ ID NO: 2694 - DNA, 843 bp, Chlorella protothecoides
  modified_base (532)..(541): a, c, t, g, unknown or other
atgcgctggatggagcagtgcgcgttcgtggcggcggcgcgcgtcgcgcgcggggcctacctgctcaccgcctccatggactccatcgcctttgccgcgccgacgcgggtgggggacatcatgtacatcgaggcccaggccaccgccatcttcggctccagcgtggaggtcatgatcagcgtctgggccgagacgcccgaggcggggggcctgttcgagtgcggcgacgcctacgccaccgtggtgtccatgaacgagtccggcgtgccccaggacatccccttcgagctggcgccggacacccccgaggaccacacgcggcacgcgggggccatccgccgccgccgcgaccggctgcagatgcgggaggccatgcgccagaccaagcgcaagcggaaagcgctggatggtatgactgaccgctggggctccaccgacgacttcctctcccacgcgctgcacgctggcagcggcaacgacagccccgggtcaggcccggcctcgcgcgcccgaaccgagcacgaggctggtnnnnnnnnnncagccccgggtcaggcccggcctcgcgcgcacggaccgagcgcgaggctgggcccgaaggaggtgaagaggagggcggggcgtgagaccaccatggcgtcgtcctgtggatgctgcgtttggcagaccgacgccgcactcccccccccacccattcccctttgggcaatcccgctcagtatcagacgcccgcctacccgctgcgcttgcttcttccccctttcttcccctgccgcgcccttgcctcctgacattcttcatcgccccatggtagtgcccctctgtaaggccggccatctgtag

SEQ ID NO: 2695 - DNA, 1731 bp, Chlorella protothecoides
atgggacatatgcagtggatgacgccctccgcagtggcacaacccctcctcatcatcggtacccttcacatgagcagaccgccggcgcaagcaggagacgcagaaaacaggtcgagcgagctgtggagtttgcagggccagattctggcggatctgagggctcagctgcagcaggagagggaggccaggagcctggaacgtgcggagtggctggcacagatgacggcgctgcacgaagagagccgctccctgcgtgccgaactcctgtcgctgctgggcaggcatgtggcgggagcccacgacgcacatgtcactgcggtggaggcggcgcgcagcaccaagggcggcggcgcagtccttcctgcatcctcccctgccgctgtgcctgacgacgatcgctcggagactgaggtgccgcagcctgctcccacttctccacccatgagcagtgaccaggagacggagcgcgcgccctggaaggatgacctgcgccttgccctggcggcctcggaggacaccgacatcctgagcatccccgccgagaactttggcgactacctggcttcccggcggagggccggaaaggacgaggcggcacagtctgggggtgaaatgtcgccggagcatgctgtgtcactcccaaccatggcggcacagccagtggccaagctggatcttggcccctccgaccctgcccgccctgccgccccccctccaggccctcccccactgctgcgggagggcgacgacgacatctcctggatgaatgctctgcactctgcgatggcagaggccgggtatcacgccggcgaggacgacgaggaggagtggtactttggctccggcaccaccagcgccctgctgacgctccaggctgcacgtcaagagttttacgcccctcaccgttccttgctttccttccaaatttcaaagcaggcgtgcgagggtctggaggagacgggcgtggcggacgaacccacctggcgcttcctgctgggcgatgcttacgacgcgatggtgaacgcctcagcgcagggcaaggctgggccccagtcgggcggcgtcggccctggcgccgacgccggcgacgcagaacccgagctctttcttgaggcggcggagctgggcatcgatgcctggatcctggaggaggacggcccccctccccccggcacccccccgcccggccgggagaggggaggcgggggcgacggcgagcggtggcccatcctgaacgagggggacggcggacgagaggtgaaggccatgcagatcgcgctggacggcgccggtttcttccccggcactgacgacatgcggtggtggcagtttggcagctcctccatgcgtgccctggctactttccaggttccaagtggtgtgccggctctcggagcagagccagcgcacccacagtgcgacgctgcagaggttccagtcccaccccccctggccacccaaccctcccgcgcaggcgtgcaatggcctgcccgagagcgggaagtcggcgctgtgggggaggctggcgtgaggttcttcgggcaaggctgtgctttgtactcactgcatgctgcaatgcgcccatgccacagagcacgcggagggtgcagaggacgaggacgatctggcagggggccaaggcgtgtggctgcttggggaacagcgctgggagaggccaggcaggctgaccaaggattgacagcccggcggggagcatttgagaggcgttga

SEQ ID NO: 2696 - DNA, 3363 bp, Chlorella protothecoides
  modified_base (1454)..(1463): a, c, t, g, unknown or other
  modified_base (2380)..(2389): a, c, t, g, unknown or other
  modified_base (2582)..(2591): a, c, t, g, unknown or other
  modified_base (2907)..(2916): a, c, t, g, unknown or other
  modified_base (3169)..(3178): a, c, t, g, unknown or other
atgtgccagcaagtgggcaagcgccgatgcgatgttgacaattgcgcatcgcgggtgcatgccggaatgcacacgctgagtgagtattctaaattggatacaacgcacacgccgccatcgaggagtcctagcccctcgcgcaaagattgcattgactgcgacaccctgctcactgggccggcatgcaggccgaggcctgtgccgcgatcgtcagcgtgcctgggtctaggtacgccatgggtgcactcgagcagtgcatgggatttgtttgggccggatgcgagcaccatgtgtgcctttgtttggaggggttgctggcccgaaggcctccccggcaactcatcaagaccgcttccccctccccaggctgagcctgtccgccgagcaccgtgtgaggccggtatttggtacaagagtgtcgaaggagaggaaggcgggtcaggccgaggtcctcctcgccctcctcaggtgggcgcctgtgcctgcgtagtcctgagaggctgcatgcacaacccctgcccgctctgggagaccttgtcatgctgtcctcatccctctccaccctccacatccatccttgctccaggcgacatgcagcatgggtgggcctcgccgccccactcctgctccaccccccggcccccgccgccgcctcctgccccgaaccttggcagggcggcggtgtgccgccgccgcacggcagcggcggcgactgcaggcccgtgcgcgtgcaggggcccgaggaggtgctgggacttgtttgcaccaaggggggatgggtttgaaggtgtggtgagcttggcaccgggttgtcccgcgcgggccagcaaggcagccgcgccccaaggtacgccttgtccaaacccatcctgggcagctgatctcctgggcctgatgatacctggccctgcatccagttgcccagccatgctgcctctcacacacacgcatcatggtgacactgcccccacacgctcccccccgcagatcacccagatgttcatcaagcagtaccgggagcaaacgggcgtggacgtccgcttccggctcagcttcggcgggtcgggcacccaggcccgcgccgtgatcgacggcctgcccgccgacatcgtggccctggctctgcccctggacgtgatcaagatcgcagaggcgggcctgctggaccccgactgggcgcccaagttcccgcaccagagcatcgtggtggagtcggtggtgtccatcgtgacgcgggcgggcaaccccaagaacatcagggggtgggacgacctcatacggtgcgtggtggtcggggtttgggggagggaggggggctgcaggcacactgatcccggagatcgctgccaggtgcgcggcggcgctgccgcagcctgcaggtcgcgtgccggcgcgtcccgacgtgagctgcatcgtggccaacgccaagacggcgggcgtggcgcgctggatcnnnnnnnnnncgtagttcgggcccctcacgagcagaccgggctgcacaccgacccatccacacccgcacacacacgtccaccgatccccccccctccccccttcccccttcataggcccgacgtgagctgcatcgtggccaatgccaagacggcgggcgtggcgcgctggatcttcctggcgctgtggggtgttcgcgctgcgcggggcgaggcggcggccatcgactacgtgacgcgcgtgtacgaccaggtggtgatccagccgcgcgacgcgcgcgaggcctccgacgtctactacaagcagcggcgcggcgacgtgctgctgacctacgagaacgaggcggtgttcaccaacctggtggtctcgccccacgagcagctgcccttcatcagccccgacaacaacgtcagggtgcgtggcgtgggggctgggggtttgggggggcactgcgccctgcacgaagccatcacatcgcagcaaacagccccgggggcgggtccccaccctgagacgcccgcaccctggaccctggcaatcgccgccactcgctctcctgctttccaccagatccagtgccccgtggcgctggtggaccggaacctggacgagggcgggcccgtggcgcggcacgccgccaccgcctttgtcaactacctgtacaccacggaggcgcagcgccacttcacggcctgcggcttccggtcccaggacccggagctggcggccgccaccgacctgccggcggtcaagggcctctggacggtggagaaggagttgggcacctgggcccagatcatccagcgcttcttctccgacggggtgcgggcgcatgggaggcgtgggggggccgaggagtggggggggtgtccgcggtgccagggagctcagggactcgacggtgggatgctcgtgatgggagggtcannnnnnnnnnataggtggtccgcggtgccagggagctcagggactggacggtgggatgctcgtgatgggagggtcaagtggggtatgtttcaggggcgcatggagatgcggtggccatggcgggctgggcttgagcagtgtgcacaagccagggggggctgtactccgtcgcgtccatgcacacaagagcgtctgcacacgcnnnnnnnnnncatgcggtggccgtggcgggctgggcttgagcagtgtgcgcaagtcaggggggcctgtactccgtcgagtccatgcacacaagagcgtctgcacacgcgcacttctcatgcccatgcagggcatactggacaggatacagcgggatgtttctcagcgaaagctggatgcacggctggggaggacgcccagcaaagccggagcgcccgcctgagcgacacgcacttgatgttgaaatcccttcccttttccgcacagtgtcctccttgtggctggacatccacgttgagatgcccggcaatgagatctgagcgcgcnnnnnnnnnntcccagacgcagtcccttgccggcggcagtcagggtgttagccatgaggaccagaccagatgcccggcaatgagatctgagcgcgcgcgcacgcggctgaatttgctgcctcggagacagcgcgctcgggcaacgtgctgcccttttaggaatgagacacattcattggtatggactggtcgatcctctcgagctcatcgaccttcgagagacattgtctgttcgtacgggactgtgggcatagggcgcgaannnnnnnnnngctcgagctcagcgaccttcgagaggcattgtctgctcgtacgggactgtgggcatagggcgcgaagtctgtacttgccaaggaaggcgtgcccagggtgcacaggagagcgttcccggattctgaattcatcaagcagtttttactcggaggatcagttcctgctgcacggagccacccggtga

SEQ ID NO: 2697 - DNA, 690 bp, Chlorella protothecoides
atgcacgcacgaccgtcctcacccgacgcaggagtggcggtggcgcagggcggagaggtggggctggacctggaggcctgcggccgcctggcacgcaacgacccgctttcctttgcgcgacgcagattctcgcccctcgaagccgaggccatgcaaggtgcgggcggtgtggctcaagcgggctctgtccttctccagcagctgccacgcgggccacgacgttgttgccaattgcaacggggggcccctttccccgccctcccctcgccagggtgcacgagcgaggctgagcgcagggccctcttcatccgcctctgggtgctgaaggaggcgtatctcaaggcgcggggcaccggcatcgcgggctcctcgggcctgagaagcttcgcctttgggattgaagatcgtgccggcagccccgcgcacatcagcctgcgccccgacccagcccgccctgacggcgactggaccttctggctgctcgagccgtggcatggcgtgctgtccgcgctgtgcatgagcagtggcgtcagcgaacacgggcccgagggggcgggcttgcgcctgtgggcgatggacgccgagggggcgcggagggggtgccgaccagcgcgcatgatcgcctgcgggcgccacactgcgcagccttcctgggaggacggcccgacccaagcgaggtcgaggctgtga

SEQ ID NO: 2698 - DNA, 1764 bp, Chlorella protothecoides
atggcggtgatcttttcgcacctgtgggcccttttcgtggccgggagccgcccccgcccccaaacagatcgggtgtccccagccccgtggcgcctcactctccggccccgctttcctcccatgcagacggcccgggcgctggagagcgcgctgctcagggagcgcagccgccggctgcagctcgaggccgtggtgcgtgctgcgctggcggccgaggagggagcggcgacggctggtgacgaggacgaggccgtggatgagggggttgcggatgagggctcagagccaggggtcgctgaggcacaggaggcggaccccccagcagcacagcagcagcggggcacgcatcgtgcgcatgcagaaaactctcttcttgaactgcttgcgaacaccagcccacgatcgattccccttcccgacccccaccaggtggtggtggtgggcagcacggctgtaccggaaccctcgcgcactgtcctggcaggagcggtgagggtggtgcggaccagtccgccacttggagttccctcggccacgacgcccactgtccgcaccctgcccggcgcagcgcgcgtctgcaggcccgccaccggccccgcggacgccccccccgcgccgccctcgacggtggtggtgttgcggcccacgcagggagcgccgcccgcctctgcgggcccctccaccgtctggcgccgcggtgcgagcagcgcgcgtcgctcgctggcgggcgtcgcggtgcccgagtggctgcacggcgaagaggacgccctgttctacgcctcgctttcctcccgcctggcggagctgggcggggacgtgtcgggggccgaggagcctgccggtggagctggggttcctgcggaggtcgacgacgaggtggctgctgtgcaggcggaggccacggtcgcgaccatggaggaggctactgttgcggttggggaggccaccagcgcggcgcctgctcccccacgagagtcggcagagcagggtcccgatcccgcggccgactcaggctcggaggccggggagttttgcgcggtctgcggcagcagccaggagggcgacgtcctgctgctctgcgacgcatgcgacgcggcgtgccacctggcctgcgcgcgcccgcgcctgcaggcggtgccctcgggcgactggttctgcggcgagtgcagcgcggccgaggcggcggaggaggaggcgaagggagcgcggagcacgcccgcaagggtgaggaggggcgaggaggcgaagccagcggggcggaggggcaggggcgaggccgagcctaccgtgagtgagcaggagaggggggccaagccgacgaggagcagtcacaaggctgaggtagtgtcggcaaggagcagtgggaaggaggaagccaaggcgacgaggagcagtcgcagggacgagaacaaggcgatgggcaccggcggcaagggaggggccaagccgacaaagagtggtcaggaggacgaggtcgctcccaagggaaagaagcgtggagcctctgcacgcacctccgctccagcacagagtcctgagaagaagcgcggccccggggcggggcgtcggcgggagcctgctgccgtggtggagggtaagcaggtagccagcccggcgcagagccggcggtcgacccggggcacggcttcccagccggcgacagggagcgccgtcgccaaggcagcctcccggcgcagtacgcgctccgaggcgggcaaggacgaggcggataccgcacagaagcggcgcacgcgccgcggctga

SEQ ID NO: 2699 - DNA, 669 bp, Chlorella protothecoides
atggctgaccccggcgccctgatcgccctgatgaatcaggtggaggccctggccgcccgggtgaaggatctggagtccaagcccagcaacggcaatggcatggacttcctgcagcgccacgagggcttgtccctgcggcgcccaccctccctgcagagcctggccggcgcgggggggcccggcatgccgcgcgcgccctcctacaccaacctgtcccatgtggaggtgcccatgccctccacgcgcgtggtcatgacccagattgtctcccccgccgacaccacgggcgctggcatctgctccggcggcaccgtcctgtcctggatcgacgtggcggcgggcctggcggccaagaccctggcgcgcgcccccgtggtcaccgccagcctggacacggtgcactttctgcgcccctgccgcctccagtccatcgtcaccatcgccgccatggtcaaccgcgtgttcgcctcctccatggaggtgggcgtgcaggtggaggaggaggacctgtccaccggctcgcgccaccactgctgctccgcctacctcacctttgtcgcgctgtcgcggagggggggggcgggcggcggggctccgcctcagaagaagctgccgcccaaggttgtgcccaccgacagctactaccagggtgaggagggggggaggtga

SEQ ID NO: 2700 - DNA, 1032 bp, Chlorella protothecoides
gcggaggcgcggcgcacctccacccgtgtgtggctggacccggccaaggttaacgcggcgctgaagcgcgtggcgctgctggcgctggagcacggcgacgtcgagacgcgcgcctcgccgcgcggcaagaagcggcgcgcctcagcgggtgccgccggcaacggcgccgccgccggcgacgggggggcggtgggtgagtcccaccccacccccccgcaccgtgtgctgctggagcgccccttccccctggccgcggccaagggggtaaagaatgccgccgagctggcggggatggtggaggcccacctgcgcgacggcgtcgccctggtcacctttctggcgtggctggaggcggaggtcggcgcggggcgcagcctgactgaggtggaggtggacgagcgcctgacggccctgcgcgcggcccagcccggctaccgtgacaccagctttgacacgatcgcgggcgcgggtccgcacggcgccatcatccactaccgcgcggagccggccaccgcggcgcgggtgggcgccgacaccctcctcctcctcgactccggcgggcagtacgactgcggcaccaccgacgtcacgcgcacgatgcactttggcacgcccagcgagcaccagcgccgctgcttcacccgcgtcctgcgcggccacatcgcgctggacaccgcggtgtaccccgagggcacgcccggctgcgcgctggacgcgctggcgcgcgcgccgctctggcagctgggcctcaactaccgccacgggacggggcacggcgtgggcgccgcgctgaatgtgcacgaggggccgcagagcatcagtgggcgctggcacatcaccgccggcctggcgcggggcatggtctgctccaacgagccggggtactacgaggacggcgcattcggcatccgcatcgagaacctgtttgtggtgaccgaggcgcagacgcccttccgcttcggcgggcaggagtacctgaccgcacagcccctcaccgtagtgcctatccagaaaaagatgatggtcagggag

SEQ ID NO: 2701 - DNA, 1071 bp, Chlorella protothecoides
  modified_base (469)..(478): a, c, t, g, unknown or other
  modified_base (779)..(788): a, c, t, g, unknown or other
atgagcgcccgtctgagcggtctccgcctgcgtcttcccacgcagctattctctcgcagcctgcttcagcgccgtcccttcacacatacacagcgatgccctctcaaagcacatagcgtttcgtcacaggaggagctgcggtcaactcctgcggggagcactgagggcgaaggcgtgcggtttgcggagctcagccccgccctccatgatgccctgaacgcctggggcttcaccacacccaccgatgtccagagctcagccatccccgccctcctggagtccagaggttcagacttcctgctggcctcccacacggggagcggaaaaacactggcgtacctgctacccctggatgccccatgcaccgcctgcgctggctgccccggcgcctggtctgcttgtaatagcaaagagcgatgtactcctttcctcacttgcagcatggcatgctgcctcctgcactcacctnnnnnnnnnngcaatgccccatgcaacgcctgcgctggctgccccggcgcctggtcggcttgtaatagcaaagagcgatgcactccgtttctcacttggagcatggcatgctgcctcctgcactcaccctcccatgcgtgccccacccccacttcccccttcttcctccctcccttgcgcagtgcaaagcctgaaggagggcgaggcgaggggcacggccaccaagccgcaccggccgcgggccctggtgctgggccccacccgcgaactgaccgaccagatcctaaaggtggccaagtccctctcccacnnnnnnnnnncgaggcgaggggcacggccaccaagccgcatcggccgcgggccctggtcctgggccccacccgcgaactgaccgatcagatcctgaaggacggtgtggggtggggggttcagcgcagtctgctgcgtgacaggaggacgttgagccttcctggtgcccgccttggtagtcgtcagctcctagagggccctctggcctggtgccgggtaccgccagcaaaaggtgcagctggcccagccgctagacgtggtggtgggcacgccccagcgcatcctccagcacgc

SEQ ID NO: 2702 - DNA, 1926 bp, Chlorella protothecoides
  modified_base (774)..(783): a, c, t, g, unknown or other
atgaggcgcttcacgctcagcacgtctgatcttcggcagatactctcgaaacggggtgctgtgtggggccgcaccgaggcgacaggatcgcaaggaccaggaccctgccaggcctgccgctcgcataaccggcatatttcccaagttctgcgctctcataggaccccgcctgcacgatctgacagcgtgccacctttctggcgcatcctcacctctcattccaagcacgcgctcactctccgtcatggagtgcgtcaggagcgctgtcgtcatgagggccagacccgtcctgagcctgtgagtatagctttctctactcttgagggccgtaggaaccctgctcggaaggccatgcactgtttcatggccagctccttgggtgagcttttctcatggaagaaaccctttaatgggagagcagtataccctccactcctgctgtccacagatcggtatcccttggaggtccaagagcgcttcaccctcgccgacatgcaggccagcacctttcccaggtccggacttgcacacagcaaggtggaagagcccaacctacgagcagtcgcccacatgtctgcgccgcagcctccaacagtaggcccaacatctataggggagcccctcacagagctgaaggagctggaccagtccgagttttactccttcattgaggagcattcgcaggatcgtctggtagtggtcgatttctacactgcatgcgtcctgcacctcaaaatctacccgatggcaggtgcggaccgtgcaaactcatcnnnnnnnnnnttgaacctcaaacccgagcgtcctgcacctaaaaatctacctgatggcaggtgcggaccgtgcaaactcatccagcccacgcttgtggagtgggcaaacgagtttgcaggcgaggtggagcttgtcaggtttgagtgcaagaaggaaaacaaggagattgggtccaagccaatcacctctttcaacactgcgcttaccaatgtgcagcttgggatcaaagtggcgcccacgtttttcctgtacaagaaaggagagaaggttgcgtctctgacaggtgcaaagacggatgagctgcgcaagctgatcgagacgcataatcgagacggtcacctcccccagcacaaagtgatctggcacggcccgctcggtgtgcgtggtcgagccagcgatccgtccaccatggctccgttgaagctcatcatagacacggatcctggcatcgacgacagcatggcgatcctggccgcattccacagccctgaggtagagatcataggtctcaccaccatctttggaaatgtgccgacatcaatggccacgcgaaatgctctccacctcagagccttggctcacagaccagatgtgagggggggtggggaggggagggcaacgtgtgtgatgacaagacgcagtacagaagatggccccaaagcatcgcaactcgtcctgccaggcactcagttcccacaatcttggaacgcccaggtccctgtcgcccagggcgccctgacatcgctcaagggtgttgccaaggagcgcatcgcagactttgtgcatggcagtgatggcttcggcaatacagaccccgagttttctcaggtgggtggaatgggatggggtatggtatgtgactcgtcagcaggcaggggcgacaggcacttgatgtcttgtgtgaagccctgcggctgcgtcctgcatcatgtttatcaacttcaggactcggaggcagccactccaggcaacgcaggaggagccgctgcccatctcagctgcccagttcatcgcggagtgtgccgcaaaatggcctggggaggtggtggtgctggccctgggaccgctgacaaacgtagcgctggccatacacctgaatccagacctgccgcagctgctggtgaggtcgcgggggttggccggggctgttga

SEQ ID NO: 2703 - DNA, 834 bp, Chlorella protothecoides
  modified_base (34)..(43): a, c, t, g, unknown or other
atgaatgcagggccacagggtctgcgagcatcannnnnnnnnngtaccacaagcacgttggcctgtaggggaggggggcagggaccctcatgcctgtatcaatgcagggccacagggtctgcgagcatcaacctgcctcgtctgcatgggcagcgtcctcttacactgggtctagccctcggatccccctccattccctcctacacaccctcccccactggacgcaggtcgtcctacggcatggatgccgtgtttgtgcatgacgctgccgcactcagcgcggtgctgcgaccggagctcttccagtggcacgcgggagcggtgctggtggacaccgagggcgccttccggggccacaccctcgggttcaggcacgtcgtcccgcagcaagaccatcctggcggtggaaggccgaggcgtagaggttgtctccctgttgttttaatcttacgctgcccgcgtcaagctggccccctgcggtccccgccaggtttgccccccatcactttgttgtcctgcaacaccctcacccctgccacccgacactgtcgcagggaagaaggagtgggtggggatgaacgagtggcagacccggcccaagatcaaggtggccctgggcgtcgacgccaaggcgctgacagacctcgtgctccagcgcatgagccagtgaggcagcatgcaaaggcaaagaaaggaggactgaggatctctcaggcatccgtccctcggctgatcgttaacatcaagccggtctatgctgctgtcatcctgctcatacatggcgcagactgcattcccgtggctcttggccctccttctctggctgcttgttga

SEQ ID NO: 2704 - DNA, 585 bp, Chlorella protothecoides
atgggcctcctgaccccgcatggcccgccagcctggcacccggcccccgcggagctccaagcggccgcgagggctgctgccagggcggcggatgctcatggtgtggacctgcccaagcttgccaccatgttttcagtagcaaatccgggtatcgccacccacctcatcggattcagcactcctgaccaggttagggacgggcggagcagtgtggctgggggccagcatcttttatgtccagagggacgagggatgccacagatggcccctgactggcaggacatgcatggcaatggtccgacctacagccgccgtatccatcatcccgacggacctgggctggttctcaccaacactgtttcttttgccctacacacctcttccctgaactccatggtaccaacactgcaggtccgcgacgctgtgcatgccgtgctgcaggctcaggggctggaggagaacgcccaggccgagcaggaggagcgtgccatggtcgagatccgagagatcctagctggtaccgcgcaagttacctggccctcgggtctccctgagaactctgacgagcagctggcggcacgataa

SEQ ID NO: 2705 - DNA, 363 bp, Chlorella protothecoides
atgtatttggggtacgtggtaaccggtgcgcgcgggtgtgaatgccagtgtcgtctggagggtggctggtttggtctccagggatggatgcccaaccctcccctttgctcacaggatgtgcatcaagacaccgctacagaggctgtgcggaccgcattcgatctcggcatcacactatttgatacctcacccttttatgggctgaccaagtcggaggatgtgctgggccaagcgttgcgggatgcaggactgcctcgagatcagtttgtgctggccaccaaggtcggacggtatggccaggacacctttgacttcaggtctgctcattcacaacctctgaccattgcagcggccccagggtga

SEQ ID NO: 2706 - DNA, 825 bp, Chlorella protothecoides
  modified_base (278)..(287): a, c, t, g, unknown or other
atgtatgctgcagactgtggtggccagggcacatgcacctccaggatcttcacacctgcggaatcgcggtccagctggtcatgccttgcagcaaagaccacgcatgctggcggggtggaaacatgtgcatggaagcatatcatcgatctgtccagcactcccatttcgccgggcatggcgaagtcctggcgtcgaaccaaggttgccgggtcgcctcgtagcggcgtccgctgcgcatgccggctcattggatggccttcaacctctctccagctacnnnnnnnnnnaattatcgttctgtccagcactcccagttcgccgggcatggcgcagtcctggcgtcgaaccaaggtcgccgggtcgcctagtagcggcgtccgctgcgcatgccggctcgttggatggccttcaacctctctccagctacactcccccagcccacctccccaccccgcccgattcggcatccgtcaaggaccttttcccttacattaccaaactggctctttctcaaagcacactttactggaggctgggagtggcattggtgctcctcgtcgggtgtgtacatggcagggtgcagttgtcgctcacatagtgtctgccccagatatgtccaaggcagctggtctgtacagccccctcctctttaagcaggcaattgacgcgctgtctgctggagcgacacccactgctgtgcagacggcctccatggcactggtcctctcaggtgccgcgagggccctgagcagtttgacccgggaggcacagcatcccatcttcacgcccatctctcaggcatgtggattggttgaatccgcttga

SEQ ID NO: 2707 - DNA, 1956 bp, Chlorella protothecoides
atgctccgcctcctgaagaccgacaacagtgtcgtggatggctcacacgcgctgccgactgcggcagcctcggtcgccgacggctccgcgccggcacggcggggggcaactcgccagcaggcgtcccagggactggccgtgcacctgcagaacgtgacgtatggctaccccggcacaacacgcaatgtgctcaagggcgtgtcgctgagcgcggcgcccggggagagcatcgccatcgtgggactgtgtttgaggatgtgtagtgacaaagaggaggccattccccaggcacactttgcagttgctcccattattaatgaaggtcacctccctcctctcctcatgccagggccgagtggatccggaaagagcacgatcctgagactcctagtgaggctgtttgacgccggctctggtgcagtgtttgtgaacggcgtggacgtacgggagctgagaaagaaggacttgcgcggcgctgtgggtgtcatccctcaggatacggtgctgtttaacgacaccctgcggcacaatgtggcatacagccgtcccagcgccaccttcgaggagctggagaaggcggccaaggcggccaagctggacgcagtggtggctcgcctgtccaagggctgggagtccttggtgggggagaggggcctgaagctgagcggcggggagaagcagcgtgttgcaatcgcccgtgctttcctaaggcaaggagcttggaagggtgcaagggttttggtgcacagaagacatgatataggcaaacctgtgtttgttatcgctgggggtgcactccagtgcatggcatgccctcatcagccgccccaacccccaaaccccctcagggagcccaagctgattgtgtgcgatgaggccacatcagcgctggacacggccaccgagaaatccatcatgggaagtctgcgggaagtgagagcattggattatgaatctgaccgttcctttcgtgccactaggcgtatccctggcacattgacggtcctgtactatactgatctttccctccccaatcctgcaggcctgcgacaggatctacgtgctgagggacggcatcgtggcggagcaggggagccatccgcagctgctggcaaagggcggcttgtaccgagagatgtggcgcctccaggaagcagagcaggtcctcttgactttactgtggccggctggaagaagtctgccatcagtgactgcctcaaacatacctctcaaccatcccctgataccccacaggccgtggacagtatctgttcgcacgatgccgaggatgccgtcatcgacggtcccctccccgggacgaaggaggaggaagtctggcgtgagggctggcgtgagggctggcagcaggggctggaggaggggcaggccgccggcgtggagaatgaggagctgggaggtggaactccggcgcaggctgccagttctcccgtgcttttcattgcttgggccgccgcttcccgattcctcctctggcatcattgccagattggcctttactttcattctgacgcagacagcagactccaggggaatatgggggaactccgctgggtgcgagaacaggctccaatcgccaaatcatgcacatcagcagttgaaagaacctgcgaccatcccgtgcgtcctcgcgtccatggagcacacccccctcctcagccccgccccgccaggccgacgggtgcgacgcggctgacccagccgcccaccccactctgtagcgcgccacgcaggctgcccagcacgccaccctcggcctggccgggggttgcctgggccagctatgggggtgaggggagcaccaggaatggcggggcatgccaactcgcaccccgccatggtgtcccccccctgcgcaccatggccttgcgcgcgacggcgccgtcgcctgagacgcgatccacgatccaccgcaagacttccggcggggctccgtga

SEQ ID NO: 2708 - DNA, 678 bp, Chlorella protothecoides
  modified_base (116)..(125): a, c, t, g, unknown or other
atgtatgttggagacttctgccggccccttgcacccttgctctggcttgcgcttctgactcaatccccgcaaacaggcccaacacccgaccgcactgcagacgagggacacccgannnnnnnnnnagcaagttgcttaatgcacccgcgctgcgctggtgcctatcgacagacactggagaatgtgtgttggagacttctgccggcccctcgcacccttgctctggcttgtgcttctgacccaatccccccaacaggcccaacacccgaccacactgcagacgagggacacccggttcgaggccgcccaagtcaccgcccttgctcggctgcgggagcagcagctggagctggaagcatccaccagcaggtaggggggggaggtggcggtgtttgcttgaggggcgcagccagccagccatggggccgtcttgggcgccgccagcctcaccgcacgaactcgctggcgcaatgcagggagggcttcctgggcctgtcggtcaccggcaccatccgccagtgccacaagctaggcctgaaggatgccgcggcgcgctttgccagggagcacaaggtgcctgagaagcaggcgcagttactggccctggacgccgcggccgcccagcatgactgggtgggcctgcaggccaaggtgaggtcggcggcggtgtttctgtga

SEQ ID NO: 2709 - DNA, 228 bp, Chlorella protothecoides
atgccccttcccccaaacctcatgattcccctgcaggaggaagctgctgccagccacgtgcgtgttgttgaccacctcggccgatcgcaggccaccggcaagcgcaagacctccatcgcgagggtctggatctgggagggtcagggtgcgttggggagctgtggcggtctgggcacgcgggatccgcttctcagagaggttgcttgtcgtggtgcttgccggacatag

SEQ ID NO: 2710 - DNA, 2916 bp, Chlorella protothecoides
  modified_base (131)..(140): a, c, t, g, unknown or other
  modified_base (1223)..(1232): a, c, t, g, unknown or other
  modified_base (1872)..(1881): a, c, t, g, unknown or other
  modified_base (1933)..(1942): a, c, t, g, unknown or other
atgtttgcgggcaagcacatcaaccataccgaggacagagccgtgctgcacaccgccctccgcgcctcgcgcgatgagtccgagccatctcccccaagtttgcccggggacatgtcagcagaccccagcannnnnnnnnncgcgagcgttggctgtactcgactgccagaatgctcccctcacccggtactgcacaccgccctgcagcaagtgtttacggatggcaaggacgtcgtgccagacgttcatgctgtgttggacaggatcaaggacttttcagtccgagccatcccccccgagtctgcccggggacatgtcagcagaccccagcagggtccccctcagccacccggcatctccacccagccccctcccctttccctacccaaacctgcagaacgcgtgaggagtggggagtggcggggcgccaccggcaagaagctgaaggacgtggtggccgtcggcatcggcggcagctacctgggaccggccttcgtccacaccgcgctctccttcgaccacaagagccaggaggaggctgagggcaggaagctgcgcttcctggcgaacgtggatcccgtggacgtcgccaaggcactgcacgggctgcgggccgagaccacgctggtcatcgtggtgtccaagaccttcaccaccacggagaccatgctcaacgcgcgcaccgtcaggtgcgcgtgtttggagggttggtgccgggagggcttgggggtgtgtgtttgggtgttctgctcagaaaaggtacattccgagcatcttcggcccagacagagcagcacatctcatctatgcgggcgggcaccggaccccaagcgagcccatcgtaccaccgtgtgcaccccgcaggacatggctgaaggccgaacttggaccggaggcagtgtccaagcatatggtcgcggtctccaccaacctcaagctggtgaaggagtttggcatcgacaccgaggtgcaatggaaaaggggggaataggtcggggatggggagtggtctcgccaatcagctctgtgcactcggttgcatgggcgggagggcgcagcaagggtgtcatttgccacccgggcgaggcctcactgccctggttgagacctgcgccgagtctggcattcacatccatgccatcctcacccgcacctcctccaccttccttccccttgccagaacgcatttgggttctgggattgggtgggcggccgctactcgnnnnnnnnnngcggtgggcgtcctgcccctggcactgcagtatggatacgaggtacgcgggagcagggaagcgagcagaaggcatgcaacagaaacgagattgcccgttgcacaccgcagctgtgatgatccaccattccccttgccatgctgcagaaagtggaggagttcctggcgggggctcgggatgtcgaccagcacttcaggacggcgccctttgcatccaacctgccggtcctcctgggcctgctcaggtgggtacagcgggaggggaagctcttcacgaggtgatcctcaaagacatgggctctgtgctactcaaaccattgtctcctgcccatgtcccaatcctccccatttcccctcccctttccctcagcatctggaactccaccttcatgaagaggtcctccatcgcgatcctgccctactgccaggccctcgccaagttcccggcccacattcagcaggtgcagaagttgggagggtttgcagacggatgggggagtcgttgcgtgcactctgccaatcgcgtgctggaagccggccactgcgtcgcagagcccggggcgccacatatcggatgcccacctggcttcccttgtgcactgacactccctgccctgctcttcttcggccgcatagtagtnnnnnnnnnncaattattgacctacccacttactggtccgcccccgcccaggtgtccatggnnnnnnnnnnggaccattgaccaacccactcactggtccgcccccgcccaggtgtccatggagtccctcggcaagcaggtgtctatggaaggggacgccctgccgttcaaggcgggcgaggtcatctttggcgagcctggcactaacgggcagcattccttttaccagctcatccaccaggtgcaggggggtcctcgtggtgggaggcttgagacatgtgtgtccaacgcactgcacaccatcgcgtcaaccctccacacacgctccgtagggccgtgtcgtgcccgccgagttcatcggcgtggtgaagagccagcagagcgtgtatctcaagggagagctggtgagcaaccacgacgagctcatgtgcaacttcttcgcccaagccgatgcgctggccatgggcaaggagtcagtggcgctgcgggccgagggccttccccagtccatcatcccccacaaaacgttcagcggtgggtggcggcatgcacctggggggtgggggaagagtggaggggagggggggtgattttattcatggcgtggagggaaagggatgcagagcttgtcgatgggaggttgctcgaggattggcggcatgtgtggaggacaacatgcctgagagatccaggcgtggcgtgcttgagcggcaaggtccctgcagcactgatcaccgccctcagcgcaccctctgcctcgcccatccctacatcaacgatccccgctcaatccacagggaaccgcccctccacctccctcctgctgcccgacatgacccccttcaccgtgggccagctgctgagcctctacgaaaaccgggtggctgtccagggcttcatctgggacatcaatgcctttgaccagtggggcgtcgagctcggcaaggtgggtcatggcggatgggcgacgtggagtggcttacagagggggatggctggttggctgggaggatcagaagaggaggcccatgcacggcaggcgtag

SEQ ID NO: 2711 - DNA, 405 bp, Chlorella protothecoides
  modified_base (214)..(223): a, c, t, g, unknown or other
atgcaggcgggctgtgcctgccacgtcatcgtgaagcataccgggcccaaggctcctgatacccctccctcacaacaaacaccaggtcctggcctccaaggtgaggacgaagatgcacgaggctcgcaccaagctgcgcaagatcctgaaggaggacggcttcaacccctcctcacgcaagatgatcaacaggtatctggagggcaaggcccannnnnnnnnngtgcctggcactctcctaccgagcatgaccctcctgctgcccatccaaccccttgtaggtatctggagggcaaggcccagctgctgtaccctgagccgagggatgtgttcccctgcgaactcatccacagcgaggcgtgcgtggcgccctgggacaagcatgaaagtgaggctgaggattga

SEQ ID NO: 2712 - DNA, 1659 bp, Chlorella protothecoides
  modified_base (77)..(86): a, c, t, g, unknown or other
  modified_base (1423)..(1432): a, c, t, g, unknown or other
atgttgacactgaccagcacggcttcagagtgtacacaattcacctctgaatatcaccgatcctggtttggactgannnnnnnnnnaccaccaggtggtcgtgagcgtcgaggcaggagaagaccactgggcacgactaactgcccactactgacgacgacctcgacattgcactggtcgcttcagtatgtcgcgtcagagtattatccttacattaggagtagtactcctgactttgagctctggaatcgccctcgatctggtccgtgcaatcttttcgtgtggagggagcggaatcttgtctcggctgaggagctcagcggaacattggactgtcgcacgtacaagtcgccagggcgcattgacacggtcaccggagtagcacgggactacctcgtggtcaaggatgcattcacggtcgatgacctttccgtcactgtgtccatcgcccacccggatgtggcttcattgaaggtggtaatgtgttgcttgacggattgttcaacatatggctggatgagattacaagtctgtcgtctgcctcagcatagagtccacgagattgtctgcaatgcccatgggaatcccccccgagcacggaggggcagtctcaccatgggcatgtggaaagcaagcacccccctttcctccgcacaggtcaccctcacggcggagcctcccattgtgagcgcagaggccctccccaccagtagtcgtaccattgtcctgaaacaaggtggtgtgggcggcgccgggagcatcctgaggaagaccacattcaacgacagtgccacgagcggcctctccagtgccgagagcgtcgatctcgagggtggagggtcttggacgttcagtgggccagaatggccaatgccacagactcatcatgatttgtacttgtcaggagggctactgcacactgaatgggcacgatctgccttcaactgcactaacgctcctctaaccatccccctttgttatttgcaacagagcgatgcccccttcacggactcctacatccccacccagcgtctgggtttcatgttcgaggatggcgacggcaaggatgcctccgacggcggcagtgagggcacctggatcctgcaggtggaagatcccctggaaaactccaccacccgtcaaattgccctcaatggctgggccctgaccctctgtggcatgcaggaggtgggtggcatatgcctgatgtttcgagagtggtcaggtcttgggtctgggtgcacatttctcatgggattgcagacgcgccctccaatcacctgtgctcctgcgacggtaaaaggggaccaggaatcagcatggcatggtgtcacatcccttccccatccaggtcgggaccatctgacctaccccaccctcttacaggcaggtgaagcagccaaagccccttcccaggaggccnnnnnnnnnncaagtcccctgccaccaggtgaagctgccgaagccccttcccaggaggcgaccactccaatgatggagaggccccttgtgacggcctcgaacgggcccccgccacccgccgccctccagatgaacgtggtcaagtcccctgccaccaggtgcgcccgggatcgagaggtcaggccccttggatgtttgcgtaatagttcacggaaagccctgcgtgccagcagctga

SEQ ID NO: 2713 - DNA, 390 bp, Chlorella protothecoides
atggtgcttgcggagctgggccagagggtaacgcaggcccttgcctccctttctgccgcccccgtcatcgatgaggcggtattggacgcttgcttgaaagagatcgcggctgccctgctgcaagcggatgtcaatgtccggctggttgccagcctgaggaacaatgtcaagaagagggtgaacgtctcagaactggggaggggcctcagcaagcagcgcatcattgaaaaggtgactggcaacatccatgcttgcctccagtcgtggccctcgttggatccagcgggacttaggacaggtgaacagatgcggagcatagatgatgctgccctgcgacctcaccctcccacgtccaaaagcctcaccgtttatctcgcaggctgtgtttga

SEQ ID NO: 2714 - DNA, 654 bp, Chlorella protothecoides
atgacctctacggccatatcatgtcacctactagtgttctcatccgaacctctcgacttgcccccaggtgctggaaagacaaccacgtgtacaaagtatgcgcactactataaacgcaagggcttcaaaccagccatggtctgtgcggacactttccgagcaggagctttcgatcagctgaagcaaaatgctacaaaagcgcaggtaggtgccgtcttgaggttcagcgatgattcagggcagtttcctgtgcctggactcttgtgtgggaaccttaaggccgctgctggctcgtatctgcactgtgggtccaggtcgagttacagtgctgcagaacaatgtccgcttggaatgcatgctgttgccctcatggtccacagctgtccacagcaagatgcactcttcaacacccaccacttcccagattccattttacgggagctacaccgagacagatccggcggtgattgctcagcaaggtgtcgaacggttcaagcaggagaagcgctccttggggtcccctccacctgttcctcctcttatcccttcagggacctgatcattgtcgatacgtcaggtcgccacaagcaggaggagtccctttttgaggagatgcggcaggtggctgccggtgagcagatgggcgatggttga

SEQ ID NO: 2715 - DNA, 681 bp, Chlorella protothecoides
  modified_base (29)..(38): a, c, t, g, unknown or other
atgccatcggagccttgcatggacacggnnnnnnnnnntttttgttctgagtcgtggcaacggtggtgggttgcaatttggaccgagtggggactttatgccatcggagccttgcatggacacgggaagggcctgcaccttgacctccacctggaactcaccatcccccgctatacccgtcaacttgcagccgtacagccagaccatgtcatctttgtcatggatggctctattggacaggcggcgtttgatcaagccaaggcgttccatgactctgtggatgctggacttaagcctgtggagatgtcaagcaccatttgcacagcgtgctgggaggacacattgtcagggatgttgctaaggcttgacttaagcctgtggaaatgtccagcaccatttgcacagcgtgctggtgttgggcaagtgatcatcacgaaactggacgggcatgccaagggtggcggcgctctgtcggctgtcgcggccacccagtcacccatcaccttcattgggacagttgattcccttactcctacaggtgaacacatgcacgagtttgagcacttcgaggccaagaagtttgtcgggcgacttcttgggaagggtgattggggcggcttcattgacaaggtcaaggatgccatccccgaggtgagctctcagtggccatgcccgggatga

SEQ ID NO: 2716 - DNA, 1287 bp, Chlorella protothecoides
  modified_base (795)..(804): a, c, t, g, unknown or other
  modified_base (1239)..(1248): a, c, t, g, unknown or other
atgaaatcacctcaagtggctctcccagcttccgcgctccgactcgtgatgggggagtgctctacagctctaaacgcaggacagcagcatgcgcagatgctgggtggccaccgtcctcctgctgcagccgctggacgtcataaagacccgactccaaggcacgcccttacgtgcaacatgaacgggaaaattgtgaccttctcccatgcctggcatgtgggtgatatcacactccaaactacccaccctgcatgtgcctgcctcatgcagttcaggatggcatcaagggccccctgccgctgtaccagggcacgctcgatgcagcaaggagcatcgtccggcaggagggctaccaggccctgtatgcagtcctgggtgcgggcgtggcctggggggtatacttcttcacctacaaccgcgccaaggagcgatacagggcctggcagggcagcagcggcaagctccctgcccatctgcatctcgccagcgccgccgaggcaggaaccctggtgcgttgatgggaggttatggagggtgggatgggtaagagaaggatcaaatgggagcgtatgtgtcatgcaggattcccgtgtccaacctcttcccagtgccccctcaggtgtgctttgtcaccaaccccctgtgggtcgccaagacccgattgcagctgcagcagcgccaggtcctggcggccagcagcgctgcaacagccgcggtgcggagctggccaagcggctgtttgtatataattcctctgagaatgcgatgctgaaggccctggcccttgcgggcgcnnnnnnnnnnggagcgcattgcactcacccgctcagcgccattgcctccgtccccaccttggaaacattgcaggtcgctgcagccccctacaggggcctggtggactgcctggtcaagatcggcaggcaggagggcatccggggcctgtacaagggcctggtcccatccctcttcctcgtctcccatggcgccatccagtttgcggtgtacgaggagctcaaggcgctcgccgccggccgccggcgcagcacggcgccggcccagcgtgcgcagcgcgagcctggcagggcccccttgtcctccttggagatcacggtctgtggcgccctgtccaagctctcggcgtctgtcgcgacctacccctctcaggcaaggccatcggcctggggttcagtggctggatgccgaggggacgagcgtgggcctgctgactcgggaccttcnnnnnnnnnngtcgcaacctacccctctcaggcaaggccaccggcctag

SEQ ID NO: 2717 - DNA, 345 bp, Chlorella protothecoides
atgcgctccactccaatgctctctcctgatcaggggcaatgctgggtgctggcggacaatgaagaattgcagcctccagcagtcttggacagccgtacctttggtcccctcgacctctcaagcatcattggcaggtggatcatagtggtggatcgtagtggtgattggcatttgtttgtggtggaactaagctgtggatatcccgtccctctgacatggacagcaaactcaagatccccatcagaccatgggcctgtagagaacagtacagcagccatgcaggctgatgtggctgtactggaagcagagctggacattgataagctgtgcaagcaggagcaatga

SEQ ID NO: 2718 - DNA, 480 bp, Chlorella protothecoides
atggccacccgagcctggaacctgcggtactctttgctgaagttgaagcatgcggtgtcggaagcagttgcatccccgcaccagggctcggtggcggacgtcctgcagaccacggtagaggcatatcagcgccggctcacgcaagtgatcgcattggccggggtgtccatggcgcccactctcaatcctctggggaccaaggaccccggggcagtggagcagcttcttgttcgccagatacctcgaccctccaccagcaacgtgtgggtgggcgacgtggtggctctgaagaccccctcgtccctgcagcccatcagcctcgccaacacagagcatgtcgattacatggttaggcgtgtcgctgccatgccaggcgaagagctggttaccgacgacccggaggacgaacctgtcgtcttgcagcaggtgggaacgaggggcggagttgcttgccctgctttgcgcagcacagatgtgtga

SEQ ID NO: 2719 - DNA, 1143 bp, Chlorella protothecoides
  modified_base (774)..(783): a, c, t, g, unknown or other
atggacgaacacccatgcacgcgcgcgtgtgcatgtaattttagaataagactgcagcgcgcatcctttgtttcaaaacaacagaaacttcagctaggatccagtgcagatcatggcgctcaccctcgccccgagttgtcatgccgcgggactccatggccggcgcttgggtgcaccctcacagtccccacatggagttttccaaaggcgcctcatggcgcatgggggcgctctccttggtacgagcgctttgaactcatcgcatggaatcctttattattccctgaccagccagtgggctgctctgcgtgcttgactgtgggaggagcagccctgccactcctcgctcgcaaccacacaggtctcggatgccgtcaccccctcaccatcagcagcgtagccgcccgggcgtccggaggaaatgaagaccgtaatacctcccgagattccaatgatccggtatggggatggttgtcggtgcctgcgtcatgccacgcaagctgccagacagcagcgttgacttgcatatcaaacggcatggttctgctacgtgtcctcgccacctggagcctcacacaaactctgcagtcatccaaggagccgattgagtttgggcacacacgcaaggacgttgtcctcatcggtgttggcctgatcggagtcagtgtgcctgcgtgcacagccaggggttgggagccgactggcacccatgttccgtcctgcactccgtccccctgcgtccctgcgctcatgcctggacaccatcttgactannnnnnnnnnctgcgtgcacagccaggggttgggagccgattggcacccatgttctgtcctgcactgcgtccccctgcgaccctgcgctcatgcctggacaccatctcgactgtacaggctctgggtctggacgccggctcagcagggaattgggtgcagctctctgtcttcctgggcatttgcgtgttctggattgggtcatacatctggcgcgttggcaccaagaacatgacgtatgccaagcagctttcggattatgaggctgcggtgatgcagaagcgatttgaggagcttcctgaggcggagatccagtccattctgaaggagcaggaagggtccaagaattccgggcccctgtccagtcaatga

SEQ ID NO: 2720 - DNA, 885 bp, Chlorella protothecoides
  modified_base (527)..(536): a, c, t, g, unknown or other
atgagcaagtgcctcccgctcccgtgccccttcccctgtccccgccatcaggacctgtggacgagcttcctgtgcgagtttgtggtgcacgtcgtgcgccagcccgtcacggtggtggggaactccatcggaggcttcgtggctgccagcctcgcaggagatcaccccagcctcgtccatggtgtgggtggaggggggtctgtcgctcgttggtggggaggagtgttccacgcctgtgtctccgcacattcagcgagcaaacacccagaacagtgcagtcgcctgcgagacgctgactcaaccatttgtcaccctcacaccttgttctcggcaggcctcgtgctggtaaactctgctggcaaggtggagccaggctatgttgcaccagagaagacgtactcagacgtcgcgcaaagcggttcgcccctgctcagccccacgctgatcaacctcgtcagctcggtgaggggccttgccaaggggcggggcaaaggggcagtgctggacaatcgtatcgatgtcctggnnnnnnnnnncggggtggggcaaaggaacagtgctggacaatcgtatcgatgtcctggacatactcatgaaaagagtttcatgcccatcccattccaggggctcttcgggctgctcaaggggaacgtcaagcggcagctgaagcagctatacccgagcgcgcctgaacgcgcggatgcctggctggcggcggagatcgtgcgggcggccacggacccggggtcaaaaggcgtgttcaccagtgtgttctaccttcagaaaccccgccccctgaaccacctggtggcagagatgtatggcggcccggttctcgtactccaggtgcttggtggaggaaaggaagaaaagagcctggcttaa

SEQ ID NO: 2721 - DNA, 276 bp, Chlorella protothecoides
atgctggagcggggatctcggtccatcgccgtgatcttcagggccattgccttcaccgccattcccacgttcctggagctggctgccgtgtgtaccatcctggcgcgaacctttgacgcccgagtctcggccctggtcctcaccacctttgccgcctatgctggctggaccatcgccatagccagagtgagggccgcgggagggagcacaaggttgattgtggggtggctggggcggtcaggtggagggatgctgcatggtgggtacctgcaatga

SEQ ID NO: 2722 - DNA, 600 bp, Chlorella protothecoides
atggatcgcttccaacgaatgttggggcaggggggcctgggcggggccggtgccgtggcaggagacgctccccagcaggacacgagcgaacagatatacatatcctcgctcgccctgctgaagatgctcaagcatggccgggcgggggtccccctggaggtcatgggcttgatgctgggcgagttcgtggacgaatacactgtcaaggtggtcgatgtcttcgcgatgccacaatcagggacaggcgtgagcgtcgaggcggtggaccccgtgttccagaccaggatgctggacatgctgaagcaagtgggcagaccggagatggtcgtcggctggtaccattcccacccgggtttcggatgctggctgtctggggtggacgtcaacacccagcagtccttcgaggccctgaaccagagggccgtggcagtggtcattgacccaatccagtctgtgaagggcaaggtggtcatcgatgccttccgctgcatcagcccgcagacgatgatgctgggccaggagccgaggcagaccacgagcaacgtgggtcacctaaacaagccctccatccaggtgcagcacggcggaagggtggtttga

SEQ ID NO: 2723 - DNA, 1158 bp, Chlorella protothecoides
atgacgggaggtagccagggcggggacggctggcgaatagcggagcagcacacggcctccatcgcccacagcagcttgatcgcggccctgatgacagtgtggccgtcacagttccccagttcgacgagcgccaagaactccgtgcgaaaacgactggtgttcctgaatggggccccggctccggctcaaaccaccgtggtgccaggcgacacgctgtgcatccggcagcgcacccgcacggtgcagaggaacccgctccccgccgccactcaggaggcggcggccgcagtccgggtggtctggcaggacggctgcctggccttcgtggagaagccacgcggcctggccacgcgcgccgggtccggcccgggccccacgctggccgcctgcctgccggcggtgctggcgcccggccccggcgccgacgcgctgccggacccagcccccgtacaccgcctggacggccccacggggggcctggtgctggtggctaagacacgggccgcgctgcgcctggccagcaccgcctttgcggcgcgggaggtgcgcaagcgctaccgcgccgtggtctggggccggctggcagcaggcggcgtcgtggacatcccgctggacggcaagcccgccagcacgggctactcgccgctgcgctggcatcccatggagccgagcggggggcgtgatgcggggggtgggacaggggagcgcggtgccgggtccttggaagggaaccgctggacaggcccccgtggcgcagcccctggatcagcactggcggtgaccgtgctggatctggcgcccgtcacggggcgcacgcaccagcttcggcgccacctggcgctgatggggcaccccatcgtgggggacccaaagtacaccagcgggtacgccgcgcagcgggcgctggcgctgggggaccccgccgcggaggagggctggcgggcgggcggcggccagacggtggctccgggggccatcgcgggggcgacgccccacctgccaacaggcctgcacctctggtcggtggggctgggcctgcggcaccccatcacgagcgagccgctgaccctgcagctggacgagccgccggaggtagcggcgctgctggaggccctgcagcgcatgcacgaacgatggcgcctgctgcatggagtttga

SEQ ID NO: 2724 - DNA, 408 bp, Chlorella protothecoides
atgctcctgaacctgcaggcaagtacacttgcgctagtttatgtgggaacgctcgtggcgaaggatgatgtgtatttaaaaggatggcagtgcgctcttgcaagcgaggaacgccttatgtatcgctcccctgtcctgcagaagcacacatggaccaaggggttgaagctgacggactttgacgagcacgcactgaagaatggcaagctcttgaccgaggctcaggacttgacagagaagtacgagaagctcatcgtcgaggaggaggacatttctctggagaagcgggtggtcgccaaggctggcaagatggatgccaagaagcgattggaggagaatgtgcagacgctgctgtctgacaacatagtgcagtgcatgggtgccatggtggacaccgtggtcttctga

SEQ ID NO: 2725 - DNA, 384 bp, Chlorella protothecoides
atgatggtgaacaagcagccctacgaccagtacttcaagaccttgccgcggcgcaacgacgtcatcacaccctttgcggtgaccaacacgctggggtcctttgatgtcatggtcaatgtcatcggtggaggcacgaccgggcagtcccagggtaacctacagcactgcttggttgcttgcatacctcctcctccgcaaaccatgcaggctgtgcggcacggcattgccaaggcgctgcagttttttgaccccgcacaccgtccggagctcaagtctgcaggtctcttgacgcgcgacgcgcgtgtggtggagaggaagaagcccggaaggtgggcagagtcatctgagctgatgggtaaagcgtgtgcgctgcatgccgtctga

SEQ ID NO: 2726 - DNA, 213 bp, Chlorella protothecoides
atggagggcgtgtctgccttgctgaatgcggggcaggcctttgtcctggcggccggcatggcggcggtgctcctggtcacagtgcggagcaagccgggtttcacagccggagacttgggactgctgctccaggtctggtccccgctttccttccttggctggttttatcgtgagctgcgacagagcctggtggacctggtgagtgtggggtga

SEQ ID NO: 2727 - DNA, 405 bp, Chlorella protothecoides
atggcgcaagctctcacatctccacgcatacaacgcacgtcacccggctatggagtcttcaaaggctgctggcgagctcctcctcagccggccttcagacacgcgaggaacccgaggggggtggtcaggagccgagcgcagcctacaaaagctgtaatcgacgtcagtgaatcaacctttgaggccgaggtgctgaaggaatacaagggcaccctgaaggttgtgaagatcgagaccgaccccaaccctggaatcgtggagaagtacaaggtttatggtctgccctgcctgttgctctttgctgacggcaaggaggtccctggcagcaggcatgaagggggcatcacaaagcaaggcctggttaaatatctagataaaaataatgtggctgcaaagcctgcttga

SEQ ID NO: 2728 - DNA, 204 bp, Chlorella protothecoides
atggcaacggtgtgggacgaggcccaggtccggctgtacatagggtcagcgtcccgcccagacatccacatctactctgcggccgggcgccagctggggctggtgctgtgggagaggggcagcgtcctggcggcgggctggagcagcgccgaggagctgctggtggtggaggaggagggcacggtgagagggttgcttgtgtga

SEQ ID NO: 2729 - DNA, 549 bp, Chlorella protothecoides
atgcccctgcatgcaggcgagcccacaccccaggccgatgccgctcccgcgcctaagggcaaggccaagcccgccggcaagaagcagaaggagaccaagctgggcatgcgggctaccaaggatggcgacttcagcgagtggtactcccaggtggtcatcgagagcgagatgatctcccactatgacgtctcaggatgctacattctgcgaccctgggcctatgccatctgggacgagatcaagaactggtttgatgccgagatcaagaagctgggcgtgcaggtgatcactgaaggggtgggaggaggggaggcatgggaatggctgactgtgctccaggtggtgcaccagaaccctgagtggtcacagggattggtctgtgaatggaaacaccttctctgggcacgtcgagagctcccccttgatgcacgggcgaacgcctacttccccctcttcatcacggaggaggccctgaccacggagaaggaccacgtggagggctttgcagcagaggtgtggggtggggttgatgctgacagtctggagtga

SEQ ID NO: 2730 - DNA, 843 bp, Chlorella protothecoides
atgacggatcccgatgtggagcagcccgattgggagctctcgaaggagaatttccagcccttgcgacaggggcggaagggggcaggcctgaaagacaacaccgaggagctccgatccgccaacttggacgctgtcaagaggttcatcgactggacacgggagacttataccgctggcggtcacaaggcggagctgatcccactgctggagcgctgcacctcgaccttgcaatccgacgagcggtaccgcaacgatccacgcttcctccgcatctggatcctatacctcactcttccattcctcccccaccaaaaacaatacaaggcggactgcctggcggagccggaggacgtcttctccttcctggcacagaacgacatcgggcagggacacgcactcttccacatcgcccacgccacctgcctggagcttcggggcgcctttggccgcgctgacgccgcgtacctgcgtggcatcgacctacacgcagccccactggagcggctgaaggccaagcacaccgagttccagtacaggatggtgggtgcagggtggtacggggcacgaaggatccagcgggatgcggcggcctccgccacggccctcggccccgtagagaccggcgccgccgcacctgcccgccgcttcggccaggcagtcggcgcccttgggggcgctaggccaccgggaggcaggccggcctttgcgcccctgggcagggcggcagcggcggcagctggtcaggtccgtggcgggtcggcggccggtgctgcgcccctcagcgtcctcgccgatgacccgggagcgccggcctgcccaggcccctccctgacggcccggtga

SEQ ID NO: 2731 - DNA, 453 bp, Chlorella protothecoides
atgtttgcgcggctgacggccttggtggggagcgggaacagcctcccgttggaagtcactggcgagccttccctgatatgggggtcctggacgcacacgagcggcaagtggaaggcagacgggtcggcggtgtctgtgttccgagtggcctcctccaacccttcggatcccaagctggcagcagcacgcaatggcaccaaacgcctgcgcacggtgagcagctggatgctcgaatatggatatgggggtggtgcaggtcaagcatcacgggaaggtgaacaaccgagacgctccaccttccatctgcagcttcgccacccaaacgtgctcatattcaaggagacactcgagctggaagaaaagggcgagcaggccatctacctgatcaccgaggccattgtgccgctggcagagttcctggagtcgacgacgctcactgggacagataggtga

SEQ ID NO: 2732 - DNA, 609 bp, Chlorella protothecoides
atggagcagctggaggcggaggggtgggaacccctggtccgccgcctggtccgccgccggcactaccacctggcgctgagcgtggctcgtgcgcaaggcctgccgggggaggccgtgctcagcgcctgggcctgcgacaaggtcaccgcctgcgggggtttgctgggcgacgccgagctcctcgccgccctcaaggcgcgcttgttgaagagtgggaacgtggaggaaggggggccgggcctttgctttgtgcactgcagctcaaggggcaggcgatgggaggcaaccccagagcatgcgacgtcaaaccgccccattacgcccacattccatgccccaccacagagcaagctggacggcgcgggcggggtggagtgggcaaacatcgcctcccacgccgcggggcagggccggcccaagctggcggcgctcctgctggacatggagcaccgggcccaccagcaagtgcccctcctgcttgagctgggtgcggagacgggaaaacggaggggtccagcacagggcgcggcgtgtgctgctgcagcgcgtcggcctgtttgcggatcggcggcgtgtgatttattcatccgaaccccaatctcggcgtag

SEQ ID NO: 2733 - DNA, 1515 bp, Chlorella protothecoides
atgtgcgcgatactgtacgaccggcgccagctggcgcgcagccacagcctgccgggcttgccgctggcgctgtcggcctgcggcacgctgctcgcgctcgccgccccgcaccccctcgaaggtggcctgtggctggcgcgcgctgccgggcgccgcagcgtgcagttcgccagccctgcgtccctggccgccgccgcgggagcagcgatgggcttggacggcgccgaccgcgcctgcgcagggccgatgaggccgcgagaggtgcggtttgcgccgggcgcggcgtcgctggcgttcctggcggacgccggcggctgcgacagcggccccgaggccgccacggcctttgttgcgcgggtgccccgggcgtggcgggacgctggggcaggggcggtgtggggctcgccgccgacccgccagctggtagctctgcgcttgcccgagcctcccctggccctggcctaccgtgcagagcctccctcaaccaaaactccccgccccaggaatctgctgatcgtgtggacagcaacaggcgcctggcaggtgaggctgccggccaacttcgccgacggcctgcccccgacccgtaggctggcggggtcagaggccgcagcggctggcgcgagcccggcctcctgtgccatgtccccagacccgaccacagaccggctcctcctggccagcaccgacgctgagaccagggatgtggcacaggagcggcgacgctacgcgacgctggacctgggcacaggccgcctgcgcctcgtcggcgagtactcggccggcgtgggcctcggcgggggacccctggacagggagggcagcccagccccttcgaccacgcagccccctgcccccgccgccttctggagccccgacgggcgcagcgccgccttcgcttcgccgcactcgggcgggggctggcaggtgtacgtcgcctcgggggtcgggcggggcgacgatcccggcgacggcgacgccgccggcaccgtggcgggcgtgacgtcgcatcccacccccctgcccccgcgctcggtgttcgtggaggtgggggccggggccggggctggcacccatggtgcggcggcctgggtgcgggacggcgaggttgcgctgaacccactgcccgccgcgcaggggccgtcacccggctggctggcgggcgcgtggctcgccgcctggggtgcgccgccccaccccgcctcgctgttcgggcgcgaggcgcccggcgcgccgcgcgagtccgtgccggccctcgattttggcgcctggctgctgcgcacgctgcgccccggcgaccgcctctggctgcgcctggacgtggcgggcgcggagctggagctgctggcgcagctgctgcaggacggcagcctggcgcgggcggggcgggtgtcggtggcctggggcgacggcgtgcggcccctcagcggccagctggccgccacctggcgcagcgtgttcgacctgctgggcgtggcctggtcggaccccggctcacccgccctggagccctga

SEQ ID NO: 2734 - DNA, 834 bp, Chlorella protothecoides
atggggaggcgcggcatgccgaggcagggcccacgcagccctggctcccgctggtggtgcagaccggcgaggtctgccgcatcatccttccaagttcttcccaaatttttaaaggctgccgttacggcaattcatttgccaaatatgtgtcacatcgtgggacgagcgtgggcatggcaagtactccccaccccgggcccccatgtacgtcgtgcccagcacgccgagcacccccgttcagcattaggcattctgggcgcaaagatgggctggccggtaccctgctcacacatacctgctaatgtaatatcgagggtggtcaccctaggtctaggatcctctcttggcgttgtgggaagacagtcgcccctgcaggctcgcacctccatcggctcgggctcccactgcgggttgcggatggcaggcatagcccacagcttgaggcaagcaccgtgcctcgcggctctgcggggctgcgccaggctttccacatccgcgcctgtgcgtggactcgaggagctcatcgtcaaggcccctaaggagggcgaggcggtcgtcaaagcaggccgggcatgggaggccgctgagctgcggttgaagagctgggacgacctgcacgccctctggtttgtgctcctgaaggagcgcaacaggctgcacgccgagcgtatgatgcaccaacatctgaagaccaacatgccggagatcacacgctacaagaaggtgaagctctccatgaaccggatcaagcaggtcatgagccagcgagcactcaatgagcacaccgacccgattgtgcaggccaagttgaaagctttcatcaacgccctttga

SEQ ID NO: 2735 - DNA, 870 bp, Chlorella protothecoides
  modified_base (115)..(124): a, c, t, g, unknown or other
  modified_base (319)..(328): a, c, t, g, unknown or other
atgctccttcctgccccgggcagagcaccagcatcgctgttgttacaccccacgtgccagtgccaggcctgggcccgtcgcctcagcaggaagcattgcgatatgcacattcgcnnnnnnnnnnggcctggggattgtatgccttggtactggatgcccatatggttacccttggagtgcagtgcggctacaggaagcattgcgatatgcacattcgctctcccaccgcccaccttcagcaagtgtccatccccaccctcccccatgccccccccagagctggagcgggccctggaggcggacctgagcttctcccccnnnnnnnnnnacatccccacccaccccatggcccccccagagctggagcgcgccctggaggcggacctgagcttctcccccgagttctcgcgcttccgggaggcggccaagtccggtaacctcgtccccctgtacgagcgcgtcttctccgaccagctcacccccgtctccgcctaccgctgcctggtccgcgccgacgaccgagaggcaccctccttcctctttgaatccgtgatcaacggtacgcagcaggggcggtacagcttcgtgggggcgcacccgtcgctggagatcgtggcgcacgccaacgcggtcaccgtgctggacaacgaggcggggacgacccgtagcttcgaggccccagaccccctccaggcaagggagtggatgtgctgtttgaatcggggtaaagaatggtggggaggtagagaaagtgtttggcttcgagacgctgcatgcttttctgttgcagtggtgctcggaatgtgcagcggtctacatctcctttatcctgcagaattccatggtggtgcttgcagcagtatactctag

SEQ ID NO: 2736 - DNA, 1704 bp, Chlorella protothecoides
  modified_base (532)..(541): a, c, t, g, unknown or other
  modified_base (902)..(911): a, c, t, g, unknown or other
  modified_base (1195)..(1204): a, c, t, g, unknown or other
atgccgggaggacgtcgctgcaccagaggcacccttgccaccgtcttgctcaagacctgggacacatggacagcggctccatcagaatgcatgtactggcaggctttggcctctcttaacaaccgttcctcagaattgtccctactcttgtgcttgtgctgtgggtggatagttgatgaactgccgtattggccattttgaattgaaggtgccacagcctacaatgtgactgtcaagcacttcccattcctccgcttaccttgctatgttttttgtgcttcttgtggtccttcttgtctgcatggtgagagatttggggccgatcaccaccacaaaggagatcctggatcacacttgttccggcatgtacctgcagctctactcggagatggtgaccgtgaccgatcctcgcggctgtttttgcccatcgctgtgacaagtcgacgatactgtggggttttgaggagtgttgacgttgagacactacgaaaaggacctggcaggtgctccgatgggagttcgatcggacctnnnnnnnnnntgcccatcgctgtgacaagtcgacgatactatggggtgttgagtagtgttgacgttgagacactacgaaaaagacctggcaggtgctcggatgggagtttgatcggacccactggtcgcgcctcaacccgcagcggcgcagggcgccaagagcacggcgatgcctcggtgcacgaggaagatgaggatgcatgcgcggtgtacgcatgagtcggactacagcgacacggaggtgagctcgcatcgacgtgttgcaactgttattcgcacatcctggcagtacccttggccctggtgacgagcgggccgctgcggtgctcgcccggtgtgcactgtcttgcagaatgggcgtggcgcctccnnnnnnnnnnccgctgcggtgctcgcccggtgtgcactgttttgcagaacatgggcgtggcgcctcgcgaattggaccctctcagtgccagcggcctgcccatcccggtgccgacccccactgcacaggtcgggccagcggaggctgccgaggccacggggcgggaggttatttacaatgcagatgtgctgcacgagaagctggaggactttgggtggagcgagcaggagcggtgggaggagacgctggtgatcacgagcgaggctcccacctccatcgccaacgtggaggatnnnnnnnnnngagcggtgggaggagacgctggtgatcacgggcgaggcccccaccaccatcgccaacgtggaggacgacctcgagcgggagctggccttctacaaccaggccgcggcggccacgcaggccgccatcgcgcgcatggaggcggcgggccaggcctgggcccggccgccggactacctcgcggagatggtcaagtcggacgagcacatggccaagatcaaggagcagatgctgcaccagtccaagctggtgaccgaaatggagcagcggaagaaggaccgcgagtccaagcgctttgccaagcaggtgcaggcggagaagaagaaggagcgggcgcaggagaagaaggcctccatctcagacgtgtccaagctgcgcaagcagcgcaagcagtcggtgcgtgggcatgttctgtttgggggatggtgtcctttctgcatgtcttgtggggagaaggggatggtttagggttggcggcgggggaacagaggacagaggagtag

SEQ ID NO: 2737 - DNA, 2118 bp, Chlorella protothecoides
  modified_base (1297)..(1306): a, c, t, g, unknown or other
  modified_base (1713)..(1722): a, c, t, g, unknown or other
atggtgagcggccgtgttctggaggggttttgccagcggggaggaccctttaactgctggctcagcctatctttgggaaccggacaccgtccctttgcagggcacggtctgcctcccgcagtgcatgcggcctccctgaccgcatgggccacgctgcacgtgctgcacgagggcgccgcgcgccaggtcaccgtccccctcaccacccccttcaagctcatccccgtgcacatccacaaccgcccgccctcctacttcatcctagggggcctggtgttcacccccgtcaccgtgcccctgctccgctccgagtacggtaaggagtttgactacgacgcgcccgtgaagctgctggacaagatgatgcacgccatggccgacgcgcccgggcagcagatcgtggtgctggcccaggtgctggcggccgacgtgaatgtgggttacgaagacatcgtcaacacccaggtgcacgcggtgaacggccagcgcgtcacctgcctggccgagctggtggccgccgcggagggcggcgcgggcgagtacatccgcctggacctggagtacaaccaggttgtcattctggggaaggaggaagccgcggccgccatgcctgccatcctggagcagcactgcatcgccgccgaccggtccgaggacctgcgcccagcggcgcgcggcggggggtgggcggggttccgagcggtcgcgggaggagggcatgctctggagcgaggaccggccggtgcagccggacatgagacctgggatgcctcgcagcgtcccaggggactactcggcttggaccaggaatttgaccgagggagggcgctgacatctcccgacccctccatgacccaccacctggagagcgagacgccctccacccttccgcttgctcgtcctcccccccctgaaccaccattcatgtgctgcagcacccctgtgcactgccctgctttactcatcatcactgctgctgctgtacttgtcatgtcacacagggtatgttttcagtatcaggcaccaatgcatgccagcatggtaggtgaccgccatcatcacagaccacagaggtgtccagccaccacaatcagaggcgcttggggatctggatggcgccgccagaggcccccagcagcgcccggaactgggccatcttggcgtcctcggcggcctgcgcggccacgagtcggtgctgcagcgcctcgtgcttcaacacggcattctgcgcgcgctttccctgagacgccgcgagcctgcgcgggtttcgtgcgaggggactggaccaggtggccgnnnnnnnnnnctttccctgagacgccgcgagcctgcgcggtttcgtgcgaggggaccggaccgggtggccaagggctcgtgtgctctgcaagattgcgtccgtcgtgcttgattgttacccagaacgaggcctgggaacctcagcgatacagtccgctaacgaggcctaggaacctcagcgatacagtccgctgtccctcccaagcctcgcgctcgagtccccccccaagcccctggcagaacctgcaccgactcgcctggccttggcggcctggaaggagtcgccgccgcccagcacatctcccccgcccggcagccggaggtgctcgggggagtcctcccgcgcccgcttctcctcccgccgggccacccgcgcctccacccgcgcctcccggccctctgccttggggtgcactnnnnnnnnnnggagtcctcccgcgcccgcttctcctcccgtcgggccacccgcgcggccacccgcgcctcccggccctctgccctggggtgcaccgcgtcgatccactcccgctcggccgcggcgctgcgccgcgccgcctcgcgccggtcccccgctgccgcctcgcgcgccgaggcctccaggttcatgtcgtcggcgatggccgccgtcaggcccaccgacgtgcgatcggccgccgccgtcccggcgccggagaaaccccaggtgtagcccgtccgctgcgtcgcggcagcggcgatgccggtgtagaacttggagggcagggcgccggagttccactctcgcacaaagtccctgaagaaggcatgggccgtctccgagtccaagtcactgtggcgagatga

SEQ ID NO: 2738 - DNA, 1368 bp, Chlorella protothecoides
  modified_base (85)..(94): a, c, t, g, unknown or other
  modified_base (602)..(611): a, c, t, g, unknown or other
  modified_base (1302)..(1311): a, c, t, g, unknown or other
atgagaataggagaagtggttggaataggggaagtgattggaataggggaagtgggagcggcgtgcaaactatcagttttcaaannnnnnnnnncagggactttaagggtgcgggatgcatgctcctatgggttaagggcgtgcttttccatgtcttctgctgcagggatcggcgtgcaaactatcagttttcaaggcctcgttttgagcaagtcatcacagacccatccatgctccatgccgcaggtggatgcggcgatcaacagcgggaacagcggtggccccgccttcagcgatagaggtgggatgtcaaggggaaaaggaggtcatgctggaggattcaggcaggataaagctgttgtcatgggacaacggcggccaacacacagagggatgctttcccatgcctgtgagcccctggtgtgcctctgggccacgcccagcagttcgcctccctcagaccatcaattctaccgtcccccacctgcacctgcaggggagtgcgtcggcatagccttccagtccctcaaacatgaggacgcggagaacatctcgtacatcatccccacgccgggtgtggactcttgggagggggggcctgnnnnnnnnnncctcaaacatgaggacgcggagaacatctcatacatcatccccacgccgggtatgggctcttgggacgtcagcctgcacgtcaagctgccgaggatggcctgcacattccctcccgcctgcccagtcatcgagcacttcatcaacgactacgagcggaatcaggcctacacaggcttcccctccctgggggtggagtggcagaagatggagagcccggtgctgcgcaaggcgctcggcatgcaggtctggccgtgggggtccaagggaggagatacccagggtttgtgggagggtttgatgacgcagcggtgggggaagagacagcaaagggggccaggtgcggtctcacaagtggtgtgagccccagcgctcacgatgcgcctgctgacagcaggaattcccctcaccccccaaccctcaccacggctgcagccctcgcaacgcggcgtcatggtgcgccggatagagcccacgtcccccgtcagcaaggtggtttgccagggggacgtcctcctggcctttgacggcatcgagatcggcacagacggtgggcggctgcggtgtccttttcatgctaggggatgctgcctgagtctggggggtgacggacagtgtgcggggccgtgcctgcgactccctccggtggtcacgacgccggcgcgggctactgatgccagccctggtgacacnnnnnnnnnntcggcacagacggtgggcggctgcggtgtcgttttcatgcaaggggatgctgactga

SEQ ID NO: 2739 - DNA, 984 bp, Chlorella protothecoides
  modified_base (140)..(149): a, c, t, g, unknown or other
atgcgagtaagctgccagaggagtccatacaaaaggtacagcctcgttgcagacgactttggtggggtgccccggccacatgctcgccggaaataccacccatgcagccttgcacagtcgcccgcactagatccagacgnnnnnnnnnncttgatcatggctccaaggagcaagaatcaggcgagtaagctgccagaggattccatacaaaagtcgcccgcactggatccagacacatctaacggcccttcttcacaggtatcgacgaggtcgcaggctccccagaagcggcgcacccccgcaggcctctccggcccggccaccggcagccaggcccgggagcaggtggacaccgctcccggctcgcccacgcaggggggccgcaagcggcgcaaggagcggctggccgcctcagcccccggctccacctccgccgccgcgctgagcgagctggactgtggcggcggcggcgagggcgcgccccccgccctgcaggcctacgccgcggaggacgacggcggcgcctcgccgcgcgaggcggagatggaggccgtggtcaaggtctttgccgtgcacagcgagcccaacttctcgcttccctggcaacgcaagcgccaattctcctcctccggatcggggtttgtggtggcagggcgccgcatcctgaccaatgcccactgcgtggaccaccacacccaggtcaaggtcaagcggcgcgggtcggacgccaagtatgtggcctccgtgctggcggtgggccaggagtgcgacatcgccatgctcaccgtggcggacgaggacttctgggcggggctggaggcggtgcgcttcggcgcactgccccgcctccaggactccatcaccgtgatcgggtaccccatcggcggcgacaccatgtccgtcacctcgggtgtggtcagcaggatagaggtcacctcctacgtccatggggcggctgagttgctgggcgtgcaggcaggctga

SEQ ID NO: 2740 - DNA, 1044 bp, Chlorella protothecoides
  modified_base (9)..(18): a, c, t, g, unknown or other
  modified_base (821)..(830): a, c, t, g, unknown or other
atgtcatcnnnnnnnnnngtggatgtttctccttcatgcatgcatgaacattccgtatatgagtgtgagaacgccatcaagaagcatgtcatccgtcactttcatccacaagaaaccagtgctgagaccaggggaaatgcatccttgttgggcaaattgctgacgacacagcttcagaagagaaccgttgtcgtgttgtcctgtggaaggatgcatttgccttatataggccaccccaagctcatgtgcagctcgggtcgcgacaagtcaggacgtatacttgaaaatgcgcgtagtctccacttgcatgcgttcagtgcattttgtagatggtccatgcactcctgcccatcctctctcaaaggcatccaagggccggcgagatccacgaccatatgccagttgactctgactgggtcgccgacctccccgtgttgggagaggcgcgatggctggggcttccgcctccctggactctgtggagtccgcatcgctattggacatgctccaatacctccgccaggtgactattcaccattcggttgcattgaggtcgtggtgtgcatggctatgaagagggagtggagccccgagtggggcgccagagagctgagaagtcacgactccgaagcagtggcacgctatggaagcaccatcctccgaaagtacgccaggaagctgaatcagactgagcgtgagtgggggcgtgctaggtgggcgaggttggatcctatatgtgccccagctgcagcgttgtcaggggctgctaaccctcctaccgactccctctatgcagtgtggctcatccacgagcagacggnnnnnnnnnntgctgcagcgtcgccaggggctgccaaccctcctaccgactccctccatgcagtgtggctcatccacgagcagacggcacaagcggcaatggacacgcacaatgagccgctggcactcagcatctcccagaacgtgttggcccgattccccaagggtgctcgcggcagccggctggcggtgcgtacggagggagcgtctggaatttccttttga

SEQ ID NO: 2741 - DNA, 876 bp, Chlorella protothecoides
  modified_base (579)..(588): a, c, t, g, unknown or other
  modified_base (793)..(802): a, c, t, g, unknown or other
atgaacgacacggaggtgggtttccggggccagcgtgtgtgcgtcgagcctctccgacctccctcagcggtaatactttatgtcggactccaaatcttctcatgtgctccccggcgctcccctccgcccactcccccaggtcacgaagacgatcgagcaaatggtccgcttcatccggcaggaggcggaggagaaggccagcgagattgccgtggccacagaggaggaggtgggtgtcgtcccctggattcagaacaggcccagcttagggtcacgttcaacatcagcaagctccagttcgtggaggcggagaagcagcgcatcaagagcgagtttgagaggagggaaggcgccattgaggtcaagaagaaggtggagcgcagcaagcagctgaatgagtcacggttgaaggtgctccaggctcgcgaggatgcagtacagaccttgctgaccgaggcgcactcccggctcgccaagctggcaaaggacaaggccaagtacaaggcgctgctcactgagctcctcatccaggtgggtactctgtgttataccgacatgccggaagccaagggctccagnnnnnnnnnngggggagcagtcgagatgaaaagggcattgtttgccctagtacggttggtcgccctggagaacatgtaccgacatgccggaagccaagggctccagggacgcatgtgcgatggatgtccgaggctccccctccctgcggagaactggtgcggcctgcgttcacgccgcacctcgccagcacaacctcaccggcaccgcgcctgcnnnnnnnnnncagctgatgcggcctgcgttcaccccgcacctcaccagcacaacctcaccggcaccgcgcctgcagggctttga

SEQ ID NO: 2742 - DNA, 342 bp, Chlorella protothecoides
atggcgacgctggagccatacagtaacccgttagtcatgccgctggcggagtggatagagcaccccattgcgcgggagctggtgcacgagggcgctaccctgcagctgctgggcatcagcaacgtctcgcgctggggtggcgaggccacccgcctccgccgctgcttccacgcccatgcgccggcgcgtgttgagctggcggcgctggcggcccgccgcctggacggcctggctggggcgggcaccctggagcagctgcatgcctccgtggaggcgcatgcggacgcgctgggtgagcgtccggaagcttgggagggtttcgctccggccgtcgcctggtga

SEQ ID NO: 2743 - DNA, 546 bp, Chlorella protothecoides
atggcacagagtctccagcctggggtggcggtggtcactcagctcagggaccccacctcccgcgtgatcagcgcctacgaatttgccgtgagcgtggcggcagagagcctgggggccgggggggagggcccgagcctccaggcgcctgagcacctcaactatgtgaacacgatggaggtctggccctggtccatcctcatcccctggttcaggcgcaacatgcaagcccgcgtgagtgtcagggcgtcttggaatgaggtgctgccttgctttgggccccttgctgagagtcgggggaattgtgctgaaccttcatgctgccctgctggtatcagagttgggtacaccactgggagtgtctacaggtacacagggctgccgcgccatgccactgaccccctccacatccccactgccccagctggaggggctcaggaaggaggcgaccagagatggcaccaccacatggctgaagttcaagaccaggaaggggcaggtgtactggtggaacaggtccaccaacgcgacctccctcaccgtgggtag

SEQ ID NO: 2744 - DNA, 498 bp, Chlorella protothecoides
  modified_base (414)..(423): a, c, t, g, unknown or other
atgcgacctctactcctcctcgtgatgctcacggcggcccaggccgtgatctgccgtgcctccctcgaaacgaacccatccgacgagcagtgtgccgcctggatcgcagcataccgagccgatcatcctgtgctggacaagcaagccctgaacggcactcggcccagccaggtgtacttcatgcacatcccccgcaccggcggcaagacgtgtttctcctgcttcctcaagtcagctgtgccaccctcccagcgctgcctcaaggcgtatgacgggcctcgccttgccctcagcagccccagctgcggcctcatctccagccacgatgactacagcctggtggatgtgagcgtgctcggctggtgtttggtcggacatcacatcctgagagccccagaccctcccatgcacaannnnnnnnnnggatgtgagcgtgctcggctggtgtttggtaggacatcgcctcctgagagccccagaccctcccacgcacagtag

SEQ ID NO: 2745 - DNA, 786 bp, Chlorella protothecoides
atggcgcaagggggagcgagtctgcttcccggcatgtgttgcggcgttgagacccgacattcgcgtgcggtggagtgctgcccgcagcacgtggagctttggttggcgctggcgcgactggagagctacaagaatgcgcaaaaggtgctgaaccgcgcgcgccaggccattcccacctcggccgaggtctggatcacggcggccaagctggaggagagcgcgggccaggccgaggcccccgccaagatcatcccgcgcggcctgaagtcgctgcaggccaacggcgtggtgctggaccgcgagtggtggctgcacgaggcggaggccgcggagcgcaccgcgccgcccctgcccgccacctgccgcgccatcgtggcggcggtggtggacgagggcgtggaggccgcggaccgcaagcgcacctgggtggctgacgcggaggaggcgctgcgccgcggcgcggtggagaccgcccgcgccatcctggccgccgcgctggccgccttcccggggaagaagtcggtgtggcgccgcgccgcggcgctggagaagctgcatggcacgcccgagcagctggacgcgctgctgcgccgcgcggtgcagtactgcccccaggccgaggtgctctggctcatggccgccaaggagcggtggcgggggggggacgtgggcggggcacgcgccgtgctggaggaggccttcctgcgcaacccggacagcgaggagatctggctggccgccttcaaggtggagttcgagagccgggaactggaccgcgccaggtga

SEQ ID NO: 2746 - DNA, 786 bp, Chlorella protothecoides
  modified_base (67)..(76): a, c, t, g, unknown or other
  modified_base (242)..(251): a, c, t, g, unknown or other
atgactggcagtgggggcctgtggatgaggtggatggtgcaggggctcggtgagccagagacatggnnnnnnnnnnctggcggtgggggcccgtggatgaggtggagtgtgcaggggctcggtgagccagagacatggcaatcagatggcggtggagatgcaggatcggtgatggggacttggcgtccacgcgttctcccttcccatgccgggggtgctggtctgcccactccctcacaccnnnnnnnnnnaggggtggagatgcaggatcggcgatggggacttggcgtccacgcgttttcccttcccatgccaggggtgctggtctgcccactccctcacacctctgtgccaacctacaggatgatcctggcaagggcccgggagcacccgcccgcctccacccagcgcgtgtggatgaagagcgccatcgtggagcgggaggcgggggacgccgttgccgaggcggcgctgctggaggagggcttgaccaggttccccaccgcctggaagctgcacctcatggcaggggcgctggcggagcgacagggcgaggtcgagcgcgcgcgtgccgcctaccacgccggcatcaagcgctgcctggactgtgtgccgctgtggatcgccgccgcggcgctggaggagcgtgagggtgccctgggaatcaggaccccgctcaccctgcagtgcatgcacctgcgccccgcgtgctcacccaccgttgctgttgtcggcgaccgcgatcttccatccagagcagccgctgtgccccgatggctctcctga

SEQ ID NO: 2747 - DNA, 783 bp, Chlorella protothecoides
  modified_base (39)..(48): a, c, t, g, unknown or other
  modified_base (200)..(209): a, c, t, g, unknown or other
atgcctctcaccatcaacaaccacaaaatcccagcaacnnnnnnnnnnggctgtgccctgatggctctcctgacgtcccctccacccaccgcacatgcctcccaccatcaacaaccacaaaatcccagcaacctccccccctcccctcggccctcaaaaagcacgcgcgcgcgctctgctggagcaggcgcggctgaagnnnnnnnnnntcccctcggccctcaaacagcccgagcccgcgctctgctggagcaggcgcggctgaagaaccccgggcagccggcgctgtggctggcggccgcgcgcaccgaggcgcgtgccggcaacggcaaggcagccgaggcactgctggcgcgcgcgctgcaggcctgccccgactctggtgcggtgtgggcggagagcatccgcgccgcgccgcgccccgcgcgccggagtcgctccgtggacgcgctcaagcgctgcaacgacgaccccaccgtcgtggcggccgtggcgcagctcttctggggcgagcgcaaggtggagaaagcccgctcctggttcgaccgcgcggtcaccctggaccctgacgtgggcgaccactgggcgctgtacttgcgcttcgaggccgcgcacggcacgcccgaggcggcggccgccgtgctggagcgcgcggtggcggccgagccacgccatggcgagcgctggcaggcgctggccaaggaccctgtgaatgcgcaccagccgctggggacgctgctcaagaagctggcacagaccatcgagaaggacatggccatgtga

SEQ ID NO: 2748 - DNA, 225 bp, Chlorella protothecoides
atggcggcggccaagcttgagaccagcgacgaggcacgcaagcgcgtgctgctgcgtgccctggagcgcatcccgcagtcggtccgcctctggaaggccgtggtcgagatctccgacgaagacgatgcgcggattcttctgaggtgtatgcgcctcgaggcatatcgcaagggggagcgagtctgcttctcggcatgtgttgcggcgttgagacgcgacacgtag

SEQ ID NO: 2749 - DNA, 513 bp, Chlorella protothecoides
atgtccatacggcctgcctcttcccggcctccccaggcccctggggccaagatcgacttcaatgccctcagggcaccagccaactatgtgccgggactggggcgtggagctgcgggcttcacgacccgctcagatatcgggccgtccatgcctgcccccgacatggcctcacaggcatgcatgtttgtgcgcggaggtgcaggcatgcagcgaggtggtcaacatcatgtgttacatacactccatcggaatgcatgcgctgcggagggcggggacgacgactccaagtttgatgagttcctgggcaacgatgggggtgtgctggccgggacgggggcctacgacgacgaggaccgggaggccgatgccgtgtgggaccaggttgaggaccgcatggacgagcggcgcagggtgagggcaggggggtggggacgggaggggaggggattgattcagggctcgccccccggtgccaccccactggcgcctcccccgcgtcgttaccctccttga

SEQ ID NO: 2750 - DNA, 690 bp, Chlorella protothecoides
atgggcaaaaacagccgcgaggatcggtcacggtcaccatctccgagtagagctgcaggcgtcagcatcctcggcacctgccatatctgcaccctatccctccactctctctcatctcgccacagtgacttggactcggagacggcccatgccttcttcagggactttgtgcgagagtggaactccggcgccctgccctccaagttctacaccggcatcgccgctgccgcgacgcagcggacgggctacacctggggtttctccggcgccgggacggcggcggccgatcgcacgtcggtgggcctgacggcggccatcgccgacgacatgaacctggaggcctcggcgcgcgaggcggcagcgggggaccggcgcgaggcggcgcggcgcagcgccgcggccgagcgggagtggatcgacgcggtgcaccccagggcagagggccgggaggcgcgggtggccgcgcggggccgggaggcgcgggtggaggcgcgggtggcccggcgggaggagaagcgggcgcgggaggactcccccgagcacctccggctgccgggcgggggagatgtgctgggcggcggcgactccttccaggccgccaaggccaggcgagtcggtgcaggttctgccaggggcttggggggggactcgagcgcgaggcttgggagggacagcggactgtatcgctga

SEQ ID NO: 2751 - DNA, 504 bp, Chlorella protothecoides
atgtcgcgcccccatgccatgacaccacgtggccgcctcgcggggggaaagtactccagcctccagcgtcatggcccccctcaagccttctgccatgtcggggcccaggctcccgcgccctacaaccccatcaagccgtcatgcagacccagccttcccgcaactggggccaggaacgtcgatacctgcgccgtgaagaccctgaagaagcggcggctgcccctgaataccacccgctccccgctcaacggtttcaatggcacgcccgaggtgctccccgcggcccaggaggccccaaaaatcccggatacctccccctggtggatgcagctgggccccacctggagcctgtgcgtcctgaccttggcctacctccaccactccaccacgggctatgccctgcccgccctcctgcccataatctccgaggacctgcacctggtggatacccaggccgccaccctcaccgcaggctacacggtgaggagtgggtggttgttttag

SEQ ID NO: 2752 - DNA, 189 bp, Chlorella protothecoides
atgtcgctgggccagcgccccgcactctccgccgccacctccaacatgaccaaggcccagttcatggccgcggtggagcgcaccaaggagcacatccaggcgggggacgtgttccagctggtgggcagccagcgcttcgagcgacgcacctttgccgacccctttgagatctacaggcaaggggggtag

SEQ ID NO: 2753 - DNA, 456 bp, Chlorella protothecoides
atggccccgccgtcggcgcaggtgccccagacgggagcggcagacccgccaagcgccgacgaggcggaggaggaggaggaggaggcgcgtgcggtgaagaggccgcggcaggggcgagccgctcattcaaggctggcgctggcagggctccgtgcatggccccccaaatgccgccctttctttcccccgtgcagcctgatttggacggacgcgctgcactgccgcttcctcgaggccctggagaccatcggcggggtggacaaggctccccccaaggccatcatgaaggtgaggcgctgcatgctgctctgggcgctgcctgtagggcttggagggctgcgcgggggcatttcttgcggcccaaacttggccgctgtgggtctgtgctgtgccgtcgccatcctggcacccatcaccaacactttgcccatcgggcaacgcaggagatgggcgtga

SEQ ID NO: 2754 - DNA, 339 bp, Chlorella protothecoides
atgagccagcgcagggcgtcggccaagaaccccggggagcggttcaagccacgcgacatcaccaagaagcgggcgcgcaaggactccaagtttggatttggaggcaagaagaggctgctgaagcagaacgacgccgtctcttctgccgacgtggacggctaccgcccctcacgccgccccgacagccccggcgggcggcggggcgggcgcggcggcgggcgcggcggcggcaggggcgagggtggcgtggggaggagccgagtgtcggctaagaagggcggtgccggccccagccagaacaggcccgggaaagcgcggcgcgcagccatgaagcgctga

SEQ ID NO: 2755 - DNA, 540 bp, Chlorella protothecoides
atgcaaatcatagatgagctggaggtgacgcggcgcgggccctacggcggcggcctgggccacgtctccttcgccggcgggctggacatggcgctcgccctgcgaaccatggtcatccccacctccagccagacctcgctgtaccagtatgggcgcggcagcgccggggcgccgccgcgccgggagtggaccgtgcacatgcaggtgagggtgtgtatctgggagggaggctgcagggtgtgtatctgggagggaggctgcatgggaggagaggcaggaggcaggggctgcagggccggggcgggggcggcaagtccatgtcgctgcggtgcgacccggctgcaccatgctccagcccatcaaggcccccctgccctactcatggccccattgctgcagtctggggctggttttgtggcagactctgacccggagaaggagtgggaggagaccgtgaacaaggcggcggggctggggcgggccatcgacctcgcggagcaggcctttgtcgggcaggcgggccgagagcaggagggatga

SEQ ID NO: 2756 - DNA, 759 bp, Chlorella protothecoides
atgaaggaggagctggagcgcttccgcgccgccaacccacgcatcggcgacctgttcacggacctgaagcgcgggctggcggagctggacgcctcggcctgggaggccatccccgagatcggggacacgacggtcaagcgcgcgcggcgcgccgagatcttcacccccgtccccgactcgctgctggcgcgcgcggcggccaccgcgggcgacgcccccgggctgaccagcctggaccccggcggcgtggggcccggcacggagaccccgggcgccgccaccagcctgaccgccatcggcgcggggaggagcaccgtggtccagctcaaactggaccgcctgtcggactcggtcacggggcagacggtggtggacccgcgtggttacctcaccgacctcaagtcggtgacgctcaagtcggacgcggagatctcggacatcaagaaggcgcgcctgctcctcaagtcggtcatcaagaccaaccccgcccacgggccgggctgggtcgccgccgcgcggctggaggaggtggcgggcaagctccccgccgcgcgcgagctggctctgaaaggctgcgagctcgcgccggggtacatcgacgtctggctggaggccgcgcgcctgcaggagccggagaacgcgaaggccatcctggcgcgcggcgtcgcagcgctgcctgaagcaggtatgtctggatactgcgcaggcgtcaggggaggagcagggggtcgaaagggcccagggatggggcaggcgtag

SEQ ID NO: 2757 - DNA, 405 bp, Chlorella protothecoides
atggcaaagccgatgcatgcctggaagtcggcccccacgatcgaggactccctcccactcacgtcggacacggcccccccctcggtcgccagcccgctggcgggcacacgcccgcgcggcgccacccaggaggctgacgaggcgctggaggcagacctgctggccgacgagaaggagctggcggagcacatcatgctggtggacctgggaaggaacgacgttggtcgcgtggcccggcacggcagcgtgaaggtcgaggcgctgatggaggtggagcgctactcccacgtcatgcacatctcctccacggtgacggggcgcctgcgcccggggctgaacgcctgggacgcgctgcgtgccgccctgcccgtgggcaccatctccggcgcccccaaggtcggttag

SEQ ID NO: 2758 - DNA, 1560 bp, Chlorella protothecoides
  modified_base (152)..(161): a, c, t, g, unknown or other
  modified_base (529)..(538): a, c, t, g, unknown or other
  modified_base (1404)..(1413): a, c, t, g, unknown or other
cccgtccaagtccagcagggccacgaggtggagcagctcggggtccacaccgtgctccctggaaatgtcggccaggccgcgacgcagcggcagcaggggcccgcacatttggtggtcagcaatgaagaatcagaggggtccaggagggacgnnnnnnnnnnatgcccggctgcagtagcggggcagcagtgggttggaggtgccgtcctcggcgccgccggggcccttctgggcttttgcgggcatcatgggctccaggcaggcatggcacacgtggctagcagtcctgtgtggaggggataccggggggggaggagagtgggaggggggggcccgcacatttggtgtaaacagcgaacagaaggcaagatggaccatgtggtcgtacagctgcctcgtgtcttgatcatcgatctgtgtgccaccatgtgtgagagcaccctggagcccaagcttgccatccatgcgccccaggcagccatgaggccatcaccaggggcccctccaaaaccacatctgcatcgcaccnnnnnnnnnnacctcaggcagccacgaggccatcaccagggaggtcggtgtcggcgacggctgtgcgccccacggcacgtccaccatgcccgggagtccagggcagggcatcctggacagcggccacggagggcagggtctgctgctgcttggacgcctggtgcggggtttggtgggggcggtcatggccatcaggtttgtagagacccgggagaagcccggtgcgtgatcagcagcaggagtgagtcaccagccggccgggactccaccttggatttcgccgggctctttgggtttggcgatgaggtgcggaccatgctgcctgtggcgattctccgtgctggccctcgtgccggggtgcagtcagtaatccttcggcctgccacgccaccgacccgcacctgtgccgataaagaatctgcatgcgcgacgccggctcgcgctgcacgacggacggggtttgtcccaccaggtctcgcaacccccgtcaagcatggtcctgatcgcggcatgtcgccctgcctctcggccgcacgacttcccagcctgagacccttgccagcctgcaccagggcgggaccaggggctttgccgagccccgtcccgagcatgagggtgatctttgttaccacagaggtggcgccctggagcaaggttgggggcctggcggacgtcatgggggcgctgcccccggcccttgcagccaggtgggatggcgtgggtggcctgggtcgggctggtcaccctggcaagtctcgggacccctggcttgggccggtgccggagtgcttgtgggtcagcggcaggacggccaccgccgttccgtcgcgcttgcctgacccccctaccctccacacccccgtgcaggggccaccnnnnnnnnnnagcccttgcagccaggtgggatggagtgggtggcctggttcgggctggccatcctggcaagtctcaggaaccctggcttgggccagtgccggagtgcttgtggttcagcggcagggcggccaccgccggtccatcgcgctttcctga

SEQ ID NO: 2759 - DNA, 426 bp, Chlorella protothecoides
atgaccgtgtccccgcggtatcaggcagcggaggatgtgctgcccaccgacctcagcgtcccgctggacctccccgcccccgaggagcgtggccccgacgagggcgatgaggaggccgatgaggccctggatacaacggcgcgcctgttcctggcccggcaggacggcgtggaccacgtcttcgtggaccacccgctcttcctggccggcggcgacatctacagctgcggcccctccctgggggtgaccacctacatggaggcggggcagggcgcggccgccgcgtccctggacctgcggtacagtgtgctgtgtcaggccgccctcgccgccccgctcctgctctgggcggcgggcgtgcgcgaggcggcggccgccgcggccgtcggcgcggcgatgggcgctgcgctggacgcggcggctgcc

SEQ ID NO: 2760 - DNA, 489 bp, Chlorella protothecoides
  modified_base (261)..(270): a, c, t, g, unknown or other
atggtgatgcgcagcaggccgtggcgcgcggcaaactccgccagctgcggcgcgcgggccatggtcccatcctcgtcgtcgttcaccacctccgccagcgcgccggcggggaagcagcccgccaggagggtcaggtccacgcccgcctcggtgtgcccgggccgctgcagcacgccaccctgggagtggggagcggggggcatggggttgaggcgggcgtcacccgtgcgctggcatcggggcagggacccgggcccacgnnnnnnnnnnccctgggagtggggagcggggggcatggggatgaggcggacgtctcccgtgcgcttgcatcggggcagggacccgggcccccacgccctccggggcgcggggtgctgggtggaaggaggtggacctgaatccggggttcccggcgccgggtgcagggacgcagaggaggccccaggccctgcctggcagcacggggcgcccgcagtggccctcccctaa

SEQ ID NO: 2761 - DNA, 213 bp, Chlorella protothecoides
atgccccccgctccccactcccagggtggcgtgctgcagcggcccgggcacaccgaggcgggcgtggacctgaccctcctggcgggctgcttccccgccggcgcgctggcggaggtggtgaacgacgacgaggatgggaccatggcccgcgcgccgcagctggcggagtttgccgcgcgccacggcctgctgcgcatcaccatcgccgacctg

SEQ ID NO: 2762 - DNA, 600 bp, Chlorella protothecoides
atgctgcggctggggcaggcactgcgccagcaagcaccccgcccggcccagcgccgtccggcgcccccgacctcacccagtcctgcagccaaagccagaccgcctgctccttcacgtgtcgcatcgtgggccgctccttccagtcgccccacgcctgcgactgtggccaggtggcgtgctgtccgtgttgggagcgaggtgcagggggaaatgaggcgccggcttgagtcctgggccgtccccgactggcacaatcatgcccccgagtcatgtgttccacgaaccccacgcagtcccaaccccttgcctcccacccaggcggtgtgcctggagctggaggccgacaaccccagggacaaacacgcgacgctggtgctggacgccgggtcgggcgctgctctggggcacgtcccgcgcgaggtggcacgcctgctggggcccctgctggccgcccagctggtggcggtggaggggtgtgtgttggaggccccggcctccagccgtgcctccgtaccggtggagttccaggtgggggcggccgggcgttgggtagcgtgtttgtgtcgtggtggatgtgtgtgtgaggacgggagggggtga

SEQ ID NO: 2763 - DNA, 2691 bp, Chlorella protothecoides
  modified_base (967)..(976): a, c, t, g, unknown or other
  modified_base (2429)..(2438): a, c, t, g, unknown or other
atgccccgaacttcaaggcgaatggcgttgtcggcacctatatcttgctcaattgaaagcctgggtgccttatatttgcggccattcactgggctccatatagaaagacggaattggctgcgtcgaagtaaggctggagtcgaggagaactcagatcgcctggacgaattccgatggcgtgtccttgccatcatgtctgacgcgggcatggcggagaacgtgcaatccctgtcactcgaggagccgaaggtgccctcggaggggaggtccgaagctgagaaggctgccaagaaggccgccaaggccgctgccaaagctcagaaggaagccgaaaaagctgccaaggccgcaagccggggccagaagcaggcatcagtcaccgaggccgacccgaacgatccacttgccagccagtacggcgatgtcgagctggttcagagccagacgatctcggggaatgtatggaccaaggtggagaagttggaccctagcattgaaggcaccacggtcttggtaagagcacgggtgcagaccgttcgtggcaagggcaagtctgcctttttagtgctgcgccaggagctggccaccgtgcaggccgtcctctttgtcgatgacaacactgtcagcaaaggcatggtcaagtacgcctccgccatcacccgggagagcgtcgtggatgtcactggtgtcgtcgtgcgccccctggctcccgtagagggctgctcgcagtctgaggtcgagctgaaggtcactgccattcgatgtgtggcacgggcaggtcccctgccctttgagatcgctgatgctggtgaggcgcaaaaaggcaacgcaccctgcacgtggtgcggaggccatatccaaggccacggaagctggcgagcaggtcgtcaccgtcttgcaggacacgcgtctggacaacaggatcatcgatctccgcacccccgccaaccactccatcttcagggtnnnnnnnnnnagtctgcggtcacacagctattccgggagtttttgctgaaggaggactttgtggagatccacaccccaaagctcctcggtggtgcctctgagggcggcgcatcagtattcaagctggattatatgggacagccagcctgcctcgctcagagtgcaagcaacactcatatcaatgtcccccatccctcatgcaatgtctgcagtcgccacagttttacaagcagatggccatctgttcagacctgcctcgtgtgtttgaggtcggcccggtcttcaggtgggcaaaaatataccagtgaacgaccaggatttcttactgtgtatgaggctaaagtcacccctcatccagtggtggattgccatgctgacgctcccaaactttccattccattccacgccagggctgagaattcgtacacgcaccgccacctgtgcgagttcactggtcttgacatggagatgactatcaacgagtcctaccatgaagttctggatgtagtagacaggcttttccacacaatgtttgagtctgctcaacggcctctgagtaatgtgccacctcggttcaacctcaaccttcaaagtcccgctccctcatgcgcacctctcaatccacagggccttaacgagcgatgtgcacgggagttgacgaccatcaactctcagtacccctttgctccgctgaaattcctgccaaaggcaccacgcctggagtttgcggaagggatcaagatgctgcaagaggctggctacgatagtcccgtcaggctgacggcccatgcgccaaccttggtgtttcaggttgatccttttggtgatctgaacacggagctggagcgggtcctcggcaagattgttgccgagaagtacaacactggtgcgagctacatccagcgtctccctccccaccctgcagacttctacattctgcatcgttacccttctgctatccgtccattctacacgatgccatgcaaggatgacgagcgatactcctgctcttacgacatcttcattcgtggcgaggaaatcatctctggcgcccagttcccagtggcctctgaatcgtcttcttaccctaccatgtcacagaggatccacgacccttccctgctggagaggagggccaaggaatgcgggattcctgtggagaccatccaggcatacgtggactccttcaagtatggtgcctggcctcatggcggcattggtgtcggcatggaacgagtggaggccacatcggcgaagagtgcatgcctggcatttgcacccccagctgatctcttgagtctcactcaagctccatcctgctgtgcaggtcatgctcttctgtggcctggacaatgtgcggaagacgtcgataggccaggggggcatgtagtcgctcaagacttggatatccaagagagagacagaggcaaagtacttgaggacgagcagtctcttgggtcagnnnnnnnnnncgtagtcgctcaggacttggatctccaagagagagacagaggcagattacttgaggacgagcagtctcttgggctcagcttccgtccatccaggggtgccctttgggatgctgatatcagcgatccgtcccccgggcaacctactacccaggggctctcaacaatctcccatcagtccgattgcgcgccttggccagatcccgagtcttcatggctgccgaaagtagctctggatgccaccaggaccgcctaa

SEQ ID NO: 2764 - DNA, 1938 bp, Chlorella protothecoides
atgtcgaatgagccagctatttccgaaagccccctcaccgggacacaccttgccacgtcggagggactatcgtctgcgaccgccatactggttgaagggaaaggaattgatgagaaaacacatgagttgacacccttagccctcgtcccggccacacgcatcctcatcgaacttcttttgacacagctcgtgccatccgcagatcagatcggagccatgcagtgtgcacgcgtcactcagccctccgttgccgggaacgggatcaggtgggaaggtgatggtcgggatgtatccgaccgcccaatgtggtgtgcagcgccctccctcggcggtcatgatggtggtctcaggcccgtcccagcgttcgctgcatggccaagcccaaccacaagggccgctggtcccacattgatgctggcaaggatacctctgatgaccaggtgtgggacaggggaaacatgctggggctgtcatgaggtcccagggagcatagaacaggctgatggccccttgtcgctccgattctcattgccgtcccccctttcctccctctctgcacagcaagacatccagcgcgggcgcgacatggtggacagcctgttccagggaggccaggcgattggcggcactcacaacgccatcctttcctccgaggagtacctgtccaccgcccagcgcactctgggcaacatcgaggacggcttctacatctccccagccttcctagacaagctgtccatccacgtggccaagaacttcctggacctgcccaagatcaaggtgcccctgatcctgggaatctggggaggcaagggccagggtaagaccttccagtgcaacctggccttcaagaagctgggcatcgcgcccatcgtcatgtcggcgggagagctggagagcgggaatgcgggggagcccgccaagctcatccgccagcgctaccgcgaggcttccgacaccatcaagaaggggaagatgtcctcgctcttcatcaacgatttggacgcaggtgctggacgtatgggctctgccacgcagtacaccgtgaacaaccagatggtgaatgccaccctcatgaacatcgccgacaaccccaccaagtgcgtgggggcgggggaggggctctggacacctgtggcgagcatcgttctgacaccatgtgaaaagcacacacgagggatcggtggcatgctgcctttcctgtgtgctcaccatcccattgctcacagcctggcacacttctcctcaggaatcacccaaaacgaatcatgccctgccctgaccaccgctcccacccgcccggcccacgtgacccgcagtgtgcagctcccgggtgtgtataagcaggaggagatcccccgtgtgcccgttgtgtgcacgggcaatgacttctccaccctgtatgcccccctcatccgcgatgggcgcatggagaagttttactgggcccccacacgggaggtgggcgactggggtgatctctgccacgcttgcacttgcttggctgtgtctgactgcagctggcaatcacgtcaacgtgtgctgtatgatcagggggcctcccctccagaccgtgttggtgtgtgcaacggcatcttccagcacgacgacgtcaatctgaaggagatcgagaagctggtggacgccttccccggtcagtccatcgacttctttggcgccctgcgcgcccgtgtttatgacgacaaggtccgcgagtggatctccggcaccggcatcgaggccatcggcaagcggctggtgaactcgcgcgagggcaaggtgacgttcgacaagcccatgatgaccctggacgtgctgatgaagtatggcaatgcgctggtgggcgagcaggagaatgtgaagcgtgttcagctggcggagagctacatgtcaggagctgccctggccggctccaccggctcctcccacgccgagtga

SEQ ID NO: 2765 - DNA, 312 bp, Chlorella protothecoides
atgacatatttgagcacggcaaaggtgggctgccagggaagtggatccttgcctctggggggaggggtaattctcggacaccgcccattcacacctgtgtacgacctgcatccatccattcagctcatcccgcacgatatacgagcacagagacaccttcagcagcatgggagtgtgcacatcaccgctctgggcacggcgctgagctccctagtcaccctgtcggaggtgctcaagaacagcaagcttgtggatgaggtgaagctcaccacttgtctggagcactttaaggacgaattcaggtatggctga

SEQ ID NO: 2766 - DNA, 966 bp, Chlorella protothecoides
atgcttgcttcgcaaacattcgggccgggctccgtttgtggacgcagacgtcagacaatctcgcacggtcaggacaaaactggggccggtgatcaagtctattgtaattactttagggtaacgtgcggatggccgttcatccctcttgaggaggggtttagaactgcttccaggattcgacaggctgcaagacgttcgtattcaaccatcgcgagggtactgccgatggtcccggagagtgtcgaatggttatgggcagtcgtgtttacttctgttagtcgtgtgtcgcagcaagggcgaggatatcgacatcggcgagataattcagttgccccttgcgtacatcgcatccaggcagcagagaaggcagccgagatcgccaagaacgcctcacagcaaggactggtaggttgtggctttgtttccgagaaattcagaattcacccctttgctgcgctctcaagattctacgctgcaacggggcggcaggtgctggcaggaggagctgctgagcaagccgcaaagaaattcggcaagcttggcctgcaagagaagcttggcccccgagcagcgaaggagaggaagccttcgcctgatgagctggctgcagtgggcatcaatgactcctaccttaacatggtgtccgagctgcacttcagtaccttcaggcaggctggttctggagggtgccaagatgcagggcgatctgccatttctgtgagtcctactgcaggcttggaagcttgcatgcccaatcctgttgccgttcttgagccctccctcctcttgtaccttttccccactgcatgcagggattttccaaaggacaagctactgcctgtacagggccaacctgtggatgaccaggagttcctgctgaacccctggcagattcagcatgcgacacttctgtgcgccgaagccaaggacatccatgagctccgattcatgctgtgcccaaggtaa

SEQ ID NO: 2767 - DNA, 477 bp, Chlorella protothecoides
  modified_base (342)..(351): a, c, t, g, unknown or other
atgcagcatgagaggcttgcagccgtgttccatgagtctcgtcggcgattcacggagagccagtcgcaagagcctctgtccgccagcccctctggaaacgatgactctgctgcgtggagagggaccgaggcggaggccacagagatgatagtgcatcacgccagcattcttcgaaacaagcgtctcctcttcacatacatgtatgttgaaaaggtgccagccgcgggaggttcagagtcggcttgtagcagggcattgaggggaactctccttttactcgtgtgcatgcatggttgcgcttccaagcaggatagacatgcgggaaagaacggaccgtctacnnnnnnnnnnttgagatcacatgcaggctcctgggagagcacccgggtgacatcatcatcacaatggagtctcggagtattcaaggatggagattctattgatagatacctatctccaggaatggtgaacttctaa

SEQ ID NO: 2768 - DNA, 633 bp, Chlorella protothecoides
atggttgcgcttccgagcaggatagacatgtgcacctgccattcaagcagggtgaacattgatgtgttctttgcctttcattacgggaagcggcagtcccccttgttcattgtcctgggcaactccaaatgcttctacaactcctcgcatcccattcgctgcaggcgggaaagaacggaccgtctacaggagttccgatggacccaccggagcctgcccgcacatgtccagaacaaccttagcccactcgagctccaatactttgccggctacgaccagctcctgaacaagtacatgcgttctgggagactgggtgtaggacttgacctaacagcggatcccactcccccagaggaccctttcgtccaagtacgtgttctgagggactatggggaggtcatgttcagcagcgctgaaggacatggtaaatactgccgaaaaggcatacgagggagagttgaagggagcataaggatcgtggagactcagggcatgaggattcaagttggcgcatctagcttctgcgcaactgctgcagagggaaaattactgcatcgcacccgacaattcggcaccccgcacgttgcaggggctggacctgtggttgcattgcactctgcccgacatatttaa

SEQ ID NO: 2769 - DNA, 1569 bp, Chlorella protothecoides
atggtcgccagcgagcgcctggagcacctgctccctgtcagcctgaaggaggacgtcaagggcccctgcttcgggcacacgggcatgctggcggcggcccaggccatcttcatggacatgaaggagcggggcatcctgaccccgctcgtgggcagcgaggcggcggctgacgactactccgcgccgcgcggggagggcccgccccagcgggaatcccagtacgacgccgacacggggcccagccccctgcgcgcggccatgggcagcgcggggcaggccattcgcgagggcgttgcggcggtgctgcccgcggggggctggacgggggcgtgcaggccaggggatgccgcaggggacgacatcgaggcacagcgcgcggcggcgagaggtgaggtcagaggggagaggggggtgggtgcttactccctgcccttgcctgatgaatgcatcccgccggggtcccaacaaacaagcacaatccctgcgcaccatgctagcagattccgacggaccacgtgtcacggtggacaagctgggggcgcaaaagtcgccgggccagaaggtgggggagctgatgaaggtgaagctgctggaggacgactggcagctcatggtggtgggacacaggtgagcgattggtaccggaaggcttgtctgcaatggggatgcttgtgttctggtcaactcctgacgctggtgcgcaactccgcggcgcgctgcaagactcgagcccgcctcctgccatgctctgtggcggttttgaactccagcaatgcatgcctcctccatcctcatacaaacatccatccaaatgcccacagtctcggcgcaggggctgcagcactcatctccctccagctcctggatcactgccccggactgaagtgcctggcgtacagctgcccaggcgcgctcgtgagcaagaacctggcacatgccatggcgagcttcactaccacgggtggggcctgggacgcggttggtttagttgtggtgggcaaggatgccgtgcccagggcctctgtggcaaacctgggcaggctgatggatgagatggtgacgtccctggcaaggtgcaaacagcccaagctcaaggtgacattctatccctggtggaagaggaagaagcaggacttcaagaatctgttctgggactatgacaagatcccagaggagtcactggaggtgttgagaggatactatgacagcaggtgtggggaacgcggattggcatgtgtgatactagagactgaactgctccgcagtgggagagcctggccatgcatggcgggtgatgtgcatcagtttcttgcagggagatccctggtaggagggtcatgctgtccgcctctatcatgcagagtctctggagggcagcccatgagcatgtacccacctggacgtctcatattcgtgcggcccatcaagacgcggcgcaagaaggcatgggactgtgtctggatctctccagaggacatcatcggtaagacaggggggcgctcggtcttgccagatgcgacgctgaacagaaaaggactccatcccaccagtgccatgtattcaagttga

SEQ ID NO: 2770 - DNA, 990 bp, Chlorella protothecoides
atggtgggtcacctgatcacctccagtatcttgaatcttcagctccttctgttgaaagcagctgtcgcactccgacccacccagggatgccttcatgatggccacatctccctggtccatgctgccgggtcccgatgcgacgtggtcatcgcctccatatatgtcaaccccacccaattctccgccaatgaggactttggggtgtacccccgcagcaccgagcgcgatttagacctcttggccaaggccggctgtgtggctgtcttcatgccggcggccttgtaccatccagggtcaagctcgctggggtcgggtgatgcgagcatggtggtgggtgcagctcagggcgaggctgcctcggacgcacactccacctgggtcaatgtggaggggctatcccagggtctatgcgcgggctccaggccacacttcttcagaggagttgccacggagagggtttcgccacacatcaacaccctgtccctccaggtggttaccaagctgttcaacatcgtggaacctgacatggcattctttgggaaaaaggactaccagcagtggcgcatcctcgagcgcctcgcccgcgacctggactttggcatcgaggtagttggcctcccgattcagcgcgaggcagatggtctggcgatgagcagtcgcaacgtgctcctggcacccgatcaccgcgccgcagcccccggcatctacaaggcattgcgcgccctggaagcggaggtcgccacgcggcgccgcgcaagtggcactgcgtcggtcctcaccgtccaggaagctcagcgatcggtgtcgaggtcgctcgaggctctgggcggggcggtggactatgtccagctggtggacgcggccagcctcaggcccctggccgccggcgctgacctggcggccgggccacctatggtgctgctggccgtggccgtcgtctttgggcgggtgcggctgatcgacaacctggagatccagggacgggcgtga

SEQ ID NO: 2771 - DNA, 1833 bp, Chlorella protothecoides
atgcggcgccggccagcgggcaagcgccccccgctgtccaacatcgcggagctgacctccggcctgctgtcgcacgtagacctggaggccaccgacctgatgacggccgtgatcctgacctccgccgcgcaaaaccggcggcggcgcctgcgcctggccaaggcgctgctgcccgtgtacgaagcgctgcgccagacggggtcgcggagcagccggtcggatcccggcacggccgccagctccgccggcggctccgactcggactccgaggcggagagcggggatgaggcgggggccagcagcgacggctcctcggtgcatgacgtgcccgccagccgccgtctgacgcggcggctggagggcgggcactcggagcggggcagggctgcggcgccccgtgagaccgtgccgcgggggcccagccggttcgacccgggcccggggctggccggcccgcgcagcaggaagatcgtgacctttgagcagttggtgtcgccggggcagccggtagaaggtggggagccgaggccagaggcgccggaggtcgtgatcgacaccgccgccagcctgcccctgaccgagagcaacgtggcgctgatggatcggctggccagcgcctcggtgggcggcgaggaaagcgcggcagggggcggagacgacgggaagcaggaggcagcggcggtggcagtgaccaacgagctccacgacctggctgccaacacggggcaaggtggggaggcgtcggagagtgtggcgaaagggttgggaaagctggccaccagcgtggacgcgactgaaggaagcaaggagcctcatgcacgtgcatcggtacccagccctgcatccagttgtgacctctttgagtgcctgtcctgcactggatgccaggctttgatactggagtgccagatgagtggcacgtcacccccttactccgttcagcacagcgccccagctcgctcagtccttgtcccgtgcacagacgcgggggaattggccgatgcactggcggatgccatccaggatgagctggaggatctgggtggcggggacatcggggccacccacgaggacgcggttctccaagtggacaaggccccctcgctggatctggccctgctggcagacggcgcgtcctccatctggctgaaccccagcgttgcaacgcaggccccctccgtctccaatcagggcgaggaagcggcacccggctctccccgccggactcaggacgccgagttcccggccggagtctctgactccggacccccagactcgccatcagtgccccccgcgacgggaagcagcccctccacccagcccccgccggtgacggtgccggagggcgtggacccgctgccctcccgcgaggccgtggtggcggccaggcaggccggcgcgccggggtcggagggccgcctgccctccgaggccagccagggggcgcgcagcggcagcgtgcgcgacctggccagcgttacgctgcgcttccccaccgtcatcacgccttcccagtacgtcaaccgcctggcggggaaactgccgcccgaggcgctggccgacatctacgctggccggcatgaccgcgtgggggtggaggtcctggaggaggccacctacttcctcaagtacgcctacgctgtctactccctgcagcccaagatcgagaacccctccagcatcctggacatggcctgctggaagccgcccgcgccccaggacgtgagcagaggagaggggagggggggtgggggttgggggagtgttgatttggggtaccagggatggcgctcagccaccgtgtcaagttcccacacccctgctgcgccatga

SEQ ID NO: 2772 - DNA, 654 bp, Chlorella protothecoides
atgcctgccgtccggctttggggccggaggtggcacttcagcaccgacatcgttcccatccccgctgccatcaacggcgccttccattttgtctggatatgcgttctcctcttcggtgctattggatcaggggaatggcccagtgggtgcaatagcgcgactgggcggcagtacgtggcgttgttcgccggcctgtttggggccttcgttcttaatctcatcatcgacgtcctgctctacatccatggaatgaagggatctccattcgaggtgtccaaacggcactgggttccgaccctcctccacatcagcactctacccattgtcgctcagttcgtgttcacaggtaggagtttgggggggccccagcgcgtcgatgtcattaggtgcctgaaggcagtggctaggagaggcccctccgtgcatgccttccgaatcaggtctctcagacatcgcaagctttgcccaaaggagcatacttcacagacaaagttttcgaagttcctgcctcttgatttcctgacagcatttgggacccatgtcgtaaatcagcagctggacgattgctggccggcagacgtgaggcatggcgtgagggtggtggcgcggatcctcgtctactccacctggggcctgatggccatcatcgcgtga

SEQ ID NO: 2773 - DNA, 735 bp, Chlorella protothecoides
atgggcgtcaacacgccggtcagctcccccgccagagctgaaccgagccagtctgaccccagaacggcctccaagccaggcgaccgcagaaaggcgtcctctgagaatcagtatgcgtcgtcggttgcgtccacagttgcaggagccctggctggtgctgtctctcgcttcgccactggtcccctggacgtgctaaagatcagattccaagtccagctcgagcctgtctggcatgcggcagcgcagtccggccgaccgctcgtccgctccaagtacacgtccattcggcaggctctcgccaccattatcaaagaggaaggcatccagggactatggcgaggtactgtcccgggccagctcctgtctgtcccatacactgctgcccagttcttcacggtccagcagagcaggcagctggcaaagcgatggggagtggacacacatcccgccgcttcgttcctgacgggcgccctgtcgggggctgctggcacggtcgccagctacccctttgacctgctgcggacgaccctggcagcccagggggtgcccagggtgtacaacagcatggccgatgctgccaagggcatagtcgctaacaatggcccggcgggactgtaccggggcatgggcatcaccatcttggagatcatcccctacgcagctctccaatttgggctatacgactacttcaacaagtgctgggaggtgagttttgtatgtggggtgggctcctga

SEQ ID NO: 2774 - DNA, 321 bp, Chlorella protothecoides
atgccaggaccatgcgttgaccgagagcctggagccgttctgtacgctccccaaacccaaccgcaccctacaacctgcccacccctgtgcagattctcctactgtgcgctgtacagcctggcactcctacgacggcttgacgcggcagacgtgcccgcggccgtggacttcctcaggcagtgccgcaactttgacggcgggtttggggcgcagcccgggggcgagtctcatgcggggcaggtgttcacctgcgtggccgcgctcagcatcgccggggccctggacgaggtcgtcgacgccgacctgctgggatggtggtga

SEQ ID NO: 2775 - DNA, 522 bp, Chlorella protothecoides
atgctgaaaggagggggagtggggggggggctccgaggtgtttggcgacattggtcttgtacatgccgacgtgctgcgaccttgcggcgactggcccactgtgccacaacacccctcaggtcacccttcatccctgctcactcccactcgcccacactggacccttgtcttaggatcagcgagcgccagacaccgagcggcggcctgaacggccggccagagaagctgcaggacgtctgctactcctggtgggcgctctcggcgctgagtacgctgggacggctggcttggatcgacgcccccgccctcactgccttcatcctgggctgccaggacctggagctgggcggtatttccgatcgtccagacgatgcggtggacgtgttccacactttctttggcctggcagggttgtccctactgggccatccgggcctggcgcccatcgacccggtgtttgccctgcctgtgaccacggtgacgcgcctgaacctggccgcccagcggttacgctgcgcctga

SEQ ID NO: 2776 - DNA, 516 bp, Chlorella protothecoides
atggctgctgataccttgtacctgacagcccccactggcggctccgaactgctgtgccgtcctcgcacgcagtttgaagcacagctggcaagcatggcgtccaccttgctctccctctccctcttgcaacttgtgcaggcacatcgggcccgctacccttccctgcccggatccaaggatgtgcagcacctcgtgtgcggcctggcgtcgggcttgctggccaagctggccacccatcccctggatgtggcgaagaaaagggtgcaggtcgcaggattggcgcgcagcactgcctacggtgagcgcgtggccctggtcgcgacccgctccctgcgaggctgtctggctgacatctaccggcgagagggctttgcaggcctgtacaagggcgtggcaccctccgtgctcaaggcggggccctcggcggcgatcacgtttgcggcgtacgagctcttcctgcgctggctcagcgtcgcgcaggaggccaggaggtccgaggcagcgtcgggggagtga

SEQ ID NO: 2777 - DNA, 762 bp, Chlorella protothecoides
atgcacgtgcctcaggatctggagggcggccctgcgctcccaccgtccacccagcaccagccatccccaggtccagccccctccaccggccaggaggtcatccaggccgaaatcgtggtggacgtggcgcctctgagcccccgcgaggggggcccgcaaggggaggacggcgccggcccgccgccggccttcggcccaccgccgctgagcagcctggctcggcccctggagcctctgagcgacgccgcgctccagctgctgcagtcccagagcgcggcggcgtgcgatcaggacctgcgggcgatgcggcacgacgatgagctggcgctgctgtcggcccggcgcgggctgcaggtccgcttcgtggtgaaggcgctgcgcacctacatgccgctatcggagatggtggtggaggcgccggagtttgccacggtggagtacctcaagcgccgcatcttccgagccaagctgcagcgaggggaggtgcgcgcggaggagcagggtgggcgaggcagatgcgattatgtcggaggggcctcagcatcgctgtggccatgctggggtgttgaggctcggggtttgaggggcacgcctcgcggccaacacatgggccttggctgcatgccctacattgatccccgcctcgcactgccccacctcgcagtacctccctgcctcccgcttcgtgctgaggaagcgtgtgatggacggcagtcacgtgctaggcatggacagcatcccgtcgcggtccagcagcggtga

SEQ ID NO: 2778 - DNA, 726 bp, Chlorella protothecoides
atggagaccgctaaggccctgcaaaatagactcgatgcggtgttcgggggcctggagggagcaggctcctctacgaagccatggctgccgacactccagcctgtattcagggccggaaggatagagactcacagcgatgatgaggacgagaaagtggaggagcgtcggcggcaaggcttggaaggtaagctgagcgtgcttatgtcagacgcatgcctgttgtgcaggctgaaaatatccagcgggcctcaagtatgtccaccccatgcaggtatcgaggagcttctagaagaagacccagatcgggccccctcatacgccttctgcagagtcgtggatggcgaggaggacttcagcgcagtggacgccgtcgccgacccgctggcggaggacccttccctgccgtccctgtcgactccagtggacgaggctgggggtgaaggggcgggcacttcctcgaggctgggcccccctccacagcaacgatcaggacccctccccgccgccctgaagaagggtcggctcttggaccatgagggacaggccgtggccccctcgattgtgccagaccacgtgcggcatccggagcggtatatgcggtacactttcgaccaggagatccaggttggaggtggcgtggcgcagctggccgagtccgccacaacccaagtgagcgggaaaaggagtgaagagggtctgcagtcggcctggtacctgtattgctga

SEQ ID NO: 2779 - DNA, 1683 bp, Chlorella protothecoides
  modified_base (1484)..(1493): a, c, t, g, unknown or other
atgcgagctccctcatcctccagcaccagcttgtcgtcgggcgaggtgaagcgggtgcggcctgtatcagtgtgtgggaaagtgtggagagtggcggacggcgtggcgaaaggatcccgattccattgcatgaccaagagccagcccggcgctggcccccagctccccgccaggtgccataccgaggtgctgctgggtggtcttgtccttgacatactcgtccaggatgctcggcttcagcttcatctccttgtacagcgtgcccaccagcacgcagtccacatcctccacggcgtcgatcactcgcacctctgcgtggtggagggtgtgtgcaggggggttcaaagggtggggggaatgggtggatggcaacactcctcccggaggcccagcctctacctagctattgaattcagcggggatcagccctgtgtcgcccacttgaatgtacggcaggctgcagtgcccacccacctgtgcatgagggccagcgcctcttggcggaggctgacacggcggggcgcagcttcaggagtcggtaaaagtacagctgggcgaattgccgatcgtacactcgctgctgcagctggaatcggtcgtcgtgcagggtgtacgaggctgtggcccgggtcaggggctctgtccgggcaagggtgctcgcaggtgtcagcagatcgtcatacttggaggacggcctgcgcggttgatgaaagattcaagcttaaacttgcttctcgggctgtattccagcgctcagccacccctcccccaggaggggtgctcggccgcgaggtcccgtcaccgcaccgcttgtccatcggacccatacccatgtgcaagaccatgggggatgctacggtatcttacaaggctcggggcaacgaggagtatgcgaaacgaaactacctgaaggcagcggccttatacacacacggactgcaggctgatcccaagaacgcgacgctctacagcaatcggagcgcggcgctgctgaatcttaacaaggtcacgaaagccttggctgatgcggaggcctgcatcagtctacggcctgactgggataaaggctactttcggaagggtctggctctagaagcagcagggaagggccaggaggtaggacgggatgtgcttggaagagaggagtctatgctgagaaggtatttgtattgcacactgggacagcccaagtgtacgtgccccactgtgacctatgccatccccgtcgcaggcactcgaggcgtaccagcaagcatcccaacttggggaaggcgaaaacaaccaggcagcactcaaagtcagacaactaacaaagcagcttggcaagatcagcaatcagagactactctcacaatgaaagttataggctgggaaaacgtcgaggtaaatctggaaattcccaccagcgcgcgacgatctccaccttccgagagcgcgccatgcagagcagaaggaaagtgttcaccgacttcggaattttatgnnnnnnnnnncttaagtgccaggatctgggggtgtcgactaaccaagtcagagactactctaacaatgaaagttataggttgggaaaacggcgaggtagatctggaaattcccacttgcgcgcgacgatctccacctcccgagagcgcgccatgcaaagcagaaggacagtgttcaccgacttcggaattttgtaactga

SEQ ID NO: 2780 - DNA, 1791 bp, Chlorella protothecoides
atgtcccagttcgtgtcggagctgagggcgggcggccccgtgaccaagggcggcagcgaggcggcctccgacaacggggctgcttcagctgcccgcggcgctgcccccgccgccacctcagccgccccagccgccaccgatgccccggccgcctccggcagcggccgcgcgccgcgcgaccgccgccgcatcaagctgaccgagcgcttctacgcctcggcccaggacatctacgagtgcttcaccgacgcgcggcgtgtgctggccttcacccagagccccgccgagctggacgcacgtgtgggcggcgcgctctccatgtttggcggcagcgtgcagggcgtgttccgggagctgactgccccctcccgcatcgtcatggactggcgcttcagcaactgggcggagggcgacaccagctgcgtgaccatcgacatcgaggagcgggagaagggagccgtcaccctgcacctcgttcagaccggcatccccgactgcgaccgcttcggccagcacgacgtggtgggcctgacacaggccggctgggccaaccagatcttccaccgcatccgccaggaagcgcggccaggtgcttgggcccagcttgagtgtcgccaggggcaccgctccatggtcgaagcaggctcgagacccaacctgctcacaccatggactgccacagcacctctgctcactacaaccccaacatgctggtctattcccctccattgctcctccacatcatctccattgctgtcactcctctgtaaaaacttgactccttctagtctgacgcaccctatcatgctccatgtcaactgggccacctctgggacagccgtctgtgacccattggaattccccatcaccaagtctcttcaaggcagccgtcgacccagctcatcacccctgcgtgcctcgtgtcgagctcgtccattctaccttgttctctggactgcaattcatcagcgcaagcaagcgcacgacatcggcgtgggggcatggggagttggcaaacggaccctcgcccgtcacgcccgcctgcacggcaaagccgaggaaggccaccatggcgagccgcccgttcttgatctccttcaccttcagctcggcaaaggtctcggggtcgtcggccaggcccagggggtcaaagggaccgccggggtagagggggtccaggccctgcaggtccgacgactcaaacttacccacgccgggggagtagccaggggggccagtgcctgtgtggtgtgggggtggtcgaaacgcctggcattacaagccgggtcgacagcattgcctcaggccaagcaacaggaattccccccccccccatgccacatggagtacaaacaagtagatcacccctcatcgcacgcacctccccatcagacgacaccagaggcacccccctccgttcctcgcacctttgccgcggaaggtctccacctggaagagcaggaccagctcgatgaggatggcccccgccaggggcagtgggttgcccacgatgccccagggcaccgcgaagtagttgagcgtgccgccgttgagcatctccgcccccgtctcgaaccaggtgccgccgtggatgttggcgccgttggcctccaggccctcggggatgatggccccggccgcggccagcatggcccagcgcgcgtgcagcagctcgttggcgcggtacttctccagcgtctcggagttcttggccagtcccagcgggtcatagccgtagtcgccaggcagggtgccgttgagcacgggggagacctcgtcccggtccagtag

SEQ ID NO: 2781 - DNA, 453 bp, Chlorella protothecoides
atggtggactacctgacgggggcgctggggggcagggaggagcagaccctggcgtcgggggtggtgcgcatggtcatagccggcggcctgctggcctccagcgcagcgctggcgcgggcggggacctacgccgatgcgcgcacgcgtgagggcgcgctggcgggcctgcgcgacgccgacgcggcgctgagtcagctcgcggcggccctccccctggacgtgatgccgggggaggccgaccccgccaacgcatcgctgccgcagcaggcgctgcaccgcgcgctgctgccctgggccgcggccgccggcgagggcctggtgcgcgccagcaacccccacgagttcgacgtagagggcgtgcgtttcctgggcctgtcggggcagaacgtggacgacgtggtcagggtgaaggcctctttggtgaacggagctcagcggttgcatggaccgtag

SEQ ID NO: 2782 - DNA, 1263 bp, Chlorella protothecoides
atgggtgccggggttgcactctgcagcacccagcgcgctgcaacctccgcgccaccctcacgacatgctccgcacgccgcacacgccgccgtcaaccgcgccgcccgctgcagccgcggagatgcgcgcgctgatgctggaccactcctccctcctcgccacgcggggaggctttgtggggaccggggcgatgacgactgtccacgaggccccaaccacctctcgcagatcgacctgagcctggcggaccccgctgcgcctgggagcggctgccctggcctggcgccggccctgcaggccctatttgcccgagctctgtccacccaggcgccacgccaccatttcggtgccggaatgccgggcgacgcatggatgactcatgacgagctggccagcgagccggcggaggcgcgctggcccgatggcacccaggggccgatggagggggaggcaggccccacccagggctcccaacagctcgctgcctgggaggacgcaggcaaggcggcatcctggggtgtataccaggggcctgctccccgccgctggggtccattcgtgcagagcaggaacacctccccccacccaatctcaccaccctcgtgtgcaggggcccagggctacgaagctgacatgtggcaggacgacatgggagcggccagcctcacgcccgcatcgatgggagtcagagatgtaggcgaggggactgcagcagggattcttggcggagaccccgccctgcccccgctgctcgagtccgcccctggctccgccccaggtgaggtgtccctgttgacgacggccacatcagcaaaccctgccgcaacctcgacggcagccttcgatgctcacgtgcaacccacccaccccccactggccacaaaagtaggcacgagcggcaccagctccggcgccggccggcccgacggcttcaccgccaggacccaggccgtgctggagaccctgggcgcgcgcttcgcgaccccggacgtgggggccaagcgacgcaggggccgcgacgcctccgaccccggccaggccacgcagctgggcttctcggcgctggtggcaggcaggggccgcagcgaggccgcgcgctggttcttcgagctgctggtcctgcaggaccggggccacgtgcggttgacccaggagcaggcctacggcgagatcgccgtgcagcccggcatggccgccgtggcggcgggcgccgccgccggcaccccaggccggagaccgctgggaccgcggaacgcggcctga

SEQ ID NO: 2783 - DNA, 1071 bp, Chlorella protothecoides
atgccggtccaggtccagaacctgttcaagaaggccccggcccccatcaagaaggctgccaagaaggcggagggccaggtcaagtccaatgtgaagaaggtcgcgcgtaatgtgccctccccgaagcagctgcagaaggggctggccaagaacaccggggggggtcgaggagcggctgggttggctgctcagcaaaccggatgtgctgcatgtggtgtgccccctcctcgtcctcctcgtcctcctcgggcccaccagagtcccctcatcccacccaggtatggccccgaccgcgcgctgtacctgcctgacggcctactggaccgggacgaggtctcccccgtgctcaacggcaccctgcctggcgactacggctatgacccgctgggactggccaagaactccgagacgctggagaagtaccgcgccaacgagctgctgcacgcgcgctgggccatgctggccgcggccggggccatcatccccgagggcctggaggccaacggcgccaacatccacggcggcacctggttcgagacgggggcggagatgctcaacggcggcacgctcaactacttcgcggtgccctggggcatcgtgggcaacccactgcccctggcgggggccatcctcatcgagctggtcctgctcttccaggtggagaccttccgcggcaaaggtgcgaggaacggaggggggtgcctctggtgtcgtctgatggggaggtgcgcgtttcgaccacccccacaccacacaggcactggcccccctggctactcccccggcgtgggtaagtttgagtcgtcggacctgcagggcctggaccccctctaccccggcggtccctttgaccccctgggcctggccgacgaccccgagacctttgccgagctgaaggtgaaggagatcaagaacgggcggctcgccatggtggccttcctcggctttgccgtgcaggcgggcgtgacgggcgagggtccgtttgccaactggtccaagcatgtggctgacccctttggctacaacctgctgaccatcctggcaggggaggaccgcctgccctccctctga

SEQ ID NO: 2784 - DNA, 531 bp, Chlorella protothecoides
atgaagctgaagccgagcatcctggacgagtatgtcaaggacaagaccacccagcagcacctcggtatggcacctggcggggagctgggggccagcgccgggctggctcttggtcatgcaatggaatcgggatctggccgcacccgcttcacctcgcccgacgacaagctggtgctggaggatgagggagctcgcatcgtgctcaccgggccggtggtgcccaccgcctccctggtcacgggggtggtggcctcggtgcggggccgcatactgcccagcggcgagttctgcgtgtcggaaatatgctatgcggagctgggggcgcagcccgtggcacccccgcccctatccctgcattcccctggctcggggccacaggtcgcccgcgcccccgcaaggtgggacagtgctggagggtggtggcggggccagcggtggtgccaaggggcccgcagacagcttcgaagatggcatgcatgcggcgcggcttcaccccctcgcagagcgtccatgcccctgcccactccttga

SEQ ID NO: 2785 - DNA, 912 bp, Chlorella protothecoides
atgacccaggcgctccagctggcggaggtggagtggcggccggttgggcccgatgtggtctgccagggctacctgcccagctccggcggcccggcggctctcctcgccgcccagctccccgggcggggccaggggcagacggggccggcgcagcagcagcagggaccccgaccgacggagccggacgatgcggtcccggccgctcccgcgcccgcccccacgatgcaggccccggccggcccggcgcccccggccccgcgcctcttctacaagtgctgggacgcgctggggtgcctgagcaacttctcgccacacccggtgtgcctgcccgccgcgccgctgacctcggcagacctgctgcgccacgctgcgccggcccgcgcgcccatgaccgccagcctggacgagtgggtgtgccctctcggcgagggggaggagggggtcgcaggcgccgcgccccacgcaagctcggcgcgcctctggcccacatcggagcactactaccaggcccagaagttcgcgggcgtggccggcgaggccgccgcggccctgcgcgccgccatcgccgcggcgccctcgcccgaggcggcagccgcgctggcgcgcgccgcgcagcgcgcgcggccgcgcctggtgcgccccgactggcacagggccaaggtggcggtcatgctgcacgtcctgcgcgccaagttcgcgtcccaccccgacgctgccgcggcgctgctggggacgggggacgcgccgctgcaggaggacgcgccgcatgactacttctgggggcggggcctgacgggtacggggaacaacatgctgggcaggctgctggtccaggtcaggagcgagctgagggccgcggggagggaggggctgctgaacggcagcccccagaacgtgtatgagctgctgtga

SEQ ID NO: 2786 - DNA, 2151 bp, Chlorella protothecoides
atggcgggagagagtactgctaccctccggaattccaacccttggcagaataatgccaggttcaagccccttgagttcagtgaactcatggaaatgcctgagtggagggatcggcaagagaaatgggagcgcctcgccgagcaggacaagtgggatgaggtcaccaaagagttccgagtgctggtcaaacccgttctcgacgaaatccgagtgagcaagcccgtgagcgatctccggtccctcaacaaaggacccctgccgaagtcagctggcccaaccactgacaccatcaactgggtcgatctcgtcctttccggtacggggttggagggtgttgcggtggaggcgtcctgggctatgctcatgtgggctatgtattggcccttgaggatgcaggtctccggttcaggtgtgcggttgatggtacccggcgtcggcatgatgccatggccgcgaaccccgcaccctattgtcctggccattgggggtgcttccgccggtgccgtcgcagcattcatcatgggcgctgtgcgcaagagtccagacgccccagtggcagacgacctgctacgtctgatggtggagatgcccacctccacctttgacgatggggtgctattcttggctgtcatcaatactctgcagcatggtatgcgaggggacgggccatgcgcgcccataggcattggcaccgccttgaaaaacagcggcctgcatcccggcaaaactttcgaggactggctgaagaacctgatgaacacatatggagccggcaccctgagcgatctcaaggccaagtgcgacctcagcaagattgagtggctcaaggtactcgatgtgttcagactccatgcagggactgagttcctgactctgctgtcagctggcaggacctgctgcctgtctgagtgtgcgcctgcaactgagcatcccccattacctctgcctccgagcctgcaccgtgatttctcaccaccatatcaggtcgaggacggaaggcagccacaggatgtggagggcttggtgtgctgtgtggccgccgacatcaccacctccaccaaggccgtgctgagctgggagaggcccgtgaactttgaccaaccccccgtgacgcactccgagctgtacatggcaaaccctgatggagaaaacccggggcactgcgtccgcgccagcatggccgtcccattcttcttcttccccaagaaattccctgtacagccgggagagaagattccctatgccgggcagcgggctgtcagcctgccggacacaaagtggaaggagattgggtttgaggactacatcccggaccaggtgaatgtcgggaggtgctgggattgtgaggtgcatcctggggcactgtgcaggggagtgaagggggggggagttgagggggcactcacagtgcctgcccccacaagacccaggcggatacgcaacctgttggcacgcacctgcatgctcgtgggaagtgtgcctaccgactggtcggctgactccagcaaggacagtgcctgtgcgtcttcctgttcccctcagcacagtacccgctccctgctcccccagcgagccatttccaggaccaccttctcccctccgccgcacaggtcacgctcgtggatggcggcttcctgtccaaccacccagtcgacctcttccacgtcccacgcgagaaggccgtttggtgccccaccttctgtgtcaacctgtcgccgccacgcaaggcacttcgcaccaggaacctcatcgagacggcctctgcgctcctctctacaggtacccaaacgcgcgacttcgagtttgtcgccaagaacaaggtgggaccccgggggaaagggggaagggtggatccgccccgttgcacggtgggcttggccatgggtttgcacagcacatggggatgcaaaccctgtccgatctcccaccccaagtccacccaccacatggcaggaatacaaccttctctctgccagtgtgtacagcggtggaatctcggccctcaattttgatgtcagccccgtggggaagtacgtgctgttctacaatggtgtggtggcagcctacaacttcctggtcgggggggatgccagcaagggaccgttcaactgggaggactacaaatccaagaggaagaatgcgacgtactga

SEQ ID NO: 2787 - DNA, 441 bp, Chlorella protothecoides
atgacacggcacattgcggccacccagcaaaagtacacgcagagcgggggcgtacgccccttcggcatcagcaccctgatcgtggggtttgatggcgcggggcgccccgcgctgtaccagaccgacccctcgggcacctactccgcctggaaggccaacgccattggccgcaactccaagaccgtgcgtgagtacctggagaagaactacgaggcggggggcccgcgcgacacgctcaagctcgcgctgcgcgcgctgaccgaggtcgtggacgccagctctaagaacgtggagatggcggtggtggaggcgggggcgggcctccgcttcctcgccgacgccgagctggacgagctggtggcggagctggaggcggagaaggcggccgccgcggcggcgcggggcggcgcggcgcgggacgcccagccgcccgcatcctga

SEQ ID NO: 2788 - DNA, 1461 bp, Chlorella protothecoides
  modified_base (7)..(16): a, c, t, g, unknown or other
  modified_base (460)..(469): a, c, t, g, unknown or other
  modified_base (1435)..(1444): a, c, t, g, unknown or other
atggtgnnnnnnnnnnagccacggcctctcggcaaaagtccagcaagggatccgattggacgtgggccttgctgcaggcaatggtgggagaactttggtggtgactgtgctggaaactcagggtggattgtgcagaggtggaggttgtggaaatggtgcgggaacgactgggcgggagttagtcagaagaggctcccagggcctcgtgagatgaggtaccagagcagtggtctccccttgacaagcatggggggaggctcccaccactcacatgtgggagctattgaggatcttggcattgtgctgctgtgctatggcaatggacccctccagcaacttgctcagaaaatcgtccagggccttggctgcatgggggtgtgcattcggcttgctgtgagcgcctcttcgtcaaatccttgtgcgctaactttcgacacccaaacttccctcctcaggccannnnnnnnnngttgtgctgctgtgctacggcaatggacccctccagtaacttgctcaggaaatcgtccagggccttggctgcatggggccaatacccatcgccctcgctcacagatgaggatggggctggccttggtaaccttgcccacgtcctcgtccgactgcatcattttcttgatgcgggctgtgaagggcgcatggtttcgaaaaaacttggagttcgaggacaaggggccctcatcccccgtcccggcgtcatccggcattgacatagaggcagcggatgggcaagggcaacagcaccccgaggagcgggtaacatcggccatgccgggtggtgtgtgggttcggaggaagttgaacacagcgcgcgctcgaccatgtcgaccatgtcgcgaacgatggcatcggctcggaacgcaccaatcgcacgtatcctccatgagagatcccacagaaattttgcgggtaacaaataatacactgagatactcctcacgtgtatttgttgccgatgtgggtcctctccaggcagccctccctctgagtgaccacagccctcaaacacacgttcttcgctcagttcacgcttccagatcgcggggggttttcccctcaaggtcgcatgccagcaggccgttacgctcccagtccctggcagatccgtcccaccatgatcctcggcaggtggggctggacaatgcaggaaaaacgaccaccctgtaccacctgcacatgggcgagacggtgaaaacccagccaaccatagggagcaacgtgagtgccaggggggggcacatgcggagcgcgaatgaccagtcgcggcatgccagggctttgaggagtggtccaagctacatgtacactgtgcgtctgccgtatctgatgcgaggtgatcgcgctcagtggatgcctgccatggtacacttcaccctctttccaacccaaatcacaggtggagcaggtcaaggtcgannnnnnnnnnggctacatgtgcactga

SEQ ID NO: 2789 - DNA, 672 bp, Chlorella protothecoides
atgggaaattcccagagcggcgcgacggcccgttttagtcaggcagaggctctgggagagttgccaggagtcacctacaaggacaccctagggggagggcgcttcttgaaaagctctctgtgtctcacagatgatggccagtcggtggttgcaaaggtgaggatggtacggcacgggaagcccactcatcggctggagaaagggaggcgttgccccccacctctccttgcccccacccctcccaggtgtaccccaaagagtctgaggcgacgctggtgcgcatgtacgaggagcgacttgcgagcatccggtgcgcaggctgctgccctgcgcccggcaggctcttgggagggggcactgagctactggtgcaggacagggctctgggcatgcagtgccgggtcaggggtgctgccgtgcatgcggcagcttcaaccaccctccccacatccctcgctcctgccccagtaccgccttcctgagcatcgactacccgcatgtgctgccgatgcagcgcatctacgagtccgacaggtccgtcttcctcgtccgccagtacctctttgccaacctggcacagcgcatctccacccgccccttcctcacggccatcgagaaggtgcgaggcacagccaggggccatggcctgcaggattaggtgttatctgctga

SEQ ID NO: 2790 - DNA, 1986 bp, Chlorella protothecoides
  modified_base (179)..(188): a, c, t, g, unknown or other
  modified_base (623)..(632): a, c, t, g, unknown or other
  modified_base (1047)..(1056): a, c, t, g, unknown or other
  modified_base (1652)..(1661): a, c, t, g, unknown or other
atgcaggaacccctggcaccaccttatttcccccagtgcctatacatcgcagctctggatagctcgccagctgatccaggccgtggcccagtcccacgccgcgggtgtgtgccacggcgacatcaaatcctccaacttcctgctgacctcctggcactgggtgttcctggcagaccacnnnnnnnnnnagcgggcgtgtgccacggcgacatcaaatccgccaacttcctgctgacttcctggcactgggtgttcctggcagaccacgcgccctataagccggtctacctcccggctgacgaccctgtgcgcgccgggggagtgaaaggggtgattggtgggcctgcatcgacaactcctgagcagcgagggcgaggggaaaacagcgcgggtgcacatgctgagcatccgtcctcctttctgcgaggtctcctctcgcccgaccgcaacattccaccccctcaccctttcactcctctgcacaggccgactactccctcttcttcgacacggacggcaggcgcacagcgtgcatcgcacccgagcgctttgtggacgtgggtcacggcaggccgctgccgcctgccccccacgcctgcacccctgccatggacgtcttctcnnnnnnnnnnatttgtggacgtgggccacggcaggccgctgccgcccaccccgcccgcctgcacccctgccatggacgtcttctccctgggctgcacgctggccgagctctttctggacggccaggccctcttcacatactccagggtgggccggtgtggggagggcgatgtggaggctggggtgtgttctacaggaggaacagggccctgttcccgctgctcaggagatccagccggcatcttacgggccatctttttagatcgaaccttcctggccctcatgactcgtccctattcagtggctggtctcatctccatatccactgggctccttgttcctctttcaccgccgaatacactcacgacgacatccccacccccccccacacacacaaaacgcagctgctggcgtaccgggcggggnnnnnnnnnntcacggtatccccccccccacacacacacaaaaaaaacgcagctgctggcgtaccgggcggggtcgttcgaccccgggcccagcctggacaggatgccgcccggggtccaggacctggtggcccacatgctgcagcgggacccgtccgccagggccggggcacaggcctacctggacggcgagctgggccggcgcgccttccccgcctggatgggcgacgtcgtgcaccctttcttcgcgtccatgctgcgtgcgccgccggatgagcgcgtggccttggcctgcgccgagctgccggcggtccatgcccagctggcaggtaccatcgccagggccatggccgccgcggggaggggcttttctttgggcaattcgcacatggaaagcatcacgagtgcgagctgggcctgtgcctctccacacaccctgttctacaggcagcgacctgcccgaccagactcggggcggcctgaagccctcccgcagcaacccaaacgaccctgcgccggtgcctgcgccggcccagcccggacatgcagggagtcggggtccctttccccccgatcccgactttggctcggagggagaaggagagnnnnnnnnnncaccgaccctgagccgatgcctgcgccgccccagcccggaaatgcagggagtcggggtccccttccccccgagcccgactttggctcggagggagaaggagagaggccgggccgtggcgcactccccggccccaaggccctgctggaggaggtgcagagggtggcggggcggctggagcacggcggcagcgcaggaaatactgagggcagacaaggaggcgatgtggcggctgccgcggcaagcagcgaggcgcggggcccggggcccggagcctcccagggcgccagcgcgagccatcgccgcccgggccccggcgacgcgccg

SEQ ID NO: 2791 - DNA, 660 bp, Chlorella protothecoides
atggcagaagacagcgaagaggatgatctagaggctttgctgaggcaagagctggagcgtccagcatccagtcttagcgaggaggaggcagggtgcgtcggggcgggtggctcgttccatgggcgctcggctggcgtatgcgcttgccggcatggatattcagcatgcctccccagcctcccgatccaggtcgccgcccgccaagcggcaattcacgggccagtccccgcgcgccggtgcgatggtggaccgtggtcctcggattcatggctgctgctgctaccaggctcctccgcctacacacccctcttcccatgcccctccacctcaatcgcagatgcccaggccccgtcgcccatctgccccccgcaccccggctacatgggcggcctgtgcatccgctgcggcgggctacgccccgagggcgaggagggggcgggcgtggcgctgcgctacatccatgccggcctggagggggccggtgtggcgctgcgctacatccatgccgggctggaggtcagccagcgcgaggcggcgcgcctgcgccgtggcgcggccgagcacgcagccgcgcagcgcaaactcaccctggtcctggacctggaccacacgctgctcaactccacgcgcttcatcgacctcaccgagggcggtgagtag

SEQ ID NO: 2792 - DNA, 483 bp, Chlorella protothecoides
atgttgggctggaggggagggcagggcggtgaatgcgcaaggacggtcgaaaagcccgagtgtgggaagccctgtgggacggacccctccccccccccctccttcaacccaccggcagctgggaggagcgcagacgtgcgcccacttgtggccgcccgccggcgcggggtgctcgcaggcgtgggcctcctgctcagccgcatcgtccccttgaccagccccgccccggatgcgcaccccctgtggcgcctggcgacggcctgcggcgcgacctgcacgctgagccccgggccacaggtgacccatgtgatggccccggactggacacagaaggcagtgtggggccgggacagggggctgcaggtggtcaccccgcagtggctcgccgagtcaggtgtgtgcgtgcgtgtgtgtgtggttggggcgggcgggggggaagcatcgactgaaacggaggtcaccaacgcagggatcgcagcctga

(The sequence listing continues in the following parts.)

What is claimed is:

1. A recombinant cell transformed with an expression vector that comprises an exogenous nucleic acid encoding the polypeptide of SEQ ID NO:49127.
2. The recombinant cell of claim 1, wherein the nucleic acid is operably linked to a promoter.
3. The recombinant cell of claim 1, wherein the nucleic acid is operably linked to an untranslated control element.
4. The recombinant cell of claim 1, wherein the nucleic acid is operably linked to a sequence encoding a targeting peptide.
5. The recombinant cell of claim 4, wherein the targeting peptide is a transit peptide selected from the group of a plastidial targeting peptide and a mitochondrial targeting peptide.
6. The recombinant cell of claim 1, wherein the nucleic acid is a DNA molecule.
7. The recombinant cell of claim 1, wherein the vector further comprises a nucleic acid that encodes a sucrose invertase.
8. The recombinant cell of claim 1, wherein the cell is a cell of the genus *Prototheca* or *Chlorella*.
9. The recombinant cell of claim 8, wherein the cell is a cell of the species *Chlorella protothecoides*.
10. A method for obtaining microbial oil comprising culturing the recombinant *Chlorella protothecoides* cell of claim 9 under conditions such that oil is produced.

* * * * *